US012394502B2

(12) United States Patent
Hacohen et al.

(10) Patent No.: US 12,394,502 B2
(45) Date of Patent: Aug. 19, 2025

(54) METHOD FOR PREDICTING HLA-BINDING PEPTIDES USING PROTEIN STRUCTURAL FEATURES

(71) Applicants: The General Hospital Corporation, Boston, MA (US); Dana-Farber Cancer Institute, Inc., Boston, MA (US); The Broad Institute, Inc., Cambridge, MA (US)

(72) Inventors: Nir Hacohen, Boston, MA (US); Catherine J. Wu, Boston, MA (US); Siranush Sarkizova, Boston, MA (US); Matthew Bakalar, Cambridge, MA (US)

(73) Assignees: The General Hospital Corporation, Boston, MA (US); Dana-Farber Cancer Institute, Inc., Boston, MA (US); The Broad Institute, Inc., Cambridge, MA (US)

( * ) Notice: Subject to any disclaimer, the term of this patent is extended or adjusted under 35 U.S.C. 154(b) by 868 days.

(21) Appl. No.: 17/062,335

(22) Filed: Oct. 2, 2020

(65) Prior Publication Data

US 2021/0104294 A1    Apr. 8, 2021

Related U.S. Application Data

(60) Provisional application No. 62/909,752, filed on Oct. 2, 2019.

(51) Int. Cl.
*G16B 15/30* (2019.01)
*G16B 40/20* (2019.01)
*G16B 40/30* (2019.01)

(52) U.S. Cl.
CPC .............. *G16B 15/30* (2019.02); *G16B 40/20* (2019.02); *G16B 40/30* (2019.02)

(58) Field of Classification Search
USPC .......................................................... 703/11
See application file for complete search history.

(56) References Cited

U.S. PATENT DOCUMENTS

| | | |
|---|---|---|
| 3,870,790 A | 3/1975 | Lowey et al. |
| 4,210,644 A | 7/1980 | Desjardins et al. |
| 4,226,859 A | 10/1980 | Stach |
| 4,369,172 A | 1/1983 | Schor et al. |
| 4,379,454 A | 4/1983 | Campbell et al. |
| 4,588,585 A | 5/1986 | Mark et al. |
| 4,603,112 A | 7/1986 | Paoletti et al. |
| 4,690,915 A | 9/1987 | Rosenberg |
| 4,743,249 A | 5/1988 | Loveland |
| 4,751,180 A | 6/1988 | Cousens et al. |
| 4,769,330 A | 9/1988 | Paoletti et al. |
| 4,816,540 A | 3/1989 | Onishi |
| 4,842,866 A | 6/1989 | Horder et al. |
| 4,844,893 A | 7/1989 | Honsik et al. |
| 4,906,169 A | 3/1990 | Chien et al. |
| 4,935,233 A | 6/1990 | Bell et al. |
| 4,973,468 A | 11/1990 | Chiang et al. |
| 5,023,084 A | 6/1991 | Chien et al. |
| 5,035,891 A | 7/1991 | Runkel et al. |
| 5,110,587 A | 5/1992 | Paoletti et al. |
| 5,174,993 A | 12/1992 | Paoletti |
| 5,185,146 A | 2/1993 | Altenburger |
| 5,198,223 A | 3/1993 | Gale et al. |
| 5,204,253 A | 4/1993 | Sanford et al. |
| 5,217,720 A | 6/1993 | Sekigawa et al. |
| 5,279,833 A | 1/1994 | Rose |
| 5,364,773 A | 11/1994 | Paoletti et al. |
| 5,422,119 A | 6/1995 | Casper |
| 5,494,807 A | 2/1996 | Paoletti et al. |
| 5,541,171 A | 7/1996 | Rhodes et al. |
| 5,580,859 A | 12/1996 | Felgner et al. |
| 5,589,466 A | 12/1996 | Felgner et al. |
| 5,658,785 A | 8/1997 | Johnson |
| 5,686,281 A | 11/1997 | Roberts |
| 5,705,190 A | 1/1998 | Broad et al. |
| 5,756,101 A | 5/1998 | Paoletti et al. |
| 5,762,938 A | 6/1998 | Paoletti et al. |
| 5,766,597 A | 6/1998 | Paoletti et al. |
| 5,766,882 A | 6/1998 | Falkner et al. |

(Continued)

FOREIGN PATENT DOCUMENTS

| | | |
|---|---|---|
| WO | 91/06309 A1 | 5/1991 |
| WO | 92/15322 A1 | 9/1992 |

(Continued)

OTHER PUBLICATIONS

Guo, Yugang, Kewen Lei, and Li Tang. "Neoantigen vaccine delivery for personalized anticancer immunotherapy." Frontiers in immunology 9 (2018): 1499. (Year: 2018).*
London, Nir, et al. "Rosetta FlexPepDock web server-high resolution modeling of peptide-protein interactions." Nucleic acids research 39.suppl_2 (2011): W249-W253.*
Abelin, et al., "Mass Spectrometry Profiling of HLA-Associated Peptidomes in Mono-allelic Cells Enables More Accurate Epitope Prediction", Immunity, vol. 46, Issue 2, Feb. 21, 2017, 315-326.
Bassani-Sternberg, et al., "Direct Identification of Clinically Relevant Neoepitopes Presented on Native Human Melanoma Tissue by Mass Spectrometry", Nature Communications, vol. 7, No. 13404, Nov. 21, 2016, 16 pages.

(Continued)

*Primary Examiner* — G. Steven Vanni
(74) *Attorney, Agent, or Firm* — Day Pitney LLP; Christopher R. Cowles; Richard B. Emmons

(57) ABSTRACT

The present invention discloses a method for predicting peptides that are capable of binding to HLA molecules that incorporate the crystal structure of HLA molecules. An improved HLA-specific peptide docking workflow is used to simulate the occupancy of a peptide on the binding pocket of an HLA molecule, and three models are trained to predict the binding of the peptide to HLA molecules. The results show that these models predict HLA-allele specific binding peptides with extremely high accuracy.

19 Claims, 70 Drawing Sheets

Specification includes a Sequence Listing.

(56) References Cited

U.S. PATENT DOCUMENTS

| | | |
|---|---|---|
| 5,770,212 A | 6/1998 | Falkner et al. |
| 5,811,104 A | 9/1998 | Dale et al. |
| 5,833,975 A | 11/1998 | Paoletti et al. |
| 5,843,728 A | 12/1998 | Seed et al. |
| 5,849,303 A | 12/1998 | Wasmoen et al. |
| 5,851,828 A | 12/1998 | Seed et al. |
| 5,858,358 A | 1/1999 | June et al. |
| 5,883,223 A | 3/1999 | Gray |
| 5,906,936 A | 5/1999 | Eshhar et al. |
| 5,912,170 A | 6/1999 | Seed et al. |
| 5,912,172 A | 6/1999 | Eshhar et al. |
| 5,942,235 A | 8/1999 | Paoletti |
| 5,989,562 A | 11/1999 | Wasmoen et al. |
| 5,990,091 A | 11/1999 | Tartaglia et al. |
| 5,994,136 A | 11/1999 | Naldini et al. |
| 6,004,777 A | 12/1999 | Tartaglia et al. |
| 6,004,811 A | 12/1999 | Seed et al. |
| 6,013,516 A | 1/2000 | Verma et al. |
| 6,040,177 A | 3/2000 | Riddell et al. |
| 6,090,393 A | 7/2000 | Fischer |
| 6,130,066 A | 10/2000 | Tartaglia et al. |
| 6,156,567 A | 12/2000 | Fischer |
| 6,159,477 A | 12/2000 | Audonnet et al. |
| 6,165,782 A | 12/2000 | Naldini et al. |
| 6,214,353 B1 | 4/2001 | Paoletti et al. |
| 6,228,846 B1 | 5/2001 | Audonnet et al. |
| 6,258,595 B1 | 7/2001 | Gao et al. |
| 6,265,189 B1 | 7/2001 | Paoletti et al. |
| 6,277,558 B1 | 8/2001 | Hudson |
| 6,284,240 B1 | 9/2001 | Seed et al. |
| 6,309,647 B1 | 10/2001 | Paoletti et al. |
| 6,312,682 B1 | 11/2001 | Kingsman et al. |
| 6,352,694 B1 | 3/2002 | June et al. |
| 6,392,013 B1 | 5/2002 | Seed et al. |
| 6,406,705 B1 | 6/2002 | Davis et al. |
| 6,410,014 B1 | 6/2002 | Seed et al. |
| 6,428,953 B1 | 8/2002 | Naldini et al. |
| 6,475,769 B1 | 11/2002 | Wilson et al. |
| 6,489,458 B2 | 12/2002 | Hackett et al. |
| 6,534,055 B1 | 3/2003 | June et al. |
| 6,537,540 B1 | 3/2003 | Burstein et al. |
| 6,537,594 B1 | 3/2003 | Paoletti et al. |
| 6,569,457 B2 | 5/2003 | Ullah et al. |
| 6,638,534 B1 | 10/2003 | Ishibashi et al. |
| 6,682,743 B2 | 1/2004 | Mayr |
| 6,713,068 B1 | 3/2004 | Audonnet et al. |
| 6,753,162 B1 | 6/2004 | Seed et al. |
| 6,761,893 B2 | 7/2004 | Chaplin et al. |
| 6,780,407 B1 | 8/2004 | Paoletti et al. |
| 6,780,417 B2 | 8/2004 | Kaslow et al. |
| 6,793,926 B1 | 9/2004 | Rasty et al. |
| 6,797,514 B2 | 9/2004 | Berenson et al. |
| 6,867,041 B2 | 3/2005 | Berenson et al. |
| 6,869,794 B2 | 3/2005 | Vogels et al. |
| 6,887,466 B2 | 5/2005 | June et al. |
| 6,893,865 B1 | 5/2005 | Lockert et al. |
| 6,905,680 B2 | 6/2005 | June et al. |
| 6,905,681 B1 | 6/2005 | June et al. |
| 6,905,874 B2 | 6/2005 | Berenson et al. |
| 6,913,752 B2 | 7/2005 | Chaplin et al. |
| 6,913,922 B1 | 7/2005 | Bout et al. |
| 6,924,128 B2 | 8/2005 | Allen |
| 6,936,466 B2 | 8/2005 | Feldhaus |
| 6,943,019 B2 | 9/2005 | Wilson et al. |
| 6,953,690 B1 | 10/2005 | Gao et al. |
| 6,955,808 B2 | 10/2005 | Curiel |
| 6,974,695 B2 | 12/2005 | Vogels et al. |
| 6,991,797 B2 | 1/2006 | Andersen et al. |
| 7,029,848 B2 | 4/2006 | Vogels et al. |
| 7,045,313 B1 | 5/2006 | Moss et al. |
| 7,097,842 B2 | 8/2006 | Suter et al. |
| 7,115,391 B1 | 10/2006 | Chen et al. |
| 7,144,575 B2 | 12/2006 | June et al. |
| 7,148,203 B2 | 12/2006 | Hackett et al. |
| 7,160,682 B2 | 1/2007 | Jackett et al. |
| 7,172,893 B2 | 2/2007 | Rabinowitz et al. |
| 7,175,843 B2 | 2/2007 | June et al. |
| 7,189,536 B2 | 3/2007 | Chaplin et al. |
| 7,198,784 B2 | 4/2007 | Kingsman et al. |
| 7,232,566 B2 | 6/2007 | June et al. |
| 7,255,862 B1 | 8/2007 | Tartaglia et al. |
| 7,259,015 B2 | 8/2007 | Kingsman et al. |
| 7,303,910 B2 | 12/2007 | Bebbington et al. |
| 7,335,364 B2 | 2/2008 | Chaplin et al. |
| 7,351,585 B2 | 4/2008 | Mitrophanous et al. |
| 7,384,644 B2 | 6/2008 | Chaplin et al. |
| 7,445,924 B2 | 11/2008 | Chaplin et al. |
| 7,446,190 B2 | 11/2008 | Sadelain et al. |
| 7,459,270 B2 | 12/2008 | Chaplin et al. |
| 7,572,631 B2 | 8/2009 | Berenson et al. |
| 7,608,279 B2 | 10/2009 | Parisot et al. |
| 7,628,980 B2 | 12/2009 | Suter et al. |
| 7,741,465 B1 | 6/2010 | Eshhar et al. |
| 7,767,449 B1 | 8/2010 | Paoletti |
| 7,892,533 B2 | 2/2011 | Suter et al. |
| 7,897,156 B2 | 3/2011 | Ackermann et al. |
| 7,923,017 B2 | 4/2011 | Chaplin et al. |
| 7,939,086 B2 | 5/2011 | Chaplin et al. |
| 7,964,395 B2 | 6/2011 | Chaplin et al. |
| 7,964,396 B2 | 6/2011 | Chaplin et al. |
| 7,964,398 B2 | 6/2011 | Chaplin et al. |
| 7,985,739 B2 | 7/2011 | Kay et al. |
| 8,034,334 B2 | 10/2011 | Dudley et al. |
| 8,088,379 B2 | 1/2012 | Robbins et al. |
| 8,163,293 B2 | 4/2012 | Chaplin |
| 8,211,422 B2 | 7/2012 | Eshhar et al. |
| 8,227,432 B2 | 7/2012 | Hackett et al. |
| 8,236,560 B2 | 8/2012 | Chaplin et al. |
| 8,268,325 B2 | 9/2012 | Chaplin et al. |
| 8,268,329 B2 | 9/2012 | Chaplin et al. |
| 8,278,036 B2 | 10/2012 | Kariko et al. |
| 8,309,098 B2 | 11/2012 | Howley et al. |
| 8,372,622 B2 | 2/2013 | Suter et al. |
| 8,399,645 B2 | 3/2013 | Campana et al. |
| 8,404,658 B2 | 3/2013 | Hajjar et al. |
| 8,454,972 B2 | 6/2013 | Nabel et al. |
| 8,470,598 B2 | 6/2013 | Chaplin et al. |
| 8,637,307 B2 | 1/2014 | June et al. |
| 8,697,854 B2 | 4/2014 | Schendel et al. |
| 8,906,682 B2 | 12/2014 | June et al. |
| 8,911,993 B2 | 12/2014 | June et al. |
| 8,916,381 B1 | 12/2014 | June et al. |
| 8,975,071 B1 | 3/2015 | June et al. |
| 9,101,584 B2 | 8/2015 | June et al. |
| 9,102,760 B2 | 8/2015 | June et al. |
| 9,102,761 B2 | 8/2015 | June et al. |
| 9,233,125 B2 | 1/2016 | Davila et al. |
| 2003/0104008 A1 | 6/2003 | Loosmore et al. |
| 2004/0013648 A1 | 1/2004 | Kingsman et al. |
| 2004/0224402 A1 | 11/2004 | Bonyhadi et al. |
| 2006/0258607 A1 | 11/2006 | Jarosch et al. |
| 2007/0025970 A1 | 2/2007 | Kingsman et al. |
| 2007/0134197 A1 | 6/2007 | Eichner et al. |
| 2008/0254008 A1 | 10/2008 | Dropulic et al. |
| 2009/0111106 A1 | 4/2009 | Mitrophanous et al. |
| 2010/0104509 A1 | 4/2010 | King et al. |
| 2011/0293571 A1 | 12/2011 | Widdowson et al. |
| 2012/0244133 A1 | 9/2012 | Rosenberg et al. |
| 2012/0295960 A1 | 11/2012 | Palfi et al. |
| 2013/0071414 A1 | 3/2013 | Dotti et al. |
| 2015/0368342 A1 | 12/2015 | Wu et al. |
| 2015/0368360 A1 | 12/2015 | Liang et al. |
| 2016/0046724 A1 | 2/2016 | Brogdon et al. |
| 2016/0129109 A1 | 5/2016 | Davila et al. |
| 2016/0175359 A1 | 6/2016 | Spencer et al. |
| 2017/0283504 A1 | 10/2017 | Wiltzius et al. |
| 2018/0085444 A1 | 3/2018 | Morgan et al. |
| 2019/0065675 A1* | 2/2019 | Yelensky ............... G16B 40/10 |
| 2022/0130489 A1* | 4/2022 | Jung ...................... G16B 20/20 |

FOREIGN PATENT DOCUMENTS

| | | |
|---|---|---|
| WO | 93/24640 A2 | 12/1993 |
| WO | 94/26877 A1 | 11/1994 |

(56) References Cited

FOREIGN PATENT DOCUMENTS

| | | |
|---|---|---|
| WO | 95/30018 A2 | 11/1995 |
| WO | 96/18372 A2 | 6/1996 |
| WO | 03/020763 A2 | 3/2003 |
| WO | 03/057171 A2 | 7/2003 |
| WO | 2004/033685 A1 | 4/2004 |
| WO | 2004/044004 A2 | 5/2004 |
| WO | 2004/074322 A1 | 9/2004 |
| WO | 2005/113595 A2 | 12/2005 |
| WO | 2005/114215 A2 | 12/2005 |
| WO | 2006/000830 A2 | 1/2006 |
| WO | 2006/125962 A2 | 11/2006 |
| WO | 2008/038002 A2 | 4/2008 |
| WO | 2008/039818 A2 | 4/2008 |
| WO | 2011/051489 A2 | 5/2011 |
| WO | 2011/146862 A1 | 11/2011 |
| WO | 2012/058460 A2 | 5/2012 |
| WO | 2012/079000 A1 | 6/2012 |
| WO | 2012/159643 A1 | 11/2012 |
| WO | 2012/159754 A2 | 11/2012 |
| WO | 2013/039889 A1 | 3/2013 |
| WO | 2013/040371 A2 | 3/2013 |
| WO | 2013/044225 A1 | 3/2013 |
| WO | 2013/154760 A1 | 10/2013 |
| WO | 2013/166321 A1 | 11/2013 |
| WO | 2013/176915 A1 | 11/2013 |
| WO | 2014/011987 A1 | 1/2014 |
| WO | 2014/018863 A1 | 1/2014 |
| WO | 2014/059173 A2 | 4/2014 |
| WO | 2014/083173 A1 | 6/2014 |
| WO | 2014/133567 A1 | 9/2014 |
| WO | 2014/133568 A1 | 9/2014 |
| WO | 2014/134165 A1 | 9/2014 |
| WO | 2014/172606 A1 | 10/2014 |
| WO | 2014/184744 A1 | 11/2014 |
| WO | 2014/191128 A1 | 12/2014 |
| WO | 2015/057834 A1 | 4/2015 |
| WO | 2015/057852 A1 | 4/2015 |
| WO | 2015/085147 A1 | 6/2015 |
| WO | 2015/120096 A2 | 8/2015 |
| WO | 2015/142675 A2 | 9/2015 |
| WO | 2015/158671 A1 | 10/2015 |
| WO | 2015/187528 A1 | 12/2015 |
| WO | 2016/000304 A1 | 1/2016 |
| WO | 2016/011210 A2 | 1/2016 |
| WO | 2016/014789 A2 | 1/2016 |
| WO | 2016/070061 A1 | 5/2016 |
| WO | 2016/191756 A1 | 12/2016 |
| WO | 2016/196388 A1 | 12/2016 |
| WO | 2017/011804 A1 | 1/2017 |
| WO | 2017/070395 A1 | 4/2017 |
| WO | 2017/184590 A1 | 10/2017 |
| WO | 2017/211900 A1 | 12/2017 |
| WO | 2018/028647 A1 | 2/2018 |
| WO | 2020/072700 A1 | 4/2020 |
| WO | 2020/131586 A1 | 6/2020 |

OTHER PUBLICATIONS

Bordner, et al., "Ab Initio Prediction of Peptide-MHC Binding Geometry for Diverse Class I MHC Allotypes", Proteins, vol. 63, No. 3, 2006, 512-526.
Bulik-Sullivan, et al., "Deep Learning Using Tumor HLA Peptide Mass Spectrometry Datasets Improves Neoantigen Identification", Nature Biotechnology, vol. 37, No. 1, Jan. 2019, 17 pages.
Chaudhury, et al., "Pyrosetta: A Script-based Interface for Implementing Molecular Modeling Algorithms using Rosetta", Bioinformatics, vol. 26, No. 5, 2010, 689-691.
Gfeller, et al., "The Length Distribution and Multiple Specificity of Naturally Presented HLA-I Ligands", Journal of Immunology, vol. 201, Nov. 2018, 13 pages.
Jurtz, et al., "NetMHCpan-4.0: Improved Peptide-MHC Class I Interaction Predictions Integrating Eluted Ligand and Peptide Binding Affinity Data", Journal of Immunology, vol. 199, No. 9, Oct. 2017, 3360-3368.
Khan, et al., "pDOCK: A New Technique for Rapid and Accurate Docking of Peptide Ligands to Major Histocompatibility Complexes", Immunome Research, vol. 6, Sep. 26-28, 2010, 16 pages.
Liu, et al., "Subangstrom Accuracy in pHLA-I Modeling by Rosetta FlexPepDock Refinement Protocol", Journal of Chemical Information and Modeling, vol. 54, No. 8, Jul. 22, 2014, 2233-2242.
Di Marco, et al., "Unveiling the Peptide Motifs of HLA-C and HLA-G from Naturally Presented Peptides and Generation of Binding Prediction Matrices", Journal of Immunology, vol. 199, Sep. 13, 2017, 14 pages.
Nielsen, et al., "NetMHCpan-3.0; Improved Prediction of Binding to MHC Class I Molecules Integrating Information from Multiple Receptor and Peptide Length Datasets", Genome Medicine, vol. 8, No. 33, 2016, 9 pages.
O'Donnell, "MHCflurry: Open-Source Class I MHC Binding Affinity Prediction", Cell Systems, vol. 7, No. 1, Jul. 25, 2018, 8 pages.
O'Meara, et al., "A Combined Covalent-electrostatic Model of Hydrogen Bonding Improves Structure Prediction with Rosetta", Journal of Chemical Theory and Computation, vol. 11, No. 2, 2015, 29 pages.
Ott, et al., "An Immunogenic Personal Neoantigen Vaccine for Patients with Melanoma", Nature, vol. 547, No. 7662, Jul. 13, 2017, 22 pages.
Raveh, et al., "Rosetta FlexPepDock ab-initio: Simultaneous Folding, Docking and Refinement of Peptides onto Their Receptors", PLoS One, vol. 6, Issue 4, Apr. 2011, 10 pages.
Rigo, et al., "Docktope: A Web-based Tool for Automated pMHC-i Modelling", Scientific Reports, vol. 5, No. 18413, Dec. 17, 2015, 13 pages.
Riley, et al., "Structure Based Prediction of Neoantigen Immunogenicity", Frontiers in Immunology, vol. 10, Article 2047, Aug. 2019, 14 pages.
Sarkizova, et al., "A Large Peptidome Dataset Improves HLA Class I Epitope Prediction Across Most of The Human Population", Nature Biotechnology, vol. 38, No. 2, Feb. 2020, 34 pages.
Schuster, et al., "The Immunopeptidomic Landscape of Ovarian Carcinomas", Proceedings of the National Academy of Sciences of the United States of America, vol. 114, No. 46, Nov. 1, 2017, 10 pages.
Trellet, et al., "A Unified Conformational Selection and Induced Fit Approach to Protein-Peptide Docking", Plos One, vol. 8, Issue 3, Mar. 2013, 13 pages.

* cited by examiner

SEQ ID NOS: 1-29

| | | Peptide | MS (score) | netMHCPan 2.8 (nM) | netMHC 4.0 (nM) | nM (measured) |
|---|---|---|---|---|---|---|
| A*01:01 | 1 | FLWPEAFLY | 0.98 | 409.9 | 1235.4 | 1.3 |
| | 2 | YVPEHWEYY | 0.96 | 551.9 | 235.3 | 11.1 |
| | 3 | KLDLLEQEY | 0.91 | 466.7 | 105.6 | 70.6 |
| | 4 | TTDGYLLRL | 0.80 | 792.1 | 283.0 | 78.9 |
| | 5 | DTEFPNFKY | 0.66 | 344.0 | 123.8 | 80.8 |
| | 6 | AHDGKVLLW | 0.97 | 532.5 | 945.4 | 191.4 |
| B*51:01 | 1 | DGLLRVLTV | 0.87 | 11221.3 | 15547.6 | 0.2 |
| | 2 | DAPLNIRSI | 0.56 | 17149.1 | 13149.4 | 6.5 |
| | 3 | DGLRDLPSI | 0.96 | 12708.1 | 18806.8 | 12.6 |
| | 4 | DGYVKETI | 0.98 | 13414.5 | 13070.7 | 13.4 |
| | 5 | DGRLVINRV | 0.60 | 18358.8 | 26689.8 | 13.5 |
| | 6 | DAYPQRIKF | 0.63 | 12680.6 | 9538.1 | 31.0 |
| | 7 | IIYPTPKVV | 0.92 | 11654.4 | 4611.5 | 38.0 |
| | 8 | VPPLVPKVL | 0.79 | 11306.6 | 3799.2 | 56.3 |
| | 9 | TPESKIRFV | 0.86 | 9336.0 | 10184.8 | 84.8 |
| | 10 | VALLVGEKV | 0.93 | 9509.3 | 3785.9 | 143.6 |
| | 11 | YIIEREPLI | 0.84 | 16193.4 | 10011.8 | 1791.8 |
| A*29:02 | 1 | FYPELKLAY | 0.89 | 396.3 | 66.1 | 0.2 |
| | 2 | HFLDRHLVF | 0.89 | 825.4 | 235.6 | 1.6 |
| | 3 | YLPALKVEY | 0.82 | 113.3 | 80.9 | 2.6 |
| | 4 | LPLDIQIFY | 0.96 | 359.2 | 116.7 | 4.6 |
| | 5 | ALSDLALHF | 0.97 | 217.6 | 418.3 | 6.0 |
| | 6 | GLDDKLLHY | 0.90 | 157.5 | 211.0 | 21.3 |
| | 7 | GLPDLVAKY | 0.98 | 123.9 | 668.7 | 29.7 |
| B*54:01 | 1 | YPVYQPVGP | 0.67 | 8015.0 | 1237.9 | 1.7 |
| | 2 | YGFVNYVTA | 0.60 | 5011.5 | 391.5 | 6.0 |
| | 3 | FVEILIPVA | 0.80 | 6043.1 | 812.6 | 12.2 |
| | 4 | FPKETFEGP | 0.82 | 8478.9 | 882.8 | 16.4 |
| | 5 | SAPVNFISA | 0.83 | 5762.2 | 7614.0 | 16.6 |

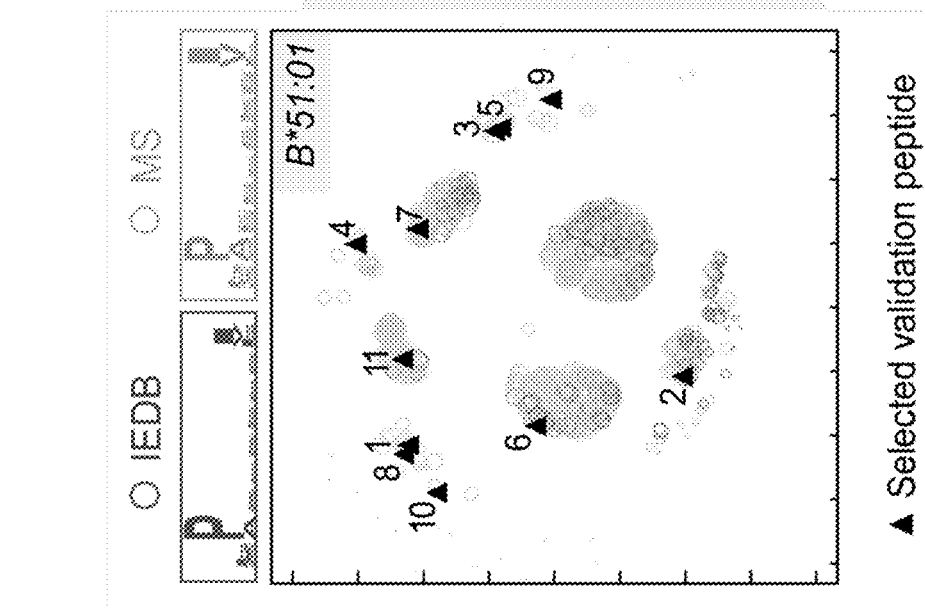

FIG. 8

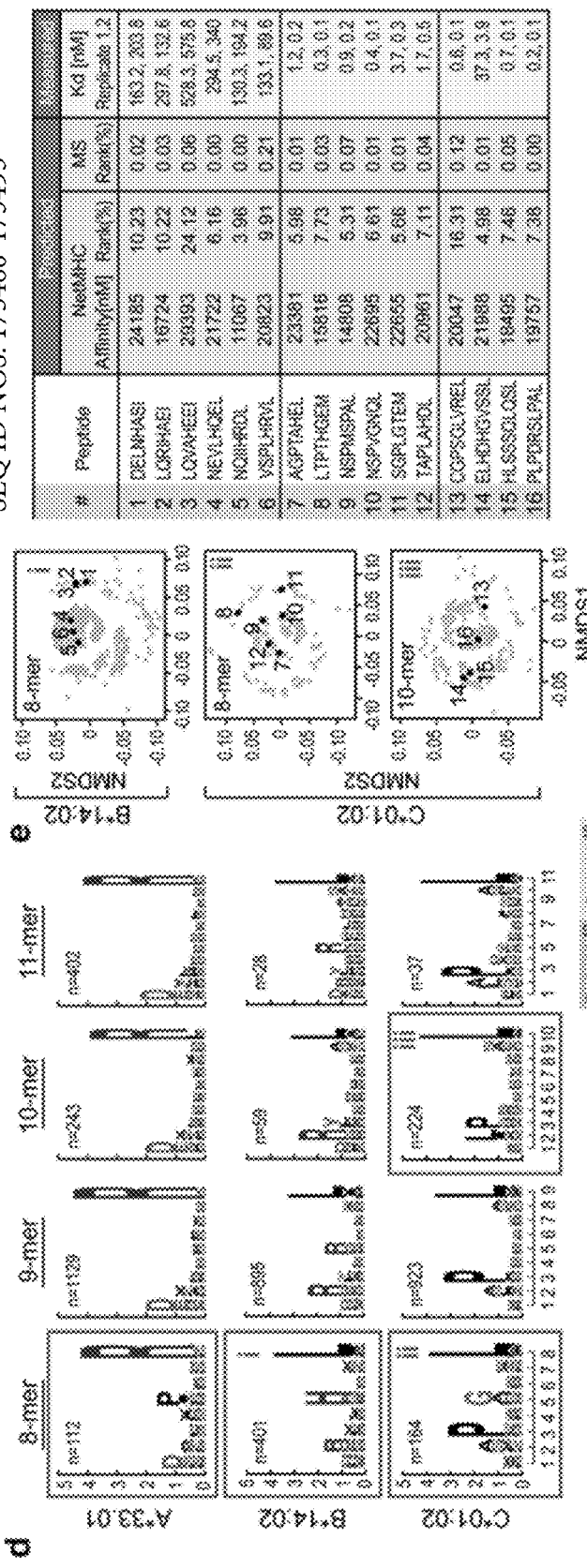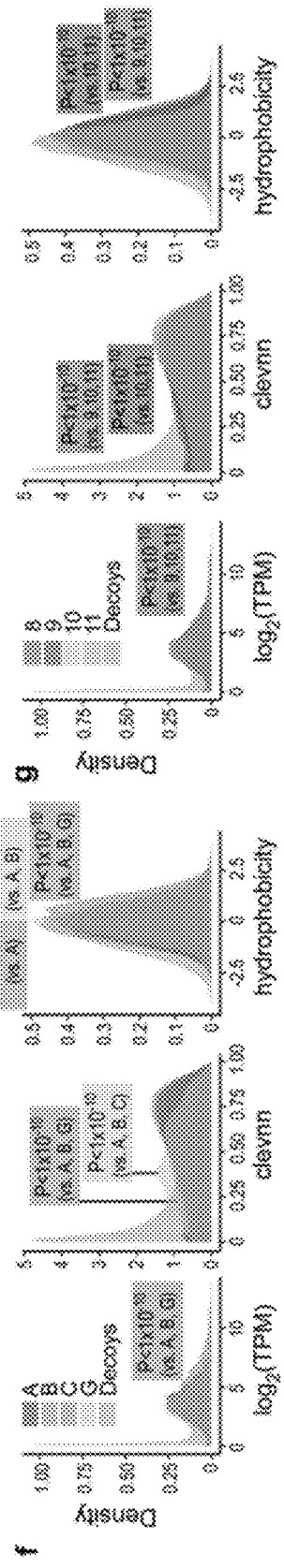
FIG. 28D-28G

METHOD FOR PREDICTING HLA-BINDING PEPTIDES USING PROTEIN STRUCTURAL FEATURES

CROSS-REFERENCE TO RELATED APPLICATIONS

This application claims the benefit of U.S. Provisional Application No. 62/909,752, filed Oct. 2, 2019. The entire contents of the above-identified application are hereby fully incorporated herein by reference.

STATEMENT REGARDING FEDERALLY SPONSORED RESEARCH

This invention was made with government support under Grant No.(s) CA155010, HL103532, CA216772, CA101942, CA210986, CA214125 and CA160034 awarded by the National Institutes of Health. The government has certain rights in the invention.

REFERENCE TO AN ELECTRONIC SEQUENCE LISTING

The contents of the electronic sequence listing (BROD_4940US_ST25.txt"; Size is 27.5 megabytes and it was created on Sep. 30, 2020) is herein incorporated by reference in its entirety.

TECHNICAL FIELD

The subject matter disclosed herein is generally directed to a method that predicts presentation of peptides on human leukocyte antigen (HLA) alleles using structural features.

BACKGROUND

Human leukocyte antigen (HLA) class I glycoproteins (HLA-A, -B, and -C) are expressed on the surface of almost all nucleated cells in the human body and are required for presentation of short peptides for detection by T cell receptors. The HLA genes are the most polymorphic genes across the human population; with more than 16,200 distinct HLA class I allele variants identified as of May 2019 (Lefranc, M.-P. et al. IMGT®, the international ImMunoGeneTics information System® 25 years on. Nucleic Acids Res. 43, D413-22 (2015); and Robinson, J. et al. The IPD and IMGT/HLA database: allele variant databases. Nucleic Acids Res. 43, D423-31 (2015)). Each HLA allele is estimated to bind and present ~1,000-10,000 unique peptides to T cells (Hunt D F, Henderson R A, Shabanowitz J, Sakaguchi K, Michel H, Sevilir N, Cox A L, Appella E, Engelhard V H. Characterization of peptides bound to the class I MHC molecule HLA-A2.1 by mass spectrometry. Science. 1992; 255:1261-1263; Rammensee H G, Friede T, Stevanoviic S. MHC ligands and peptide motifs: first listing. Immunogenetics. 1995; 41:178-228; Vita R, Overton J A, Greenbaum J A, Ponomarenko J, Clark J D, Cantrell J R, Wheeler D K, Gabbard J L, Hix D, Sette A, Peters B. The immune epitope database (IEDB) 3.0. Nucleic Acids Res. 2015; 43:D405-D412), less than 0.1% of the estimated 10 million potential 9-mer peptides from human protein-coding genes. Given such diversity in HLA binding, accurate prediction of whether a peptide is likely to bind to a specific HLA allele is highly challenging.

Rules for peptide binding to HLA molecules have been studied extensively for a subset of HLA alleles (Vita R, Overton J A, Greenbaum J A, Ponomarenko J, Clark J D, Cantrell J R, Wheeler D K, Gabbard J L, Hix D, Sette A, Peters B. The immune epitope database (IEDB) 3.0. Nucleic Acids Res. 2015; 43:D405-D412) and have been encoded in modern advanced neural-network-based algorithms (Hoof I, Peters B, Sidney J, Pedersen L E, Sette A, Lund O, Buus S, Nielsen M. NetMHCpan, a method for MHC class I binding prediction beyond humans. Immunogenetics. 2009; 61:1-13; Lundegaard C, Lamberth K, Harndahl M, Buus S, Lund O, Nielsen M. NetMHC-3.0: accurate web accessible predictions of human, mouse and monkey MHC class I affinities for peptides of length 8-11. Nucleic Acids Res. 2008; 36:W509-12). However, the algorithms in common use today (Trolle T, Metushi I G, Greenbaum J A, Kim Y, Sidney J, Lund O, Sette A, Peters B, Nielsen M. Automated benchmarking of peptide-MHC class I binding predictions. Bioinformatics. 2015; 31:2174-2181) are trained almost exclusively on measurements of biochemical affinity of synthetic peptides. This imparts several disadvantages. First, the throughput of these methods is limited because only a very small percentage of peptides are expected to bind, and therefore researchers must synthesize and experimentally assess potentially 1,000s of negative examples to identify 10s of strong-binding positive examples. Biased sampling can improve these odds but carries the risk of skewing the results or missing subdominant motifs. Meanwhile, other unintentional forms of bias, such as pre-existing notions of the length distribution or limitations on peptide synthesis and solubility, are difficult to avoid. Most importantly, these approaches do not necessarily consider the endogenous processing and transport of peptides prior to HLA binding. Mass spectrometry (MS)-based approaches yield a large and relatively unbiased portrait of the population of processed and presented peptides and should theoretically address most of these problems. However, historically liquid chromatography-tandem mass spectrometry (LC-MS/MS) methods have required large cellular input, which limits throughput, and the multi-allelic nature of the data complicates productive motif learning.

Citation or identification of any document in this application is not an admission that such a document is available as prior art to the present invention.

SUMMARY

In one aspect, the present invention provides for a method of predicting peptides capable of binding to an HLA allele comprising: identifying structural features indicative of occupancy of one or more candidate peptides on the binding pocket of the HLA allele; and predicting the candidate peptides that bind to the HLA molecule using a machine learning algorithm model trained using structural features extracted from one or more output models simulating occupancy of one or more binding peptides and one or more non-binding peptides on the HLA binding pocket in a crystal structure of the HLA allele or the crystal structure of a similar HLA allele. In certain embodiments, the structural features are identified by: providing a crystal structure of the HLA allele or the crystal structure of a similar HLA allele; generating one or more output models simulating occupancy of the one or more candidate peptides on the HLA binding pocket in the crystal structure; and extracting structural features from the output models. In certain embodiments, the structural features are identified by a second machine learning algorithm model that infers occupancy of the one or more candidate peptides on the HLA binding pocket, and wherein the second machine learning algorithm model is trained using one or more output models simulating occupancy of one or more binding peptides and one or more non-binding peptides on the HLA binding pocket in a crystal structure of the HLA allele or the crystal structure of a similar HLA allele. In certain embodiments, the method further comprises: providing a crystal structure of the HLA allele or the crystal structure of a similar HLA allele; simulating occupancy of one or more binding peptides and one or more non-binding peptides on the HLA binding pocket in the crystal structure to generate one or more output models; extracting structural features from the output models; and training the machine learning algorithm model using the extracted features. In certain embodiments, at least 100 to 300 output models are generated for each peptide.

In certain embodiments, the machine learning algorithm model is trained with one or more peptides bound to HLA molecules in cell lines monoallelic for the HLA allele. In certain embodiments, the one or more binding peptides are selected from the group consisting of: A*01:01 (SEQ ID Nos: 44-1120); A*02:01 (SEQ ID Nos: 1121-4202); A*02:02 (SEQ ID Nos: 4203-7373); A*02:03 (SEQ ID Nos: 7374-9953); A*02:04 (SEQ ID Nos: 9954-11940); A*02:05 (SEQ ID Nos: 11941-14981); A*02:06 (SEQ ID Nos: 14982-17191); A*02:07 (SEQ ID Nos: 17192-20710); A*02:11 (SEQ ID Nos: 20711-22696); A*03:01 (SEQ ID Nos: 22697-24233); A*11:01 (SEQ ID Nos: 24234-27505); A*11:02 (SEQ ID Nos: 27506-29812); A*23:01 (SEQ ID Nos: 29813-32133); A*24:02 (SEQ ID Nos: 32134-34347); A*24:07 (SEQ ID Nos: 34348-35681); A*25:01 (SEQ ID Nos: 35682-36682); A*26:01 (SEQ ID Nos: 36683-37957); A*29:02 (SEQ ID Nos: 37958-38921); A*30:01 (SEQ ID Nos: 38922-40029); A*30:02 (SEQ ID Nos: 40030-42114); A*31:01 (SEQ ID Nos: 42115-42919); A*32:01 (SEQ ID Nos: 42920-44874); A*33:01 (SEQ ID Nos: 44875-46761); A*33:03 (SEQ ID Nos: 46762-49053); A*34:01 (SEQ ID Nos: 49054-50948); A*34:02 (SEQ ID Nos: 50949-53677); A*36:01 (SEQ ID Nos: 53678-55165); A*66:01 (SEQ ID Nos: 55166-56901); A*68:01 (SEQ ID Nos: 56902-58374); A*68:02 (SEQ ID Nos: 58375-59804); A*74:01 (SEQ ID Nos: 59805-61821); B*07:02 (SEQ ID Nos: 61822-63473); B*07:04 (SEQ ID Nos: 63474-64885); B*08:01 (SEQ ID Nos: 64886-65609); B*13:01 (SEQ ID Nos: 65610-69419); B*13:02 (SEQ ID Nos: 69420-71587); B*14:02 (SEQ ID Nos: 71588-72970); B*15:01 (SEQ ID Nos: 72971-76378); B*15:02 (SEQ ID Nos: 76379-77762); B*15:03 (SEQ ID Nos: 77763-80458); B*15:10 (SEQ ID Nos: 80459-81940); B*15:17 (SEQ ID Nos: 81941-83632); B*18:01 (SEQ ID Nos: 83633-85593); B*27:05 (SEQ ID Nos: 85594-87076); B*35:01 (SEQ ID Nos: 87077-87772); B*35:03 (SEQ ID Nos: 87773-89157); B*35:07 (SEQ ID Nos: 89158-90977); B*37:01 (SEQ ID Nos: 90978-92452); B*38:01 (SEQ ID Nos: 92453-94858); B*38:02 (SEQ ID Nos: 94859-97742); B*40:01 (SEQ ID Nos: 97743-100731); B*40:02 (SEQ ID Nos: 100732-104409); B*40:06 (SEQ ID Nos: 104410-106653); B*42:01 (SEQ ID Nos: 106612-019885); B*44:02 (SEQ ID Nos: 109886-110903); B*44:03 (SEQ ID Nos: 110904-111749); B*45:01 (SEQ ID Nos: 111750-113153); B*46:01 (SEQ ID Nos: 113154-114113); B*49:01 (SEQ ID Nos: 114114-117833); B*50:01 (SEQ ID Nos: 117834-118468); B*51:01 (SEQ ID Nos: 118469-119991); B*52:01 (SEQ ID Nos: 119992-121525); B*53:01 (SEQ ID Nos: 121526-123560); 54:01 (SEQ ID Nos: 123561-124684); B*55:01 (SEQ ID Nos: 124685-126136); B*55:02 (SEQ ID Nos: 126137-127557); B*56:01 (SEQ ID Nos: 127558-129239); B*57:01 (SEQ ID Nos: 129240-130274); B*57:03 (SEQ ID Nos: 130275-132636); B*58:01 (SEQ ID Nos: 132637-134577); B*58:02 (SEQ ID Nos: 134578-135530); C*01:02 (SEQ ID Nos: 135531-136878); C*02:02 (SEQ ID Nos: 136879-137802); C*03:02 (SEQ ID Nos: 137803-138984); C*03:03 (SEQ ID Nos: 138985-141074); C*03:04 (SEQ ID Nos: 141075-143394); C*04:01 (SEQ ID Nos: 143395-145236); C*04:03 (SEQ ID Nos: 145237-146269); C*05:01 (SEQ ID Nos: 146270-147708); C*06:02 (SEQ ID Nos: 147709-149028); C*07:01 (SEQ ID Nos: 149029-149822); C*07:02 (SEQ ID Nos: 149823-150900); C*07:04 (SEQ ID Nos: 150901-151615); C*08:01 (SEQ ID Nos: 151616-153388); C*08:02 (SEQ ID Nos: 153389-156499); C*12:02 (SEQ ID Nos: 156500-157889); C*12:03 (SEQ ID Nos: 157890-160043); C*14:02 (SEQ ID Nos: 160044-161408); C*14:03 (SEQ ID Nos: 161409-164186); C*15:02 (SEQ ID Nos: 164187-167475); C*16:01 (SEQ ID Nos: 167476-170317); C*17:01 (SEQ ID Nos: 170318-171281); G*01:01 (SEQ ID Nos: 171282-172073); G*01:03 (SEQ ID Nos: 172074-172742) and G*01:04 (SEQ ID Nos: 172743-173477).

In certain embodiments, simulating occupancy is performed using one or more protein-peptide docking models and/or molecular dynamics simulation. In certain embodiments, the structural features are selected from the group consisting of amino acid residues capable of fitting a model of peptide occupancy on the binding pocket of HLA alleles, hydrophobicity, exposed hydrophobic surface, the size and position of the amino acid side chains, energies of attraction, energies of repulsion, energies of solvation, energies of side chain and backbone hydrogen bonds, energies of side chain and backbone conformations, and any energy terms listed in table 1. In certain embodiments, the machine learning algorithm model further comprises training with non-structural features of the one or more binding peptides and one or more non-binding peptides, whereby the model combines structural and non-structural features. In certain embodiments, the non-structural features comprise peptide sequence, amino acid physical properties, peptide physical properties, expression level of the source protein of a peptide, protein stability, protein translation rate, protein degradation rate, translational efficiencies from ribosomal profiling, protein cleavability, protein localization, motifs of host proteins that facilitate TAP transport, whether host protein is subject to autophagy, motifs that favor ribosomal stalling, protein features that favor nonsense-mediated mRNA decay (NMD), peptide cleavability, dummy peptide encoding, PCA peptide encoding, and/or Kidera peptide-level features. In certain embodiments, the expression level of the source protein of a peptide comprises the protein levels and/or transcripts of the source protein. In certain embodiments, protein features that favor nonsense-mediated mRNA decay (NMD) comprise a long 3' UTR and stop codon >50 nt upstream of last exon-exon junction. In certain embodiments, motifs that favor ribosomal stalling comprise polyproline stretches. In certain embodiments, the machine learning algorithm model comprises a neural network model. In certain embodiments, the neural network model comprises a single hidden layer neural network model and/or convolutional neural network model. In certain embodiments, the machine learning algorithm model comprises one or more peptide encoding schemes. In certain embodiments, the one or more peptide encoding schemes comprise one-hot/dummy encoding, blosum62 encoding, or peptide: MHC binding energy covariance (PMBEC) encoding.

In certain embodiments, the candidate peptide is predicted to bind to one or more HLA alleles. In certain embodiments, the HLA binding peptides are 8, 9, 10, or 11 amino acids in length. In certain embodiments, the HLA binding peptides are any combination of peptides selected from the group consisting of 8, 9, 10, and 11 amino acids in length. In certain embodiments, the accuracy of prediction is evaluated using metrics comprising area under the curve for the receiver operating characteristic curve and positive predictive value. In certain embodiments, the HLA-allele is an HLA-A allele, HLA-B allele, HLA-C allele, or HLA-G allele.

In certain embodiments, the candidate peptides are selected from a subject and the HLA allele is expressed in the subject. In certain embodiments, the subject is suffering from a disease or condition. In certain embodiments, the disease or condition is selected from the group consisting of cancer, an infection, an autoimmune disease, and a transplant. In certain embodiments, the peptides are identified by nucleic acid sequencing of a sample obtained from the subject, wherein the sample comprises tumor cells, infected cells, cells targeted by the autoimmune response, or cells to be transplanted. In certain embodiments, the disease is cancer and the peptides are neoantigens and/or novel unannotated open reading frames (nuORFs).

In another aspect, the present invention provides for an immunogenic composition for use in a method of inducing a tumor specific or infection specific immune response or inducing immune tolerance, said immunogenic composition comprising one or more peptides identified with the method of any embodiment herein. In certain embodiments, the immunogenic composition comprises autologous dendritic cells or antigen presenting cells that have been pulsed with the one or more peptides. In certain embodiments, the immunogenic composition comprises at least one vector capable of expressing the one or more peptides. In certain embodiments, the immunogenic composition comprises at least one mRNA capable of expressing the one or more peptides.

In another aspect, the present invention provides for an immunogenic composition for use in a method of inducing a tumor specific or infection specific immune response or inducing immune tolerance, said immunogenic composition comprising two or more peptides identified with the method of any embodiment herein and a pharmaceutically acceptable carrier.

In another aspect, the present invention provides for an immunogenic composition for use in a method of inducing a tumor specific or infection specific immune response or inducing immune tolerance, comprising autologous dendritic cells or antigen presenting cells that have been pulsed with the two or more peptides identified with the method of any embodiment herein.

The immunogenic composition according to any embodiment herein may be for use in a method of inducing a tumor or infection specific immune response or inducing immune tolerance, comprising at least one vector capable of expressing two or more peptides identified with the method of any embodiment herein. In certain embodiments, the vector is a viral vector.

In another aspect, the present invention provides for an immune cell specific for a peptide identified with the method of any embodiment herein. In certain embodiments, the immune cell is a CD8+ T cell. In certain embodiments, the immune cell expresses a chimeric antigen receptor (CAR) or exogenous T cell receptor (TCR) specific to the peptide. In certain embodiments, the immune cell is a dendritic cell loaded with the peptide.

These and other aspects, objects, features, and advantages of the example embodiments will become apparent to those having ordinary skill in the art upon consideration of the following detailed description of example embodiments.

BRIEF DESCRIPTION OF THE DRAWINGS

An understanding of the features and advantages of the present invention will be obtained by reference to the following detailed description that sets forth illustrative embodiments, in which the principles of the invention may be utilized, and the accompanying drawings of which:

FIG. 6A) Single HLA Class I allele expression on B721.221 cells. No inference of peptide binding to allele based on preexisting predictors. Unambiguous peptide-to-allele assignment. Enables creation of new predictors and comprehensive allele-specific and pan-allele analyses of binding preferences. FIG. 6B) Allele expression is confirmed by FACS. Sample preparation for HLA-peptides includes sample preparation (50 Mio cells per IP, 3 IPs pooled for 2 injections, acid elution and desalt), LC-MS/MS (QE+, QE-HF or Lumos, Lumos: include 1+ precursor fragmentation, 2 injections/replicate) and data analysis: spectrum mill (No enzyme specificity search, Improved scoring for HLA-derived peptides, FDR filtering to 1%).

FIG. 8—Applicants systematically selected MS-enriched binding motifs (left) and validated their binding strength in vitro (right) (SEQ ID NO:1-29). Of 33 peptides selected for validation across 5 alleles, 32 were confirmed as strong binders showing the feasibility and benefit of an endogenous unbiased profiling approach. Peptides that represent novel binding motifs were validated as strong binders with tradition affinity measurement assays.

FIG. 26A) Schematic of the experimental design: HLA-null B721.221 cells transfected to express a single HLA allele (31 HLA-A, 40 HLA-B, 21 HLA-C and 3 HLA-G) were subjected to HLA class I-immunoprecipitation with W6/32 antibody from 50-300 million cells per allele followed by identification of eluted peptides by LC-MS/MS, in order to generate endogenous peptide binding data used to characterize allele-specific or pan-allele binding preferences and train neural network predictors of antigen processing and presentation. FIG. 26B) Surface expression of each transfected HLA-alleles was confirmed by flow cytometric detection against parental cells transfected with an empty vector (MFI: Mean fluorescence intensity; profiles of all lines in FIG. 32A). FIG. 26C) Overlap of human genes represented by at least two HLA-associated peptides (pink), detected in RNA sequencing (TPM>2, light grey) or identified in deep proteome analysis (>2 unique peptides, dark grey) of the B721.221 mono-allelic cells lines. FIG. 26D) Top: Numbers of HLA-bound peptides identified per allele by MS-based profiling (circles; filled: newly generated data; open: previously reported (Abelin et al. 2017); or recorded in IEDB (diamonds). Bottom: Heatmaps of relative median population frequencies per allele across racial groups (AFA: African American, API: Asian or Pacific Islander, HIS: Hispanic, CAU: Caucasian) in the US population (Gragert et al. 2013) and worldwide.

FIG. 27A) Pair-wise correlations between the 95 HLA-A, -B, —C, and -G binding motifs, each represented as a vector of amino acid frequencies (left), and pair-wise distances between the 95 HLA binding pockets, each represented by the properties of amino acids that are in contact with the peptide (right). Examples of groups of alleles with high similarity (middle) and the corresponding binding motif of each group (bottom). FIG. 27B) Average correlations of A to A (i.e. each dot represents an HLA-A allele and the y-axis is the mean of the correlations between that allele and all other HLA-A alleles), B to B, C to C and G to G alleles show that C and G alleles are more similar to each other than A and B alleles in both peptide motif (left) and protein (right) space. FIG. 27C) Number of alleles sharing a submotif colored according to HLA locus (A: purple, B: blue, C: orange, G: yellow). FIG. 27D) 2D-visualization of submotifs identified across the 95 alleles (middle), colored according to HLA locus (A:purple; B:blue; C:orange; G:yellow) and scaled in size according to the number of underlying peptides making up the sub-cluster. The collection of all allele-specific submotifs was clustered to identify groups of alleles that share a submotif (shown in FIG. 34B). Four examples of clusters of submotifs are highlighted with dashed circles, along with the respective motifs they represent and the allele-specific clusters that contribute to each shared motif.

FIGS. 28A-28G—Mono-allelic data uncovers lengths-specific HLA-binding preferences. FIG. 28A) Frequencies of peptide lengths observed across alleles (8: pink, 9: violet, 10: green, 11: cyan). All but two HLA-B alleles preferentially present 9-mers. HLA-A alleles bind longer peptides more frequently than B and C alleles, while B and C alleles have a higher propensity for short peptides. FIG. 28B) 8-, 10-, and 11-mer binding motifs were transformed to pseudo 9-mer motifs by adding (8-mers: positions 4 or 5) or removing (10-mers: positions 5 or 6; 11-mers positions 5, 6, or 7) middle residues and selecting the pseudo-9-mer motif which was most similar to the corresponding 9-mer motifs. The maximum difference amongst peptide positions between the 8-, 10-, and 11-mer pseudo 9-mer motifs and the corresponding 9-mer motif in amino acid frequency (x-axis) and entropy (y-axis) are shown. Circle size reflects number of peptides, dotted lines indicate cutoff values. Circles in color and label denote alleles with >100 peptides with change in amino acid frequency or entropy greater than the selected cutoffs. FIG. 28C) Percent motif changes within each HLA type colored by length. FIG. 28D) Length dependent logo plots for A*33:01, B*14:02 and C*01:02; red boxes outline the changing motifs. FIG. 28E) Experimental validation of selected peptides (indicated with black dots on the NMDS plots) by in vitro binding assays compared to their predicted scores by NetMHC and MS models (SEQ ID NO: 173480-173495). FIG. 28F)-FIG. 28G) Expression, predicted cleavability and hydrophobicity stratified by HLA loci and peptide length.

FIG. 29A) Three types of primary tumor cell lines (melanoma [MEL], glioblastoma [GBM] and clear cell renal cell carcinoma [ccRCC]) used to identify HLA-associated peptidomes. FIG. 29B) Changes in relative protein abundance of proteasomal subunits and IFNγ inducible genes in patient-derived GBM cells with or without IFNγ-treatment based on MS proteome analysis. FIG. 29C) Schematic of proteasomal cleavage signature analysis. FIG. 29D) Peptide processing signatures of HLA ligands presented by primary tumor and cancer cell lines at baseline (top) and following IFN7 treatment (bottom), showing overrepresented (red) or underrepresented (blue) amino acid residues upstream and downstream of the HLA peptide. The number in each cell denotes percent change over a background decoy set; color intensity indicates significance (see key). FIG. 29E) Peptide processing signatures of HLA peptides in normal tissue (primary skin and fibroblast cells). FIG. 29F) Heatmap of Spearman correlations between the processing preferences in untreated and IFNγ-treated samples at upstream and downstream positions. Signatures for peptides from the IFNγ treated cells correlate well with peptides eluted from untreated cells suggesting minimal to no difference between the two patterns.

FIG. 30A) Contribution of predictor variables (peptide binding, transcript expression, cleavability, and gene presentation bias) to positive predictive value (PPV) as the most informative variable is added on at a time. FIG. 30B) Schematic of the neural networks used to generate allele-length-specific and pan predictive models. FIG. 30C) Comparison of PPVs across each of the 95 HLA alleles (grey lines) by testing novel length-specific and pan-allele MS based-models on internal data against NetMHC and MHCflurry. FIG. 30D) Summary of PPVs for state-of-the-art and MS-based models resulting in a 2-fold improvement for PPV at top 0.1% of observed peptides, or 7-fold for PPV at 40% recall of positives. FIG. 30E) Prediction of peptides presented by C-alleles (Di Marco et al. 2017) using NetMHC, MHCflurry and MS-based models. FIG. 30F) Correlation of actual PPV vs predicted PPV using a linear model, with variables in the linear model and their respective significance tabulated. FIG. 30G) pie chart.

FIG. 31A) schematic of evaluation: generation of the dataset of observed peptides displayed on primary tumor specimens, prediction of epitopes based on unique HLA identities of each set of cells, and comparison of predicted to observed peptides across 7 prediction models in order to determine performance and accuracy. FIG. 31B) MS-based predictor ranks MS detected peptides better than NetMHCpan and MHCflurry. Internal data on 12 patients (5 Mel, 3 GBM, 3 CLL, 1 OV), and external data(Bassani-Sternberg et al. 2016; Schuster et al. 2017). FIG. 31C) Using the best scoring peptide-allele combination, peptides can be reassigned to the respective allele. Allele contribution to peptide presentation is tumor and individual dependent and includes A, -B, and -C alleles in endogenous datasets. FIG. 31D) Fraction of peptides contributing per allele type+/− IFNγ. Peptides presentation on HLA-B increased with IFNγ stimulation.

FIG. 32N) Correlation analysis of mean aliphatic index of peptides per allele and number of identified peptides does not indicate a bias during ionization towards peptides with charged residues and less aliphatic residues.

FIG. 33B) 2D visualization of all submotifs as in FIG. 27D but colored by identified cluster. FIG. 33C)

Clustering of submotifs colored by HLA-type (middle). For circled clusters, the respective motif and the allele-specific clusters contributing to the shared motif are highlighted.

Figure 34A:
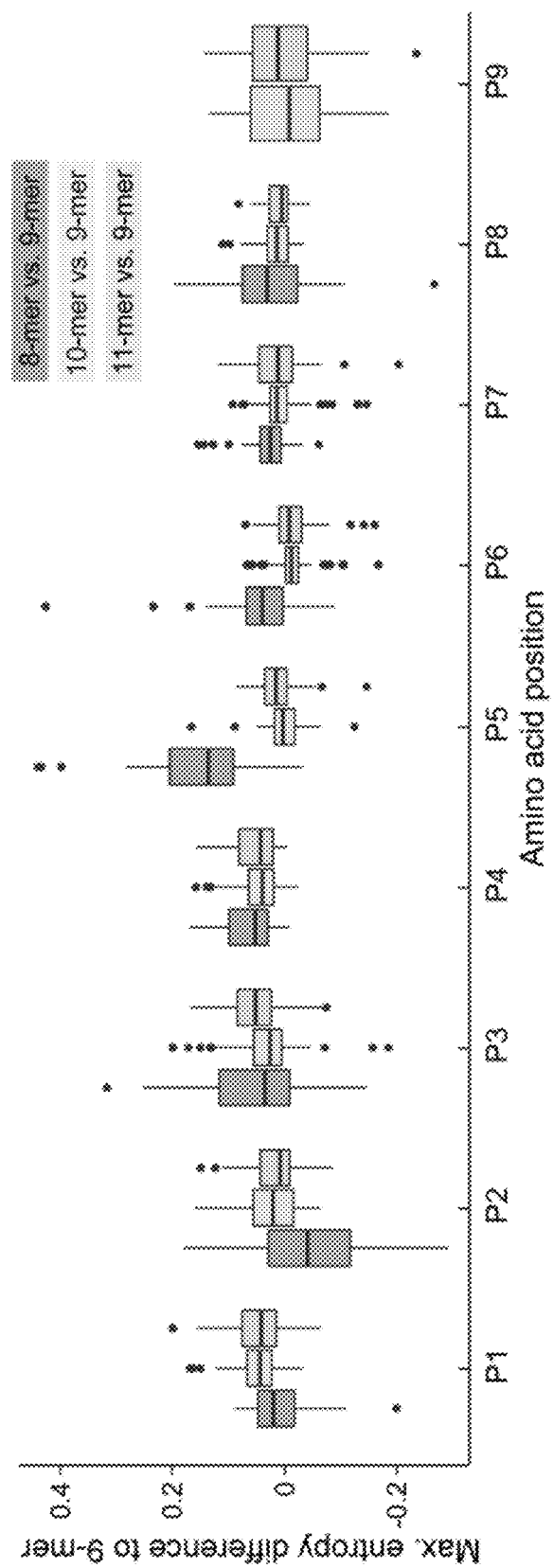
Figure 34B:
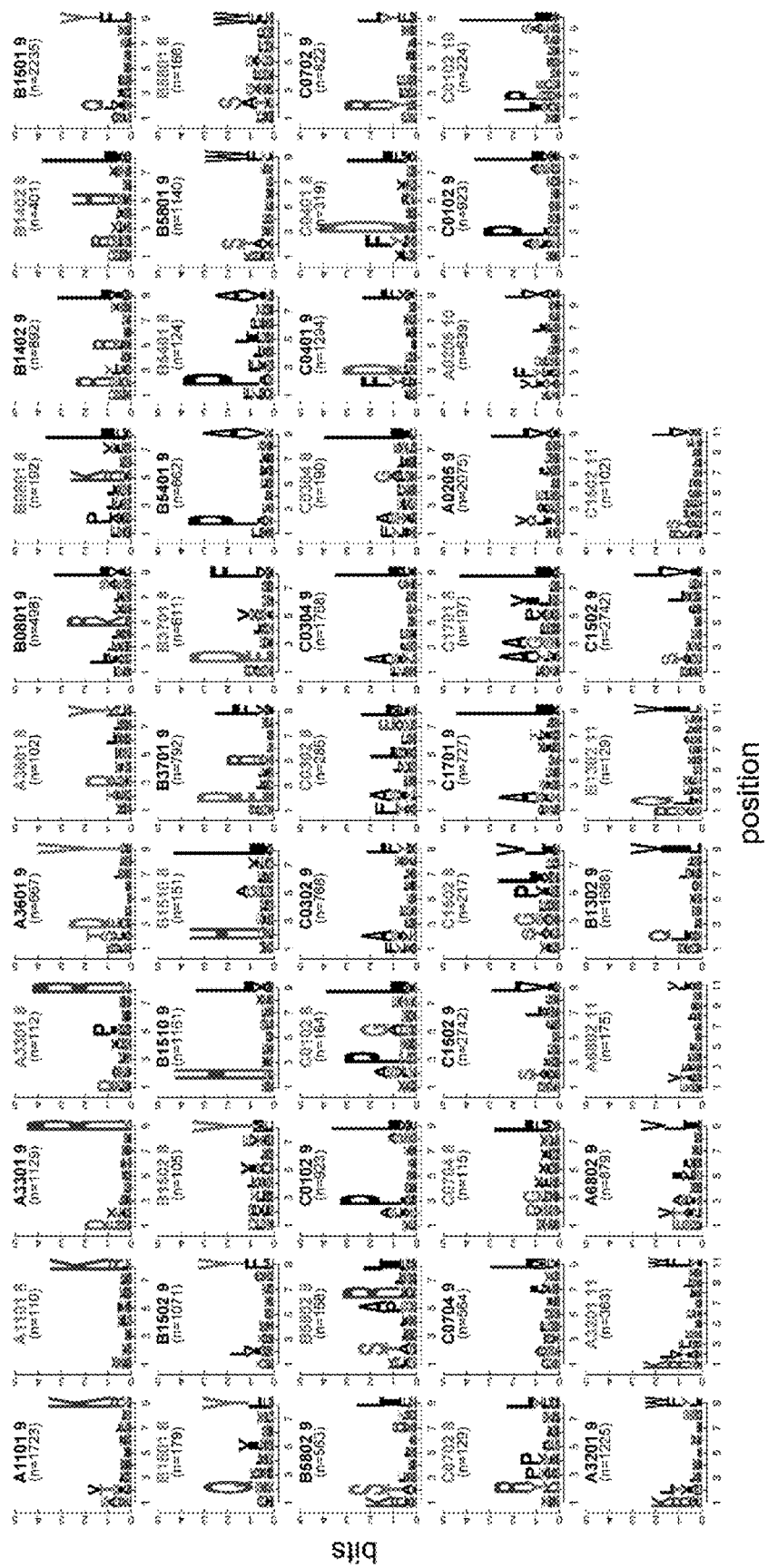
Figure 34C:
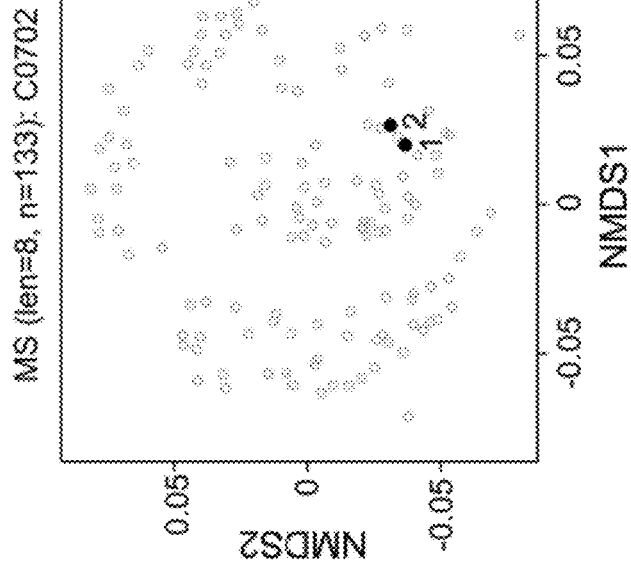

FIGS. 34A-34C—FIG. 34A) Amino acid entropy difference for each peptide position in 8-, 10-, 11-mers compared to 9-mers. 8-mers show significantly higher entropy at P5 indicating that this position is part of an 8-mer specific motif. FIG. 34B) Motif logo plots of alleles that differ from their corresponding 9-mer. FIG. 34C) Experimental validation of selected 8-mer peptides for C*07:02 (indicated with black dots on the NMDS plots) by in vitro binding assays compared to their predicted scores by NetMHC and MS models (SEQ ID NOS: 173496-173497).

Figure 35A:
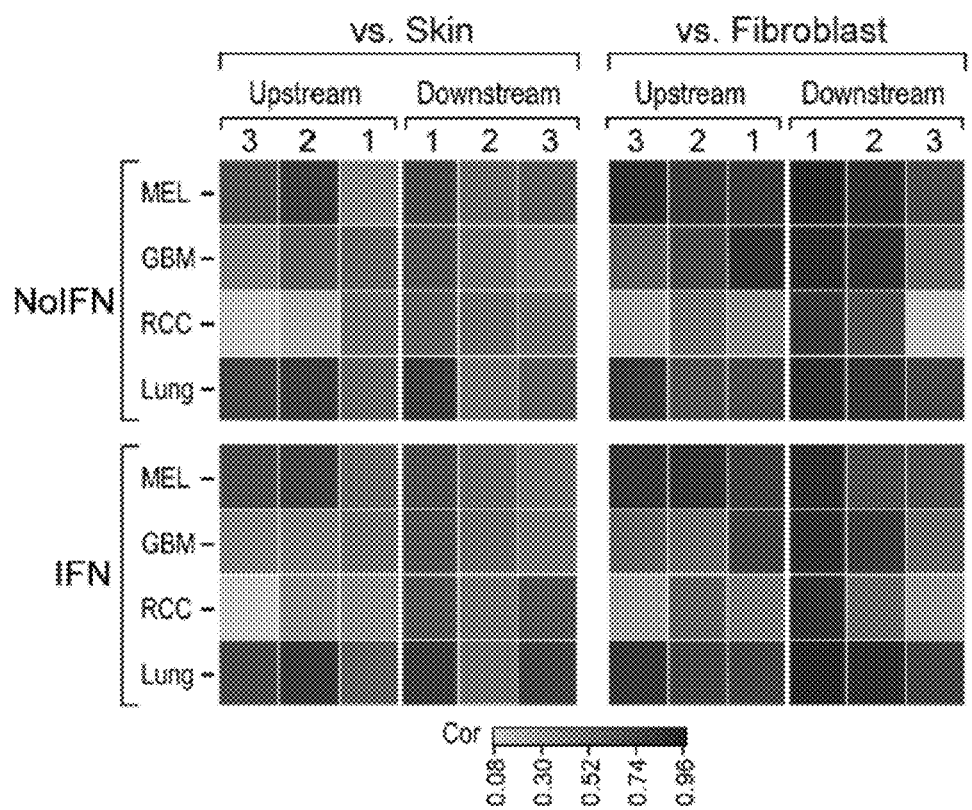
Figure 35B:
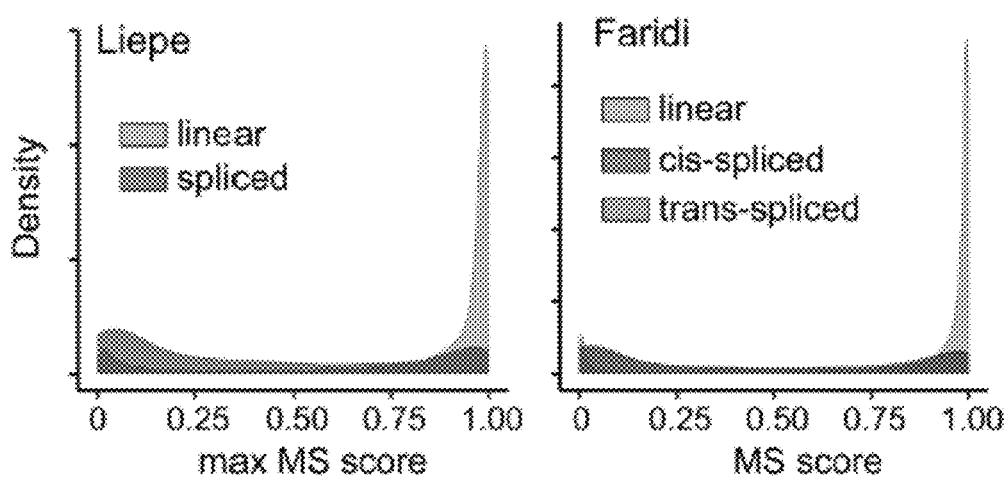

FIGS. 35A-35B—FIG. 35A) Heatmap of correlations between processing differences in evaluated tumor lineages (MEL, GBM, ccRCC, lung) compared to healthy tissues (skin, fibroblast) at upstream and downstream positions for untreated and IFNγ stimulated tumor samples. FIG. 35B) Potential proteasomal spliced peptides (data from Liepe et al. and Faridi et al. (Liepe et al. 2016; Faridi et al. 2018)) are distributed over a wide range of predicted binding score whereas linear peptides are predicted with very high affinity.

Figures 36A, 36B:
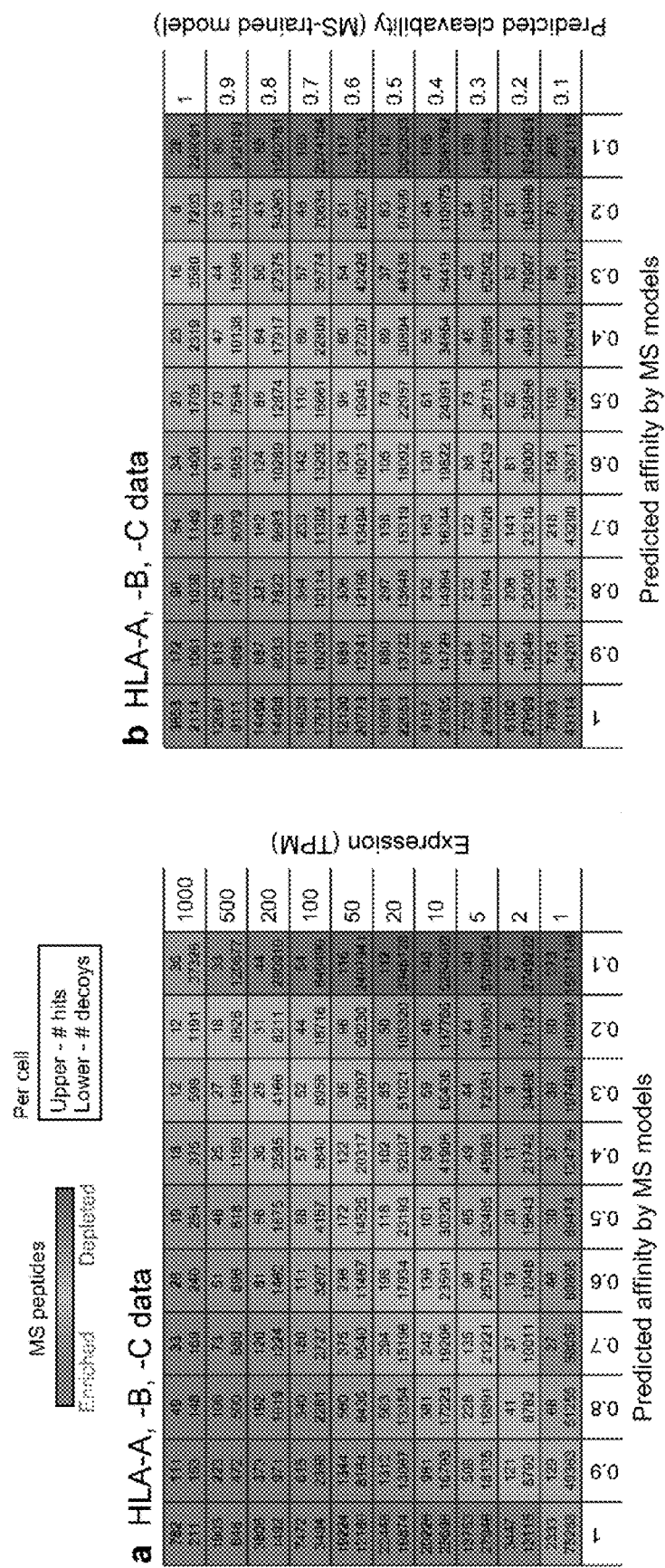

FIGS. 36A-36B—Gene expression and cleavability influence HLA presentation. Hits and decoys are binned according to (FIG. 36A) source transcript expression (per RNA-seq; y axis) or (FIG. 36B) predicted cleavability and predicted affinity (x-axis) for each allele. Per bin, hits (top) and decoys (bottom) counts are reported. Each cell is colored according to the hit:decoy ratio (red=enriched for hits; blue=depleted of hits).

Figures 37A, 37B:
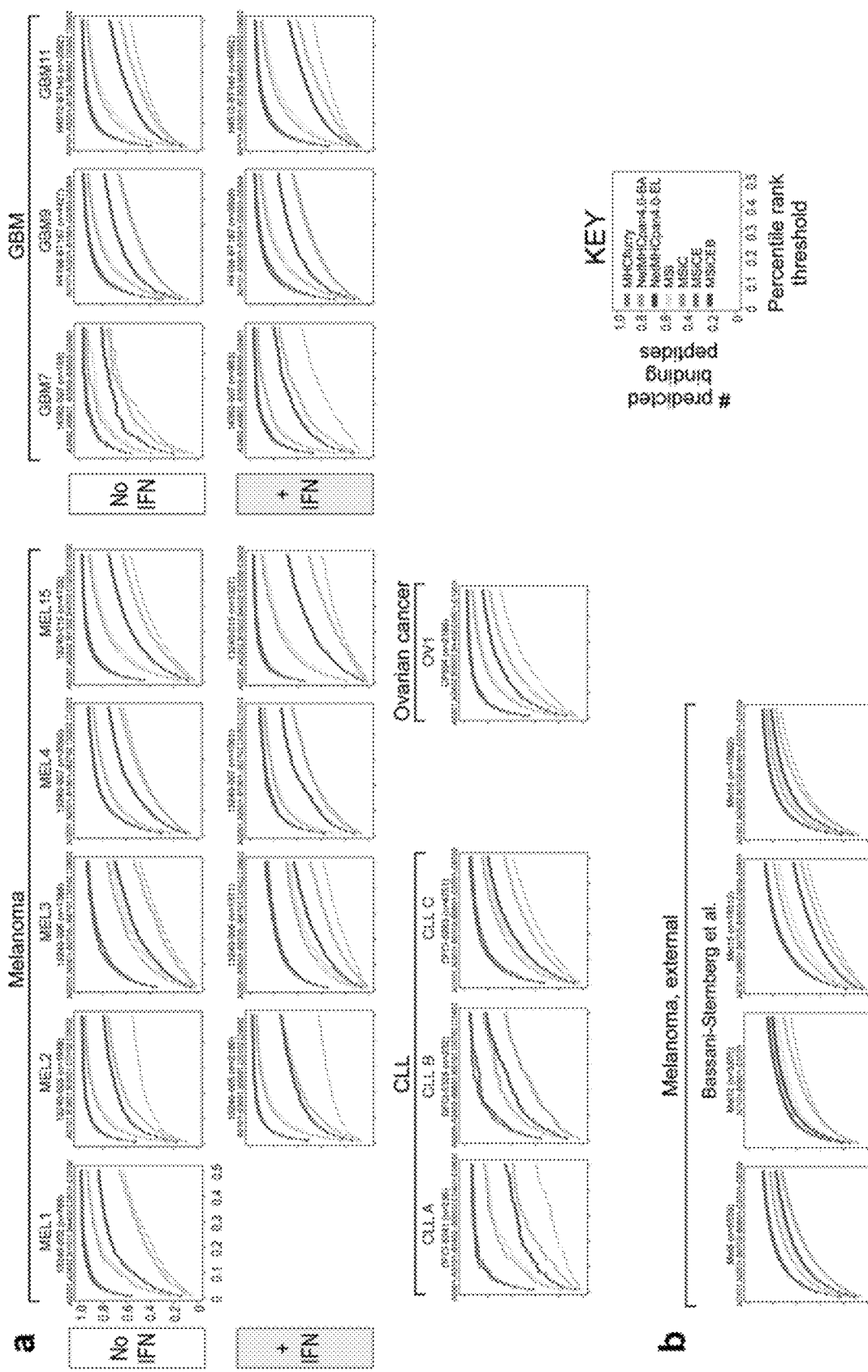
Figure 37C:
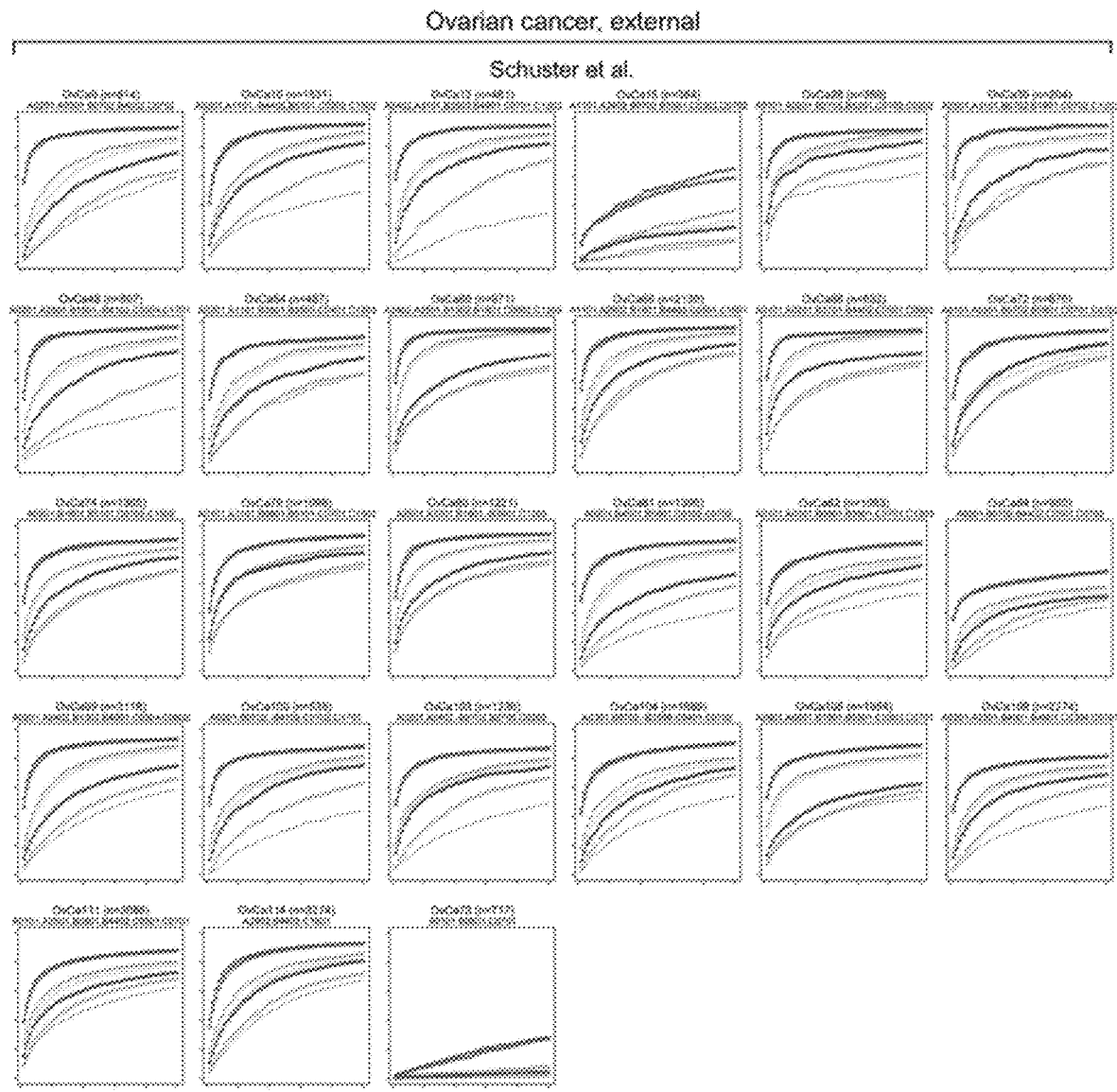

FIGS. 37A-37C—Evaluation of MS informed models compared to other prediction tools MHCflurry, NetMHCpan4.0-BA, NetMHCpan4.0-EL for patient derived tumor samples FIG. 37A) on internally generated data, FIG. 37B) and FIG. 37C) on external datasets (Bassani-Sternberg et al. 2016; Schuster et al. 2017). Predictions were made with the allele-and-length-specific models for covered alleles (n=50), while missing alleles (n=7; indicated by '-' in front of the allele name, e.g. -B4701) were scored by the pan-allele-pan-length predictors. Performance was evaluated by number of predicted binding peptides at percentile rank thresholds.

Figure 38:
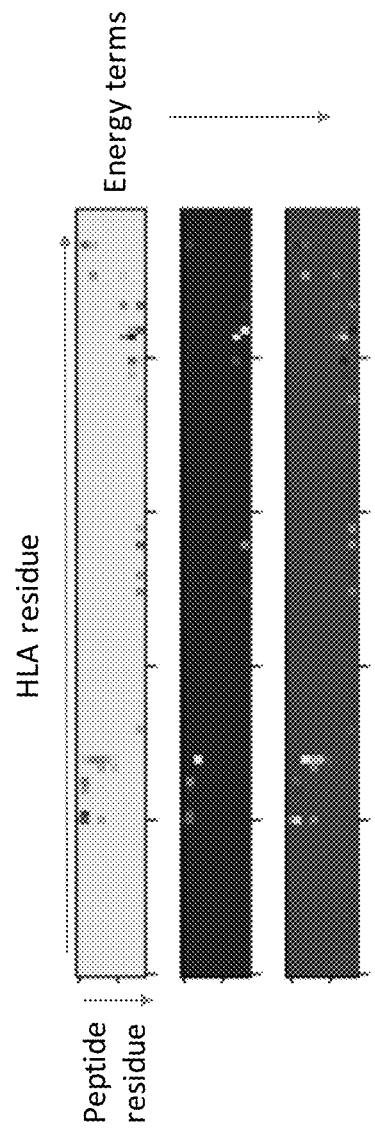

FIG. 38.—A schematic to depict the protein-peptide docking working flow. The input structure is prepacked to avoid the interference of side chains to the interaction between the peptide and the HLA molecule.

Figure 39:
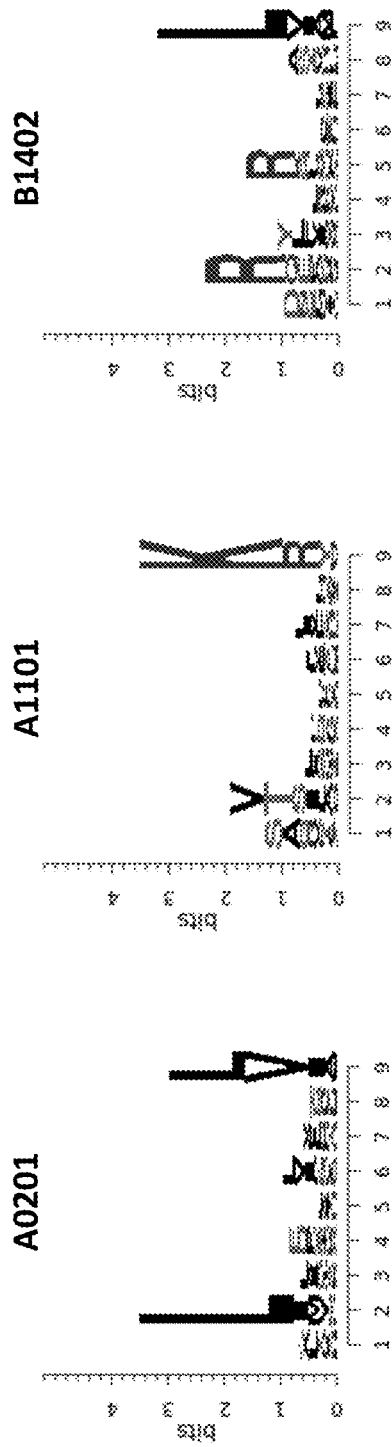

FIG. 39.—As a proof a concept, training dataset and test datasets are used for evaluating the candidate peptides capable of binding to HLA allele A02:01, A11:01, and B14:02.

Figure 40A:
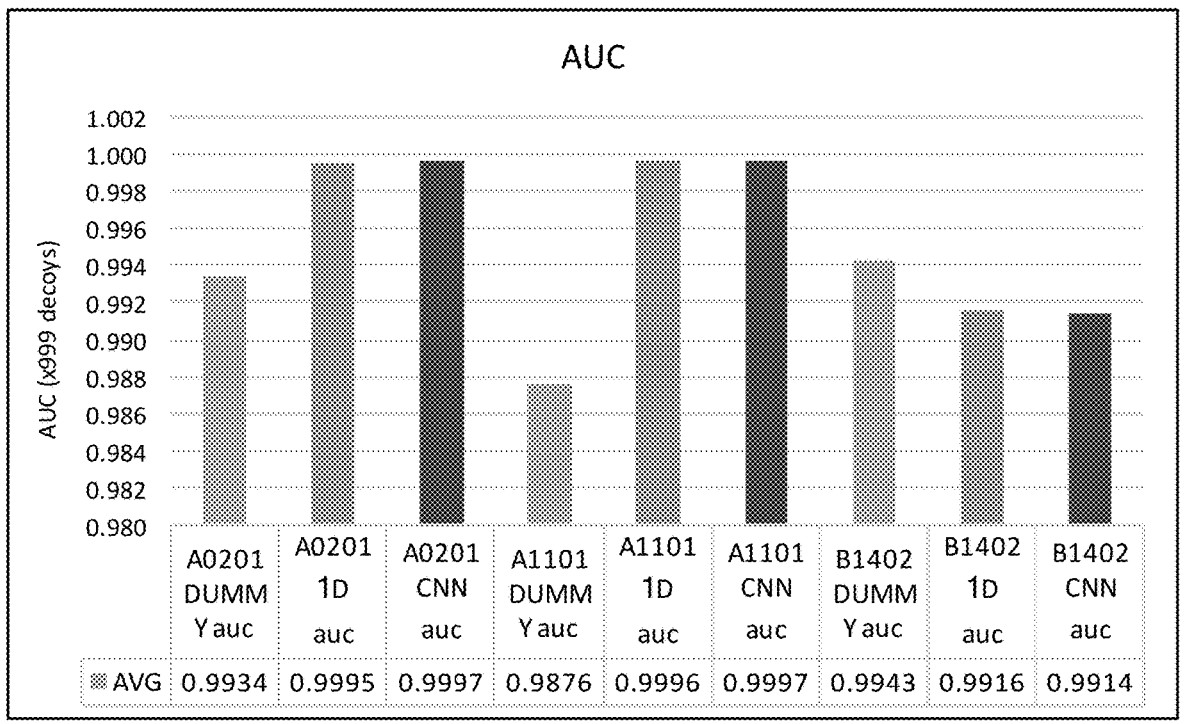
Figure 40B:
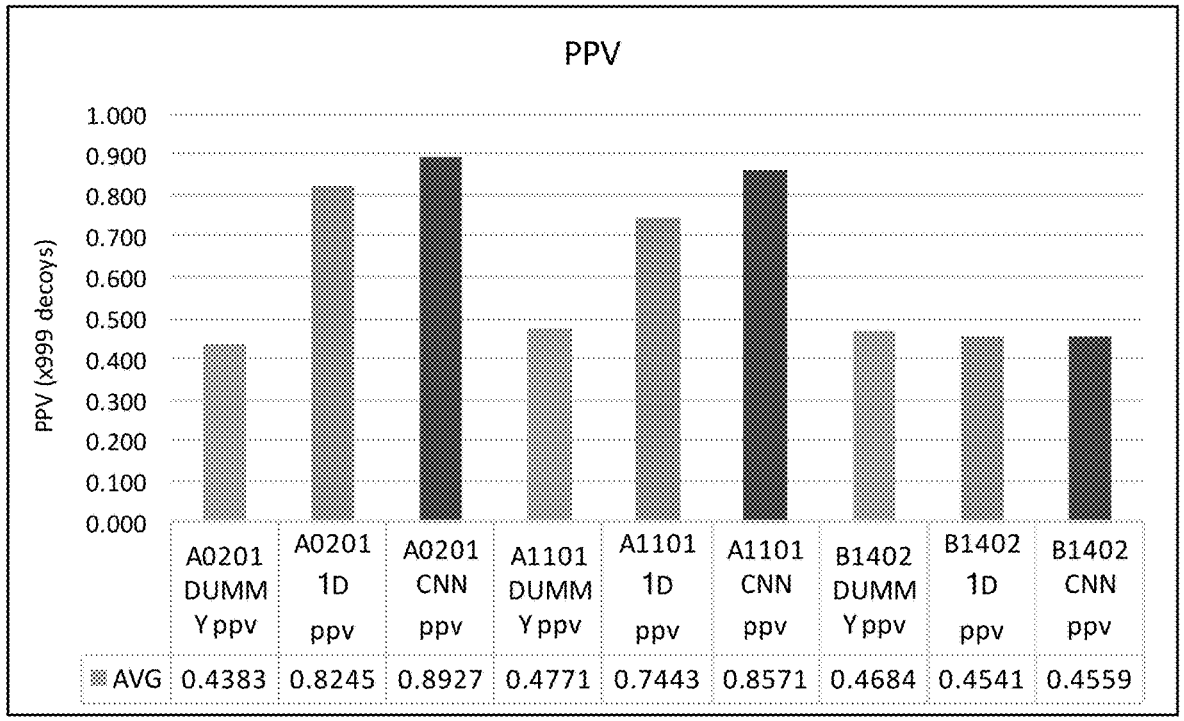

FIGS. 40A-40B.—Three models (DUMMY, 1D, CNN) are used for predicting the binding of peptides to HLA molecules. The AUC (FIG. 40A) and PPV (FIG. 40B) values are shown for each method on each HLA allele.

The figures herein are for illustrative purposes only and are not necessarily drawn to scale.

DETAILED DESCRIPTION OF THE EXAMPLE EMBODIMENTS

General Definitions

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, 2$^{nd}$ edition (1989) (Sambrook, Fritsch, and Maniatis); Molecular Cloning: A Laboratory Manual, 4$^{th}$ edition (2012) (Green and Sambrook); Current Protocols in Molecular Biology (1987) (F. M. Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboratory Manual (1988) (Harlow and Lane, eds.): Antibodies A Laboratory Manual, 2$^{nd}$ edition 2013 (E. A. Greenfield ed.); Animal Cell Culture (1987) (R. I. Freshney, ed.); Benjamin Lewin, Genes IX, published by Jones and Bartlet, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology 2$^{nd}$ ed., J. Wiley & Sons (New York, N.Y. 1994), March, Advanced Organic Chemistry Reactions, Mechanisms and Structure 4$^{th}$ ed., John Wiley & Sons (New York, N.Y. 1992); and Marten H. Hofker and Jan van Deursen, Transgenic Mouse Methods and Protocols, 2$^{nd}$ edition (2011).

As used herein, the singular forms "a" "an", and "the" include both singular and plural referents unless the context clearly dictates otherwise.

The term "optional" or "optionally" means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms "about" or "approximately" as used herein when referring to a measurable value such as a parameter, an amount, a temporal duration, and the like, are meant to encompass variations of and from the specified value, such as variations of +/−10% or less, +/−5% or less, +/−1% or less, and +/−0.1% or less of and from the specified value, insofar such variations are appropriate to perform in the disclosed invention. It is to be understood that the value to which the modifier "about" or "approximately" refers is itself also specifically, and preferably, disclosed.

As used herein, a "biological sample" may contain whole cells and/or live cells and/or cell debris. The biological sample may contain (or be derived from) a "bodily fluid". The present invention encompasses embodiments wherein the bodily fluid is selected from amniotic fluid, aqueous humour, vitreous humour, bile, blood serum, breast milk, cerebrospinal fluid, cerumen (earwax), chyle, chyme, endolymph, perilymph, exudates, feces, female ejaculate, gastric acid, gastric juice, lymph, mucus (including nasal drainage and phlegm), pericardial fluid, peritoneal fluid, pleural fluid, pus, rheum, saliva, sebum (skin oil), semen, sputum, synovial fluid, sweat, tears, urine, vaginal secretion, vomit and mixtures of one or more thereof. Biological samples include cell cultures, bodily fluids, cell cultures from bodily fluids. Bodily fluids may be obtained from a mammal organism, for example by puncture, or other collecting or sampling procedures.

The terms "subject," "individual," and "patient" are used interchangeably herein to refer to a vertebrate, preferably a mammal, more preferably a human. Mammals include, but are not limited to, murines, simians, humans, farm animals, sport animals, and pets. Tissues, cells and their progeny of a biological entity obtained in vivo or cultured in vitro are also encompassed.

Various embodiments are described hereinafter. It should be noted that the specific embodiments are not intended as an exhaustive description or as a limitation to the broader aspects discussed herein. One aspect described in conjunction with a particular embodiment is not necessarily limited to that embodiment and can be practiced with any other embodiment(s). Reference throughout this specification to "one embodiment", "an embodiment," "an example embodiment," means that a particular feature, structure or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment, but may. Furthermore, the particular features, structures or characteristics may be combined in any suitable manner, as would be apparent to a person skilled in the art from this disclosure, in one or more embodiments. Furthermore, while some embodiments described herein include some but not other features included in other embodiments, combinations of features of different embodiments are meant to be within the scope of the invention. For example, in the appended claims, any of the claimed embodiments can be used in any combination.

Reference is made to international patent application Serial No. PCT/US2017/028122 filed 18 Apr. 2017, which published as PCT Publication No. WO 2017/184590 on 26 Oct. 2017, which claims priority to U.S. provisional patent application Ser. Nos. 62/324,228 18 filed April 2016, 62/345,556 03 filed June 2016 and 62/458,954 filed 14 Feb. 2017. Reference is also made to international patent application Serial No. PCT/US2019/054365 filed Oct. 2, 2019, which published as PCT Publication No. WO 2020/072700 on Apr. 9, 2020, which claims priority to U.S. provisional patent application Ser. Nos. 62/740,324, filed Oct. 2, 2018, and 62/852,924, filed May 24, 2019. Reference is also made to Sarkizova S, Klaeger S, Le P M, et al. A large peptidome dataset improves HLA class I epitope prediction across most of the human population. Nat Biotechnol. 2020; 38(2):199-209. doi:10.1038/s41587-019-0322-9.

All publications, published patent documents, and patent applications cited herein are hereby incorporated by reference to the same extent as though each individual publication, published patent document, or patent application was specifically and individually indicated as being incorporated by reference.

Overview

Immune System and Antigen Presentation

The immune system can be classified into two functional subsystems: the innate and the acquired immune system. The innate immune system is the first line of defense against infections, and most potential pathogens are rapidly neutralized by this system before they can cause, for example, a noticeable infection. The acquired immune system reacts to molecular structures, referred to as antigens, of the intruding organism. There are two types of acquired immune reactions, which include the humoral immune reaction and the cell-mediated immune reaction. In the humoral immune reaction, antibodies secreted by B cells into bodily fluids bind to pathogen-derived antigens, leading to the elimination of the pathogen through a variety of mechanisms, e.g. complement-mediated lysis. In the cell-mediated immune reaction, T cells capable of destroying other cells are activated. For example, if proteins associated with a disease are present in a cell, they are fragmented proteolytically to peptides within the cell. Specific cell proteins then attach themselves to the antigen or peptide formed in this manner and transport them to the surface of the cell, where they are presented to the molecular defense mechanisms, in particular T cells, of the body. Cytotoxic T cells recognize these antigens and kill the cells that harbor the antigens.

The molecules that transport and present peptides on the cell surface are referred to as proteins of the major histocompatibility complex (MHC). MHC proteins are classified into two types, referred to as MHC class I and MHC class II. The structures of the proteins of the two MHC classes are very similar; however, they have very different functions. Proteins of MHC class I are present on the surface of almost all cells of the body, including most tumor cells. MHC class I proteins are loaded with antigens that usually originate from endogenous proteins or from pathogens present inside cells, and are then presented to naïve or cytotoxic T-lymphocytes (CTLs). MHC class II proteins are present on dendritic cells, B-lymphocytes, macrophages and other antigen-presenting cells. They mainly present peptides, which are processed from external antigen sources, i.e. outside of the cells, to T-helper (Th) cells. Most of the peptides bound by the MHC class I proteins originate from cytoplasmic proteins produced in the healthy host cells of an organism itself, and do not normally stimulate an immune reaction. Accordingly, cytotoxic T-lymphocytes that recognize such self-peptide-presenting MHC molecules of class I are deleted in the thymus (central tolerance) or, after their release from the thymus, are deleted or inactivated, i.e. tolerized (peripheral tolerance). MHC molecules are capable of stimulating an immune reaction when they present peptides to non-tolerized T-lymphocytes. Cytotoxic T-lymphocytes have both T cell receptors (TCR) and CD8 molecules on their surface. T cell receptors are capable of recognizing and binding peptides complexed with the molecules of MHC class I. Each cytotoxic T-lymphocyte expresses a unique T cell receptor which is capable of binding specific MHC/peptide complexes.

The peptide antigens attach themselves to the molecules of MHC class I by competitive affinity binding within the endoplasmic reticulum, before they are presented on the cell surface. Here, the affinity of an individual peptide antigen is directly linked to its amino acid sequence and the presence of specific binding motifs in defined positions within the amino acid sequence. If the sequence of such a peptide is known, it is possible to manipulate the immune system against diseased cells using, for example, peptide vaccines. The human leukocyte antigen (HLA) system is a gene complex encoding the major histocompatibility complex (MHC) proteins in humans.

By "proteins or molecules of the major histocompatibility complex (MHC)", "MHC molecules", "MHC proteins" or "HLA proteins" is thus meant proteins capable of binding peptides resulting from the proteolytic cleavage of protein antigens and representing potential T-cell epitopes, transporting them to the cell surface and presenting them there to specific cells, in particular cytotoxic T-lymphocytes or T-helper cells. MHC molecules of class I consist of a heavy chain and a light chain and are capable of binding a peptide of about 8 to 11 amino acids, but usually 9 or 10 amino acids, if this peptide has suitable binding motifs, and presenting it to cytotoxic T-lymphocytes. The peptide bound by the MHC molecules of class I originates from an endogenous protein antigen. The heavy chain of the MHC molecules of class I is preferably an HLA-A, HLA-B or HLA-C monomer, and the light chain is β-2-microglobulin (B2M).

The present invention provides methods for predicting peptides capable of binding to HLA alleles. The embodiments take a set of candidate peptide sequences and identify one or more structural features indicative of occupancy of the candidate peptides on the binding pocket of HLA alleles. These structural features are input into a machine learning algorithm model that was trained using structural features extracted from one or more output models simulating occupancy of one or more binding peptides and one or more non-binding peptides on the HLA binding pocket in a crystal structure of the HLA allele or the crystal structure of a similar HLA allele. The structural features can be identified by simulating occupancy of the one or more candidate peptides on the HLA binding pocket in a crystal structure of the HLA allele or the crystal structure of a similar HLA allele. The structural features can be extracted from the output models generated during the simulations. The structural features can also be identified using a machine learning algorithm model that infers occupancy of the one or more candidate peptides on the HLA binding pocket. The inference can be based on the model being trained with simulated models of peptides verified to bind to the HLA allele and verified peptides that do not bind to the HLA allele.

Applicants can train the algorithms with binding peptides previously identified. Applicants utilized a single-allele method to profile naturally presented peptides on HLA molecules via mass spectrometry to collect endogenous ligandome data for 95 HLA-A, B, C and G alleles, identifying >185,000 peptides. In addition, endogenously presented antigens on primary tumor-derived cell lines from 11 patients (3 chronic lymphocytic leukemia, 1 ovarian, 3 glioblastoma, 4 melanoma) were also identified by MS.

Vaccine therapies (e.g., cancer and infections) rely on accurate selection of immunizing peptides to potentiate immune responses (e.g., against tumor-specific neoepitopes or viral epitopes). Given the patient's particular complement of HLA alleles, the ability to predict which epitopes will be presented is a fundamental prerequisite for successful vaccine design. Additionally, given the unique accumulation of mutations in different tumors as well as the patient's particular complement of HLA alleles, the ability to predict which epitopes will be presented is a fundamental prerequisite for successful cancer vaccine design. Additionally, epitopes recognized in autoimmune diseases for patients having specific HLA alleles is a prerequisite for designing treatments aimed at blocking an immune response against the target proteins. Applicants recently showed that prediction of endogenous antigen presentation is greatly improved when models utilize single HLA allele ligandome datasets and integrate intracellular processes such as proteasomal processing and gene expression. Applicants now extend the approach to include structural features.

In some embodiments, an improved prediction method is provided herein for predicting peptides capable of binding to a given HLA molecule based on the crystal structure of the HLA molecule. Models are provided for the prediction of binding peptides, and the models with best performance (highest AUC and PPV values) are disclosed.

Providing One or More Candidate Peptide Sequences

In certain example embodiments, the invention takes as an initial input a candidate peptide or a set of candidate peptides. In certain embodiments, the candidate peptide or set of candidate peptides may be obtained from a subject or group of subjects in need of an immune response or modified immune response. In certain embodiments, candidate peptides can be identified in a peptide sequence database (e.g., derived from sequencing of subjects having a specific condition where an immunogenic composition would be useful).

In certain embodiments, a peptide sequence database includes HLA allele binding and non-binding peptides. Such a database is very useful for predicting suitable HLA-binding peptides, identifying factors which play a role in HLA-peptide presentation and generating a more accurate prediction algorithm for identifying HLA-allele specific binding peptides. Candidate peptides can be isolated and sequenced for each HLA-allele to identify HLA-binding peptides. In particular embodiments, candidate peptides can be obtained by providing a) a population of cells which expresses a single class I HLA allele or a single pair of class II HLA alleles (one a-chain and one β-chain); b) isolating the respective HLA-peptide complexes from said cells; c) isolating peptides from said HLA-peptide complexes; and d) sequencing said peptides. One of the advantages of the present method is the ability to identify a large number of HLA binding peptides which are specific for a particular HLA allele.

The population of cells may express either a single class I HLA allele, a single pair of class II HLA alleles, or a single class I HLA allele and a single pair of class II HLA alleles. Suitable cell populations include, e.g., class I deficient cells lines in which a single HLA class I allele is expressed, class II deficient cell lines in which a single pair of HLA class II alleles are expressed, or class I and class II deficient cell lines in which a single HLA class I and/or single pair of class II alleles are expressed. As an exemplary embodiment, the class I deficient B cell line is B721.221. However, it is clear to a skilled person that other cell populations can be generated which are class I and/or class II deficient. An exemplary method for deleting/inactivating endogenous class I or class II genes includes, CRISPR-Cas9 mediated genome editing.

The population of cells may be professional antigen presenting cells such as macrophages, B cells and dendritic cells. Preferably, the cells are B cells or dendritic cells. In preferred embodiments, the cells are tumor cells or cells from a tumor cell line. In particular embodiments, the cells are cells isolated from a patient. In preferred embodiments, the population of cells comprises at least $10^6$ cells.

In some embodiments, the population of cells are further modified, such as by increasing or decreasing the expression and/or activity of at least one gene. In preferred embodiments, the gene encodes a member of the immunoproteasome. The immunoproteasome is known to be involved in the processing of HLA class I binding peptides and includes the LMP2 (β1i), MECL-1 (β2i), and LMP7 (β5i) subunits. The immunoproteasome can also be induced by interferon-gamma. Accordingly, in some embodiments, the population of cells may be contacted with one or more cytokines, growth factors, or other proteins. Preferably, the cells are stimulated with inflammatory cytokines such as interferon-gamma, IL-Iβ, IL-6, and/or T F-α. The population of cells may also be subjected to various environmental conditions, such as stress (heat stress, oxygen deprivation, glucose starvation, DNA damaging agents, etc.). In some embodiments the cells are contacted with one or more of a chemotherapy drug, radiation, targeted therapies, immunotherapy. The methods disclosed herein can therefore be used to study the effect of various genes or conditions on HLA peptide processing and presentation. In particular embodiments, the conditions used are selected so as to match the condition of the patient for which the population of HLA-peptides is to be identified.

Any HLA allele may be expressed in the cell population. Typically, it will be of interest to sequentially perform the methods provided herein for different HLA alleles, such that resulting datasets can be used in combination. In particular embodiments, the HLA allele is selected so as to correspond to a genotype of interest. In a preferred embodiment, the HLA allele is a mutated HLA allele, which may be non-naturally occurring allele or a naturally occurring allele in an afflicted patient. The methods disclosed herein have the further advantage of identifying HLA binding peptides for HLA alleles associated with various disorders as well as alleles which are present at low frequency. Accordingly, in a preferred method the HLA allele is present at a frequency of less than 1% within a population, such as within the Caucasian population.

Vectors, promoters, etc. for expression. In some embodiments, the nucleic acid sequence encoding the HLA allele further comprises a peptide tag which can be used to immunopurify the HLA-protein. Suitable tags are well-known in the art and include Myc, VSV, V5, His, HA, and FLAG tags.

The methods further comprise isolating HLA-peptide complexes from said cells. In preferred embodiments, the complexes can be isolated using standard immunoprecipitation techniques known in the art with commercially available antibodies. Preferably, the cells are first lysed. HLA class I-peptide complexes can be isolated using HLA class I specific antibodies such as the W6/32 antibody, while HLA class II-peptide complexes can be isolated using HLA class II specific antibodies such as the M5/114.15.2 monoclonal antibody. In some embodiments, the single (or pair of) HLA alleles are expressed as a fusion protein with a peptide tag and the HLA-peptide complexes are isolated using binding molecules that recognize the peptide tags.

The methods further comprise isolating peptides from said HLA-peptide complexes and sequencing the peptides. The peptides are isolated from the complex by any method known to one of skill in the art, such as acid elution. While any sequencing method may be used, methods employing mass spectrometry, such as liquid chromatography-mass spectrometry (LC-MS or LC-MS/MS, or alternatively HPLC-MS or HPLC-MS/MS) are preferred. These sequencing methods are well-known to a skilled person and are reviewed in Medzihradszky K F and Chalkley R J. Mass Spectrom Rev. 2015 January-February; 34(1):43-63.

Typically, an HLA-allele specific binding peptide sequence database comprises at least 1000 different binding peptide sequences.

The methods disclosed herein may also be used to generate a database comprising the HLA-allele specific binding peptide sequences for more than one HLA-allele. In preferred embodiments, the methods comprise performing the step—a)-d) for at least two different HLA-alleles, preferably at least five, more preferably at least 10 different alleles.

In one aspect, the present disclosure provides a plurality of HLA-allele specific binding peptides, or the sequences thereof, which peptides correspond to the peptides which are presented by one specific HLA allele. More particularly, an HLA-allele specific binding peptide sequence database is provided obtained by carrying out the method according to the invention. In particular embodiments, combinations of pluralities of peptides, sets of sequences or databases is provided, represent HLA-allele specific peptides, sets of sequences or databases for different HLA alleles. The combination of databases is also referred to herein as a dataset. These combinations differentiate themselves over prior art datasets in that they represent HLA-specific peptides for each HLA-allele individually rather than combining HLA peptides obtained from a combination of HLA-alleles.

Predicting Peptide Binding to HLA Alleles

In one aspect, the present disclosure provides methods for generating a prediction algorithm for identifying HLA-allele specific binding peptides, which methods comprise training a neural network with one or more peptide sequence databases (i.e.; combinations of databases). In particular embodiments, the methods involve training a machine with one or more peptide sequence databases generated with a method according to the invention. More particularly, the methods comprise training a neural network running on a machine with several peptide sequence databases. In the methods provided herein, the sequences are compared so as to identify prediction algorithms for a peptide to be presented by said HLA-allele. In a preferred embodiment, the methods involve generating models based on predictive variables or features. As used herein, the terms variables and features are used interchangeably.

Generating a prediction algorithm by training a machine is a well-known technique. The most important in the training of the machine is the quality of the database used for the training. Typically, the machine combines one or more linear models, support vector machines, decision trees and/or a neural network.

Machine learning can be generalized as the ability of a learning machine to perform accurately on new, unseen examples/tasks after having experienced a learning data set. Machine learning may include the following concepts and methods. Supervised learning concepts may include AODE; Artificial neural network, such as Backpropagation, Autoencoders, Hopfield networks, Boltzmann machines, Restricted Boltzmann Machines, and Spiking neural networks; Bayesian statistics, such as Bayesian network and Bayesian knowledge base; Case-based reasoning; Gaussian process regression; Gene expression programming; Group method of data handling (GMDH); Inductive logic programming; Instance-based learning; Lazy learning; Learning Automata; Learning Vector Quantization; Logistic Model Tree; Minimum message length (decision trees, decision graphs, etc.), such as Nearest Neighbor Algorithm and Analogical modeling; Probably approximately correct learning (PAC) learning; Ripple down rules, a knowledge acquisition methodology; Symbolic machine learning algorithms; Support vector machines; Random Forests; Ensembles of classifiers, such as Bootstrap aggregating (bagging) and Boosting (meta-algorithm); Ordinal classification; Information fuzzy networks (IFN); Conditional Random Field; ANOVA; Linear classifiers, such as F'sher's linear discriminant, Linear regression, Logistic regression, Multinomial logistic regressnaïveNaive Bayes classifier, Perceptron, Support vector machines; Quadratic classifiers; k-nearest neighbor; Boosting; Decision trees, such as C4.5, Random forests, ID3, CART, SLIQ, SPRINT; Bayesian networksnaïveh as Naive Bayes; and Hidden Markov models. Unsupervised learning concepts may include; Expectation-maximization algorithm; Vector Quantization; Generative topographic map; Information bottleneck method; Artificial neural network, such as Self-organizing map; Association rule learning, such as, Apriori algorithm, Eclat algorithm, and FP-growth algorithm; Hierarchical clustering, such as Single-linkage clustering and Conceptual clustering; Cluster analysis, such as, K-means algorithm, Fuzzy clustering, DBSCAN, and OPTICS algorithm; and Outlier Detection, such as Local Outlier Factor. Semi-supervised learning concepts may include; Generative models; Low-density separation; Graph-based methods; and Co-training. Reinforcement learning concepts may include; Temporal difference learning; Q-learning; Learning Automata; and SARSA. Deep learning concepts may include; Deep belief networks;

Deep Boltzmann machines; Deep Convolutional neural networks; Deep Recurrent neural networks; and Hierarchical temporal memory.

Structural Features of Peptides

In one aspect, the present disclosure provides methods for identifying HLA-allele specific binding peptides, which method comprises analyzing structural features indicative of occupancy of a peptides on the binding pocket of HLA alleles. In certain embodiments, the structural features are amino acid residues capable of fitting a model of peptide occupancy on the binding pocket of HLA alleles (e.g., enrichment in hydrophobicity, exposed hydrophobic surface and charges determined' by the peptide's conformation within the binding pocket, as well as the size and position of the various amino acid side chains). In certain embodiments, the structural features are energetic features that are encoded not by peptide sequence, but by modeled three-dimensional structures of peptide occupancy on the binding pocket of an HLA allele (e.g., energies of attraction, repulsion, and solvation; energies of side chain and backbone hydrogen bonds; and energies and probabilities of side chain and backbone conformations) (see, e.g., Alford R F, Leaver-Fay A, Jeliazkov J R, O'Meara M J, DiMaio F P, Park H, et al. The rosetta all-atom energy function for macromolecular modeling and design. J Chem Theory Comput. (2017) 13:3031-48; and Riley et al., Structure Based Prediction of Neoantigen Immunogenicity. Front Immunol. 2019 Aug. 28; 10:2047). In certain embodiments, the structural features that are extracted are the standard rosetta energy terms (see, e.g., www.rosettacommons.org/docs/latest/rosetta_basics/scoring/score-types) (see, Table 1).

TABLE 1

| | Nonlimiting Energy Terms |
|---|---|
| fa_atr | Lennard-Jones attractive between atoms in different residues. Supports canonical and noncanonical residue types. |
| fa_rep | Lennard-Jones repulsive between atoms in different residues. Supports canonical and noncanonical residue types. |
| fa_sol | Lazaridis-Karplus solvation energy. Supports canonical and noncanonical residue types. |
| fa_intra_rep | Lennard-Jones repulsive between atoms in the same residue. Supports canonical and noncanonical residue types. |
| fa_elec | Coulombic electrostatic potential with a distance-dependent dielectric. Supports canonical and noncanonical residue types. |
| pro_close | Proline ring closure energy and energy of psi angle of preceding residue. Supports D- or L-proline, plus D- or L-oligourea-proline. |
| hbond_sr_bb | Backbone-backbone hbonds close in primary sequence. All hydrogen bonding terms support canonical and noncanonical types. |
| hbond_lr_bb | Backbone-backbone hbonds distant in primary sequence. |
| hbond_bb_sc | Sidechain-backbone hydrogen bond energy. |
| hbond_sc | Sidechain-sidechain hydrogen bond energy. |
| dslf_fa13 | Disulfide geometry potential. Supports D- and L-cysteine disulfides, plus homocysteine disulfides or disulfides involving beta-3-cysteine. |
| rama | Ramachandran preferences. Supports only the 20 canonical alpha-amino acids and their mirror images. |
| omega | Omega dihedral in the backbone. A Harmonic constraint on planarity with standard deviation of ~6 deg. Supports alpha-amino acids, beta-amino acids, and oligoureas. In the case of oligoureas, both amide bonds (called "mu" and "omega" in Rosetta) are constrained to planarity. |
| fa_dun | Internal energy of sidechain rotamers as derived from Dunbrack's statistics (2010 Rotamer Library used in Talaris2013). Supports any residue type for which a rotamer library is avalable. |
| p_aa_pp | Probability of amino acid at $\Phi/\Psi$. Supports only the 20 canonical alpha-amino acids and their mirror images. |
| ref | Reference energy for each amino acid. Balances internal energy of amino acid terms. Plays role in design. Supports only the 20 canonical alpha-amino acids and their mirror images. |

In certain embodiments, the binding pocket is determined by a structural analysis. Non-limiting structural analysis methods include X-ray crystallography and nuclear magnetic resonance (NMR) spectroscopy (see, e.g., Alberts B, Johnson A, Lewis J, et al. Molecular Biology ° f the Cell. 4th edition. New York: Garland Science; 2002. Analyzing Protein Structure and Function). In preferred embodiments, a crystal structure is used to determine the binding pocket. Any HLA-allele crystal structure may be used to simulate occupancy of peptides in the binding pocket. In certain embodiments, a structure is obtained by generating a crystal structure of an HLA-allele. In certain embodiments, the crystal structures for HLA molecules are obtained from a database (e.g., the Protein Data Bank (PDB, www.rcsb.org)). In certain embodiments, structures of similar HLA alleles are used if a structure for the HLA-allele of interest is unavailable or cannot be generated. In certain embodiments, similar HLA-alleles include HLA alleles having the highest similarity between the amino acid sequences of the binding pocket. The similarity of the binding pocket can be computed as the sum of pair-wise residue similarities according to a 20×20 amino acid similarity matrix. In certain embodiments, similar HLA-alleles include HLA alleles having similarity between the binding motifs (i.e. two alleles are considered similar if they bind similar peptides). In certain embodiments, the HLA alleles bind to two or more of the same peptides and do not bind to 2 or more of the same peptides. In certain embodiments, the HLA alleles bind to 10 or more of the same peptides and do not bind to 10 or more of the same peptides. In certain embodiments, similar HLA-alleles include HLA alleles from the same class (e.g., HLA-A, HLA-B, HLA-C, HLA-E, HLA-F, HLA-G, HLA-K and HLA-L). In certain embodiments, similar HLA-alleles include HLA alleles having the highest amino acid sequence identity to the HLA-allele of interest.

In certain embodiments, structural features are identified by simulating models of how the candidate peptides occupy the HLA binding pocket. In certain embodiments, the method comprises analyzing simulations of the occupancy of a peptides on the binding pocket of HLA alleles. In certain embodiments, one or more peptide docking tools are used to generate output models of peptide occupancy on the binding pocket of HLA alleles. In certain embodiments, molecular dynamics simulation is used to generate output models of peptide occupancy on the binding pocket of HLA alleles (see, e.g., Kmiecik et al., Coarse-Grained Protein Models and Their Applications. Chem Rev. 2016 Jul. 27; 116(14): 7898-936). In certain embodiments, output models of peptide occupancy on the binding pocket of HLA alleles is generated by docking, molecular dynamics simulations, protein threading, or combinations of these methods. In certain embodiments, more than one output model is generated by altering the position of the peptide and altering the position of the HLA allele. In certain embodiments, millions of docking models are tested (e.g., approximately 30 million) to generate hundreds of output models (e.g., approximately 200). In certain embodiments, the number of simulations is important for identifying the features of binding and non-binding peptides and not whether an output model or simulation is correct in how the peptide actually binds. Thus, having a large number of simulated output models is required to extract structural features. Non-limiting examples of peptide docking tools include, FlexPepDock, DockTope, pDOCK and HADDOCK (see, e.g., Chaudhury S, Lyskov S, Gray J J. PyRosetta: a script-based interface for implementing molecular modeling algorithms using Rosetta. Bioinformatics. (2010) 26:689-91; O'Meara M J, Leaver-Fay A, Tyka M D, Stein A, Houlihan K, DiMaio F, et al. Combined covalent-electrostatic model of hydrogen bonding improves structure prediction with rosetta. J Chem Theory Comput. (2015) 11:609-22); Rigo, et al., DockTope: a Web-based tool for automated pMHC-I modelling. Sci Rep. 2015 Dec. 17; 5:18413; Khan and Ranganathan, pDOCK: a new technique for rapid and accurate docking of peptide ligands to Major Histocompatibility Complexes. Immunome Res. 2010 Sep. 27; 6 Suppl 1(Suppl 1):52; Liu et al., Subangstrom accuracy in pHLA-I modeling by Rosetta FlexPepDock refinement protocol. J Chem Inf Model. 2014 Aug. 25; 54(8):2233-42; Raveh et al., Rosetta FlexPepDock ab-initio: simultaneous folding, docking and refinement of peptides onto their receptors. PLoS One. 2011 Apr. 29; 6(4):e18934; and Trellet, et al., A unified conformational selection and induced fit approach to protein-peptide docking, PLoS One. 2013; 8(3):e58769). Molecular dynamics simulation includes, but is not limited to coarse-grained Monte Carlo protein-peptide docking (~30 million per peptide)(see, e.g., Bordner A J, Abagyan R. Ab initio prediction of peptide-MHC binding geometry for diverse class I MHC allotypes. Proteins. 2006 May 15; 63(3):512-26).

In certain embodiments, the output models are used to generate structural feature maps. The structural feature maps can then be input into a prediction model that was trained by machine learning. In certain embodiments, a machine learning algorithm (i.e., the prediction model) is trained using feature maps generated from the structural simulations of peptides confirmed to bind to the HLA allele and non-binding peptides. In certain embodiments, a neural network is trained on energetic features that are encoded by the modeled three-dimensional structures of the peptide/HLA-A2 complexes. In certain embodiments, the model is trained using simulations of the peptides identified herein using mono-allelic cell lines. In certain embodiments, a machine is trained with a peptide sequence database obtained by carrying out the method according to the invention for said HLA-allele. In a preferred embodiment, the method comprises using information on the simulated binding outputs as a variable. Thus, in certain embodiments, simulated models generated for binding peptides or non-binding peptides to an HLA allele can be compared to simulated models generated for candidate peptides by a neural network or machine learning algorithm. Based on the simulations obtained the prediction model can determine if the candidate peptide has a certain probability of binding. Peptide binding can be validated by detecting binding of a peptide to the HLA allele using any known in vitro assay or cellular reporter assay.

In one aspect, the present disclosure provides methods for generating a prediction algorithm for identifying HLA-allele specific binding peptides, which methods comprise training a neural network with one or more structural features obtained by modeling occupancy of peptide sequence databases comprising peptides that have been experimentally determined to bind to an HLA allele and to not bind to an HLA allele (i.e., combinations of databases). In particular embodiments, the methods involve training a machine with one or more peptide sequence databases generated with a method according to the invention (i.e., peptides bound to HLA alleles expressed in monoallelic cell lines). More particularly, the methods comprise training a neural network running on a machine with several peptide sequence databases.

In one embodiment, how peptides occupy the HLA binding pocket is computationally simulated. Existing peptide docking protocols can be used with modifications to suit identifying structural features. This can be performed for a number of diverse HLA alleles and peptides and simulate both known binders as well as known non-binders, obtaining multiple high-scoring conformations for each peptide. One drawback of peptide docking techniques is that they are computationally intensive. Therefore, using a large dataset of confidently docked HLA-peptide pairs, machine learning can be used (input peptide sequence, output structure/structural features) to infer how peptides dock and thus be able to very quickly produce the structural features needed for presentation prediction. Machine learning can also be used to quickly produce computational simulations of the docked peptide-MHC structures. Thus, 'the m'del can 'learn' how to produce structural features directly from the peptide and HLA allele sequences.

In another embodiment, a large dataset of structures with both binding and non-binding peptides can be built. Those structures can be used to train a machine learning prediction algorithm that learns what the differentiating features between binders and non-binders are (incorporating signals from the structures as well as signals from the amino acid sequence and properties). With this model trained, it can then be applied to a new candidate peptide to obtain a numerical score that captures how likely the candidate peptide is to be presented by a given HLA allele.

Sequence Specific Features of Peptides

In certain embodiments, the prediction algorithm comprises structural features and non-structural features described herein. In certain embodiments, the structural features are used in combination with sequence only models described herein. In certain embodiments, models incorporating structural and sequence features predict HLA-allele specific binding peptides with higher accuracy than any previously described method.

In certain embodiments, non-structural features are also used as variables (such as sequence, amino acid properties, peptide characteristics). In alternative embodiments, the models also incorporate extrinsic features such as expression and cleavage information. In particular embodiments, the variables used to train the machine comprise one or more predictive variables selected from the group consisting of peptide sequence (e.g., dummy peptide encoding, PCA peptide encoding, Kidera peptide-level features), amino acid physical properties, peptide physical properties, protein stability, protein translation rate, protein degradation rate, translational efficiencies from ribosomal profiling, protein cleavability, protein localization, motifs of host protein that facilitate TAP transport, whether host protein is subject to autophagy, motifs that favor ribosomal stalling (polyproline stretches) and protein features that fa'or NMD (long 3' UTR, stop codon >50 nt upstream of last exon junction) (see, e.g., Kidera, et al., (1985). Statistical analysis of the physical properties of the 20 naturally occurring amino acids. Journal of Protein Chemistry, 4(1), 23-55; and Wang B, Kennedy M A. Principal components analysis of protein sequence clusters. J Struct Funct Genomics. 2014; 15(1):1-11. doi: 10.1007/s10969-014-9173-2). In particular embodiments, at least two of these features are used. In further embodiments, at least 3, 4, 5, 6, 7, 8, 9 or all ten of these features are used. In a preferred embodiment, the variables used to train the machine comprise the expression level of the source protein of a peptide within a cell. In a preferred embodiment, the variables used to train the machine comprise expression level of the source protein of a peptide within a cell, peptide sequence, amino acid physical properties, peptide physical properties, expression level of the source protein of a peptide within a cell, Protein stability, protein translation rate, protein degradation rate, translational efficiencies from ribosomal profiling, protein cleavability, protein localization, motifs of host protein that facilitate TAP transport, host protein is subject to autophagy, motifs that favor ribosomal stalling (polyproline stretches), protein features that favor NMD (long 3' UTR, stop codon >50 nt upstream of last exon junction and peptide cleavability).

In one aspect, the present disclosure provides methods for identifying HLA-allele specific binding peptides, which method comprises analyzing the sequence of a peptide with a machine which has been trained with a peptide sequence database obtained by carrying out the method according to the invention for said HLA-allele. In a preferred embodiment, the method comprises using information on the expression level of the source protein of the peptide within the cell as a variable. In further embodiments, the method comprises determining the expression level of the source protein of the peptide within a cell and using the source protein expression as one of the predictive variables used by the machine. Typically, the expression level is determined by measuring the amount of source protein or the amount of RNA encoding said source protein.

Applicants previously identified that expression and cleavability contribute to the likelihood of presentation independent of the peptide identity (amino acid sequence) or HLA allele. Therefore, a combination of structural and residue properties together with cleavage and expression will improve the overall performance of a model that predicts endogenous antigen presentation. To evaluate the improvements achieved by structural signals amino acid sequence-only models are compared to sequence+structure models. Orthogonal features can then be added to build the final models.

Therapeutic Peptides

It is demonstrated herein that the methods provided herein allow a more effective prediction of HLA-binding peptides than methods of the prior art, with fewer false positives. This is important as the number of immunogenic peptides that can practically be generated in the context of an immune therapy is limited. In particular embodiments, the methods are used to determine an effective neoantigen vaccine. In particular embodiments, the methods are used to determine an effective vaccine against a pathogen. In particular embodiments, the methods are used to determine an effective tolerizing vaccine. In these contexts, it is of interest to determine which peptides forming neoantigens, pathogen antigens, or self-antigens are likely to bind to a subject's HLA so as to effectively function as immunogenic peptides.

Subject specific HLA alleles or HLA genotype of a subject may be determined by any method known in the art. In preferred embodiments, HLA genotypes are determined by any method described in International Patent Application number PCT/US2014/068746, published Jun. 11, 2015 as WO2015085147. Briefly, the methods include determining polymorphic gene types that may comprise generating an alignment of reads extracted from a sequencing data set to a gene reference set comprising allele variants of the polymorphic gene, determining a first posterior probability or a posterior probability derived score for each allele variant in the alignment, identifying the allele variant with a maximum first posterior probability or posterior probability derived score as a first allele variant, identifying one or more overlapping reads that aligned with the first allele variant and one or more other allele variants, determining a second posterior probability or posterior probability derived score for the one or more other allele variants using a weighting factor, identifying a second allele variant by selecting the allele variant with a maximum second posterior probability or posterior probability derived score, the first and second allele variant defining the gene type for the polymorphic gene, and providing an output of the first and second allele variant.

One of the critical barriers to developing curative and tumor-specific immunotherapy is the identification and selection of highly specific and restricted tumor antigens to avoid autoimmunity. Tumor neoantigens, which arise as a result of genetic change (e.g., inversions, translocations, deletions, missense mutations, splice site mutations, etc.) within malignant cells, represent the most tumor-specific class of antigens. Neoantigens have rarely been used in cancer vaccine or immunogenic compositions due to technical difficulties in identifying them, selecting optimized neoantigens, and producing neoantigens for use in a vaccine or immunogenic composition. These problems may be addressed by: identifying mutations in neoplasias/tumors which are present at the DNA level in tumor but not in matched germline samples from a high proportion of subjects having cancer; analyzing the identified mutations with one or more peptide-MHC binding prediction algorithms to generate a plurality of neoantigen T cell epitopes that are expressed within the neoplasia/tumor and that bind to a high proportion of patient HLA alleles; and synthesizing the plurality of neoantigenic peptides selected from the sets of all neoantigen peptides and predicted binding peptides for use in a cancer vaccine or immunogenic composition suitable for treating a high proportion of subjects having cancer.

For example, translating sequencing information into a therapeutic vaccine may include: (1) Prediction of mutated peptides that can bind to HLA molecules of a high proportion of individuals. Efficiently choosing which particular mutations to utilize as immunogen requires the ability to predict which mutated peptides would efficiently bind to a high proportion of patient's HLA alleles. Recently, neural network based learning approaches with validated binding and non-binding peptides have advanced the accuracy of prediction algorithms for the major HLA-A and -B alleles; (2) Formulating the drug as a multi-epitope vaccine of long peptides. Targeting as many mutated epitopes as practically possible takes advantage of the enormous capacity of the immune system, prevents the opportunity for immunological escape by down-modulation of a particular immune targeted gene product, and compensates for the known inaccuracy of epitope prediction approaches. Synthetic peptides provide a particularly useful means to prepare multiple immunogens efficiently and to rapidly translate identification of mutant epitopes to an effective vaccine. Peptides can be readily synthesized chemically and easily purified utilizing reagents free of contaminating bacteria or animal substances. The small size allows a clear focus on the mutated region of the protein and also reduces irrelevant antigenic competition from other components (unmutated protein or viral vector antigens); (3) Combination with a strong vaccine adjuvant. Effective vaccines require a strong adjuvant to initiate an immune response. As described below, poly-ICLC, an agonist of TLR3 and the RNA helicase-domains of MDA5 and RIG3, has shown several desirable properties for a vaccine adjuvant. These properties include the induction of local and systemic activation of immune cells in vivo, production of stimulatory chemokines and cytokines, and stimulation of antigen-presentation by DCs. Furthermore, poly-ICLC can induce durable CD4+ and CD8+ responses in humans. Importantly, striking similarities in the upregulation of transcriptional and signal transduction pathways were seen in subjects vaccinated with poly-ICLC and in volunteers who had received the highly effective, replication-competent yellow fever vaccine. Furthermore, >90% of ovarian carcinoma patients immunized with poly-ICLC in combination with a NYES0-1 peptide vaccine (in addition to Montanide) showed induction of CD4+ and CD8+ T cell, as well as antibody responses to the peptide in a recent phase 1 study. At the same time, polyICLC has been extensively tested in more than 25 clinical trials to date and exhibited a relatively benign toxicity profile.

The application provides improved methods of prediction of peptides, such as mutated peptides, that can bind to HLA molecules of a high proportion of individuals. In particular embodiments, the application provides methods of identifying from a given set of neo-antigen comprising peptides the most suitable peptides for preparing an immunogenic composition for a subject, said method comprising selecting from set given set of peptides the plurality of peptides capable of binding an HLA protein of the subject, wherein said ability to bind an HLA protein is determined by analyzing the sequence of peptides with a machine which has been trained with peptide sequence databases corresponding to the specific HLA-binding peptides for each of the HLA-alleles of said subject. More particularly, the application provides methods of identifying from a given set of neo-antigen comprising peptides the most suitable peptides for preparing an immunogenic composition for a subject, said method comprising selecting from set given set of peptides the plurality of peptides determined as capable of binding an HLA protein of the subject, ability to bind an HLA protein is determined by analyzing the sequence of peptides with a machine which has been trained with a peptide sequence database obtained by carrying out the methods described herein above. Thus, in particular embodiments, the application provides methods of identifying a plurality of subject-specific peptides for preparing a subject-specific immunogenic composition, wherein the subject has a tumor and the subject-specific peptides are specific to the subject and the subject's tumor, said method comprising: whole genome or whole exome nucleic acid sequencing of a sample of the subject's tumor and a non-tumor sample of the subject; determining based on the whole genome or whole exome nucleic acid sequencing, non-silent mutations present in the genome of cancer cells of the subject but not in normal tissue from the subject, and the HLA genotype of the subject, wherein the non-silent mutations comprise a point, splice-site, frameshift, read-through or gene-fusion mutation; and selecting from the identified non-silent mutations the plurality of subject-specific peptides, each having a different tumor neo-epitope that is an epitope specific to the tumor of the subject and each being identified as capable of binding an HLA protein of the subject, as determined by analyzing the sequence of peptides derived from the non-silent mutations in the methods for predicting HLA binding described herein.

In particular embodiments, the methods are used to determine whether or not a peptide will bind to an HLA protein. In further embodiments, the methods provide a predictive score indicative of binding an HLA protein of the subject.

Thus, in particular embodiments, the application provides methods of identifying a plurality of subject-specific peptides for preparing a subject-specific immunogenic composition, said method comprising selecting a plurality of subject-specific peptides, each having a different tumor neo-epitope that is an epitope specific to the tumor of the subject and each having a predictive score indicative of binding an HLA protein of the subject, wherein said predictive score is determined by analyzing the sequence of peptides derived from the non-silent mutations by carrying out the method of predicting HLA-binding described herein.

In particular embodiments, the cell used in the method for determining HLA binding as described herein is an antigen-presenting cell.

Neoantigens

In certain embodiments, tumor antigens that bind to HLA alleles are identified or predicted. In certain embodiments, the tumor antigens are neoantigens. In a further aspect, the invention provides methods for identifying tumor neoantigen-comprising peptides, wherein the methods comprise identifying for a given HLA allele, the peptides binding said HLA allele in a tumor cell from a tumor of a patient.

As described herein, there is a large body of evidence in both animals and humans that mutated epitopes are effective in inducing an immune response and that cases of spontaneous tumor regression or long term survival correlate with CD8+ T cell responses to mutated epitopes (Buckwalter and Srivastava P K. "It is the antigen(s), stupid" and other lessons from over a decade of vaccine therapy of human cancer. Seminars in immunology 20:296-300 (2008); Karanikas et al, High frequency of cytolytic T lymphocytes directed against a tumor-specific mutated antigen detectable with HLA tetramers in the blood of a lung carcinoma patient with long survival. Cancer Res. 61:3718-3724 (2001); Lennerz et al, The response of autologous T cells to a human melanoma is dominated by mutated neoantigens. Proc Natl Acad Sci USA. 102: 16013 (2005)) and that "immunoediting" can be tracked to alterations in expression of dominant mutated antigens in mice and man (Matsushita et al, Cancer exome analysis reveals a T-cell-dependent mechanism of cancer immunoediting Nature 482:400 (2012); DuPage et al, Expression of tumor-specific antigens underlies cancer immunoediting Nature 482:405 (2012); and Sampson et al, Immunologic escape after prolonged progression-free survival with epidermal growth factor receptor variant III peptide vaccination in patients with newly diagnosed glioblastoma J Clin Oncol. 28:4722-4729 (2010)).

Sequencing technology has revealed that each tumor contains multiple, patient-specific mutations that alter the protein coding content of a gene. Such mutations create altered proteins, ranging from single amino acid changes (caused by missense mutations) to addition of long regions of novel amino acid sequence due to frame shifts, read-through of termination codons or translation of intron regions (novel open reading frame mutations; neoORFs). These mutated proteins are valuable targets for the host's immune response to the tumor as, unlike native proteins, they are not subject to the immune-dampening effects of self-tolerance. Therefore, mutated proteins are more likely to be immunogenic and are also more specific for the tumor cells compared to normal cells of the patient. The mutated proteins can be referred to as neoantigens. The term "neoantigen" or "neoantigenic" means a class of tumor antigens that arises from a tumor-specific mutation(s) which alters the amino acid sequence of genome encoded proteins.

Embodiments disclosed herein provide a method of identifying peptides, e.g., neoantigens, including, but not limited to novel unannotated open reading frames (nuORFs), that are capable of eliciting a cancer specific T cell response (see, e.g., WO2020131586A2). Genomic aberrations in cancer cells give rise to mutant peptides (neoantigens) displayed on the human leukocyte antigen (HLA) molecules and recognized by T cells, thus triggering an immune response against cancer cells. Patients vaccinated with neoantigen-based peptides display expanded neoantigen-specific T cells, suggesting that this could be a promising avenue for cancer treatment (Ott et al., An immunogenic personal neoantigen vaccine or patients with melanoma, Nature 2017 Jul 13; 547(7662):217-221; Sahin et al., 2017 Personalized RNA mutanome vaccines mobilize poly-specific therapeutic immunity against cancer", Nature, vol. 547, 2017, pages 222-226). Neoantigens are commonly predicted based on mutations detected by whole exome sequencing (WES). Their expression levels are estimated using mRNA sequencing (RNA-seq). Ribosome profiling (Ribo-seq) allows to monitor mRNA translation, and has been used to predict a plethora of translated novel unannotated ORFs (nuORFs) (Fields et al., 2015. A Regression-Based Analysis of Ribosome-Profiling Data Reveals a Conserved Complexity to Mammalian Translation, Mol Cell, vol. 60, pages 816-827; Ji et al., 2015. Many lncRNAs, 5'UTRs, and pseudogenes are translated and some are likely to express functional proteins, ELIFE, vol. 4). Ribo-seq analysis of human fibroblasts infected with HSV-1 and HCMV has identified nuORFs that contribute peptides presented on major histocompatibility complex class I (MHC I) (Erhard et al., 2018. Improved Ribo-seq enables identification of cryptic translation events, Nat. Methods, vol. 15, no. 5, pages 363-366).

The present invention provides for improved HLA epitope prediction, methods and products for use therein. Provided herein are methods and tools for improved HLA epitope prediction. These are of interest, for example, for use in the production of suitable neoantigen-comprising peptides as described further herein.

The prediction tools can be used to select subject specific peptides that are presented by a tumor for any neoplasia. By "neoplasia" is meant any disease that is caused by or results in inappropriately high levels of cell division, inappropriately low levels of apoptosis, or both. For example, cancer is an example of a neoplasia. Examples of cancers include, without limitation, leukemia (e.g., acute leukemia, acute lymphocytic leukemia, acute myelocytic leukemia, acute myeloblastic leukemia, acute promyelocytic leukemia, acute myelomonocytic leukemia, acute monocytic leukemia, acute erythroleukemia, chronic leukemia, chronic myelocytic leukemia, chronic lymphocytic leukemia), polycythemia vera, lymphoma (e.g., Hodgkin's disease, non-Hodgkin's disease), Waldenstrom's macroglobulinemia, heavy chain disease, and solid tumors such as sarcomas and carcinomas (e.g., fibrosarcoma, myxosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, colon carcinoma, pancreatic cancer, breast cancer, ovarian cancer, prostate cancer, squamous cell carcinoma, basal cell carcinoma, adenocarcinoma, sweat gland carcinoma, sebaceous gland carcinoma, papillary carcinoma, papillary adenocarcinomas, cystadenocarcinoma, medullary carcinoma, bronchogenic carcinoma, renal cell carcinoma, hepatoma, bile duct carcinoma, choriocarcinoma, seminoma, embryonal carcinoma, Wilm's tumor, cervical cancer, uterine cancer, testicular cancer, lung carcinoma, small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, schwannoma, meningioma, melanoma, neuroblastoma, and retinoblastoma). Lymphoproliferative disorders are also considered to be proliferative diseases.

Autoimmune Diseases

In certain embodiments, self-antigen peptides that bind to HLA alleles are identified or predicted. In certain embodiments, the self-antigens are aberrantly targeted by the host immune system. As used throughout the present specification, the terms "autoimmune disease" or "autoimmune disorder" are used interchangeably refer to a diseases or disorders caused by an immune response against a self-tissue or tissue component (self-antigen) and include a self-antibody response and/or cell-mediated response. The terms encompass organ-specific autoimmune diseases, in which an autoimmune response is directed against a single tissue, as well as non-organ specific autoimmune diseases, in which an autoimmune response is directed against a component present in two or more, several or many organs throughout the body.

Examples of autoimmune diseases include but are not limited to acute disseminated encephalomyelitis (ADEM); Addison's disease; ankylosing spondylitis; antiphospholipid antibody syndrome (APS); aplastic anemia; autoimmune gastritis; autoimmune hepatitis; autoimmune thrombocytopenia; Behçet's disease; coeliac disease; dermatomyositis; diabetes mellitus type I; Goodpasture's syndrome; Graves' disease; Guillain-Barre syndrome (GBS); Hashimoto's disease; idiopathic thrombocytopenic purpura; inflammatory bowel disease (IBD) including Crohn's disease and ulcerative colitis; mixed connective tissue disease; multiple sclerosis (MS); myasthenia gravis; opsoclonus myoclonus syndrome (OMS); optic neuritis; Ord's thyroiditis; pemphigus; pernicious anaemia; polyarteritis nodosa; polymyositis; primary biliary cirrhosis; primary myxedema; psoriasis; rheumatic fever; rheumatoid arthritis; Reiter's syndrome; scleroderma; Sjogren's syndrome; systemic lupus erythematosus; Takayasu's arteritis; temporal arteritis; vitiligo; warm autoimmune hemolytic anemia; or Wegener's granulomatosis.

Infections

In certain embodiments, peptides arising from an infectious agent (e.g., virus, bacteria, or any pathogen) that bind to subject specific HLA alleles are identified or predicted. In certain embodiments, the infectious agent mutates to express peptides capable of binding different HLA-alleles. Thus, peptides for generating an immunological composition or vaccine require prediction of novel peptide binding to subject specific HLA alleles.

Examples of pathogenic bacteria include without limitation any one or more of (or any combination of) *Acinetobacter baumannii, Actinobacillus* sp., *Actinomycetes, Actinomyces* sp. (such as *Actinomyces israelii* and *Actinomyces naeslundii*), *Aeromonas* sp. (such as *Aeromonas hydrophila, Aeromonas veronii* biovar *sobria* (*Aeromonas sobria*), and *Aeromonas caviae*), *Anaplasma phagocytophilum, Anaplasma marginale, Alcaligenes xylosoxidans, Acinetobacter baumannii, Actinobacillus actinomycetemcomitans, Bacillus* sp. (such as *Bacillus anthracis, Bacillus cereus, Bacillus subtilis, Bacillus thuringiensis,* and *Bacillus stearothermophilus*), *Bacteroides* sp. (such as *Bacteroides fragilis*), *Bartonella* sp. (such as *Bartonella bacilliformis* and *Bartonella henselae*), *Bifidobacterium* sp., *Bordetella* sp. (such as *Bordetella pertussis, Bordetella parapertussis,* and *Bordetella bronchiseptica*), *Borrelia* sp. (such as *Borrelia recurrentis,* and *Borrelia burgdorferi*), *Brucella* sp. (such as *Brucella abortus, Brucella canis, Brucella melitensis* and *Brucella suis*), *Burkholderia* sp. (such as *Burkholderia pseudomallei* and *Burkholderia cepacia*), *Campylobacter* sp. (such as *Campylobacter jejuni, Campylobacter coli, Campylobacter lari* and *Campylobacter fetus*), *Capnocytophaga* sp., *Cardiobacterium hominis, Chlamydia trachomatis, Chlamydophila pneumoniae, Chlamydophila psittaci, Citrobacter* sp. *Coxiella burnetii, Corynebacterium* sp. (such as, *Corynebacterium diphtheriae, Corynebacterium jeikeium* and *Corynebacterium*), *Clostridium* sp. (such as *Clostridium perfringens, Clostridium difficile, Clostridium botulinum* and *Clostridium tetani*), *Eikenella corrodens, Enterobacter* sp. (such as *Enterobacter aerogenes, Enterobacter agglomerans, Enterobacter cloacae* and *Escherichia coli,* including opportunistic *Escherichia coli,* such as enterotoxigenic *E. coli,* enteroinvasive *E. coli,* enteropathogenic *E. coli,* enterohemorrhagic *E. coli,* enteroaggregative *E. coli* and uropathogenic *E. coli*) *Enterococcus* sp. (such as *Enterococcus faecalis* and *Enterococcus faecium*) *Ehrlichia* sp. (such as *Ehrlichia chaffeensis* and *Ehrlichia canis*), *Erysipelothrix rhusiopathiae, Eubacterium* sp., *Francisella tularensis, Fusobacterium nucleatum, Gardnerella vaginalis, Gemella morbillorum, Haemophilus* sp. (such as *Haemophilus influenzae, Haemophilus ducreyi, Haemophilus aegyptius, Haemophilus parainfluenzae, Haemophilus haemolyticus* and *Haemophilus parahaemolyticus*), *Helicobacter* sp. (such as *Helicobacter pylori, Helicobacter cinaedi* and *Helicobacter fennelliae*), *Kingella kingae, Klebsiella* sp. (such as *Klebsiella pneumoniae, Klebsiella granulomatis* and *Klebsiella oxytoca*), *Lactobacillus* sp., *Listeria monocytogenes, Leptospira interrogans, Legionella pneumophila, Leptospira interrogans, Peptostreptococcus* sp., *Mannheimia haemolytica, Moraxella catarrhalis, Morganella* sp., *Mobiluncus* sp., *Micrococcus* sp., *Mycobacterium* sp. (such as *Mycobacterium leprae, Mycobacterium tuberculosis, Mycobacterium paratuberculosis, Mycobacterium intracellulare, Mycobacterium avium, Mycobacterium bovis,* and *Mycobacterium marinum*), *Mycoplasma* sp. (such as *Mycoplasma pneumoniae, Mycoplasma hominis,* and *Mycoplasma genitalium*), *Nocardia* sp. (such as *Nocardia asteroides, Nocardia cyriacigeorgica* and *Nocardia brasiliensis*), *Neisseria* sp. (such as *Neisseria gonorrhoeae* and *Neisseria meningitidis*), *Pasteurella multocida, Plesiomonas shigelloides. Prevotella* sp., *Porphyromonas* sp., *Prevotella melaninogenica, Proteus* sp. (such as *Proteus vulgaris* and *Proteus mirabilis*), *Providencia* sp. (such as *Providencia alcalifaciens, Providencia rettgeri* and *Providencia stuartii*), *Pseudomonas aeruginosa, Propionibacterium acnes, Rhodococcus equi, Rickettsia* sp. (such as *Rickettsia rickettsii, Rickettsia akari* and *Rickettsia prowazekii, Orientia tsutsugamushi* (formerly: *Rickettsia tsutsugamushi*) and *Rickettsia typhi*), *Rhodococcus* sp., *Serratia marcescens, Stenotrophomonas maltophilia, Salmonella* sp. (such as *Salmonella enterica, Salmonella typhi, Salmonella paratyphi, Salmonella enteritidis, Salmonella choleraesuis* and *Salmonella typhimurium*), *Serratia* sp. (such as *Serratia marcescens* and *Serratia liquefaciens*), *Shigella* sp. (such as *Shigella dysenteriae, Shigella flexneri, Shigella boydii* and *Shigella sonnei*), *Staphylococcus* sp. (such as *Staphylococcus aureus, Staphylococcus epidermidis, Staphylococcus haemolyticus, Staphylococcus saprophyticus*), *Streptococcus* sp. (such as *Streptococcus pneumoniae* (for example chloramphenicol-resistant serotype 4 *Streptococcus pneumoniae,* spectinomycin-resistant serotype 6B *Streptococcus pneumoniae,* streptomycin-resistant serotype 9V *Streptococcus pneumoniae,* erythromycin-resistant serotype 14 *Streptococcus pneumoniae,* optochin-resistant serotype 14 *Streptococcus pneumoniae,* rifampicin-resistant serotype 18C *Streptococcus pneumoniae,* tetracycline-resistant serotype 19F *Streptococcus pneumoniae,* penicillin-resistant serotype 19F *Streptococcus pneumoniae,* and trimethoprim-resistant serotype 23F *Streptococcus pneumoniae,* chloramphenicol-resistant serotype 4 *Streptococcus pneumoniae,* spectinomycin-resistant serotype 6B *Streptococcus pneumoniae,* streptomycin-resistant serotype 9V *Streptococcus pneumoniae,* optochin-resistant serotype 14 *Streptococcus pneumoniae,* rifampicin-resistant serotype 18C *Streptococcus pneumo-* niae, penicillin-resistant serotype 19F *Streptococcus pneumoniae*, or trimethoprim-resistant serotype 23F *Streptococcus pneumoniae*), *Streptococcus agalactiae, Streptococcus mutans, Streptococcus pyogenes,* Group A streptococci, *Streptococcus pyogenes,* Group B streptococci, *Streptococcus agalactiae,* Group C streptococci, *Streptococcus anginosus, Streptococcus equisimilis,* Group D streptococci, *Streptococcus bovis,* Group F streptococci, and *Streptococcus anginosus* Group G streptococci), *Spirillum minus, Streptobacillus moniliformis, Treponema* sp. (such as *Treponema carateum, Treponema pertenue, Treponema pallidum* and *Treponema endemicum*), *Tropheryma whippelii, Ureaplasma urealyticum, Veillonella* sp., *Vibrio* sp. (such as *Vibrio cholerae, Vibrio parahemolyticus, Vibrio vulnificus, Vibrio parahaemolyticus, Vibrio vulnificus, Vibrio alginolyticus, Vibrio mimicus, Vibrio hollisae, Vibrio fluvialis, Vibrio metschnikovii, Vibrio damsela* and *Vibrio furnissii*), *Yersinia* sp. (such as *Yersinia enterocolitica, Yersinia pestis,* and *Yersinia pseudotuberculosis*) and *Xanthomonas maltophilia* among others.

Examples of fungi include without limitation any one or more of (or any combination of), *Aspergillus, Blastomyces, Candidiasis, Coccidioidomycosis, Cryptococcus neoformans, Cryptococcus gattii, Histoplasma, Mucormycosis, Pneumocystis, Sporothrix,* fungal eye infections ringwork, *Exserohilum,* and *Cladosporium.* In certain example embodiments, the fungus is a yeast. Examples of yeast include without limitation one or more of (or any combination of), *Aspergillus* species, a *Geotrichum* species, a *Saccharomyces* species, a *Hansenula* species, a *Candida* species, a *Kluyveromyces* species, a *Debaryomyces* species, a *Pichia* species, or combination thereof. In certain example embodiments, the fungus is a mold. Example molds include, but are not limited to, a *Penicillium* species, a *Cladosporium* species, a *Byssochlamys* species, or a combination thereof.

In certain example embodiments, the pathogen may be a virus. The virus may be a DNA virus, a RNA virus, or a retrovirus. Example of RNA viruses include one or more of (or any combination of) Coronaviridae virus, a Picornaviridae virus, a Caliciviridae virus, a Flaviviridae virus, a Togaviridae virus, a Bornaviridae, a Filoviridae, a Paramyxoviridae, a Pneumoviridae, a Rhabdoviridae, an Arenaviridae, a Bunyaviridae, an Orthomyxoviridae, or a Deltavirus. In certain example embodiments, the virus is Coronavirus, SARS, Poliovirus, Rhinovirus, Hepatitis A, Norwalk virus, Yellow fever virus, West Nile virus, Hepatitis C virus, Dengue fever virus, Zika virus, Rubella virus, Ross River virus, Sindbis virus, Chikungunya virus, Borna disease virus, Ebola virus, Marburg virus, Measles virus, Mumps virus, Nipah virus, Hendra virus, Newcastle disease virus, Human respiratory syncytial virus, Rabies virus, Lassa virus, Hantavirus, Crimean-Congo hemorrhagic fever virus, Influenza, or Hepatitis D virus.

In certain example embodiments, the virus may be a retrovirus. Example retroviruses include one or more of or any combination of viruses of the Genus Alpharetrovirus, Betaretrovirus, Gammaretrovirus, Deltaretrovirus, Epsilonretrovirus, Lentivirus, Spumavirus, or the Family Metaviridae, Pseudoviridae, and Retroviridae (including HIV), Hepadnaviridae (including Hepatitis B virus), and Caulimoviridae (including Cauliflower mosaic virus).

In certain example embodiments, the virus is a DNA virus. Example DNA viruses that include one or more of (or any combination of) viruses from the Family Myoviridae, Podoviridae, Siphoviridae, Alloherpesviridae, Herpesviridae (including human herpes virus, and Varicella Zoster virus), Maloca herpesviridae, Lipothrixviridae, Rudiviridae, Adenoviridae, Ampullaviridae, Ascoviridae, Asfarviridae (including African swine fever virus), Baculoviridae, Coronaviridae, Clavaviridae, Corticoviridae, Fusellovididae, Globuloviridae, Guttaviridae, Hytrosaviridae, Iridoviridae, Marseille viridae, Mimiviridae, Nudiviridae, Nimaviridae, Pandoraviridae, Papillomaviridae, Phycodnaviridae, Plasmaviridae, Polydnaviruses, Polyomaviridae (including Simian virus 40, JC virus, BK virus), Poxviridae (including Cowpox and smallpox), Sphaerolipoviridae, Tectiviridae, Turriviridae, Dinodnavirus, Salterprovirus, Rhinovirus, among others.

In certain example embodiments, the pathogen may be a protozoon. Examples of protozoa include without limitation any one or more of (or any combination of), Euglenozoa, Heterolobosea, Diplomonadida, Amoebozoa, *Blastocystis,* and Apicomplexa. Example Euglenozoa include, but are not limited to, *Trypanosoma cruzi* (Chagas disease), *T. brucei gambiense, T. brucei rhodesiense, Leishmania braziliensis, L. infantum, L. mexicana, L. major, L. tropica,* and *L. donovani.* Example Heterolobosea include, but are not limited to, *Naegleria fowleri.* Example Diplomonadida include, but are not limited to, Giardia intestinalis (*G. lamblia, G. duodenalis*). Example Amoebozoa include, but are not limited to, *Acanthamoeba castellanii, Balamuthia mandrillaris, Entamoeba histolytica.* Example *Blastocystis* include, but are not limited to, *Blastocystis hominis.* Example Apicomplexa include, but are not limited to, *Babesia microti, Cryptosporidium parvum, Cyclospora cayetanensis, Plasmodium falciparum, P. vivax, P. ovale, P. malariae,* and *Toxoplasma gondii.*

Therapeutic Compositions and Methods of Use
Vaccines and Immunological Compositions In certain embodiments, the peptides identified according to the present invention are used in a vaccine or immunological composition to treat any disease or condition described herein (e.g., tumor, autoimmunity, infection, transplant). The term "vaccine" or "immunological composition" are used interchangeably and are meant to refer in the present context to a pooled sample of one or more antigenic peptides, for example at least one, at least two, at least three, at least four, at least five, or more antigenic peptides. A "vaccine" is to be understood as including a protective vaccine, which is a composition for generating immunity for the prophylaxis and/or treatment of diseases (e.g., neoplasia/tumor). A "vaccine" is also to be understood as including a tolerizing vaccine, which is a composition for reducing immunity for the prophylaxis and/or treatment of diseases (e.g., autoimmune disease). A tolerizing vaccine may be formulated with antigenic epitopes specific for an allergen or for an autoimmunity antigen identified according to the present invention. A protective vaccine may be formulated with antigenic epitopes specific for a pathogen or for a cancer cell. Accordingly, vaccines are medicaments which comprise antigens and are intended to be used in humans or animals for generating specific defense and protective substance by vaccination. A "vaccine composition" can include a pharmaceutically acceptable excipient, carrier or diluent.

The vaccine may include one or more peptides identified according to the present invention. For example, 1 to 10 peptides. Ranges provided herein are understood to be shorthand for all of the values within the range. For example, a range of 1 to 50 is understood to include any number, combination of numbers, or sub-range from the group consisting of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50. With respect to sub-ranges, "nested sub-ranges"

that extend from either end point of the range are specifically contemplated. For example, a nested sub-range of an exemplary range of 1 to 50 may comprise 1 to 10, 1 to 20, 1 to 30, and 1 to 40 in one direction, or 50 to 40, 50 to 30, 50 to 20, and 50 to 10 in the other direction.

As used herein, the terms "prevent," "preventing," "prevention," "prophylactic treatment," and the like, refer to reducing the probability of developing a disease or condition in a subject, who does not have, but is at risk of or susceptible to developing a disease or condition.

The vaccine of the present invention may ameliorate a disease as described herein. By "ameliorate" is meant decrease, suppress, attenuate, diminish, arrest, or stabilize the development or progression of a disease (e.g., a neoplasia, tumor, autoimmunity, infection, etc.).

The terms "treat," "treated," "treating," "treatment," and the like are meant to refer to reducing or ameliorating a disorder and/or symptoms associated therewith (e.g., a neoplasia or tumor). "Treating" may refer to administration of the therapy to a subject after the onset, or suspected onset, of a cancer. "Treating" includes the concepts of "alleviating", which refers to lessening the frequency of occurrence or recurrence, or the severity, of any symptoms or other ill effects related to a cancer and/or the side effects associated with cancer therapy. The term "treating" also encompasses the concept of "managing" which refers to reducing the severity of a particular disease or disorder in a patient or delaying its recurrence, e.g., lengthening the period of remission in a patient who had suffered from the disease. It is appreciated that, although not precluded, treating a disorder or condition does not require that the disorder, condition, or symptoms associated therewith be completely eliminated.

The term "therapeutic effect" refers to some extent of relief of one or more of the symptoms of a disorder (e.g., a neoplasia or tumor) or its associated pathology. "Therapeutically effective amount" as used herein refers to an amount of an agent which is effective, upon single or multiple dose administration to the cell or subject, in prolonging the survivability of the patient with such a disorder, reducing one or more signs or symptoms of the disorder, preventing or delaying, and the like beyond that expected in the absence of such treatment. "Therapeutically effective amount" is intended to qualify the amount required to achieve a therapeutic effect. A physician or veterinarian having ordinary skill in the art can readily determine and prescribe the "therapeutically effective amount" (e.g., ED50) of the pharmaceutical composition required. For example, the physician or veterinarian could start doses of the compounds of the invention employed in a pharmaceutical composition at levels lower than that required in order to achieve the desired therapeutic effect and gradually increase the dosage until the desired effect is achieved.

In certain embodiments, a protective vaccine is used to treat cancer. Additional examples of cancers and cancer conditions that can be treated with the therapy of this document include, but are not limited to a patient in need thereof that has been diagnosed as having cancer, or at risk of developing cancer. The subject may have a solid tumor such as breast, ovarian, prostate, lung, kidney, gastric, colon, testicular, head and neck, pancreas, brain, melanoma, and other tumors of tissue organs and hematological tumors, such as lymphomas and leukemias, including acute myelogenous leukemia, chronic myelogenous leukemia, chronic lymphocytic leukemia, T cell lymphocytic leukemia, and B cell lymphomas, tumors of the brain and central nervous system (e.g., tumors of the meninges, brain, spinal cord, cranial nerves and other parts of the CNS, such as glioblastomas or medulla blastomas); head and/or neck cancer, breast tumors, tumors of the circulatory system (e.g., heart, mediastinum and pleura, and other intrathoracic organs, vascular tumors, and tumor-associated vascular tissue); tumors of the blood and lymphatic system (e.g., Hodgkin's disease, Non-Hodgkin's disease lymphoma, Burkitt's lymphoma, AIDS-related lymphomas, malignant immunoproliferative diseases, multiple myeloma, and malignant plasma cell neoplasms, lymphoid leukemia, myeloid leukemia, acute or chronic lymphocytic leukemia, monocytic leukemia, other leukemias of specific cell type, leukemia of unspecified cell type, unspecified malignant neoplasms of lymphoid, hematopoietic and related tissues, such as diffuse large cell lymphoma, T cell lymphoma or cutaneous T cell lymphoma); tumors of the excretory system (e.g., kidney, renal pelvis, ureter, bladder, and other urinary organs); tumors of the gastrointestinal tract (e.g., esophagus, stomach, small intestine, colon, colorectal, rectosigmoid junction, rectum, anus, and anal canal); tumors involving the liver and intrahepatic bile ducts, gall bladder, and other parts of the biliary tract, pancreas, and other digestive organs; tumors of the oral cavity (e.g., lip, tongue, gum, floor of mouth, palate, parotid gland, salivary glands, tonsil, oropharynx, nasopharynx, pyriform sinus, hypopharynx, and other sites of the oral cavity); tumors of the reproductive system (e.g., vulva, vagina, Cervix uteri, uterus, ovary, and other sites associated with female genital organs, placenta, penis, prostate, testis, and other sites associated with male genital organs); tumors of the respiratory tract (e.g., nasal cavity, middle ear, accessory sinuses, larynx, trachea, bronchus and lung, such as small cell lung cancer and non-small cell lung cancer); tumors of the skeletal system (e.g., bone and articular cartilage of limbs, bone articular cartilage and other sites); tumors of the skin (e.g., malignant melanoma of the skin, non-melanoma skin cancer, basal cell carcinoma of skin, squamous cell carcinoma of skin, mesothelioma, Kaposi's sarcoma); and tumors involving other tissues including peripheral nerves and autonomic nervous system, connective and soft tissue, retroperitoneum and peritoneum, eye, thyroid, adrenal gland, and other endocrine glands and related structures, secondary and unspecified malignant neoplasms of lymph nodes, secondary malignant neoplasm of respiratory and digestive systems and secondary malignant neoplasm of other sites. Thus the population of subjects described herein may be suffering from one of the above cancer types. In other embodiments, the population of subjects may be all subjects suffering from solid tumors, or all subjects suffering from liquid tumors.

Of special interest is the treatment of Non-Hodgkin's Lymphoma (NHL), clear cell Renal Cell Carcinoma (ccRCC), metastatic melanoma, sarcoma, leukemia or a cancer of the bladder, colon, brain, breast, head and neck, endometrium, lung, ovary, pancreas or prostate. In certain embodiments, the melanoma is high risk melanoma.

Cancers that can be treated using the therapy described herein may include among others cases which are refractory to treatment with other chemotherapeutics. The term "refractory, as used herein refers to a cancer (and/or metastases thereof), which shows no or only weak antiproliferative response (e.g., no or only weak inhibition of tumor growth) after treatment with another chemotherapeutic agent. These are cancers that cannot be treated satisfactorily with other chemotherapeutics. Refractory cancers encompass not only (i) cancers where one or more chemotherapeutics have already failed during treatment of a patient, but also (ii) cancers that can be shown to be refractory by other means, e.g., biopsy and culture in the presence of chemotherapeutics.

The therapy described herein is also applicable to the treatment of patients in need thereof who have not been previously treated.

The therapy described herein is also applicable where the subject has no detectable neoplasia but is at high risk for disease recurrence.

Also of special interest is the treatment of patients in need thereof who have undergone Autologous Hematopoietic Stem Cell Transplant (AHSCT), and in particular patients who demonstrate residual disease after undergoing AHSCT. The post-AHSCT setting is characterized by a low volume of residual disease, the infusion of immune cells to a situation of homeostatic expansion, and the absence of any standard relapse-delaying therapy. These features provide a unique opportunity to use the claimed neoplastic vaccine or immunogenic composition compositions to delay disease relapse.

In certain embodiments, the vaccine as described herein can promote tolerance or dampen an inappropriate, unwanted, or undesirable immune response, thereby permitting treatment of autoimmune disease, as described herein, and/or conditions associated with transplants (e.g., graft vs. host disease). Immune tolerance, or immunological tolerance, or immunotolerance, is a state of unresponsiveness of the immune system to substances or tissue that have the capacity to elicit an immune response in given organism. Immune recognition of non-self-antigens typically complicates transplantation and engrafting of foreign tissue from an organism of the same species (allografts), resulting in graft reaction. In certain embodiments, a state of tolerance can be induced, either by previous exposure to the antigen of the donor in a manner that causes immune tolerance rather than sensitization in the recipient. Antigen-specific immune tolerance (ASI) is a promising approach to treat or prevent autoimmune disorders, however, there is a need to identify proper peptides (see, e.g., Shakya and Nandakumar, Antigen-Specific Tolerization and Targeted Delivery as Therapeutic Strategies for Autoimmune Diseases. Trends Biotechnol. 2018 July; 36(7):686-699; and Pozsgay et al., Antigen-specific immunotherapies in rheumatic diseases. Nat Rev Rheumatol. 2017 September; 13(9):525-537). In certain embodiments, approaches include the use of tolerizing peptides coupled to MHC constructs and/or nanocompounds, tolerizing dendritic cells (see, e.g., Wei et al., Development and Functional Characterization of Murine Tolerogenic Dendritic Cells. J Vis Exp. 2018 May 18; (135)), and antigen-specific vaccines.

The present invention is based, at least in part, on the ability to present the immune system of the patient with one or more HLA allele specific peptides. In certain embodiments, the immune system of the patient is presented with a pool of tumor specific neoantigens. The application further provides novel neoantigenic peptides identified by the methods provided herein. Accordingly, provided herein are immunogenic compositions comprising a peptide having a sequence selected from $XLXX_4XX_6X_7XX_9$ (SEQ ID NO:30); wherein one or more of $X_4$ is E or D, $X_6$ is L, V, or I, $X_7$ is I, V, or A, and X is L or V, and wherein X is any amino acid; $XLXDXXX_7XX_9$ (SEQ ID NO:31), wherein one or more of $X_7$ is L and $X_9$ is Y or F, and wherein X is any amino acid; $XX_2X_3X_4XXXXY$ (SEQ ID NO:32), wherein one or more of $X_2$ is T, S, or L, $X_3$ is D or E and $X_7$ is I, V, or A, and wherein X is any amino acid; $XLXXXX_6XXX_9$ (SEQ ID NO:33); wherein one or more of $X_6$ is L or V and $X_9$ is V or L, and wherein X is any amino acid; $XLXX_4XX_6XXX_9$ (SEQ ID NO:34), wherein one or more of $X_4$ is E or D, $X_6$ is L or V and $X_9$ is V or L, and wherein X is any amino acid; $XLDXXXXX_9$ (SEQ ID NO:35), wherein $X_9$ is L or V, and wherein X is any amino acid; $XXXXXXLXX_9$ (SEQ ID NO:36), wherein one or more of $X_2$ is L or V and $X_9$ is K, Y or R, and wherein X is any amino acid; $XiX_2XXXXXXR$ (SEQ ID NO:37), wherein one or more of $X_1$ is R or A and $X_2$ is V or L, and wherein X is any amino acid; $EX_2XXXXXXX_9$ (SEQ ID NO:38), wherein one or more of $X_2$ is V, T, or A and X is V or L, and wherein X is any amino acid; $XX_2XRXXXXX_9$ (SEQ ID NO:39), wherein one or more of $X_2$ is P or A and $X_9$ is Y, F, or L, and wherein X is any amino acid; $X_1EXXLXXXX_9$ (SEQ ID NO:40), wherein one or more of $X_1$ is A or E and $X_9$ is F, W, or L, and wherein X is any amino acid; $X_1EXXLXLXX_9$ (SEQ ID NO:41), wherein one or more of $X_1$ is A or E and $X_9$ is F, W, or L, and wherein X is any amino acid; $DX_2XXXXXXX_9$ (SEQ ID NO:42), wherein one or more of $X_2$ is P or A and $X_9$ is I, V, or L, and wherein X is any amino acid; and $X_1YXXXXXXX_9$ (SEQ ID NO:43), wherein one or more of $X_1$ is M, W, or V and $X_9$ is F or L, and wherein X is any amino acid.

Producing Antigenic Peptides

One of skill in the art from this disclosure and the knowledge in the art will appreciate that there are a variety of ways in which to produce such tumor specific neoantigens or any other antigens. In general, such tumor specific neoantigens or antigens may be produced either in vitro or in vivo. Tumor specific neoantigens or antigens may be produced in vitro as peptides or polypeptides, which may then be formulated into a neoplasia vaccine or immunogenic composition and administered to a subject. As described in further detail herein, such in vitro production may occur by a variety of methods known to one of skill in the art such as, for example, peptide synthesis or expression of a peptide/polypeptide from a DNA or RNA molecule in any of a variety of bacterial, eukaryotic, or viral recombinant expression systems, followed by purification of the expressed peptide/polypeptide. Alternatively, tumor specific neoantigens or antigens may be produced in vivo by introducing molecules (e.g., DNA, RNA, viral expression systems, and the like) that encode tumor specific neoantigens or antigens into a subject, whereupon the encoded tumor specific neoantigens or antigens are expressed. The methods of in vitro and in vivo production of neoantigens or antigens is also further described herein as it relates to pharmaceutical compositions and methods of delivery of the therapy. By an isolated "polypeptide" or "peptide" is meant a polypeptide that has been separated from components that naturally accompany it. Typically, the polypeptide is isolated when it is at least 60%, by weight, free from the proteins and naturally-occurring organic molecules with which it is naturally associated. Preferably, the preparation is at least 75%, more preferably at least 90%, and most preferably at least 99%, by weight, a polypeptide. An isolated polypeptide may be obtained, for example, by extraction from a natural source, by expression of a recombinant nucleic acid encoding such a polypeptide; or by chemically synthesizing the protein. Purity can be measured by any appropriate method, for example, column chromatography, polyacrylamide gel electrophoresis, or by HPLC analysis.

In certain embodiments, the present invention includes modified neoantigenic or antigenic peptides. As used herein in reference to peptides, the terms "modified", "modification" and the like refer to one or more changes that enhance a desired property of the antigenic peptide, where the change does not alter the primary amino acid sequence of the antigenic peptide. "Modification" includes a covalent chemical modification that does not alter the primary amino acid sequence of the neoantigenic peptide itself. Such desired properties include, for example, prolonging the in vivo half-life, increasing the stability, reducing the clearance, altering the immunogenicity or allergenicity, enabling the raising of particular antibodies, cellular targeting, antigen uptake, antigen processing, MHC affinity, MHC stability, or antigen presentation. Changes to an antigenic peptide that may be carried out include, but are not limited to, conjugation to a carrier protein, conjugation to a ligand, conjugation to an antibody, PEGylation, polysialylation HESylation, recombinant PEG mimetics, Fc fusion, albumin fusion, nanoparticle attachment, nanoparticulate encapsulation, cholesterol fusion, iron fusion, acylation, amidation, glycosylation, side chain oxidation, phosphorylation, biotinylation, the addition of a surface active material, the addition of amino acid mimetics, or the addition of unnatural amino acids. Modified peptides also include analogs. By "analog" is meant a molecule that is not identical, but has analogous functional or structural features. For example, a tumor specific neo-antigen polypeptide analog retains the biological activity of a corresponding naturally-occurring tumor specific neo-antigen polypeptide, while having certain biochemical modifications that enhance the analog's function relative to a naturally-occurring polypeptide. Such biochemical modifications could increase the analog's protease resistance, membrane permeability, or half-life, without altering, for example, ligand binding. An analog may include an unnatural amino acid.

The recitation of a listing of chemical groups in any definition of a variable herein includes definitions of that variable as any single group or combination of listed groups. The recitation of an embodiment for a variable or aspect herein includes that embodiment as any single embodiment or in combination with any other embodiments or portions thereof.

Modified peptides may include a spacer or a linker. The terms "spacer" or "linker" as used in reference to a fusion protein refers to a peptide that joins the proteins comprising a fusion protein. Generally, a spacer has no specific biological activity other than to join or to preserve some minimum distance or other spatial relationship between the proteins or RNA sequences. However, in certain embodiments, the constituent amino acids of a spacer may be selected to influence some property of the molecule such as the folding, net charge, or hydrophobicity of the molecule.

Suitable linkers for use in an embodiment of the present invention are well known to those of skill in the art and include, but are not limited to, straight or branched-chain carbon linkers, heterocyclic carbon linkers, or peptide linkers. The linker is used to separate two neoantigenic peptides by a distance sufficient to ensure that, in a preferred embodiment, each neoantigenic peptide properly folds. Preferred peptide linker sequences adopt a flexible extended conformation and do not exhibit a propensity for developing an ordered secondary structure. Typical amino acids in flexible protein regions include Gly, Asn and Ser. Virtually any permutation of amino acid sequences containing Gly, Asn and Ser would be expected to satisfy the above criteria for a linker sequence. Other near neutral amino acids, such as Thr and Ala, also may be used in the linker sequence. Still other amino acid sequences that may be used as linkers are disclosed in Maratea et al. (1985), Gene 40: 39-46; Murphy et al. (1986) Proc. Nat'l. Acad. Sci. USA 83: 8258-62; U.S. Pat. Nos. 4,935,233; and 4,751,180.

The clinical effectiveness of protein therapeutics is often limited by short plasma half-life and susceptibility to protease degradation. Studies of various therapeutic proteins (e.g., filgrastim) have shown that such difficulties may be overcome by various modifications, including conjugating or linking the polypeptide sequence to any of a variety of non-proteinaceous polymers, e.g., polyethylene glycol (PEG), polypropylene glycol, or polyoxyalkylenes (see, for example, typically via a linking moiety covalently bound to both the protein and the nonproteinaceous polymer, e.g., a PEG). Such PEG-conjugated biomolecules have been shown to possess clinically useful properties, including better physical and thermal stability, protection against susceptibility to enzymatic degradation, increased solubility, longer in vivo circulating half-life and decreased clearance, reduced immunogenicity and antigenicity, and reduced toxicity.

PEGs suitable for conjugation to a polypeptide sequence are generally soluble in water at room temperature, and have the general formula $R(O-CH_2-CH_2)_nO-R$, where R is hydrogen or a protective group such as an alkyl or an alkanol group, and where n is an integer from 1 to 1000. When R is a protective group, it generally has from 1 to 8 carbons. The PEG conjugated to the polypeptide sequence can be linear or branched. Branched PEG derivatives, "star-PEGs" and multi-armed PEGs are contemplated by the present disclosure. A molecular weight of the PEG used in the present disclosure is not restricted to any particular range, but certain embodiments have a molecular weight between 500 and 20,000 while other embodiments have a molecular weight between 4,000 and 10,000. The present disclosure also contemplates compositions of conjugates wherein the PEGs have different n values and thus the various different PEGs are present in specific ratios. For example, some compositions comprise a mixture of conjugates where n=1, 2, 3 and 4. In some compositions, the percentage of conjugates where n=1 is 18-25%, the percentage of conjugates where n=2 is 50-66%, the percentage of conjugates where n=3 is 12-16%, and the percentage of conjugates where n=4 is up to 5%. Such compositions can be produced by reaction conditions and purification methods know in the art. For example, cation exchange chromatography may be used to separate conjugates, and a fraction is then identified which contains the conjugate having, for example, the desired number of PEGs attached, purified free from unmodified protein sequences and from conjugates having other numbers of PEGs attached.

PEG may be bound to a polypeptide of the present disclosure via a terminal reactive group (a "spacer"). The spacer is, for example, a terminal reactive group which mediates a bond between the free amino or carboxyl groups of one or more of the polypeptide sequences and polyethylene glycol. The PEG having the spacer which may be bound to the free amino group includes N-hydroxysuccinimide polyethylene glycol which may be prepared by activating succinic acid ester of polyethylene glycol with N-hydroxysuccinimide. Another activated polyethylene glycol which may be bound to a free amino group is 2,4-bis(0-methoxypolyethyleneglycol)-6-chloro-s-triazine which may be prepared by reacting polyethylene glycol monomethyl ether with cyanuric chloride. The activated polyethylene glycol which is bound to the free carboxyl group includes polyoxyethylenediamine.

Conjugation of one or more of the polypeptide sequences of the present disclosure to PEG having a spacer may be carried out by various conventional methods. For example, the conjugation reaction can be carried out in solution at a pH of from 5 to 10, at temperature from 4° C. to room temperature, for 30 minutes to 20 hours, utilizing a molar ratio of reagent to protein of from 4:1 to 30:1. Reaction conditions may be selected to direct the reaction towards producing predominantly a desired degree of substitution. In general, low temperature, low pH (e.g., pH=5), and short reaction time tend to decrease the number of PEGs attached, whereas high temperature, neutral to high pH (e.g., pH>7), and longer reaction time tend to increase the number of PEGs attached. Various means known in the art may be used to terminate the reaction. In some embodiments the reaction is terminated by acidifying the reaction mixture and freezing at, e.g., −20° C.

The present disclosure also contemplates the use of PEG Mimetics. Recombinant PEG mimetics have been developed that retain the attributes of PEG (e.g., enhanced serum half-life) while conferring several additional advantageous properties. By way of example, simple polypeptide chains (comprising, for example, Ala, Glu, Gly, Pro, Ser and Thr) capable of forming an extended conformation similar to PEG can be produced recombinantly already fused to the peptide or protein drug of interest (e.g., Amunix' XTEN technology; Mountain View, CA). This obviates the need for an additional conjugation step during the manufacturing process. Moreover, established molecular biology techniques enable control of the side chain composition of the polypeptide chains, allowing optimization of immunogenicity and manufacturing properties.

For purposes of the present disclosure, "glycosylation" is meant to broadly refer to the enzymatic process that attaches glycans to proteins, lipids or other organic molecules. The use of the term "glycosylation" in conjunction with the present disclosure is generally intended to mean adding or deleting one or more carbohydrate moieties (either by removing the underlying glycosylation site or by deleting the glycosylation by chemical and/or enzymatic means), and/or adding one or more glycosylation sites that may or may not be present in the native sequence. In addition, the phrase includes qualitative changes in the glycosylation of the native proteins involving a change in the nature and proportions of the various carbohydrate moieties present. Glycosylation can dramatically affect the physical properties of proteins and can also be important in protein stability, secretion, and subcellular localization. Proper glycosylation can be essential for biological activity. In fact, some genes from eucaryotic organisms, when expressed in bacteria (e.g., *E. coli*) which lack cellular processes for glycosylating proteins, yield proteins that are recovered with little or no activity by virtue of their lack of glycosylation.

Addition of glycosylation sites can be accomplished by altering the amino acid sequence. The alteration to the polypeptide may be made, for example, by the addition of, or substitution by, one or more serine or threonine residues (for O-linked glycosylation sites) or asparagine residues (for N-linked glycosylation sites). The structures of N-linked and O-linked oligosaccharides and the sugar residues found in each type may be different. One type of sugar that is commonly found on both is N-acetylneuraminic acid (hereafter referred to as sialic acid). Sialic acid is usually the terminal residue of both N-linked and O-linked oligosaccharides and, by virtue of its negative charge, may confer acidic properties to the glycoprotein. A particular embodiment of the present disclosure comprises the generation and use of N-glycosylation variants.

The polypeptide sequences of the present disclosure may optionally be altered through changes at the DNA level, particularly by mutating the DNA encoding the polypeptide at preselected bases such that codons are generated that will translate into the desired amino acids. Another means of increasing the number of carbohydrate moieties on the polypeptide is by chemical or enzymatic coupling of glycosides to the polypeptide.

Removal of carbohydrates may be accomplished chemically or enzymatically, or by substitution of codons encoding amino acid residues that are glycosylated. Chemical deglycosylation techniques are known, and enzymatic cleavage of carbohydrate moieties on polypeptides can be achieved by the use of a variety of endo- and exo-glycosidases.

Dihydrofolate reductase (DHFR)—deficient Chinese Hamster Ovary (CHO) cells are a commonly used host cell for the production of recombinant glycoproteins. These cells do not express the enzyme beta-galactoside alpha-2,6-sialyltransferase and therefore do not add sialic acid in the alpha-2,6 linkage to N-linked oligosaccharides of glycoproteins produced in these cells.

The present disclosure also contemplates the use of polysialylation, the conjugation of peptides and proteins to the naturally occurring, biodegradable a-(2→8) linked polysialic acid ("PSA") in order to improve their stability and in vivo pharmacokinetics. PSA is a biodegradable, non-toxic natural polymer that is highly hydrophilic, giving it a high apparent molecular weight in the blood which increases its serum half-life. In addition, polysialylation of a range of peptide and protein therapeutics has led to markedly reduced proteolysis, retention of activity in vivo activity, and reduction in immunogenicity and antigenicity (see, e.g., G. Gregoriadis et al., Int. J. Pharmaceutics 300(1-2): 125-30). As with modifications with other conjugates (e.g., PEG), various techniques for site-specific polysialylation are available (see, e.g., T. Lindhout et al., PNAS 108(18)7397-7402 (2011)).

Additional suitable components and molecules for conjugation include, for example, thyroglobulin; albumins such as human serum albumin (HAS); tetanus toxoid; Diphtheria toxoid; polyamino acids such as poly(D-lysine:D-glutamic acid); VP6 polypeptides of rotaviruses; influenza virus hemagglutinin, influenza virus nucleoprotein; Keyhole Limpet Hemocyanin (KLH); and hepatitis B virus core protein and surface antigen; or any combination of the foregoing.

Fusion of albumin to one or more polypeptides of the present disclosure can, for example, be achieved by genetic manipulation, such that the DNA coding for HSA, or a fragment thereof, is joined to the DNA coding for the one or more polypeptide sequences. Thereafter, a suitable host can be transformed or transfected with the fused nucleotide sequences in the form of, for example, a suitable plasmid, so as to express a fusion polypeptide. The expression may be effected in vitro from, for example, prokaryotic or eukaryotic cells, or in vivo from, for example, a transgenic organism. In some embodiments of the present disclosure, the expression of the fusion protein is performed in mammalian cell lines, for example, CHO cell lines. Transformation is used broadly herein to refer to the genetic alteration of a cell resulting from the direct uptake, incorporation and expression of exogenous genetic material (exogenous DNA) from its surroundings and taken up through the cell membrane(s). Transformation occurs naturally in some species of bacteria, but it can also be effected by artificial means in other cells.

Furthermore, albumin itself may be modified to extend its circulating half-life. Fusion of the modified albumin to one or more Polypeptides can be attained by the genetic manipulation techniques described above or by chemical conjugation; the resulting fusion molecule has a half-life that exceeds that of fusions with non-modified albumin. (See WO2011/051489).

Several albumin—binding strategies have been developed as alternatives for direct fusion, including albumin binding through a conjugated fatty acid chain (acylation). Because serum albumin is a transport protein for fatty acids, these natural ligands with albumin-binding activity have been used for half-life extension of small protein therapeutics. For example, insulin detemir (LEVEMIR), an approved product for diabetes, comprises a myristyl chain conjugated to a genetically-modified insulin, resulting in a long-acting insulin analog.

Another type of modification is to conjugate (e.g., link) one or more additional components or molecules at the N- and/or C-terminus of a polypeptide sequence, such as another protein (e.g., a protein having an amino acid sequence heterologous to the subject protein), or a carrier molecule. Thus, an exemplary polypeptide sequence can be provided as a conjugate with another component or molecule. A conjugate modification may result in a polypeptide sequence that retains activity with an additional or complementary function or activity of the second molecule. For example, a polypeptide sequence may be conjugated to a molecule, e.g., to facilitate solubility, storage, in vivo or shelf half-life or stability, reduction in immunogenicity, delayed or controlled release in vivo, etc. Other functions or activities include a conjugate that reduces toxicity relative to an unconjugated polypeptide sequence, a conjugate that targets a type of cell or organ more efficiently than an unconjugated polypeptide sequence, or a drug to further counter the causes or effects associated with a disorder or disease as set forth herein (e.g., diabetes).

A Polypeptide may also be conjugated to large, slowly metabolized macromolecules such as proteins; polysaccharides, such as sepharose, agarose, cellulose, cellulose beads; polymeric amino acids such as polyglutamic acid, polylysine; amino acid copolymers; inactivated virus particles; inactivated bacterial toxins such as toxoid from diphtheria, tetanus, cholera, leukotoxin molecules; inactivated bacteria; and dendritic cells.

Additional candidate components and molecules for conjugation include those suitable for isolation or purification. Particular non-limiting examples include binding molecules, such as biotin (biotin-avidin specific binding pair), an antibody, a receptor, a ligand, a lectin, or molecules that comprise a solid support, including, for example, plastic or polystyrene beads, plates or beads, magnetic beads, test strips, and membranes.

Purification methods such as cation exchange chromatography may be used to separate conjugates by charge difference, which effectively separates conjugates into their various molecular weights. For example, the cation exchange column can be loaded and then washed with ~20 mM sodium acetate, pH ~4, and then eluted with a linear (0 M to 0.5 M) NaCl gradient buffered at a pH from about 3 to 5.5, e.g., at pH ~4.5. The content of the fractions obtained by cation exchange chromatography may be identified by molecular weight using conventional methods, for example, mass spectroscopy, SDS-PAGE, or other known methods for separating molecular entities by molecular weight.

In certain embodiments, the amino- or carboxyl-terminus of a polypeptide sequence of the present disclosure can be fused with an immunoglobulin Fc region (e.g., human Fc) to form a fusion conjugate (or fusion molecule). Fc fusion conjugates have been shown to increase the systemic half-life of biopharmaceuticals, and thus the biopharmaceutical product may require less frequent administration. Fc binds to the neonatal Fc receptor (FcRn) in endothelial cells that line the blood vessels, and, upon binding, the Fc fusion molecule is protected from degradation and re-released into the circulation, keeping the molecule in circulation longer. This Fc binding is believed to be the mechanism by which endogenous IgG retains its long plasma half-life. More recent Fc-fusion technology links a single copy of a biopharmaceutical to the Fc region of an antibody to optimize the pharmacokinetic and pharmacodynamic properties of the biopharmaceutical as compared to traditional Fc-fusion conjugates.

The present disclosure contemplates the use of other modifications, currently known or developed in the future, of the Polypeptides to improve one or more properties. One such method for prolonging the circulation half-life, increasing the stability, reducing the clearance, or altering the immunogenicity or allergenicity of a polypeptide of the present disclosure involves modification of the polypeptide sequences by hesylation, which utilizes hydroxyethyl starch derivatives linked to other molecules in order to modify the molecule's characteristics. Various aspects of hesylation are described in, for example, U.S. Patent Appln. Nos. 2007/0134197 and 2006/0258607.

In Vitro Peptide/Polypeptide Synthesis

Proteins or peptides may be made by any technique known to those of skill in the art, including the expression of proteins, polypeptides or peptides through standard molecular biological techniques, the isolation of proteins or peptides from natural sources, in vitro translation, or the chemical synthesis of proteins or peptides. The nucleotide and protein, polypeptide and peptide sequences corresponding to various genes have been previously disclosed, and may be found at computerized databases known to those of ordinary skill in the art. One such database is the National Center for Biotechnology Information's Genbank and GenPept databases located at the National Institutes of Health website. The coding regions for known genes may be amplified and/or expressed using the techniques disclosed herein or as would be known to those of ordinary skill in the art. Alternatively, various commercial preparations of proteins, polypeptides and peptides are known to those of skill in the art.

Peptides can be readily synthesized chemically utilizing reagents that are free of contaminating bacterial or animal substances (Merrifield R B: Solid phase peptide synthesis. I. The synthesis of a tetrapeptide. J. Am. Chem. Soc. 85:2149-54, 1963). In certain embodiments, neoantigenic peptides are prepared by (1) parallel solid-phase synthesis on multichannel instruments using uniform synthesis and cleavage conditions; (2) purification over a RP-HPLC column with column stripping; and re-washing, but not replacement, between peptides; followed by (3) analysis with a limited set of the most informative assays. The Good Manufacturing Practices (GMP) footprint can be defined around the set of peptides for an individual patient, thus requiring suite changeover procedures only between syntheses of peptides for different patients.

Alternatively, a nucleic acid (e.g., a polynucleotide) encoding a neoantigenic peptide of the invention may be used to produce the neoantigenic peptide in vitro. The polynucleotide may be, e.g., DNA, cDNA, PNA, CNA, RNA, either single- and/or double-stranded, or native or stabilized forms of polynucleotides, such as e.g. polynucleotides with a phosphorothioate backbone, or combinations thereof and it may or may not contain introns so long as it codes for the peptide. In one embodiment in vitro translation is used to produce the peptide. Many exemplary systems exist that one skilled in the art could utilize (e.g., Retic Lysate IVT Kit, Life Technologies, Waltham, MA).

An expression vector capable of expressing a polypeptide can also be prepared. Expression vectors for different cell types are well known in the art and can be selected without undue experimentation. Generally, the DNA is inserted into an expression vector, such as a plasmid, in proper orientation and correct reading frame for expression. If necessary, the DNA may be linked to the appropriate transcriptional and translational regulatory control nucleotide sequences recognized by the desired host (e.g., bacteria), although such controls are generally available in the expression vector. The vector is then introduced into the host bacteria for cloning using standard techniques (see, e.g., Sambrook et al. (1989) Molecular Cloning, A Laboratory Manual, Cold Spring Harbor Laboratory, Cold Spring Harbor, N.Y.).

Expression vectors comprising the isolated polynucleotides, as well as host cells containing the expression vectors, are also contemplated. The neoantigenic peptides may be provided in the form of RNA or cDNA molecules encoding the desired neoantigenic peptides. One or more neoantigenic peptides of the invention may be encoded by a single expression vector.

The term "polynucleotide encoding a polypeptide" encompasses a polynucleotide which includes only coding sequences for the polypeptide as well as a polynucleotide which includes additional coding and/or non-coding sequences. Polynucleotides can be in the form of RNA or in the form of DNA. DNA includes cDNA, genomic DNA, and synthetic DNA; and can be double-stranded or single-stranded, and if single stranded can be the coding strand or non-coding (anti-sense) strand.

In embodiments, the polynucleotides may comprise the coding sequence for the tumor specific neoantigenic peptide fused in the same reading frame to a polynucleotide which aids, for example, in expression and/or secretion of a polypeptide from a host cell (e.g., a leader sequence which functions as a secretory sequence for controlling transport of a polypeptide from the cell). The polypeptide having a leader sequence is a preprotein and can have the leader sequence cleaved by the host cell to form the mature form of the polypeptide.

In embodiments, the polynucleotides can comprise the coding sequence for the tumor specific neoantigenic peptide fused in the same reading frame to a marker sequence that allows, for example, for purification of the encoded polypeptide, which may then be incorporated into the personalized neoplasia vaccine or immunogenic composition. For example, the marker sequence can be a hexa-histidine tag supplied by a pQE-9 vector to provide for purification of the mature polypeptide fused to the marker in the case of a bacterial host, or the marker sequence can be a hemagglutinin (HA) tag derived from the influenza hemagglutinin protein when a mammalian host (e.g., COS-7 cells) is used. Additional tags include, but are not limited to, Calmodulin tags, FLAG tags, Myc tags, S tags, SBP tags, Softag 1, Softag 3, V5 tag, Xpress tag, Isopeptag, SpyTag, Biotin Carboxyl Carrier Protein (BCCP) tags, GST tags, fluorescent protein tags (e.g., green fluorescent protein tags), maltose binding protein tags, Nus tags, Strep-tag, thioredoxin tag, TC tag, Ty tag, and the like.

In embodiments, the polynucleotides may comprise the coding sequence for one or more of the tumor specific neoantigenic peptides fused in the same reading frame to create a single concatamerized neoantigenic peptide construct capable of producing multiple neoantigenic peptides.

In certain embodiments, isolated nucleic acid molecules having a nucleotide sequence at least 60% identical, at least 65% identical, at least 70% identical, at least 75% identical, at least 80% identical, at least 85% identical, at least 90% identical, at least 95% identical, or at least 96%, 97%, 98% or 99% identical to a polynucleotide encoding a tumor specific neoantigenic peptide of the present invention, can be provided. By a polynucleotide having a nucleotide sequence at least, for example, 95% "identical" to a reference nucleotide sequence is intended that the nucleotide sequence of the polynucleotide is identical to the reference sequence except that the polynucleotide sequence can include up to five point mutations per each 100 nucleotides of the reference nucleotide sequence. In other words, to obtain a polynucleotide having a nucleotide sequence at least 95% identical to a reference nucleotide sequence, up to 5% of the nucleotides in the reference sequence can be deleted or substituted with another nucleotide, or a number of nucleotides up to 5% of the total nucleotides in the reference sequence can be inserted into the reference sequence. These mutations of the reference sequence can occur at the amino- or carboxy-terminal positions of the reference nucleotide sequence or anywhere between those terminal positions, interspersed either individually among nucleotides in the reference sequence or in one or more contiguous groups within the reference sequence.

As a practical matter, whether any particular nucleic acid molecule is at least 80% identical, at least 85% identical, at least 90% identical, and in some embodiments, at least 95%, 96%, 97%, 98%, or 99% identical to a reference sequence can be determined conventionally using known computer programs such as the Bestfit program (Wisconsin Sequence Analysis Package, Version 8 for Unix, Genetics Computer Group, University Research Park, 575 Science Drive, Madison, WI 53711). Bestfit uses the local homology algorithm of Smith and Waterman, Advances in Applied Mathematics 2:482-489 (1981), to find the best segment of homology between two sequences. When using Bestfit or any other sequence alignment program to determine whether a particular sequence is, for instance, 95% identical to a reference sequence according to the present invention, the parameters are set such that the percentage of identity is calculated over the full length of the reference nucleotide sequence and that gaps in homology of up to 5%>of the total number of nucleotides in the reference sequence are allowed.

The isolated tumor specific neoantigenic peptides described herein can be produced in vitro (e.g., in the laboratory) by any suitable method known in the art. Such methods range from direct protein synthetic methods to constructing a DNA sequence encoding isolated polypeptide sequences and expressing those sequences in a suitable transformed host. In some embodiments, a DNA sequence is constructed using recombinant technology by isolating or synthesizing a DNA sequence encoding a wild-type protein of interest. Optionally, the sequence can be mutagenized by site-specific mutagenesis to provide functional analogs thereof. See, e.g. Zoeller et al., Proc. Nat'l. Acad. Sci. USA 81:5662-5066 (1984) and U.S. Pat. No. 4,588,585.

In embodiments, a DNA sequence encoding a polypeptide of interest would be constructed by chemical synthesis using an oligonucleotide synthesizer. Such oligonucleotides can be designed based on the amino acid sequence of the desired polypeptide and selecting those codons that are favored in the host cell in which the recombinant polypeptide of interest is produced. Standard methods can be applied to synthesize an isolated polynucleotide sequence encoding an isolated polypeptide of interest. For example, a complete amino acid sequence can be used to construct a back-translated gene. Further, a DNA oligomer containing a nucleotide sequence coding for the particular isolated polypeptide can be synthesized. For example, several small oligonucleotides coding for portions of the desired polypeptide can be synthesized and then ligated. The individual oligonucleotides typically contain 5' or 3' overhangs for complementary assembly.

Once assembled (e.g., by synthesis, site-directed mutagenesis, or another method), the polynucleotide sequences encoding a particular isolated polypeptide of interest is inserted into an expression vector and optionally operatively linked to an expression control sequence appropriate for expression of the protein in a desired host. Proper assembly can be confirmed by nucleotide sequencing, restriction mapping, and expression of a biologically active polypeptide in a suitable host. As well known in the art, in order to obtain high expression levels of a transfected gene in a host, the gene can be operatively linked to transcriptional and translational expression control sequences that are functional in the chosen expression host.

Recombinant expression vectors may be used to amplify and express DNA encoding the tumor specific neoantigenic peptides. Recombinant expression vectors are replicable DNA constructs which have synthetic or cDNA-derived DNA fragments encoding a tumor specific neoantigenic peptide or a bioequivalent analog operatively linked to suitable transcriptional or translational regulatory elements derived from mammalian, microbial, viral or insect genes. A transcriptional unit generally comprises an assembly of (1) a genetic element or elements having a regulatory role in gene expression, for example, transcriptional promoters or enhancers, (2) a structural or coding sequence which is transcribed into mRNA and translated into protein, and (3) appropriate transcription and translation initiation and termination sequences, as described in detail herein. Such regulatory elements can include an operator sequence to control transcription. The ability to replicate in a host, usually conferred by an origin of replication, and a selection gene to facilitate recognition of transformants can additionally be incorporated. DNA regions are operatively linked when they are functionally related to each other. For example, DNA for a signal peptide (secretory leader) is operatively linked to DNA for a polypeptide if it is expressed as a precursor which participates in the secretion of the polypeptide; a promoter is operatively linked to a coding sequence if it controls the transcription of the sequence; or a ribosome binding site is operatively linked to a coding sequence if it is positioned so as to permit translation. Generally, operatively linked means contiguous, and in the case of secretory leaders, means contiguous and in reading frame. Structural elements intended for use in yeast expression systems include a leader sequence enabling extracellular secretion of translated protein by a host cell. Alternatively, where recombinant protein is expressed without a leader or transport sequence, it can include an N-terminal methionine residue. This residue can optionally be subsequently cleaved from the expressed recombinant protein to provide a final product.

Useful expression vectors for eukaryotic hosts, especially mammals or humans include, for example, vectors comprising expression control sequences from SV40, bovine papilloma virus, adenovirus and cytomegalovirus. Useful expression vectors for bacterial hosts include known bacterial plasmids, such as plasmids from *Escherichia coli*, including pCR 1, pBR322, pMB9 and their derivatives, wider host range plasmids, such as Ml 3 and filamentous single-stranded DNA phages.

Suitable host cells for expression of a polypeptide include prokaryotes, yeast, insect or higher eukaryotic cells under the control of appropriate promoters. Prokaryotes include gram negative or gram positive organisms, for example *E. coli* or bacilli. Higher eukaryotic cells include established cell lines of mammalian origin. Cell-free translation systems could also be employed. Appropriate cloning and expression vectors for use with bacterial, fungal, yeast, and mammalian cellular hosts are well known in the art (see Pouwels et al., Cloning Vectors: A Laboratory Manual, Elsevier, N.Y., 1985).

Various mammalian or insect cell culture systems are also advantageously employed to express recombinant protein. Expression of recombinant proteins in mammalian cells can be performed because such proteins are generally correctly folded, appropriately modified and completely functional. Examples of suitable mammalian host cell lines include the COS-7 lines of monkey kidney cells, described by Gluzman (Cell 23: 175, 1981), and other cell lines capable of expressing an appropriate vector including, for example, L cells, C127, 3T3, Chinese hamster ovary (CHO), 293, HeLa and BHK cell lines. Mammalian expression vectors can comprise nontranscribed elements such as an origin of replication, a suitable promoter and enhancer linked to the gene to be expressed, and other 5' or 3' flanking nontranscribed sequences, and 5' or 3' nontranslated sequences, such as necessary ribosome binding sites, a polyadenylation site, splice donor and acceptor sites, and transcriptional termination sequences. Baculovirus systems for production of heterologous proteins in insect cells are reviewed by Luckow and Summers, Bio/Technology 6:47 (1988).

The proteins produced by a transformed host can be purified according to any suitable method. Such standard methods include chromatography (e.g., ion exchange, affinity and sizing column chromatography, and the like), centrifugation, differential solubility, or by any other standard technique for protein purification. Affinity tags such as hexahistidine, maltose binding domain, influenza coat sequence, glutathione-S-transferase, and the like can be attached to the protein to allow easy purification by passage over an appropriate affinity column. Isolated proteins can also be physically characterized using such techniques as proteolysis, nuclear magnetic resonance and x-ray crystallography.

For example, supernatants from systems which secrete recombinant protein into culture media can be first concentrated using a commercially available protein concentration filter, for example, an Amicon or Millipore Pellicon ultrafiltration unit. Following the concentration step, the concentrate can be applied to a suitable purification matrix. Alternatively, an anion exchange resin can be employed, for example, a matrix or substrate having pendant diethylaminoethyl (DEAE) groups. The matrices can be acrylamide, agarose, dextran, cellulose or other types commonly employed in protein purification. Alternatively, a cation exchange step can be employed. Suitable cation exchangers include various insoluble matrices comprising sulfopropyl or carboxymethyl groups. Finally, one or more reversed-phase high performance liquid chromatography (RP-ffPLC) steps employing hydrophobic RP-FTPLC media, e.g., silica gel having pendant methyl or other aliphatic groups, can be employed to further purify a cancer stem cell protein-Fc composition. Some or all of the foregoing purification steps, in various combinations, can also be employed to provide a homogeneous recombinant protein. Recombinant protein produced in bacterial culture can be isolated, for example, by initial extraction from cell pellets, followed by one or more concentration, salting-out, aqueous ion exchange or size exclusion chromatography steps. High performance liquid chromatography (HPLC) can be employed for final purification steps. Microbial cells employed in expression of a recombinant protein can be disrupted by any convenient method, including freeze-thaw cycling, sonication, mechanical disruption, or use of cell lysing agents.

In Vivo Peptide/Polypeptide Synthesis

The present invention also contemplates the use of nucleic acid molecules as vehicles for delivering neoantigenic peptides/polypeptides to the subject in need thereof, in vivo, in the form of, e.g., DNA/RNA vaccines (see, e.g., WO2012/159643, and WO2012/159754, hereby incorporated by reference in their entirety).

In one embodiment antigens may be administered to a patient in need thereof by use of a plasmid. These are plasmids which usually consist of a strong viral promoter to drive the in vivo transcription and translation of the gene (or complementary DNA) of interest (Mor, et al., (1995), The Journal of Immunology 155 (4): 2039-2046). Intron A may sometimes be included to improve mRNA stability and hence increase protein expression (Leitner et al. (1997), The Journal of Immunology 159 (12): 6112-6119). Plasmids also include a strong polyadenylation/transcriptional termination signal, such as bovine growth hormone or rabbit beta-globulin polyadenylation sequences (Alarcon et al., (1999), Adv. Parasitol. Advances in Parasitology 42: 343-410; Robinson et al., (2000). Adv. Virus Res. Advances in Virus Research 55: 1-74; Bohm et al., (1996). Journal of Immunological Methods 193 (1): 29-40.). Multi cistronic vectors are sometimes constructed to express more than one immunogen, or to express an immunogen and an immunostimulatory protein (Lewis et al., (1999). Advances in Virus Research (Academic Press) 54: 129-88).

Because the plasmid is the "vehicle" from which the immunogen is expressed, optimising vector design for maximal protein expression is essential (Lewis et al., (1999). Advances in Virus Research (Academic Press) 54: 129-88). One way of enhancing protein expression is by optimising the codon usage of pathogenic mRNAs for eukaryotic cells. Another consideration is the choice of promoter. Such promoters may be the SV40 promoter or Rous Sarcoma Virus (RSV). Plasmids may be introduced into animal tissues by a number of different methods. The two most popular approaches are injection of DNA in saline, using a standard hypodermic needle, and gene gun delivery. A schematic outline of the construction of a DNA vaccine plasmid and its subsequent delivery by these two methods into a host is illustrated at Scientific American (Weiner et al., (1999) Scientific American 281 (1): 34-41). Injection in saline is normally conducted intramuscularly (EVI) in skeletal muscle, or intradermally (ID), with DNA being delivered to the extracellular spaces. This can be assisted by electroporation by temporarily damaging muscle fibres with myotoxins such as bupivacaine; or by using hypertonic solutions of saline or sucrose (Alarcon et al., (1999). Adv. Parasitol. Advances in Parasitology 42: 343-410). Immune responses to this method of delivery can be affected by many factors, including needle type, needle alignment, speed of injection, volume of injection, muscle type, and age, sex and physiological condition of the animal being injected (Alarcon et al., (1999). Adv. Parasitol. Advances in Parasitology 42: 343-410).

Gene gun delivery, the other commonly used method of delivery, ballistically accelerates plasmid DNA (pDNA) that has been adsorbed onto gold or tungsten microparticles into the target cells, using compressed helium as an accelerant (Alarcon et al., (1999). Adv. Parasitol. Advances in Parasitology 42: 343-410; Lewis et al., (1999). Advances in Virus Research (Academic Press) 54: 129-88).

Alternative delivery methods may include aerosol instillation of naked DNA on mucosal surfaces, such as the nasal and lung mucosa, (Lewis et al., (1999). Advances in Virus Research (Academic Press) 54: 129-88) and topical administration of pDNA to the eye and vaginal mucosa (Lewis et al., (1999) Advances in Virus Research (Academic Press) 54: 129-88). Mucosal surface delivery has also been achieved using cationic liposome-DNA preparations, biodegradable microspheres, attenuated *Shigella* or *Listeria* vectors for oral administration to the intestinal mucosa, and recombinant adenovirus vectors. DNA or RNA may also be delivered to cells following mild mechanical disruption of the cell membrane, temporarily permeabilizing the cells. Such a mild mechanical disruption of the membrane can be accomplished by gently forcing cells through a small aperture (Ex vivo Cytosolic Delivery of Functional Macromolecules to Immune Cells, Sharei et al, PLOS ONE|DOI: 10.1371/journal.pone.Ol 18803 Apr. 13, 2015).

The method of delivery determines the dose of DNA required to raise an effective immune response. Saline injections require variable amounts of DNA, from 10 µg-1 mg, whereas gene gun deliveries require 100 to 1000 times less DNA than intramuscular saline injection to raise an effective immune response. Generally, 0.2 µg-20 µg are required, although quantities as low as 16 ng have been reported. These quantities vary from species to species, with mice, for example, requiring approximately 10 times less DNA than primates. Saline injections require more DNA because the DNA is delivered to the extracellular spaces of the target tissue (normally muscle), where it has to overcome physical barriers (such as the basal lamina and large amounts of connective tissue, to mention a few) before it is taken up by the cells, while gene gun deliveries bombard DNA directly into the cells, resulting in less "wastage" (See e.g., Sedegah et al., (1994). Proceedings of the National Academy of Sciences of the United States of America 91 (21): 9866-9870; Daheshia et al., (1997). The Journal of Immunology 159 (4): 1945-1952; Chen et al., (1998). The Journal of Immunology 160 (5): 2425-2432; Sizemore (1995) Science 270 (5234): 299-302; Fynan et al., (1993) Proc. Natl. Acad. Sci. U.S.A. 90 (24): 11478-82).

In one embodiment, a neoplasia vaccine or immunogenic composition may include separate DNA plasmids encoding, for example, one or more neoantigenic peptides/polypeptides as identified in according to the invention. As discussed herein, the exact choice of expression vectors can depend upon the peptide/polypeptides to be expressed, and is well within the skill of the ordinary artisan. The expected persistence of the DNA constructs (e.g., in an episomal, non-replicating, non-integrated form in the muscle cells) is expected to provide an increased duration of protection.

One or more antigenic peptides of the invention may be encoded and expressed in vivo using a viral based system (e.g., an adenovirus system, an adeno associated virus (AAV) vector, a poxvirus, or a lentivirus). In one embodiment, the neoplasia vaccine or immunogenic composition may include a viral based vector for use in a human patient in need thereof, such as, for example, an adenovirus (see, e.g., Baden et al. First-in-human evaluation of the safety and immunogenicity of a recombinant adenovirus serotype 26

HIV-1 Env vaccine (IPCAVD 001). J Infect Dis. 2013 Jan. 15; 207(2):240-7, hereby incorporated by reference in its entirety). Plasmids that can be used for adeno associated virus, adenovirus, and lentivirus delivery have been described previously (see e.g., U.S. Pat. Nos. 6,955,808 and 6,943,019, and U.S. Patent application No. 20080254008, hereby incorporated by reference). The peptides and polypeptides of the invention can also be expressed by a vector, e.g., a nucleic acid molecule as herein-discussed, e.g., RNA or a DNA plasmid, a viral vector such as a poxvirus, e.g., orthopox virus, avipox virus, or adenovirus, AAV or lentivirus. This approach involves the use of a vector to express nucleotide sequences that encode the peptide of the invention. Upon introduction into an acutely or chronically infected host or into a noninfected host, the vector expresses the immunogenic peptide, and thereby elicits a host CTL response.

Among vectors that may be used in the practice of the invention, integration in the host genome of a cell is possible with retrovirus gene transfer methods, often resulting in long term expression of the inserted transgene. In a preferred embodiment the retrovirus is a lentivirus. Additionally, high transduction efficiencies have been observed in many different cell types and target tissues. The tropism of a retrovirus can be altered by incorporating foreign envelope proteins, expanding the potential target population of target cells. A retrovirus can also be engineered to allow for conditional expression of the inserted transgene, such that only certain cell types are infected by the lentivirus. Cell type specific promoters can be used to target expression in specific cell types. Lentiviral vectors are retroviral vectors (and hence both lentiviral and retroviral vectors may be used in the practice of the invention). Moreover, lentiviral vectors are preferred as they are able to transduce or infect non-dividing cells and typically produce high viral titers. Selection of a retroviral gene transfer system may therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the desired nucleic acid into the target cell to provide permanent expression. Widely used retroviral vectors that may be used in the practice of the invention include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., (1992) J. Virol. 66:2731-2739; Johann et al., (1992) J. Virol. 66: 1635-1640; Sommnerfelt et al., (1990) Virol. 176:58-59; Wilson et al., (1998) J. Virol. 63:2374-2378; Miller et al., (1991) J. Virol. 65:2220-2224; PCT/US94/05700).

Also useful in the practice of the invention is a minimal non-primate lentiviral vector, such as a lentiviral vector based on the equine infectious anemia virus (EIAV) (see, e.g., Balagaan, (2006) J Gene Med; 8: 275-285, Published online 21 Nov. 2005 in Wiley InterScience (www.interscience.wiley.com). DOI: 10.1002/jgm.845). The vectors may have cytomegalovirus (CMV) promoter driving expression of the target gene. Accordingly, the invention contemplates amongst vector(s) useful in the practice of the invention: viral vectors, including retroviral vectors and lentiviral vectors.

Lentiviral vectors have been disclosed as in the treatment for Parkinson's Disease, see, e.g., US Patent Publication No. 20120295960 and U.S. Pat. Nos. 7,303,910 and 7,351,585. Lentiviral vectors have also been disclosed for delivery to the Brain, see, e.g., US Patent Publication Nos. US20110293571; US20040013648, US20070025970, US20090111106 and U.S. Pat. No. 7,259,015. In another embodiment lentiviral vectors are used to deliver vectors to the brain of those being treated for a disease.

As to lentivirus vector systems useful in the practice of the invention, mention is made of U.S. Pat. Nos. 6,428,953, 6,165,782, 6,013,516, 5,994,136, 6,312,682, and 7,198,784, and documents cited therein.

In an embodiment herein the delivery is via an lentivirus. Zou et al. administered about 10 µ[|$]$¨$$[|$]$¨ AÄ[|$] $¨gi of a recombinant lentivirus having a titer of $1 \times 10^9$ transducing units (TU)/ml by an intrathecal catheter. These sort of dosages can be adapted or extrapolated to use of a retroviral or lentiviral vector in the present invention. For transduction in tissues such as the brain, it is necessary to use very small volumes, so the viral preparation is concentrated by ultracentrifugation. The resulting preparation should have at least $10^8$ TU/ml, preferably from $10^8$ to $10^9$ TU/ml, more preferably at least $10^9$ TU/ml. Other methods of concentration such as ultrafiltration or binding to and elution from a matrix may be used.

In other embodiments the amount of lentivirus administered may be $1.\times.10^5$ or about $1.\times.10^5$ plaque forming units (PFU), $5.\times.10^5$ or about $5.\times.10^5$ PFU, $1.\times.10^6$ or about $1.\times 10^6$ PFU, $5.\times.10^6$ or about $5.\times.10^6$ PFU, $1.\times.10^7$ or about $1.\times.10^7$ PFU, $5.\times.10^7$ or about $5.\times.10^7$ PFU, $1.\times.10^8$ or about $1.\times.10^8$ PFU, $5.\times.10^8$ or about $5.\times.10^8$ PFU, $1.\times.10^9$ or about $1.\times.10^9$ PFU, $5.\times.10^9$ or about $5.\times.10^9$ PFU, $1.\times.10^{10}$ or about $1.\times.10^{10}$ PFU or $5.\times.10^{10}$ or about $5.\times.10^{10}$ PFU as total single dosage for an average human of 75 kg or adjusted for the weight and size and species of the subject. One of skill in the art can determine suitable dosage. Suitable dosages for a virus can be determined empirically. Also useful in the practice of the invention is an adenovirus vector. One advantage is the ability of recombinant adenoviruses to efficiently transfer and express recombinant genes in a variety of mammalian cells and tissues in vitro and in vivo, resulting in the high expression of the transferred nucleic acids. Further, the ability to productively infect quiescent cells, expands the utility of recombinant adenoviral vectors. In addition, high expression levels ensure that the products of the nucleic acids will be expressed to sufficient levels to generate an immune response (see e.g., U.S. Pat. No. 7,029,848, hereby incorporated by reference).

As to adenovirus vectors useful in the practice of the invention, mention is made of U.S. Pat. No. 6,955,808. The adenovirus vector used can be selected from the group consisting of the Ad5, Ad35, Adl 1, C6, and C7 vectors. The sequence of the Adenovirus 5 ("Ad5") genome has been published. (Chroboczek, J., Bieber, F., and Jacrot, B. (1992) The Sequence of the Genome of Adenovirus Type 5 and Its Comparison with the Genome of Adenovirus Type 2, Virology 186, 280-285; the contents if which is hereby incorporated by reference). Ad35 vectors are described in U.S. Pat. Nos. 6,974,695, 6,913,922, and 6,869,794. Adl 1 vectors are described in U.S. Pat. No. 6,913,922. C6 adenovirus vectors are described in U.S. Pat. Nos. 6,780,407; 6,537,594; 6,309, 647; 6,265, 189; 6,156,567; 6,090,393; 5,942,235 and 5,833, 975. C7 vectors are described in U.S. Pat. No. 6,277,558. Adenovirus vectors that are El-defective or deleted, E3-defective or deleted, and/or E4-defective or deleted may also be used. Certain adenoviruses having mutations in the E1 region have improved safety margin because E1-defective adenovirus mutants are replication-defective in non-permissive cells, or, at the very least, are highly attenuated. Adenoviruses having mutations in the E3 region may have enhanced the immunogenicity by disrupting the mechanism whereby adenovirus down-regulates MHC class I molecules. Adenoviruses having E4 mutations may have reduced immunogenicity of the adenovirus vector because of suppression of late gene expression. Such vectors may be particularly useful when repeated re-vaccination utilizing the same vector is desired. Adenovirus vectors that are deleted or mutated in E1, E3, E4, E1 and E3, and E1 and E4 can be used in accordance with the present invention. Furthermore, "gutless" adenovirus vectors, in which all viral genes are deleted, can also be used in accordance with the present invention. Such vectors require a helper virus for their replication and require a special human 293 cell line expressing both E1 a and Cre, a condition that does not exist in natural environment. Such "gutless" vectors are non-immunogenic and thus the vectors may be inoculated multiple times for re-vaccination. The "gutless" adenovirus vectors can be used for insertion of heterologous inserts/genes such as the transgenes of the present invention, and can even be used for co-delivery of a large number of heterologous inserts/genes.

In an embodiment herein the delivery is via an adenovirus, which may be at a single booster dose containing at least $1\times10^5$ particles (also referred to as particle units, pu) of adenoviral vector. In an embodiment herein, the dose preferably is at least about $1\times10^6$ particles (for example, about $1\times10^6$-$1\times10^{12}$ particles), more preferably at least about $1\times10^7$ particles, more preferably at least about $1\times10^8$ particles (e.g., about $1\times10^8$-$1\times10^{11}$ particles or about $1\times10^8$-$1\times10^{12}$ particles), and most preferably at least about $1\times10^9$ particles (e.g., about $1\times10^9$-$1\times10^{10}$ particles or about $1\times10^9$-$1\times10^{12}$ particles), or even at least about $1\times10^{10}$ particles (e.g., about $1\times10^{10}$-$1\times10^{12}$ particles) of the adenoviral vector. Alternatively, the dose comprises no more than about $1\times10^{14}$ particles, preferably no more than about $1\times10^{11}$ particles, even more preferably no more than about $1\times10^{12}$ particles, even more preferably no more than about $1\times10^{11}$ particles, and most preferably no more than about $1\times10^{10}$ particles (e.g., no more than about $1\times10^9$ articles). Thus, the dose may contain a single dose of adenoviral vector with, for example, about $1\times10^6$ particle units (pu), about $2\times10^6$ pu, about $4\times10^6$ pu, about $1\times10^7$ pu, about $2\times10$ pu, about $4\times10$ pu, about $1\times10$ pu, about $2\times10$ pu, about $4\times10$ pu, about $1\times10^9$ pu, about $2\times10^9$ pu, about $4\times10^9$ pu, about $1\times10^{10}$ pu, about $2\times10^{10}$ pu, about $4\times10^{10}$ pu, about $1\times10^{11}$ pu, about $2\times10^{11}$ pu, about $4\times10^{11}$ pu, about $1\times10^{12}$ pu, about $2\times10^{12}$ pu, or about $4\times10^{12}$ pu of adenoviral vector. See, for example, the adenoviral vectors in U.S. Pat. No. 8,454,972 B2 to Nabel, et. al., granted on Jun. 4, 2013; incorporated by reference herein, and the dosages at col 29, lines 36-58 thereof. In an embodiment herein, the adenovirus is delivered via multiple doses.

In terms of in vivo delivery, AAV is advantageous over other viral vectors due to low toxicity and low probability of causing insertional mutagenesis because it doesn't integrate into the host genome. AAV has a packaging limit of 4.5 or 4.75 Kb. Constructs larger than 4.5 or 4.75 Kb result in significantly reduced virus production. There are many promoters that can be used to drive nucleic acid molecule expression. AAV ITR can serve as a promoter and is advantageous for eliminating the need for an additional promoter element. For ubiquitous expression, the following promoters can be used: CMV, CAG, CBh, PGK, SV40, Ferritin heavy or light chains, etc. For brain expression, the following promoters can be used: Synapsin1 for all neurons, CaMKIIalpha for excitatory neurons, GAD67 or GAD65 or VGAT for GABAergic neurons, etc. Promoters used to drive RNA synthesis can include: Pol III promoters such as U6 or H1. The use of a Pol II promoter and intronic cassettes can be used to express guide RNA (gRNA).

With regard to AAV vectors useful in the practice of the invention, mention is made of U.S. Pat. Nos. 5,658,785, 7,115,391, 7,172,893, 6,953,690, 6,936,466, 6,924,128, 6,893,865, 6,793,926, 6,537,540, 6,475,769 and 6,258,595, and documents cited therein.

As to AAV, the AAV can be AAV1, AAV2, AAV5 or any combination thereof. One can select the AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. The above promoters and vectors are preferred individually.

In an embodiment herein, the delivery is via an AAV. A therapeutically effective dosage for in vivo delivery of the AAV to a human is believed to be in the range of from about 20 to about 50 ml of saline solution containing from about $1\times10^{10}$ to about $1\times10^{50}$ functional AAV/ml solution. The dosage may be adjusted to balance the therapeutic benefit against any side effects. In an embodiment herein, the AAV dose is generally in the range of concentrations from about $1\times10$ to $1\times10$ genomes AAV, from about $1\times10$ to $1\times10$ genomes AAV, from about $1\times10^{10}$ to about $1\times10^{16}$ genomes, or about $1\times10^{11}$ to about $1\times10^{16}$ genomes AAV. A human dosage may be about $1\times10^{13}$ genomes AAV. Such concentrations may be delivered in from about 0.001 ml to about 100 ml, about 0.05 to about 50 ml, or about 10 to about 25 ml of a carrier solution. In a preferred embodiment, AAV is used with a titer of about $2\times10^{13}$ viral genomes/milliliter, and each of the striatal hemispheres of a mouse receives one 500 nanoliter injection. Other effective dosages can be readily established by one of ordinary skill in the art through routine trials establishing dose response curves. See, for example, U.S. Pat. No. 8,404,658 B2 to Hajjar, et al., granted on Mar. 26, 2013, at col. 27, lines 45-60.

In another embodiment effectively activating a cellular immune response for a neoplasia vaccine or immunogenic composition can be achieved by expressing the relevant antigens in a vaccine or immunogenic composition in a non-pathogenic microorganism. Well-known examples of such microorganisms are *Mycobacterium bovis* BCG, *Salmonella* and *Pseudomonas* (See, U.S. Pat. No. 6,991,797, hereby incorporated by reference in its entirety). In another embodiment a Poxvirus is used in the neoplasia vaccine or immunogenic composition. These include orthopoxvirus, avipox, vaccinia, MVA, NYVAC, canarypox, ALVAC, fowlpox, TROVAC, etc. (see e.g., Verardi et al., Hum Vaccin Immunother. 2012 July; 8(7):961-70; and Moss, Vaccine. 2013; 31(39): 4220-4222). Poxvirus expression vectors were described in 1982 and quickly became widely used for vaccine development as well as research in numerous fields. Advantages of the vectors include simple construction, ability to accommodate large amounts of foreign DNA and high expression levels.

Information concerning poxviruses that may be used in the practice of the invention, such as Chordopoxvirinae subfamily poxviruses (poxviruses of vertebrates), for instance, orthopoxviruses and avipoxviruses, e.g., vaccinia virus (e.g., Wyeth Strain, WR Strain (e.g., ATCC® VR-1354), Copenhagen Strain, NYVAC, NYVAC. 1, NYVAC.2, MVA, MVA-BN), canarypox virus (e.g., Wheatley C93 Strain, ALVAC), fowlpox virus (e.g., FP9 Strain, Webster Strain, TROVAC), dovepox, pigeonpox, quailpox, and raccoon pox, inter alia, synthetic or non-naturally occurring recombinants thereof, uses thereof, and methods for making and using such recombinants may be found in scientific and patent literature, such as: U.S. Pat. Nos. 4,603,112, 4,769,330, 5,110,587, 5,174,993, 5,364,773, 5,762,938, 5,494,807, 5,766,597, 7,767,449, 6,780,407, 6,537,594, 6,265,189, 6,214,353, 6,130,066, 6,004,777, 5,990,091, 5,942,235, 5,833,975, 5,766,597, 5,756, 101, 7,045,313, 6,780,417, 8,470,598, 8,372,622, 8,268,329, 8,268,325, 8,236,560, 8,163,293, 7,964,398, 7,964,396, 7,964,395, 7,939,086, 7,923,017, 7,897,156, 7,892,533, 7,628,980, 7,459,270, 7,445,924, 7,384,644, 7,335,364, 7,189,536, 7,097,842, 6,913,752, 6,761,893, 6,682,743, 5,770,212, 5,766,882, and 5,989,562, and Panicali, D. Proc. Natl. Acad. Sci. 1982; 79; 4927-493, Panicali D. Proc. Natl. Acad. Sci. 1983; 80(17): 5364-8, Mackett, M. Proc. Natl. Acad. Sci. 1982; 79: 7415-7419, Smith G L. Proc. Natl. Acad. Sci. 1983; 80(23): 7155-9, Smith G L. Nature 1983; 302: 490-5, Sullivan V J. Gen. Vir. 1987; 68: 2587-98, Perkus M Journal of Leukocyte Biology 1995; 58: 1-13, Yilma T D. Vaccine 1989; 7: 484-485, Brochier B. Nature 1991; 354: 520-22, Wiktor, T J. Proc. Natl Acd. Sci. 1984; 81: 7194-8, Rupprecht, C E. Proc. Natl Acd. Sci. 1986; 83: 7947-50, Poulet, H Vaccine 2007; 25(July): 5606-12, Weyer J. Vaccine 2009; 27(November): 7198-201, Buller, R M Nature 1985; 317(6040): 813-5, Buller R M. J. Virol. 1988; 62(3):866-74, Flexner, C. Nature 1987; 330(6145): 259-62, Shida, H. J. Virol. 1988; 62(12): 4474-80, Kotwal, G J. J. Virol. 1989; 63(2): 600-6, Child, S J. Virology 1990; 174(2): 625-9, Mayr A. Zentralbl Bakteriol 1978; 167(5,6): 375-9, Antoine G. Virology. 1998; 244(2): 365-96, Wyatt, L S. Virology 1998; 251(2): 334-42, Sancho, M C. J. Virol. 2002; 76(16); 8313-34, Gallego-Gomez, J C. J. Virol. 2003; 77(19); 10606-22, Goebel S J. Virology 1990; (a,b) 179: 247-66, Tartaglia, J. Virol. 1992; 188(1): 217-32, Najera J L. J. Virol. 2006; 80(12): 6033-47, Najera, J L. J. Virol. 2006; 80: 6033-6047, Gomez, C E. J. Gen. Virol. 2007; 88: 2473-78, Mooij, P. Jour. Of Virol. 2008; 82: 2975-2988, Gomez, C E. Curr. Gene Ther. 2011; 11: 189-217, Cox, W. Virology 1993; 195: 845-50, Perkus, M. Jour. Of Leukocyte Biology 1995; 58: 1-13, Blanchard T J. J Gen Virology 1998; 79(5): 1159-67, Amara R. Science 2001; 292: 69-74, Hel, Z., J. Immunol. 2001; 167: 7180-9, Gherardi M M. J. Virol. 2003; 77: 7048-57, Didierlaurent, A. Vaccine 2004; 22: 3395-3403, Bissht H. Proc. Nat. Aca. Sci. 2004; 101: 6641-46, McCurdy L H. Clin. Inf. Dis 2004; 38: 1749-53, Earl P L. Nature 2004; 428: 182-85, Chen Z. J. Virol. 2005; 79: 2678-2688, Najera J L. J. Virol. 2006; 80(12): 6033-47, Nam J H. Acta. Virol. 2007; 51: 125-30, Antonis A F. Vaccine 2007; 25: 4818-4827, B Weyer J. Vaccine 2007; 25: 4213-22, Ferrier-Rembert A. Vaccine 2008; 26(14): 1794-804, Corbett M. Proc. Natl. Acad. Sci. 2008; 105(6): 2046-51, Kaufman H L., J. Clin. Oncol. 2004; 22: 2122-32, Amato, R J. Clin. Cancer Res. 2008; 14(22): 7504-10, Dreicer R. Invest New Drugs 2009; 27(4): 379-86, Kantoff P W. J. Clin. Oncol. 2010, 28, 1099-1 105, Amato R J. J. Clin. Can. Res. 2010; 16(22): 5539-47, Kim, D W. Hum. Vaccine. 2010; 6: 784-791, Oudard, S. Cancer Immunol. Immunother. 2011; 60: 261-71, Wyatt, L S. Aids Res. Hum. Retroviruses. 2004; 20: 645-53, Gomez, C E. Virus Research 2004; 105: 11-22, Webster, D P. Proc. Natl. Acad. Sci. 2005; 102: 4836-4, Huang, X. Vaccine 2007; 25: 8874-84, Gomez, C E. Vaccine 2007a; 25: 2863-85, Esteban M. Hum. Vaccine 2009; 5: 867-871, Gomez, C E. Curr. Gene therapy 2008; 8(2): 97-120, Whelan, K T. Plos one 2009; 4(6): 5934, Scriba, T J. Eur. Jour. Immuno. 2010; 40(1): 279-90, Corbett, M. Proc. Natl. Acad. Sci. 2008; 105: 2046-2051, Midgley, C M. J. Gen. Virol. 2008; 89: 2992-97, Von Krempelhuber, A. Vaccine 2010; 28: 1209-16, Perreau, M. J. Of Virol. 2011; October: 9854-62, Pantaleo, G. Curr Opin HIV-AIDS. 2010; 5: 391-396, each of which is incorporated herein by reference.

In another embodiment the vaccinia virus is used in the neoplasia vaccine or immunogenic composition to express a neoantigen. (Rolph et al., Recombinant viruses as vaccines and immunological tools. Curr Opin Immunol 9:517-524, 1997). The recombinant vaccinia virus is able to replicate within the cytoplasm of the infected host cell and the polypeptide of interest can therefore induce an immune response. Moreover, Poxviruses have been widely used as vaccine or immunogenic composition vectors because of their ability to target encoded antigens for processing by the major histocompatibility complex class I pathway by directly infecting immune cells, in particular antigen-presenting cells, but also due to their ability to self-adjuvant.

In another embodiment ALVAC is used as a vector in a neoplasia vaccine or immunogenic composition. ALVAC is a canarypox virus that can be modified to express foreign transgenes and has been used as a method for vaccination against both prokaryotic and eukaryotic antigens (Horig H, Lee D S, Conkright W, et al. Phase I clinical trial of a recombinant canarypoxvirus (ALVAC) vaccine expressing human carcinoembryonic antigen and the B7.1 co-stimulatory molecule. Cancer Immunol Immunother 2000; 49:504-14; von Mehren M, Arlen P, Tsang K Y, et al. Pilot study of a dual gene recombinant avipox vaccine containing both carcinoembryonic antigen (CEA) and B7.1 transgenes in patients with recurrent CEA-expressing adenocarcinomas. Clin Cancer Res 2000; 6:2219-28; Musey L, Ding Y, Elizaga M, et al. HIV-1 vaccination administered intramuscularly can induce both systemic and mucosal T cell immunity in HIV-1-uninfected individuals. J Immunol 2003; 171: 1094-101; Paoletti E. Applications of pox virus vectors to vaccination: an update. Proc Natl Acad Sci USA 1996; 93: 11349-53; U.S. Pat. No. 7,255,862). In a phase I clinical trial, an ALVAC virus expressing the tumor antigen CEA showed an excellent safety profile and resulted in increased CEA-specific T cell responses in selected patients; objective clinical responses, however, were not observed (Marshall J L, Hawkins M J, Tsang K Y, et al. Phase I study in cancer patients of a replication-defective avipox recombinant vaccine that expresses human carcinoembryonic antigen. J Clin Oncol 1999; 17:332-7).

In another embodiment a Modified Vaccinia Ankara (MVA) virus may be used as a viral vector for a neoantigen vaccine or immunogenic composition. MVA is a member of the Orthopoxvirus family and has been generated by about 570 serial passages on chicken embryo fibroblasts of the Ankara strain of Vaccinia virus (CVA) (for review see Mayr, A., et al., Infection 3, 6-14, 1975). As a consequence of these passages, the resulting MVA virus contains 31 kilobases less genomic information compared to CVA, and is highly host-cell restricted (Meyer, H. et al., J. Gen. Virol. 72, 1031-1038, 1991). MVA is characterized by its extreme attenuation, namely, by a diminished virulence or infectious ability, but still holds an excellent immunogenicity. When tested in a variety of animal models, MVA was proven to be avirulent, even in immuno-suppressed individuals. Moreover, MVA-BN®-HER2 is a candidate immunotherapy designed for the treatment of HER-2-positive breast cancer and is currently in clinical trials. (Mandl et al., Cancer Immunol Immunother. January 2012; 61(1): 19-29). Methods to make and use recombinant MVA has been described (e.g., see U.S. Pat. Nos. 8,309,098 and 5, 185,146 hereby incorporated in its entirety).

In another embodiment the modified Copenhagen strain of vaccinia virus, NYVAC and NYVAC variations are used as a vector (see U.S. Pat. No. 7,255,862; PCT WO 95/30018; U.S. Pat. Nos. 5,364,773 and 5,494,807, hereby incorporated by reference in its entirety).

In one embodiment recombinant viral particles of the vaccine or immunogenic composition are administered to patients in need thereof. Dosages of expressed neoantigen can range from a few to a few hundred micrograms, e.g., 5 to 500 µg. The vaccine or immunogenic composition can be administered in any suitable amount to achieve expression at these dosage levels. The viral particles can be administered to a patient in need thereof or transfected into cells in an amount of about at least $10^{3.5}$ pfu; thus, the viral particles are preferably administered to a patient in need thereof or infected or transfected into cells in at least about $10^4$ pfu to about $10^6$ pfu; however, a patient in need thereof can be administered at least about $10^7$ pfu such that a more preferred amount for administration can be at least about $10^7$ pfu to about $10^9$ pfu. Doses as to NYVAC are applicable as to ALVAC, MVA, MVA-BN, and avipoxes, such as canarypox and fowlpox.

Vaccine or Immunogenic Composition Adjuvant

Effective vaccine or immunogenic compositions advantageously include a strong adjuvant to initiate an immune response. As described herein, poly-ICLC, an agonist of TLR3 and the RNA helicase-domains of MDA5 and RIG3, has shown several desirable properties for a vaccine or immunogenic composition adjuvant. These properties include the induction of local and systemic activation of immune cells in vivo, production of stimulatory chemokines and cytokines, and stimulation of antigen-presentation by DCs. Furthermore, poly-ICLC can induce durable CD4+ and CD8+ responses in humans. Importantly, striking similarities in the upregulation of transcriptional and signal transduction pathways were seen in subjects vaccinated with poly-ICLC and in volunteers who had received the highly effective, replication-competent yellow fever vaccine. Furthermore, >90% of ovarian carcinoma patients immunized with poly-ICLC in combination with a NY-ESO-1 peptide vaccine (in addition to Montanide) showed induction of CD4+ and CD8+ T cell, as well as antibody responses to the peptide in a recent phase 1 study. At the same time, poly-ICLC has been extensively tested in more than 25 clinical trials to date and exhibited a relatively benign toxicity profile. In addition to a powerful and specific immunogen the neoantigen peptides may be combined with an adjuvant (e.g., poly-ICLC) or another anti-neoplastic agent. Without being bound by theory, these neoantigens are expected to bypass central thymic tolerance (thus allowing stronger anti-tumor T cell response), while reducing the potential for autoimmunity (e.g., by avoiding targeting of normal self-antigens). An effective immune response advantageously includes a strong adjuvant to activate the immune system (Speiser and Romero, Molecularly defined vaccines for cancer immunotherapy, and protective T cell immunity Seminars in Immunol 22: 144 (2010)). For example, Toll-like receptors (TLRs) have emerged as powerful sensors of microbial and viral pathogen "danger signals", effectively inducing the innate immune system, and in turn, the adaptive immune system (Bhardwaj and Gnjatic, TLR AGONISTS: Are They Good Adjuvants?Cancer J. 16:382-391 (2010)). Among the TLR agonists, poly-ICLC (a synthetic double-stranded RNA mimic) is one of the most potent activators of myeloid-derived dendritic cells. In a human volunteer study, poly-ICLC has been shown to be safe and to induce a gene expression profile in peripheral blood cells comparable to that induced by one of the most potent live attenuated viral vaccines, the yellow fever vaccine YF-17D (Caskey et al, Synthetic double-stranded RNA induces innate immune responses similar to a live viral vaccine in humans J Exp Med 208:2357 (2011)). In a preferred embodiment Hiltonol®, a GMP preparation of poly-ICLC prepared by Oncovir, Inc, is utilized as the adjuvant. In other embodiments, other adjuvants described herein are envisioned. For instance oil-in-water, water-in-oil or multiphasic W/O/W; see, e.g., U.S. Pat. No. 7,608,279 and Aucouturier et al, Vaccine 19 (2001), 2666-2672, and documents cited therein.

Pharmaceutical Compositions/Methods of Delivery

The present invention is also directed to pharmaceutical compositions comprising an effective amount of one or more antigenic peptides as described herein (including a pharmaceutically acceptable salt, thereof), optionally in combination with a pharmaceutically acceptable carrier, excipient or additive.

The term "pharmaceutically acceptable" refers to approved or approvable by a regulatory agency of the Federal or a state government or listed in the U.S. Pharmacopeia or other generally recognized pharmacopeia for use in animals, including humans.

A "pharmaceutically acceptable excipient, carrier or diluent" refers to an excipient, carrier or diluent that can be administered to a subject, together with an agent, and which does not destroy the pharmacological activity thereof and is nontoxic when administered in doses sufficient to deliver a therapeutic amount of the agent.

A "pharmaceutically acceptable salt" of pooled tumor specific neoantigens as recited herein may be an acid or base salt that is generally considered in the art to be suitable for use in contact with the tissues of human beings or animals without excessive toxicity, irritation, allergic response, or other problem or complication. Such salts include mineral and organic acid salts of basic residues such as amines, as well as alkali or organic salts of acidic residues such as carboxylic acids. Specific pharmaceutical salts include, but are not limited to, salts of acids such as hydrochloric, phosphoric, hydrobromic, malic, glycolic, fumaric, sulfuric, sulfamic, sulfanilic, formic, toluenesulfonic, methanesulfonic, benzene sulfonic, ethane disulfonic, 2-hydroxyethylsulfonic, nitric, benzoic, 2-acetoxybenzoic, citric, tartaric, lactic, stearic, salicylic, glutamic, ascorbic, pamoic, succinic, fumaric, maleic, propionic, hydroxymaleic, hydroiodic, phenylacetic, alkanoic such as acetic, HOOC—(CH2)n-COOH where n is 0-4, and the like. Similarly, pharmaceutically acceptable cations include, but are not limited to sodium, potassium, calcium, aluminum, lithium and ammonium. Those of ordinary skill in the art will recognize from this disclosure and the knowledge in the art that further pharmaceutically acceptable salts for the pooled tumor specific neoantigens provided herein, including those listed by Remington's Pharmaceutical Sciences, 17th ed., Mack Publishing Company, Easton, PA, p. 1418 (1985). In general, a pharmaceutically acceptable acid or base salt can be synthesized from a parent compound that contains a basic or acidic moiety by any conventional chemical method. Briefly, such salts can be prepared by reacting the free acid or base forms of these compounds with a stoichiometric amount of the appropriate base or acid in an appropriate solvent.

When administered as a combination, the therapeutic agents (i.e. the neoantigenic peptides) can be formulated as separate compositions that are given at the same time or different times, or the therapeutic agents can be given as a single composition.

The compositions may be administered once daily, twice daily, once every two days, once every three days, once every four days, once every five days, once every six days, once every seven days, once every two weeks, once every three weeks, once every four weeks, once every two months, once every six months, or once per year. The dosing interval can be adjusted according to the needs of individual patients. For longer intervals of administration, extended release or depot formulations can be used.

The compositions of the invention can be used to treat diseases and disease conditions that are acute, and may also be used for treatment of chronic conditions. In particular, the compositions of the invention are used in methods to treat or prevent a neoplasia. In certain embodiments, the compounds of the invention are administered for time periods exceeding two weeks, three weeks, one month, two months, three months, four months, five months, six months, one year, two years, three years, four years, or five years, ten years, or fifteen years; or for example, any time period range in days, months or years in which the low end of the range is any time period between 14 days and 15 years and the upper end of the range is between 15 days and 20 years (e.g., 4 weeks and 15 years, 6 months and 20 years). In some cases, it may be advantageous for the compounds of the invention to be administered for the remainder of the patient's life. In preferred embodiments, the patient is monitored to check the progression of the disease or disorder, and the dose is adjusted accordingly. In preferred embodiments, treatment according to the invention is effective for at least two weeks, three weeks, one month, two months, three months, four months, five months, six months, one year, two years, three years, four years, or five years, ten years, fifteen years, twenty years, or for the remainder of the subject's life.

Surgical resection uses surgery to remove abnormal tissue in cancer, such as mediastinal, neurogenic, or germ cell tumors, or thymoma. In certain embodiments, administration of the composition is initiated following tumor resection. In other embodiments, administration of the neoplasia vaccine or immunogenic composition is initiated 1, 2, 3, 4, 5, 6, 7, 8, 9, 10, 11, 12, 13, 14, 15 or more weeks after tumor resection. Preferably, administration of the neoplasia vaccine or immunogenic composition is initiated 4, 5, 6, 7, 8, 9, 10, 11 or 12 weeks after tumor resection.

In certain embodiments, the vaccine of the present invention is administered to a subject one or more times. In certain embodiments, a subject is primed with a vaccine and then boosted after the initial vaccination. The term "prime/boost" or "prime/boost dosing regimen" is meant to refer to the successive administrations of a vaccine or immunogenic or immunological compositions. The priming administration (priming) is the administration of a first vaccine or immunogenic or immunological composition type and may comprise one, two or more administrations. The boost administration is the second administration of a vaccine or immunogenic or immunological composition type and may comprise one, two or more administrations, and, for instance, may comprise or consist essentially of annual administrations. In certain embodiments, administration of the neoplasia vaccine or immunogenic composition is in a prime/boost dosing regimen.

In certain embodiments, administration of the neoplasia vaccine or immunogenic composition is in a prime/boost dosing regimen, for example administration of the neoplasia vaccine or immunogenic composition at weeks 1, 2, 3 or 4 as a prime and administration of the neoplasia vaccine or immunogenic composition is at months 2, 3 or 4 as a boost. In another embodiment heterologous prime-boost strategies are used to elicit a greater cytotoxic T cell response (see Schneider et al., Induction of CD8+ T cells using heterologous prime-boost immunisation strategies, Immunological Reviews Volume 170, Issue 1, pages 29-38, August 1999). In another embodiment DNA encoding neoantigens is used to prime followed by a protein boost. In another embodiment protein is used to prime followed by boosting with a virus encoding the neoantigen. In another embodiment a virus encoding the neoantigen is used to prime and another virus is used to boost. In another embodiment protein is used to prime and DNA is used to boost. In a preferred embodiment a DNA vaccine or immunogenic composition is used to prime a T cell response and a recombinant viral vaccine or immunogenic composition is used to boost the response. In another preferred embodiment a viral vaccine or immunogenic composition is coadministered with a protein or DNA vaccine or immunogenic composition to act as an adjuvant for the protein or DNA vaccine or immunogenic composition. The patient can then be boosted with either the viral vaccine or immunogenic composition, protein, or DNA vaccine or immunogenic composition (see Hutchings et al., Combination of protein and viral vaccines induces potent cellular and humoral immune responses and enhanced protection from murine malaria challenge. Infect Immun. 2007 December; 75(12):5819-26. Epub 2007 Oct. 1). The pharmaceutical compositions can be processed in accordance with conventional methods of pharmacy to produce medicinal agents for administration to patients in need thereof, including humans and other mammals.

Modifications of the neoantigenic peptides can affect the solubility, bioavailability and rate of metabolism of the peptides, thus providing control over the delivery of the active species. Solubility can be assessed by preparing the neoantigenic peptide and testing according to known methods well within the routine practitioner's skill in the art.

In certain embodiments of the pharmaceutical composition the pharmaceutically acceptable carrier comprises water. In certain embodiments, the pharmaceutically acceptable carrier further comprises dextrose. In certain embodiments, the pharmaceutically acceptable carrier further comprises dimethylsulfoxide. In certain embodiments, the pharmaceutical composition further comprises an immunomodulator or adjuvant. In certain embodiments, the immunomodulator or adjuvant is selected from the group consisting of poly-ICLC, STING agonist, 1018 ISS, aluminum salts, Amplivax, AS15, BCG, CP-870,893, CpG7909, CyaA, dSLEVI, GM-CSF, IC30, IC31, Imiquimod, ImuFact FMP321, IS Patch, ISS, ISCOMATRLX, JuvImmune, LipoVac, MF59, monophosphoryl lipid A, Montanide IMS 1312, Montanide ISA 206, Montanide ISA 50V, Montanide ISA-51, OK-432, OM-174, OM-197-MP-EC, ONTAK, PEPTEL, vector system, PLGA microparticles, resiquimod, SRL172, Virosomes and other Virus-like particles, YF-17D, VEGF trap, R848, beta-glucan, Pam3Cys, and Aquila's QS21 stimulon. In certain embodiments, the immunomodulator or adjuvant comprises poly-ICLC.

Xanthenone derivatives such as, for example, Vadimezan or AsA404 (also known as 5,6-dimethylaxanthenone-4-acetic acid (DMXAA)), may also be used as adjuvants according to embodiments of the invention. Alternatively, such derivatives may also be administered in parallel to the vaccine or immunogenic composition of the invention, for example via systemic or intratumoral delivery, to stimulate immunity at the tumor site. Without being bound by theory, it is believed that such xanthenone derivatives act by stimulating interferon (IFN) production via the stimulator of IFN gene (ISTING) receptor (see e.g., Conlon et al. (2013)

Mouse, but not Human STING, Binds and Signals in Response to the Vascular Disrupting Agent 5,6-Dimethyl-xanthenone-4-Acetic Acid, Journal of Immunology, 190: 5216-25 and Kim et al. (2013) Anticancer Flavonoids are Mouse-Selective STING Agonists, 8: 1396-1401). The vaccine or immunological composition may also include an adjuvant compound chosen from the acrylic or methacrylic polymers and the copolymers of maleic anhydride and an alkenyl derivative. It is in particular a polymer of acrylic or methacrylic acid cross-linked with a polyalkenyl ether of a sugar or polyalcohol (carbomer), in particular cross-linked with an allyl sucrose or with allylpentaerythritol. It may also be a copolymer of maleic anhydride and ethylene cross-linked, for example, with divinyl ether (see U.S. Pat. No. 6,713,068 hereby incorporated by reference in its entirety).

In certain embodiments, the pH modifier can stabilize the adjuvant or immunomodulator as described herein.

In certain embodiments, a pharmaceutical composition comprises: one to five peptides, dimethylsulfoxide (DMSO), dextrose, water, succinate, poly I: poly C, poly-L-lysine, carboxymethylcellulose, and chloride. In certain embodiments, each of the one to five peptides is present at a concentration of 300 µg/ml. In certain embodiments, the pharmaceutical composition comprises <3% DMSO by volume. In certain embodiments, the pharmaceutical composition comprises 3.6-3.7% dextrose in water. In certain embodiments, the pharmaceutical composition comprises 3.6-3.7 mM succinate (e.g., as sodium succinate) or a salt thereof. In certain embodiments, the pharmaceutical composition comprises 0.5 mg/ml poly I: poly C. In certain embodiments, the pharmaceutical composition comprises 0.375 mg/ml poly-L-Lysine. In certain embodiments, the pharmaceutical composition comprises 1.25 mg/ml sodium carboxymethylcellulose. In certain embodiments, the pharmaceutical composition comprises 0.225% sodium chloride.

Pharmaceutical compositions comprise the herein-described tumor specific neoantigenic peptides in a therapeutically effective amount for treating diseases and conditions (e.g., a neoplasia/tumor), which have been described herein, optionally in combination with a pharmaceutically acceptable additive, carrier and/or excipient. One of ordinary skill in the art from this disclosure and the knowledge in the art will recognize that a therapeutically effective amount of one of more compounds according to the present invention may vary with the condition to be treated, its severity, the treatment regimen to be employed, the pharmacokinetics of the agent used, as well as the patient (animal or human) treated.

To prepare the pharmaceutical compositions according to the present invention, a therapeutically effective amount of one or more of the compounds according to the present invention is preferably intimately admixed with a pharmaceutically acceptable carrier according to conventional pharmaceutical compounding techniques to produce a dose. A carrier may take a wide variety of forms depending on the form of preparation desired for administration, e.g., ocular, oral, topical or parenteral, including gels, creams ointments, lotions and time released implantable preparations, among numerous others. In preparing pharmaceutical compositions in oral dosage form, any of the usual pharmaceutical media may be used. Thus, for liquid oral preparations such as suspensions, elixirs and solutions, suitable carriers and additives including water, glycols, oils, alcohols, flavoring agents, preservatives, coloring agents and the like may be used. For solid oral preparations such as powders, tablets, capsules, and for solid preparations such as suppositories, suitable carriers and additives including starches, sugar carriers, such as dextrose, mannitol, lactose and related carriers, diluents, granulating agents, lubricants, binders, disintegrating agents and the like may be used. If desired, the tablets or capsules may be enteric-coated or sustained release by standard techniques.

The active compound is included in the pharmaceutically acceptable carrier or diluent in an amount sufficient to deliver to a patient a therapeutically effective amount for the desired indication, without causing serious toxic effects in the patient treated.

Oral compositions generally include an inert diluent or an edible carrier. They may be enclosed in gelatin capsules or compressed into tablets. For the purpose of oral therapeutic administration, the active compound or its prodrug derivative can be incorporated with excipients and used in the form of tablets, troches, or capsules. Pharmaceutically compatible binding agents, and/or adjuvant materials can be included as part of the composition.

The tablets, pills, capsules, troches and the like can contain any of the following ingredients, or compounds of a similar nature: a binder such as microcrystalline cellulose, gum tragacanth or gelatin; an excipient such as starch or lactose, a dispersing agent such as alginic acid or corn starch; a lubricant such as magnesium stearate; a glidant such as colloidal silicon dioxide; a sweetening agent such as sucrose or saccharin; or a flavoring agent such as peppermint, methyl salicylate, or orange flavoring. When the dosage unit form is a capsule, it can contain, in addition to material herein discussed, a liquid carrier such as a fatty oil. In addition, dosage unit forms can contain various other materials which modify the physical form of the dosage unit, for example, coatings of sugar, shellac, or enteric agents. Formulations of the present invention suitable for oral administration may be presented as discrete units such as capsules, cachets or tablets each containing a predetermined amount of the active ingredient; as a powder or granules; as a solution or a suspension in an aqueous liquid or a non-aqueous liquid; or as an oil-in-water liquid emulsion or a water-in-oil emulsion and as a bolus, etc.

A tablet may be made by compression or molding, optionally with one or more accessory ingredients. Compressed tablets may be prepared by compressing in a suitable machine the active ingredient in a free-flowing form such as a powder or granules, optionally mixed with a binder, lubricant, inert diluent, preservative, surface-active or dispersing agent. Molded tablets may be made by molding in a suitable machine a mixture of the powdered compound moistened with an inert liquid diluent. The tablets optionally may be coated or scored and may be formulated so as to provide slow or controlled release of the active ingredient therein.

Methods of formulating such slow or controlled release compositions of pharmaceutically active ingredients, are known in the art and described in several issued U.S. patents, some of which include, but are not limited to, U.S. Pat. Nos. 3,870,790; 4,226,859; 4,369,172; 4,842,866 and 5,705,190, the disclosures of which are incorporated herein by reference in their entireties. Coatings can be used for delivery of compounds to the intestine (see, e.g., U.S. Pat. Nos. 6,638,534, 5,541,171, 5,217,720, and 6,569,457, and references cited therein).

The active compound or pharmaceutically acceptable salt thereof may also be administered as a component of an elixir, suspension, syrup, wafer, chewing gum or the like. A syrup may contain, in addition to the active compounds, sucrose or fructose as a sweetening agent and certain preservatives, dyes and colorings and flavors.

Solutions or suspensions used for ocular, parenteral, intradermal, subcutaneous, or topical application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates; and agents for the adjustment of tonicity such as sodium chloride or dextrose. In certain embodiments, the pharmaceutically acceptable carrier is an aqueous solvent, i.e., a solvent comprising water, optionally with additional co-solvents. Exemplary pharmaceutically acceptable carriers include water, buffer solutions in water (such as phosphate-buffered saline (PBS), and 5% dextrose in water (D5W)). In certain embodiments, the aqueous solvent further comprises dimethyl sulfoxide (DMSO), e.g., in an amount of about 1-4%, or 1-3%. In certain embodiments, the pharmaceutically acceptable carrier is isotonic (i.e., has substantially the same osmotic pressure as a body fluid such as plasma).

In one embodiment, the active compounds are prepared with carriers that protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, polylactic acid, and polylactic-co-glycolic acid (PLGA). Methods for preparation of such formulations are within the ambit of the skilled artisan in view of this disclosure and the knowledge in the art.

A skilled artisan from this disclosure and the knowledge in the art recognizes that in addition to tablets, other dosage forms can be formulated to provide slow or controlled release of the active ingredient. Such dosage forms include, but are not limited to, capsules, granulations and gel-caps.

Liposomal suspensions may also be pharmaceutically acceptable carriers. These may be prepared according to methods known to those skilled in the art. For example, liposomal formulations may be prepared by dissolving appropriate lipid(s) in an inorganic solvent that is then evaporated, leaving behind a thin film of dried lipid on the surface of the container. An aqueous solution of the active compound are then introduced into the container. The container is then swirled by hand to free lipid material from the sides of the container and to disperse lipid aggregates, thereby forming the liposomal suspension. Other methods of preparation well known by those of ordinary skill may also be used in this aspect of the present invention.

The formulations may conveniently be presented in unit dosage form and may be prepared by conventional pharmaceutical techniques. Such techniques include the step of bringing into association the active ingredient and the pharmaceutical carrier(s) or excipient(s). In general, the formulations are prepared by uniformly and intimately bringing into association the active ingredient with liquid carriers or finely divided solid carriers or both, and then, if necessary, shaping the product.

Formulations and compositions suitable for topical administration in the mouth include lozenges comprising the ingredients in a flavored basis, usually sucrose and acacia or tragacanth; pastilles comprising the active ingredient in an inert basis such as gelatin and glycerin, or sucrose and acacia; and mouthwashes comprising the ingredient to be administered in a suitable liquid carrier.

Formulations suitable for topical administration to the skin may be presented as ointments, creams, gels and pastes comprising the ingredient to be administered in a pharmaceutical acceptable carrier. A preferred topical delivery system is a transdermal patch containing the ingredient to be administered.

Formulations for rectal administration may be presented as a suppository with a suitable base comprising, for example, cocoa butter or a salicylate.

Formulations suitable for nasal administration, wherein the carrier is a solid, include a coarse powder having a particle size, for example, in the range of 20 to 500 microns which is administered in the manner in which snuff is administered, i.e., by rapid inhalation through the nasal passage from a container of the powder held close up to the nose. Suitable formulations, wherein the carrier is a liquid, for administration, as for example, a nasal spray or as nasal drops, include aqueous or oily solutions of the active ingredient.

Formulations suitable for vaginal administration may be presented as pessaries, tampons, creams, gels, pastes, foams or spray formulations containing in addition to the active ingredient such carriers as are known in the art to be appropriate.

The parenteral preparation can be enclosed in ampoules, disposable syringes or multiple dose vials made of glass or plastic. If administered intravenously, preferred carriers include, for example, physiological saline or phosphate buffered saline (PBS).

For parenteral formulations, the carrier usually comprises sterile water or aqueous sodium chloride solution, though other ingredients including those which aid dispersion may be included. Of course, where sterile water is to be used and maintained as sterile, the compositions and carriers are also sterilized. Injectable suspensions may also be prepared, in which case appropriate liquid carriers, suspending agents and the like may be employed. Formulations suitable for parenteral administration include aqueous and non-aqueous sterile injection solutions which may contain antioxidants, buffers, bacteriostats and solutes which render the formulation isotonic with the blood of the intended recipient; and aqueous and non-aqueous sterile suspensions which may include suspending agents and thickening agents. The formulations may be presented in unit-dose or multi-dose containers, for example, sealed ampules and vials, and may be stored in a freeze-dried (lyophilized) condition requiring only the addition of the sterile liquid carrier, for example, water for injections, immediately prior to use. Extemporaneous injection solutions and suspensions may be prepared from sterile powders, granules and tablets of the kind previously described.

Administration of the active compound may range from continuous (intravenous drip) to several oral administrations per day (for example, Q.I.D.) and may include oral, topical, eye or ocular, parenteral, intramuscular, intravenous, subcutaneous, transdermal (which may include a penetration enhancement agent), buccal and suppository administration, among other routes of administration, including through an eye or ocular route.

The neoplasia vaccine or immunogenic composition, and any additional agents, may be administered by injection, orally, parenterally, by inhalation spray, rectally, vaginally, or topically in dosage unit formulations containing conventional pharmaceutically acceptable carriers, adjuvants, and vehicles. The term parenteral as used herein includes, into a lymph node or nodes, subcutaneous, intravenous, intramuscular, intrasternal, infusion techniques, intraperitoneally, eye or ocular, intravitreal, intrabuccal, transdermal, intranasal, into the brain, including intracranial and intradural, into the joints, including ankles, knees, hips, shoulders, elbows, wrists, directly into tumors, and the like, and in suppository form.

In certain embodiments, the vaccine or immunogenic composition is administered intravenously or subcutaneously. Various techniques can be used for providing the subject compositions at the site of interest, such as injection, use of catheters, trocars, projectiles, pluronic gel, stents, sustained drug release polymers or other device which provides for internal access. Where an organ or tissue is accessible because of removal from the patient, such organ or tissue may be bathed in a medium containing the subject compositions, the subject compositions may be painted onto the organ, or may be applied in any convenient way.

The tumor specific neoantigenic peptides may be administered through a device suitable for the controlled and sustained release of a composition effective in obtaining a desired local or systemic physiological or pharmacological effect. The method includes positioning the sustained released drug delivery system at an area wherein release of the agent is desired and allowing the agent to pass through the device to the desired area of treatment.

The tumor specific neoantigenic peptides may be utilized in combination with at least one known other therapeutic agent, or a pharmaceutically acceptable salt of said agent. Examples of known therapeutic agents which can be used for combination therapy include, but are not limited to, corticosteroids (e.g., cortisone, prednisone, dexamethasone), non-steroidal anti-inflammatory drugs (NSAIDS) (e.g., ibuprofen, celecoxib, aspirin, indomethacin, naproxen), alkylating agents such as busulfan, cis-platin, mitomycin C, and carboplatin; antimitotic agents such as colchicine, vinblastine, paclitaxel, and docetaxel; topo I inhibitors such as camptothecin and topotecan; topo II inhibitors such as doxorubicin and etoposide; and/or RNA/DNA antimetabolites such as 5-azacytidine, 5-fluorouracil and methotrexate; DNA antimetabolites such as 5-fluoro-2'-deoxy-uridine, ara-C, hydroxyurea and thioguanine; antibodies such as HERCEPTIN and RITUXAN.

It should be understood that in addition to the ingredients particularly mentioned herein, the formulations of the present invention may include other agents conventional in the art having regard to the type of formulation in question, for example, those suitable for oral administration may include flavoring agents.

Pharmaceutically acceptable salt forms may be the preferred chemical form of compounds according to the present invention for inclusion in pharmaceutical compositions according to the present invention.

The present compounds or their derivatives, including prodrug forms of these agents, can be provided in the form of pharmaceutically acceptable salts. As used herein, the term pharmaceutically acceptable salts or complexes refers to appropriate salts or complexes of the active compounds according to the present invention which retain the desired biological activity of the parent compound and exhibit limited toxicological effects to normal cells. Nonlimiting examples of such salts are (a) acid addition salts formed with inorganic acids (for example, hydrochloric acid, hydrobromic acid, sulfuric acid, phosphoric acid, nitric acid, and the like), and salts formed with organic acids such as acetic acid, oxalic acid, tartaric acid, succinic acid, malic acid, ascorbic acid, benzoic acid, tannic acid, pamoic acid, alginic acid, and polyglutamic acid, among others; (b) base addition salts formed with metal cations such as zinc, calcium, sodium, potassium, and the like, among numerous others.

The compounds herein are commercially available or can be synthesized. As can be appreciated by the skilled artisan, further methods of synthesizing the compounds of the formulae herein is evident to those of ordinary skill in the art. Additionally, the various synthetic steps may be performed in an alternate sequence or order to give the desired compounds. Synthetic chemistry transformations and protecting group methodologies (protection and deprotection) useful in synthesizing the compounds described herein are known in the art and include, for example, those such as described in R. Larock, Comprehensive Organic Transformations, 2nd. Ed., Wiley-VCH Publishers (1999); T. W. Greene and P. G. M. Wuts, Protective Groups in Organic Synthesis, 3rd. Ed., John Wiley and Sons (1999); L. Fieser and M. Fieser, Fieser and Fieser's Reagents for Organic Synthesis, John Wiley and Sons (1999); and L. Paquette, ed., Encyclopedia of Reagents for Organic Synthesis, John Wiley and Sons (1995), and subsequent editions thereof.

The additional agents that may be included with the tumor specific neo-antigenic peptides of this invention may contain one or more asymmetric centers and thus occur as racemates and racemic mixtures, single enantiomers, individual diastereomers and diastereomeric mixtures. All such isomeric forms of these compounds are expressly included in the present invention. The compounds of this invention may also be represented in multiple tautomeric forms, in such instances, the invention expressly includes all tautomeric forms of the compounds described herein (e.g., alkylation of a ring system may result in alkylation at multiple sites, the invention expressly includes all such reaction products). All such isomeric forms of such compounds are expressly included in the present invention. All crystal forms of the compounds described herein are expressly included in the present invention.

Dosage. When the agents described herein are administered as pharmaceuticals to humans or animals, they can be given per se or as a pharmaceutical composition containing active ingredient in combination with a pharmaceutically acceptable carrier, excipient, or diluent.

Actual dosage levels and time course of administration of the active ingredients in the pharmaceutical compositions of the invention can be varied so as to obtain an amount of the active ingredient which is effective to achieve the desired therapeutic response for a particular patient, composition, and mode of administration, without being toxic to the patient. Generally, agents or pharmaceutical compositions of the invention are administered in an amount sufficient to reduce or eliminate symptoms associated with neoplasia, e.g. cancer or tumors.

A preferred dose of an agent is the maximum that a patient can tolerate and not develop serious or unacceptable side effects. Exemplary dose ranges include 0.01 mg to 250 mg per day, 0.01 mg to 100 mg per day, 1 mg to 100 mg per day, 10 mg to 100 mg per day, 1 mg to 10 mg per day, and 0.01 mg to 10 mg per day. A preferred dose of an agent is the maximum that a patient can tolerate and not develop serious or unacceptable side effects. In embodiments, the agent is administered at a concentration of about 10 micrograms to about 100 mg per kilogram of body weight per day, about 0.1 to about 10 mg/kg per day, or about 1.0 mg to about 10 mg/kg of body weight per day.

In embodiments, the pharmaceutical composition comprises an agent in an amount ranging between 1 and 10 mg, such as 1, 2, 3, 4, 5, 6, 7, 8, 9, or 10 mg.

In embodiments, the therapeutically effective dosage produces a serum concentration of an agent of from about 0.1 ng/ml to about 50-100 mg/ml. The pharmaceutical compositions 5 typically should provide a dosage of from about 0.001 mg to about 2000 mg of compound per kilogram of body weight per day. For example, dosages for systemic administration to a human patient can range from 1-10 mg/kg, 20-80 mg/kg, 5-50 mg/kg, 75-150 mg/kg, 100-500 mg/kg, 250-750 mg/kg, 500-1000 mg/kg, 1-10 mg/kg, 5-50 mg/kg, 25-75 mg/kg, 50-100 mg/kg, 100-250 mg/kg, 50-100 mg/kg, 250-500 mg/kg, 500-750 mg/kg, 750-1000 mg/kg, 1000-1500 mg/kg, 10 1500-2000 mg/kg, 5 mg/kg, 20 mg/kg, 50 mg/kg, 100 mg/kg, 500 mg/kg, 1000 mg/kg, 1500 mg/kg, or 2000 mg/kg. Pharmaceutical dosage unit forms are prepared to provide from about 1 mg to about 5000 mg, for example from about 100 to about 2500 mg of the compound or a combination of essential ingredients per dosage unit form.

In embodiments, about 50 nM to about 1 μM of an agent is administered to a subject. In related embodiments, about 50-100 nM, 50-250 nM, 100-500 nM, 250-500 nM, 250-750 nM, 500-750 nM, 500 nM to 1 μM, or 750 nM to 1 μM of an agent is administered to a subject.

Determination of an effective amount is well within the capability of those skilled in the art, especially in light of the detailed disclosure provided herein. Generally, an efficacious or effective amount of an agent is determined by first administering a low dose of the agent(s) and then incrementally increasing the administered dose or dosages until a desired effect (e.g., reduce or eliminate symptoms associated with viral infection or autoimmune disease) is observed in the treated subject, with minimal or acceptable toxic side effects. Applicable methods for determining an appropriate dose and dosing schedule for administration of a pharmaceutical composition of the present invention are described, for example, in Goodman and Gilman's The Pharmacological Basis of Therapeutics, Goodman et al., eds., 11th Edition, McGraw-Hill 2005, and Remington: The Science and Practice of Pharmacy, 20th and 21st Editions, Gennaro and University of the Sciences in Philadelphia, Eds., Lippincott Williams & Wilkins (2003 and 2005), each of which is hereby incorporated by reference.

Preferred unit dosage formulations are those containing a daily dose or unit, daily sub-dose, as herein discussed, or an appropriate fraction thereof, of the administered ingredient.

The dosage regimen for treating a disorder or a disease with the tumor specific neoantigenic peptides of this invention and/or compositions of this invention is based on a variety of factors, including the type of disease, the age, weight, sex, medical condition of the patient, the severity of the condition, the route of administration, and the particular compound employed. Thus, the dosage regimen may vary widely, but can be determined routinely using standard methods.

The amounts and dosage regimens administered to a subject can depend on a number of factors, such as the mode of administration, the nature of the condition being treated, the body weight of the subject being treated and the judgment of the prescribing physician; all such factors being within the ambit of the skilled artisan from this disclosure and the knowledge in the art.

The amount of compound included within therapeutically active formulations according to the present invention is an effective amount for treating the disease or condition. In general, a therapeutically effective amount of the present preferred compound in dosage form usually ranges from slightly less than about 0.025 mg/kg/day to about 2.5 g/kg/day, preferably about 0.1 mg/kg/day to about 100 mg/kg/day of the patient or considerably more, depending upon the compound used, the condition or infection treated and the route of administration, although exceptions to this dosage range may be contemplated by the present invention. In its most preferred form, compounds according to the present invention are administered in amounts ranging from about 1 mg/kg/day to about 100 mg/kg/day. The dosage of the compound can depend on the condition being treated, the particular compound, and other clinical factors such as weight and condition of the patient and the route of administration of the compound. It is to be understood that the present invention has application for both human and veterinary use.

For oral administration to humans, a dosage of between approximately 0.1 to 100 mg/kg/day, preferably between approximately 1 and 100 mg/kg/day, is generally sufficient.

Where drug delivery is systemic rather than topical, this dosage range generally produces effective blood level concentrations of active compound ranging from less than about 0.04 to about 400 micrograms/cc or more of blood in the patient. The compound is conveniently administered in any suitable unit dosage form, including but not limited to one containing 0.001 to 3000 mg, preferably 0.05 to 500 mg of active ingredient per unit dosage form. An oral dosage of 10-250 mg is usually convenient.

According to certain exemplary embodiments, the vaccine or immunogenic composition is administered at a dose of about 10 μg to 1 mg per neoantigenic peptide. According to certain exemplary embodiments, the vaccine or immunogenic composition is administered at an average weekly dose level of about 10 μg to 2000 μg per neoantigenic peptide.

The concentration of active compound in the drug composition will depend on absorption, distribution, inactivation, and excretion rates of the drug as well as other factors known to those of skill in the art. It is to be noted that dosage values will also vary with the severity of the condition to be alleviated. It is to be further understood that for any particular subject, specific dosage regimens should be adjusted over time according to the individual need and the professional judgment of the person administering or supervising the administration of the compositions, and that the concentration ranges set forth herein are exemplary only and are not intended to limit the scope or practice of the claimed composition. The active ingredient may be administered at once, or may be divided into a number of smaller doses to be administered at varying intervals of time.

The invention provides for pharmaceutical compositions containing at least one tumor specific neoantigen described herein. In embodiments, the pharmaceutical compositions contain a pharmaceutically acceptable carrier, excipient, or diluent, which includes any pharmaceutical agent that does not itself induce the production of an immune response harmful to a subject receiving the composition, and which may be administered without undue toxicity. As used herein, the term "pharmaceutically acceptable" means being approved by a regulatory agency of the Federal or a state government or listed in the U.S. Pharmacopia, European Pharmacopia or other generally recognized pharmacopia for use in mammals, and more particularly in humans. These compositions can be useful for treating and/or preventing viral infection and/or autoimmune disease.

A thorough discussion of pharmaceutically acceptable carriers, diluents, and other excipients is presented in Remington's Pharmaceutical Sciences (17th ed., Mack Publishing Company) and Remington: The Science and Practice of Pharmacy (21st ed., Lippincott Williams & Wilkins), which are hereby incorporated by reference. The formulation of the pharmaceutical composition should suit the mode of administration. In embodiments, the pharmaceutical composition is suitable for administration to humans, and can be sterile, non-particulate and/or non-pyrogenic.

Pharmaceutically acceptable carriers, excipients, or diluents include, but are not limited, to saline, buffered saline, dextrose, water, glycerol, ethanol, sterile isotonic aqueous buffer, and combinations thereof.

Wetting agents, emulsifiers and lubricants, such as sodium lauryl sulfate and magnesium stearate, as well as coloring agents, release agents, coating agents, sweetening, flavoring and perfuming agents, preservatives, and antioxidants can also be present in the compositions.

Examples of pharmaceutically-acceptable antioxidants include, but are not limited to: (1) water soluble antioxidants, such as ascorbic acid, cysteine hydrochloride, sodium bisulfate, sodium metabi sulfite, sodium sulfite and the like; (2) oil-soluble antioxidants, such as ascorbyl palmitate, butylated hydroxyanisole (BHA), butylated hydroxytoluene (BHT), lecithin, propyl gallate, alpha-tocopherol, and the like; and (3) metal chelating agents, such as citric acid, ethylenediamine tetraacetic acid (EDTA), sorbitol, tartaric acid, phosphoric acid, and the like.

In embodiments, the pharmaceutical composition is provided in a solid form, such as a lyophilized powder suitable for reconstitution, a liquid solution, suspension, emulsion, tablet, pill, capsule, sustained release formulation, or powder.

In embodiments, the pharmaceutical composition is supplied in liquid form, for example, in a sealed container indicating the quantity and concentration of the active ingredient in the pharmaceutical composition. In related embodiments, the liquid form of the pharmaceutical composition is supplied in a hermetically sealed container. Methods for formulating the pharmaceutical compositions of the present invention are conventional and well known in the art (see Remington and Remington's). One of skill in the art can readily formulate a pharmaceutical composition having the desired characteristics (e.g., route of administration, biosafety, and release profile).

Methods for preparing the pharmaceutical compositions include the step of bringing into association the active ingredient with a pharmaceutically acceptable carrier and, optionally, one or more accessory ingredients. The pharmaceutical compositions can be prepared by uniformly and intimately bringing into association the active ingredient with liquid carriers, or finely divided solid carriers, or both, and then, if necessary, shaping the product. Additional methodology for preparing the pharmaceutical compositions, including the preparation of multilayer dosage forms, are described in Ansel's Pharmaceutical Dosage Forms and Drug Delivery Systems (9th ed., Lippincott Williams & Wilkins), which is hereby incorporated by reference.

Pharmaceutical compositions suitable for oral administration can be in the form of capsules, cachets, pills, tablets, lozenges (using a flavored basis, usually sucrose and acacia or tragacanth), powders, granules, or as a solution or a suspension in an aqueous or non-aqueous liquid, or as an oil-in-water or water-in-oil liquid emulsion, or as an elixir or syrup, or as pastilles (using an inert base, such as gelatin and glycerin, or sucrose and acacia) and/or as mouth washes and the like, each containing a predetermined amount of a compound(s) described herein, a derivative thereof, or a pharmaceutically acceptable salt or prodrug thereof as the active ingredient(s). The active ingredient can also be administered as a bolus, electuary, or paste.

In solid dosage forms for oral administration (e.g., capsules, tablets, pills, dragees, powders, granules and the like), the active ingredient is mixed with one or more pharmaceutically acceptable carriers, excipients, or diluents, such as sodium citrate or dicalcium phosphate, and/or any of the following: (1) fillers or extenders, such as starches, lactose, sucrose, glucose, mannitol, and/or silicic acid; (2) binders, such as, for example, carboxymethylcellulose, alginates, gelatin, polyvinyl pyrrolidone, sucrose and/or acacia; (3) humectants, such as glycerol; (4) disintegrating agents, such as agar-agar, calcium carbonate, potato or tapioca starch, alginic acid, certain silicates, and sodium carbonate; (5) solution retarding agents, such as paraffin; (6) absorption accelerators, such as quaternary ammonium compounds; (7) wetting agents, such as, for example, acetyl alcohol and glycerol monostearate; (8) absorbents, such as kaolin and bentonite clay; (9) lubricants, such a talc, calcium stearate, magnesium stearate, solid polyethylene glycols, sodium lauryl sulfate, and mixtures thereof; and (10) coloring agents. In the case of capsules, tablets, and pills, the pharmaceutical compositions can also comprise buffering agents. Solid compositions of a similar type can also be prepared using fillers in soft and hard-filled gelatin capsules, and excipients such as lactose or milk sugars, as well as high molecular weight polyethylene glycols and the like.

A tablet can be made by compression or molding, optionally with one or more accessory ingredients. Compressed tablets can be prepared using binders (for example, gelatin or hydroxypropylmethyl cellulose), lubricants, inert diluents, preservatives, disintegrants (for example, sodium starch glycolate or cross-linked sodium carboxymethyl cellulose), surface-actives, and/or dispersing agents. Molded tablets can be made by molding in a suitable machine a mixture of the powdered active ingredient moistened with an inert liquid diluent.

The tablets and other solid dosage forms, such as dragees, capsules, pills, and granules, can optionally be scored or prepared with coatings and shells, such as enteric coatings and other coatings well known in the art.

In some embodiments, in order to prolong the effect of an active ingredient, it is desirable to slow the absorption of the compound from subcutaneous or intramuscular injection. This can be accomplished by the use of a liquid suspension of crystalline or amorphous material having poor water solubility. The rate of absorption of the active ingredient then depends upon its rate of dissolution which, in turn, can depend upon crystal size and crystalline form. Alternatively, delayed absorption of a parenterally-administered active ingredient is accomplished by dissolving or suspending the compound in an oil vehicle. In addition, prolonged absorption of the injectable pharmaceutical form can be brought about by the inclusion of agents that delay absorption such as aluminum monostearate and gelatin.

Controlled release parenteral compositions can be in form of aqueous suspensions, microspheres, microcapsules, magnetic microspheres, oil solutions, oil suspensions, emulsions, or the active ingredient can be incorporated in biocompatible carrier(s), liposomes, nanoparticles, implants or infusion devices.

Materials for use in the preparation of microspheres and/or microcapsules include biodegradable/bioerodible polymers such as polyglactin, poly-(isobutyl cyanoacrylate), poly(2-hydroxyethyl-L-glutamine) and poly(lactic acid). Biocompatible carriers which can be used when formulating a controlled release parenteral formulation include carbohydrates such as dextrans, proteins such as albumin, lipoproteins or antibodies.

Materials for use in implants can be non-biodegradable, e.g., polydimethylsiloxane, or biodegradable such as, e.g., poly(caprolactone), poly(lactic acid), poly(glycolic acid) or poly(ortho esters).

In embodiments, the active ingredient(s) are administered by aerosol. This is accomplished by preparing an aqueous aerosol, liposomal preparation, or solid particles containing the compound. A nonaqueous (e.g., fluorocarbon propellant) suspension can be used. The pharmaceutical composition can also be administered using a sonic nebulizer, which would minimize exposing the agent to shear, which can result in degradation of the compound.

Ordinarily, an aqueous aerosol is made by formulating an aqueous solution or suspension of the active ingredient(s) together with conventional pharmaceutically-acceptable carriers and stabilizers. The carriers and stabilizers vary with the requirements of the particular compound, but typically include nonionic surfactants (Tweens, Pluronics, or polyethylene glycol), innocuous proteins like serum albumin, sorbitan esters, oleic acid, lecithin, amino acids such as glycine, buffers, salts, sugars or sugar alcohols. Aerosols generally are prepared from isotonic solutions.

Dosage forms for topical or transdermal administration of an active ingredient(s) includes powders, sprays, ointments, pastes, creams, lotions, gels, solutions, patches and inhalants. The active ingredient(s) can be mixed under sterile conditions with a pharmaceutically acceptable carrier, and with any preservatives, buffers, or propellants as appropriate.

Transdermal patches suitable for use in the present invention are disclosed in Transdermal Drug Delivery: Developmental Issues and Research Initiatives (Marcel Dekker Inc., 1989) and U.S. Pat. Nos. 4,743,249, 4,906,169, 5,198,223, 4,816,540, 5,422,119, 5,023,084, which are hereby incorporated by reference. The transdermal patch can also be any transdermal patch well known in the art, including transscrotal patches. Pharmaceutical compositions in such transdermal patches can contain one or more absorption enhancers or skin permeation enhancers well known in the art (see, e.g., U.S. Pat. Nos. 4,379,454 and 4,973,468, which are hereby incorporated by reference). Transdermal therapeutic systems for use in the present invention can be based on iontophoresis, diffusion, or a combination of these two effects. Transdermal patches have the added advantage of providing controlled delivery of active ingredient(s) to the body. Such dosage forms can be made by dissolving or dispersing the active ingredient(s) in a proper medium. Absorption enhancers can also be used to increase the flux of the active ingredient across the skin. The rate of such flux can be controlled by either providing a rate controlling membrane or dispersing the active ingredient(s) in a polymer matrix or gel.

Such pharmaceutical compositions can be in the form of creams, ointments, lotions, liniments, gels, hydrogels, solutions, suspensions, sticks, sprays, pastes, plasters and other kinds of transdermal drug delivery systems. The compositions can also include pharmaceutically acceptable carriers or excipients such as emulsifying agents, antioxidants, buffering agents, preservatives, humectants, penetration enhancers, chelating agents, gel-forming agents, ointment bases, perfumes, and skin protective agents.

Examples of emulsifying agents include, but are not limited to, naturally occurring gums, e.g. gum acacia or gum tragacanth, naturally occurring phosphatides, e.g. soybean lecithin and sorbitan monooleate derivatives.

Examples of antioxidants include, but are not limited to, butylated hydroxy anisole (BHA), ascorbic acid and derivatives thereof, tocopherol and derivatives thereof, and cysteine.

Examples of preservatives include, but are not limited to, parabens, such as methyl or propyl p-hydroxybenzoate and benzalkonium chloride.

Examples of humectants include, but are not limited to, glycerin, propylene glycol, sorbitol and urea.

Examples of penetration enhancers include, but are not limited to, propylene glycol, DMSO, triethanolamine, N,N-dimethylacetamide, N,N-dimethylformamide, 2-pyrrolidone and derivatives thereof, tetrahydrofurfuryl alcohol, propylene glycol, diethylene glycol monoethyl or monomethyl ether with propylene glycol monolaurate or methyl laurate, eucalyptol, lecithin, TRANSCUTOL, and AZO E.

Examples of chelating agents include, but are not limited to, sodium EDTA, citric acid and phosphoric acid.

Examples of gel forming agents include, but are not limited to, Carbopol, cellulose derivatives, bentonite, alginates, gelatin and polyvinylpyrrolidone. In addition to the active ingredient(s), the ointments, pastes, creams, and gels of the present invention can contain excipients, such as animal and vegetable fats, oils, waxes, paraffins, starch, tragacanth, cellulose derivatives, polyethylene glycols, silicones, bentonites, silicic acid, talc and zinc oxide, or mixtures thereof.

Powders and sprays can contain excipients such as lactose, talc, silicic acid, aluminum hydroxide, calcium silicates and polyamide powder, or mixtures of these substances. Sprays can additionally contain customary propellants, such as chlorofluorohydrocarbons, and volatile unsubstituted hydrocarbons, such as butane and propane.

Injectable depot forms are made by forming microcapsule matrices of compound(s) of the invention in biodegradable polymers such as polylactide-polyglycolide. Depending on the ratio of compound to polymer, and the nature of the particular polymer employed, the rate of compound release can be controlled. Examples of other biodegradable polymers include poly(orthoesters) and poly(anhydrides). Depot injectable formulations are also prepared by entrapping the drug in liposomes or microemulsions which are compatible with body tissue.

Subcutaneous implants are well known in the art and are suitable for use in the present invention. Subcutaneous implantation methods are preferably non-irritating and mechanically resilient. The implants can be of matrix type, of reservoir type, or hybrids thereof. In matrix type devices, the carrier material can be porous or non-porous, solid or semi-solid, and permeable or impermeable to the active compound or compounds. The carrier material can be biodegradable or may slowly erode after administration. In some instances, the matrix is non-degradable but instead relies on the diffusion of the active compound through the matrix for the carrier material to degrade. Alternative subcutaneous implant methods utilize reservoir devices where the active compound or compounds are surrounded by a rate controlling membrane, e.g., a membrane independent of component concentration (possessing zero-order kinetics). Devices consisting of a matrix surrounded by a rate controlling membrane also suitable for use.

Both reservoir and matrix type devices can contain materials such as polydimethylsiloxane, such as SILASTIC, or other silicone rubbers. Matrix materials can be insoluble polypropylene, polyethylene, polyvinyl chloride, ethylvinyl acetate, polystyrene and polymethacrylate, as well as glycerol esters of the glycerol palmitostearate, glycerol stearate, and glycerol behenate type. Materials can be hydrophobic or hydrophilic polymers and optionally contain solubilizing agents. Subcutaneous implant devices can be slow-release capsules made with any suitable polymer, e.g., as described in U.S. Pat. Nos. 5,035,891 and 4,210,644, which are hereby incorporated by reference.

In general, at least four different approaches are applicable in order to provide rate control over the release and transdermal permeation of a drug compound. These approaches are: membrane-moderated systems, adhesive diffusion-controlled systems, matrix dispersion-type systems and microreservoir systems. It is appreciated that a controlled release percutaneous and/or topical composition can be obtained by using a suitable mixture of these approaches.

In a membrane-moderated system, the active ingredient is present in a reservoir which is totally encapsulated in a shallow compartment molded from a drug-impermeable laminate, such as a metallic plastic laminate, and a rate-controlling polymeric membrane such as a microporous or a non-porous polymeric membrane, e.g., ethylene-vinyl acetate copolymer. The active ingredient is released through the rate controlling polymeric membrane. In the drug reservoir, the active ingredient can either be dispersed in a solid polymer matrix or suspended in an unleachable, viscous liquid medium such as silicone fluid. On the external surface of the polymeric membrane, a thin layer of an adhesive polymer is applied to achieve an intimate contact of the transdermal system with the skin surface. The adhesive polymer is preferably a polymer which is hypoallergenic and compatible with the active drug substance.

In an adhesive diffusion-controlled system, a reservoir of the active ingredient is formed by directly dispersing the active ingredient in an adhesive polymer and then by, e.g., solvent casting, spreading the adhesive containing the active ingredient onto a flat sheet of substantially drug-impermeable metallic plastic backing to form a thin drug reservoir layer.

A matrix dispersion-type system is characterized in that a reservoir of the active ingredient is formed by substantially homogeneously dispersing the active ingredient in a hydrophilic or lipophilic polymer matrix. The drug-containing polymer is then molded into disc with a substantially well-defined surface area and controlled thickness. The adhesive polymer is spread along the circumference to form a strip of adhesive around the disc.

A microreservoir system can be considered as a combination of the reservoir and matrix dispersion type systems. In this case, the reservoir of the active substance is formed by first suspending the drug solids in an aqueous solution of water-soluble polymer and then dispersing the drug suspension in a lipophilic polymer to form a multiplicity of unleachable, microscopic spheres of drug reservoirs.

Any of the herein-described controlled release, extended release, and sustained release compositions can be formulated to release the active ingredient in about 30 minutes to about 1 week, in about 30 minutes to about 72 hours, in about 30 minutes to 24 hours, in about 30 minutes to 12 hours, in about 30 minutes to 6 hours, in about 30 minutes to 4 hours, and in about 3 hours to 10 hours. In embodiments, an effective concentration of the active ingredient(s) is sustained in a subject for 4 hours, 6 hours, 8 hours, 10 hours, 12 hours, 16 hours, 24 hours, 48 hours, 72 hours, or more after administration of the pharmaceutical compositions to the subject.

Vaccine or immunogenic compositions. The present invention is directed in some aspects to pharmaceutical compositions suitable for the prevention or treatment of cancer. In one embodiment, the composition comprises at least an immunogenic composition, e.g., a neoplasia vaccine or immunogenic composition capable of raising a specific T cell response. The neoplasia vaccine or immunogenic composition comprises neoantigenic peptides and/or neoantigenic polypeptides corresponding to tumor specific neoantigens as described herein.

A suitable neoplasia vaccine or immunogenic composition can preferably contain a plurality of tumor specific neoantigenic peptides. In an embodiment, the vaccine or immunogenic composition can include between 1 and 100 sets of peptides, more preferably between 1 and 50 such peptides, even more preferably between 10 and 30 sets peptides, even more preferably between 15 and 25 peptides. According to another preferred embodiment, the vaccine or immunogenic composition can include at least one peptides, more preferably 2, 3, 4, or 5 peptides. In certain embodiments, the vaccine or immunogenic composition can comprise 5, 6, 7, 8, 9, 10, 11, 12, 13, 14, 15, 16, 17, 18, 19, 20, 21, 22, 23, 24, 25, 26, 27, 28, 29, or 30 different peptides.

The optimum amount of each peptide to be included in the vaccine or immunogenic composition and the optimum dosing regimen can be determined by one skilled in the art without undue experimentation. For example, the peptide or its variant may be prepared for intravenous (i.v.) injection, sub-cutaneous (s.c.) injection, intradermal (i.d.) injection, intraperitoneal (i.p.) injection, intramuscular (i.m.) injection. Preferred methods of peptide injection include s.c, i.d., i.p., i.m., and i.v. Preferred methods of DNA injection include i.d., i.m., s.c, i.p. and i.v. For example, doses of between 1 and 500 mg 50 µg and 1.5 mg, preferably 10 µg to 500 µg, of peptide or DNA may be given and can depend from the respective peptide or DNA. Doses of this range were successfully used in previous trials (Brunsvig P F, et al., Cancer Immunol Immunother. 2006; 55(12): 1553-1564; M. Staehler, et al., ASCO meeting 2007; Abstract No 3017). Other methods of administration of the vaccine or immunogenic composition are known to those skilled in the art.

In one embodiment of the present invention the different tumor specific neoantigenic peptides and/or polypeptides are selected for use in the neoplasia vaccine or immunogenic composition so as to maximize the likelihood of generating an immune attack against the neoplasias/tumors in a high proportion of subjects in the population. Without being bound by theory, it is believed that the inclusion of a diversity of tumor specific neoantigenic peptides can generate a broad scale immune attack against a neoplasia/tumor. In one embodiment, the selected tumor specific neoantigenic peptides/polypeptides are encoded by missense mutations. In a second embodiment, the selected tumor specific neoantigenic peptides/polypeptides are encoded by a combination of missense mutations and neoORF mutations. In a third embodiment, the selected tumor specific neoantigenic peptides/polypeptides are encoded by neoORF mutations.

In one embodiment in which the selected tumor specific neoantigenic peptides/polypeptides are encoded by missense mutations, the peptides and/or polypeptides are chosen based on their capability to associate with the MHC molecules of a high proportion of subjects in the population. Peptides/polypeptides derived from neoOR mutations can also be selected on the basis of their capability to associate with the MHC molecules of the patient population.

The vaccine or immunogenic composition is capable of raising a specific cytotoxic T-cells response and/or a specific helper T cell response.

The vaccine or immunogenic composition can further comprise an adjuvant and/or a carrier. Examples of useful adjuvants and carriers are given herein. The peptides and/or polypeptides in the composition can be associated with a carrier such as, e.g., a protein or an antigen-presenting cell such as e.g. a dendritic cell (DC) capable of presenting the peptide to a T cell. Adjuvants are any substance whose admixture into the vaccine or immunogenic composition increases or otherwise modifies the immune response to the mutant peptide. Carriers are scaffold structures, for example a polypeptide or a polysaccharide, to which the neoantigenic peptides, is capable of being associated. Optionally, adjuvants are conjugated covalently or non-covalently to the peptides or polypeptides of the invention.

The ability of an adjuvant to increase the immune response to an antigen is typically manifested by a significant increase in immune-mediated reaction, or reduction in disease symptoms. For example, an increase in humoral immunity is typically manifested by a significant increase in the titer of antibodies raised to the antigen, and an increase in T cell activity is typically manifested in increased cell proliferation, or cellular cytotoxicity, or cytokine secretion. An adjuvant may also alter an immune response, for example, by changing a primarily humoral or Th2 response into a primarily cellular, or Th1 response.

Suitable adjuvants include, but are not limited to 1018 ISS, aluminum salts, Amplivax, AS15, BCG, CP-870,893, CpG7909, CyaA, dSLEVI, GM-CSF, IC30, IC31, Imiquimod, ImuFact FMP321, IS Patch, ISS, ISCOMATRIX, Juvlmmune, LipoVac, MF59, monophosphoryl lipid A, Montanide FMS 1312, Montanide ISA 206, Montanide ISA 50V, Montanide ISA-51, OK-432, OM-174, OM-197-MP-EC, ONTAK, PEPTEL. vector system, PLG microparticles, resiquimod, SRL172, Virosomes and other Virus-like particles, YF-17D, VEGF trap, R848, beta-glucan, Pam3Cys, Aquila's QS21 stimulon (Aquila Biotech, Worcester, Mass., USA) which is derived from saponin, mycobacterial extracts and synthetic bacterial cell wall mimics, and other proprietary adjuvants such as Ribi's Detox. Quil or Superfos. Several immunological adjuvants (e.g., MF59) specific for dendritic cells and their preparation have been described previously (Dupuis M, et al., Cell Immunol. 1998; 186(1): 18-27; Allison A C; Dev Biol Stand. 1998; 92:3-11). Also cytokines may be used. Several cytokines have been directly linked to influencing dendritic cell migration to lymphoid tissues (e.g., TNF-alpha), accelerating the maturation of dendritic cells into efficient antigen-presenting cells for T-lymphocytes (e.g., GM-CSF, IL-1 and IL-4) (U.S. Pat. No. 5,849,589, specifically incorporated herein by reference in its entirety) and acting as immunoadjuvants (e.g., IL-12) (Gabrilovich D I, et al., J Immunother Emphasis Tumor Immunol. 1996 (6):414-418).

Toll like receptors (TLRs) may also be used as adjuvants, and are important members of the family of pattern recognition receptors (PRRs) which recognize conserved motifs shared by many micro-organisms, termed "pathogen-associated molecular patterns" (PAMPS). Recognition of these "danger signals" activates multiple elements of the innate and adaptive immune system. TLRs are expressed by cells of the innate and adaptive immune systems such as dendritic cells (DCs), macrophages, T and B cells, mast cells, and granulocytes and are localized in different cellular compartments, such as the plasma membrane, lysosomes, endosomes, and endolysosomes. Different TLRs recognize distinct PAMPS. For example, TLR4 is activated by LPS contained in bacterial cell walls, TLR9 is activated by unmethylated bacterial or viral CpG DNA, and TLR3 is activated by double stranded RNA. TLR ligand binding leads to the activation of one or more intracellular signaling pathways, ultimately resulting in the production of many key molecules associated with inflammation and immunity (particularly the transcription factor NF-κB and the Type-I interferons). TLR mediated DC activation leads to enhanced DC activation, phagocytosis, upregulation of activation and co-stimulation markers such as CD80, CD83, and CD86, expression of CCR7 allowing migration of DC to draining lymph nodes and facilitating antigen presentation to T cells, as well as increased secretion of cytokines such as type I interferons, IL-12, and IL-6. All of these downstream events are critical for the induction of an adaptive immune response.

Among the most promising cancer vaccine or immunogenic composition adjuvants currently in clinical development are the TLR9 agonist CpG and the synthetic double-stranded RNA (dsRNA) TLR3 ligand poly-ICLC. In preclinical studies poly-ICLC appears to be the most potent TLR adjuvant when compared to LPS and CpG due to its induction of pro-inflammatory cytokines and lack of stimulation of IL-10, as well as maintenance of high levels of co-stimulatory molecules in DCsl. Furthermore, poly-ICLC was recently directly compared to CpG in non-human primates (rhesus macaques) as adjuvant for a protein vaccine or immunogenic composition consisting of human papillomavirus (HPV)16 capsomers (Stahl-Hennig C, Eisenblatter M, Jasny E, et al. Synthetic double-stranded RNAs are adjuvants for the induction of T helper 1 and humoral immune responses to human papillomavirus in rhesus macaques. PLoS pathogens. April 2009; 5(4)).

CpG immuno stimulatory oligonucleotides have also been reported to enhance the effects of adjuvants in a vaccine or immunogenic composition setting. Without being bound by theory, CpG oligonucleotides act by activating the innate (non-adaptive) immune system via Toll-like receptors (TLR), mainly TLR9. CpG triggered TLR9 activation enhances antigen-specific humoral and cellular responses to a wide variety of antigens, including peptide or protein antigens, live or killed viruses, dendritic cell vaccines, autologous cellular vaccines and polysaccharide conjugates in both prophylactic and therapeutic vaccines. More importantly, it enhances dendritic cell maturation and differentiation, resulting in enhanced activation of Th1 cells and strong cytotoxic T-lymphocyte (CTL) generation, even in the absence of CD4 T cell help. The Th1 bias induced by TLR9 stimulation is maintained even in the presence of vaccine adjuvants such as alum or incomplete Freund's adjuvant (IF A) that normally promote a Th2 bias. CpG oligonucleotides show even greater adjuvant activity when formulated or co-administered with other adjuvants or in formulations such as microparticles, nano particles, lipid emulsions or similar formulations, which are especially necessary for inducing a strong response when the antigen is relatively weak. They also accelerate the immune response and enabled the antigen doses to be reduced by approximately two orders of magnitude, with comparable antibody responses to the full-dose vaccine without CpG in some experiments (Arthur M. Krieg, Nature Reviews, Drug Discovery, 5, Jun. 2006, 471-484). U.S. Pat. No. 6,406,705 B1 describes the combined use of CpG oligonucleotides, non-nucleic acid adjuvants and an antigen to induce an antigen-specific immune response. A commercially available CpG TLR9 antagonist is dSLEVI (double Stem Loop Immunomodulator) by Mologen (Berlin, GERMANY), which is a preferred component of the pharmaceutical composition of the present invention. Other TLR binding molecules such as RNA binding TLR 7, TLR 8 and/or TLR 9 may also be used.

Other examples of useful adjuvants include, but are not limited to, chemically modified CpGs (e.g. CpR, Idera), Poly(I:C)(e.g. polyi:CI2U), non-CpG bacterial DNA or RNA as well as immunoactive small molecules and antibodies such as cyclophosphamide, sunitinib, bevacizumab, celebrex, NCX-4016, sildenafil, tadalafil, vardenafil, sorafenib, XL-999, CP-547632, pazopanib, ZD2171, AZD2171, ipilimumab, tremelimumab, and SC58175, which may act therapeutically and/or as an adjuvant. The amounts and concentrations of adjuvants and additives useful in the context of the present invention can readily be determined by the skilled artisan without undue experimentation. Additional adjuvants include colony-stimulating factors, such as Granulocyte Macrophage Colony Stimulating Factor (GM-CSF, sargramostim).

Poly-ICLC is a synthetically prepared double-stranded RNA consisting of polyI and polyC strands of average length of about 5000 nucleotides, which has been stabilized to thermal denaturation and hydrolysis by serum nucleases by the addition of polylysine and carboxymethylcellulose. The compound activates TLR3 and the RNA helicase-domain of MDA5, both members of the PAMP family, leading to DC and natural killer (NK) cell activation and production of a "natural mix" of type I interferons, cytokines, and chemokines. Furthermore, poly-ICLC exerts a more direct, broad host-targeted anti-infectious and possibly antitumor effect mediated by the two IFN-inducible nuclear enzyme systems, the 2'5'-OAS and the Pl/eIF2a kinase, also known as the PKR (4-6), as well as RIG-I helicase and MDA5.

In rodents and non-human primates, poly-ICLC was shown to enhance T cell responses to viral antigens, cross-priming, and the induction of tumor-, virus-, and autoantigen-specific CD8+ T cells. In a recent study in non-human primates, poly-ICLC was found to be essential for the generation of antibody responses and T cell immunity to DC targeted or non-targeted HIV Gag p24 protein, emphasizing its effectiveness as a vaccine adjuvant.

In human subjects, transcriptional analysis of serial whole blood samples revealed similar gene expression profiles among the 8 healthy human volunteers receiving one single s.c. administration of poly-ICLC and differential expression of up to 212 genes between these 8 subjects versus 4 subjects receiving placebo. Remarkably, comparison of the poly-ICLC gene expression data to previous data from volunteers immunized with the highly effective yellow fever vaccine YF17D showed that a large number of transcriptional and signal transduction canonical pathways, including those of the innate immune system, were similarly upregulated at peak time points.

More recently, an immunologic analysis was reported on patients with ovarian, fallopian tube, and primary peritoneal cancer in second or third complete clinical remission who were treated on a phase 1 study of subcutaneous vaccination with synthetic overlapping long peptides (OLP) from the cancer testis antigen NY-ESO-1 alone or with Montanide-ISA-51, or with 1.4 mg poly-ICLC and Montanide. The generation of NY-ESO-1-specific CD4+ and CD8+ T cell and antibody responses were markedly enhanced with the addition of poly-ICLC and Montanide compared to OLP alone or OLP and Montanide.

A vaccine or immunogenic composition according to the present invention may comprise more than one different adjuvant. Furthermore, the invention encompasses a therapeutic composition comprising any adjuvant substance including any of those herein discussed. It is also contemplated that the peptide or polypeptide, and the adjuvant can be administered separately in any appropriate sequence. A carrier may be present independently of an adjuvant. The carrier may be covalently linked to the antigen. A carrier can also be added to the antigen by inserting DNA encoding the carrier in frame with DNA encoding the antigen. The function of a carrier can for example be to confer stability, to increase the biological activity, or to increase serum half-life. Extension of the half-life can help to reduce the number of applications and to lower doses, thus are beneficial for therapeutic but also economic reasons. Furthermore, a carrier may aid presenting peptides to T cells. The carrier may be any suitable carrier known to the person skilled in the art, for example a protein or an antigen presenting cell. A carrier protein could be but is not limited to keyhole limpet hemocyanin, serum proteins such as transferrin, bovine serum albumin, human serum albumin, thyroglobulin or ovalbumin, immunoglobulins, or hormones, such as insulin or palmitic acid. For immunization of humans, the carrier may be a physiologically acceptable carrier acceptable to humans and safe. However, tetanus toxoid and/or diptheria toxoid are suitable carriers in one embodiment of the invention. Alternatively, the carrier may be dextrans for example sepharose.

Cytotoxic T cells (CTLs) recognize an antigen in the form of a peptide bound to an MHC molecule rather than the intact foreign antigen itself. The MHC molecule itself is located at the cell surface of an antigen presenting cell. Thus, an activation of CTLs is only possible if a trimeric complex of peptide antigen, MHC molecule, and APC is present. Correspondingly, it may enhance the immune response if not only the peptide is used for activation of CTLs, but if additionally APCs with the respective MHC molecule are added. Therefore, in some embodiments the vaccine or immunogenic composition according to the present invention additionally contains at least one antigen presenting cell.

The antigen-presenting cell (or stimulator cell) typically has an MHC class I or II molecule on its surface, and in one embodiment is substantially incapable of itself loading the MHC class I or II molecule with the selected antigen. As is described in more detail herein, the MHC class I or II molecule may readily be loaded with the selected antigen in vitro.

CD8+ cell activity may be augmented through the use of CD4+ cells. The identification of CD4 T+ cell epitopes for tumor antigens has attracted interest because many immune based therapies against cancer may be more effective if both CD8+ and CD4+T lymphocytes are used to target a patient's tumor. CD4+ cells are capable of enhancing CD8 T cell responses. Many studies in animal models have clearly demonstrated better results when both CD4+ and CD8+ T cells participate in anti-tumor responses (see e.g., Nishimura et al. (1999) Distinct role of antigen-specific T helper type 1 (TH1) and Th2 cells in tumor eradication in vivo. J Ex Med 190:617-27). Universal CD4+ T cell epitopes have been identified that are applicable to developing therapies against different types of cancer (see e.g., Kobayashi et al. (2008) Current Opinion in Immunology 20:221-27). For example, an HLA-DR restricted helper peptide from tetanus toxoid was used in melanoma vaccines to activate CD4+ T cells non-specifically (see e.g., Slingluff et al. (2007) Immunologic and Clinical Outcomes of a Randomized Phase II Trial of Two Multipeptide Vaccines for Melanoma in the Adjuvant Setting, Clinical Cancer Research 13(21):6386-

95). It is contemplated within the scope of the invention that such CD4+ cells may be applicable at three levels that vary in their tumor specificity: 1) a broad level in which universal CD4+ epitopes (e.g., tetanus toxoid) may be used to augment CD8+ cells; 2) an intermediate level in which native, tumor-associated CD4+ epitopes may be used to augment CD8+ cells; and 3) a patient specific level in which neoantigen CD4+ epitopes may be used to augment CD8+ cells in a patient specific manner. Although current algorithms for predicting CD4 epitopes are limited in accuracy, it is a reasonable expectation that many long peptides containing predicted CD8 neoepitopes will also include CD4 epitopes. CD4 epitopes are longer than CD8 epitopes and typically are 10-12 amino acids in length although some can be longer (Kreiter et al, Mutant MHC Class II epitopes drive therapeutic immune responses to cancer, Nature (2015)). Thus, the neoantigen epitopes described herein, either in the form of long peptides (>25 amino acids) or nucleic acids encoding such long peptides, may also boost CD4 responses in a tumor and patient-specific manner (level (3) above).

CD8+ cell immunity may also be generated with neoantigen loaded dendritic cell (DC) vaccine. DCs are potent antigen-presenting cells that initiate T cell immunity and can be used as cancer vaccines when loaded with one or more peptides of interest, for example, by direct peptide injection. For example, patients that were newly diagnosed with metastatic melanoma were shown to be immunized against 3 HLA-A*0201-restricted gplOO melanoma antigen-derived peptides with autologous peptide pulsed CD40L/IFN-g-activated mature DCs via an IL-12p70-producing patient DC vaccine (see e.g., Carreno et al (2013) L-12p70-producing patient DC vaccine elicits Tel-polarized immunity, Journal of Clinical Investigation, 123(8):3383-94 and Ali et al. (2009) In situ regulation of DC subsets and T cells mediates tumor regression in mice, Cancer Immunotherapy, 1(8): 1-10). It is contemplated within the scope of the invention that neoantigen loaded DCs may be prepared using the synthetic TLR 3 agonist Polyinosinic-Polycytidylic Acid-poly-L-lysine Carboxymethylcellulose (Poly-ICLC) to stimulate the DCs. Poly-ICLC is a potent individual maturation stimulus for human DCs as assessed by an upregulation of CD83 and CD86, induction of interleukin-12 (IL-12), tumor necrosis factor (TNF), interferon gamma-induced protein 10 (IP-10), interleukin 1 (IL-1), and type I interferons (IFN), and minimal interleukin 10 (IL-10) production. DCs may be differentiated from frozen peripheral blood mononuclear cells (PBMCs) obtained by leukapheresis, while PBMCs may be isolated by Ficoll gradient centrifugation and frozen in aliquots.

Illustratively, the following 7 day activation protocol may be used. Day 1 PBMCs are thawed and plated onto tissue culture flasks to select for monocytes which adhere to the plastic surface after 1-2 hr incubation at 37° C. in the tissue culture incubator. After incubation, the lymphocytes are washed off and the adherent monocytes are cultured for 5 days in the presence of interleukin-4 (IL-4) and granulocyte macrophage-colony stimulating factor (GM-CSF) to differentiate to immature DCs. On Day 6, immature DCs are pulsed with the keyhole limpet hemocyanin (KLH) protein which serves as a control for the quality of the vaccine and may boost the immunogenicity of the vaccine. The DCs are stimulated to mature, loaded with peptide antigens, and incubated overnight. On Day 7, the cells are washed, and frozen in 1 ml aliquots containing 4-20×10(6) cells using a controlled-rate freezer. Lot release testing for the batches of DCs may be performed to meet minimum specifications before the DCs are injected into patients (see e.g., Sabado et al. (2013) Preparation of tumor antigen-loaded mature dendritic cells for immunotherapy, J. Vis Exp. August 1; (78). doi: 10.3791/50085).

A DC vaccine may be incorporated into a scaffold system to facilitate delivery to a patient. Therapeutic treatment of a patients neoplasia with a DC vaccine may utilize a biomaterial system that releases factors that recruit host dendritic cells into the device, differentiates the resident, immature DCs by locally presenting adjuvants (e.g., danger signals) while releasing antigen, and promotes the release of activated, antigen loaded DCs to the lymph nodes (or desired site of action) where the DCs may interact with T cells to generate a potent cytotoxic T lymphocyte response to the cancer neoantigens. Implantable biomaterials may be used to generate a potent cytotoxic T lymphocyte response against a neoplasia in a patient specific manner. The biomaterial-resident dendritic cells may then be activated by exposing them to danger signals mimicking infection, in concert with release of antigen from the biomaterial. The activated dendritic cells then migrate from the biomaterials to lymph nodes to induce a cytotoxic T effector response. This approach has previously been demonstrated to lead to regression of established melanoma in preclinical studies using a lysate prepared from tumor biopsies (see e.g., Ali et al. (2209) In situ regulation of DC subsets and T cells mediates tumor regression in mice, Cancer Immunotherapy 1(8): 1-10; Ali et al. (2009) Infection-mimicking materials to program dendritic cells in situ. Nat Mater 8: 151-8), and such a vaccine is currently being tested in a Phase I clinical trial recently initiated at the Dana-Farber Cancer Institute. This approach has also been shown to lead to regression of glioblastoma, as well as the induction of a potent memory response to prevent relapse, using the C6 rat glioma model.24 in the current proposal. The ability of such an implantable, biomatrix vaccine delivery scaffold to amplify and sustain tumor specific dendritic cell activation may lead to more robust anti-tumor immunosensitization than can be achieved by traditional subcutaneous or intra-nodal vaccine administrations.

The present invention may include any method for loading a neoantigenic peptide onto a dendritic cell. One such method applicable to the present invention is a microfluidic intracellular delivery system. Such systems cause temporary membrane disruption by rapid mechanical deformation of human and mouse immune cells, thus allowing the intracellular delivery of biomolecules (Sharei et al., 2015, PLOS ONE).

Preferably, the antigen presenting cells are dendritic cells. Suitably, the dendritic cells are autologous dendritic cells that are pulsed with the neoantigenic peptide. The peptide may be any suitable peptide that gives rise to an appropriate T cell response. T cell therapy using autologous dendritic cells pulsed with peptides from a tumor associated antigen is disclosed in Murphy et al. (1996) The Prostate 29, 371-380 and Tjua et al. (1997) The Prostate 32, 272-278. In certain embodiments the dendritic cells are targeted using CD141, DEC205, or XCR1 markers. CD141+XCR1+DCs were identified as a subset that may be better suited to the induction of anti-tumor responses (Bachem et al., J. Exp. Med. 207, 1273-1281 (2010); Crozat et al., J. Exp. Med. 207, 1283-1292 (2010); and Gallois & Bhardwaj, Nature Med. 16, 854-856 (2010)).

Thus, in one embodiment of the present invention the vaccine or immunogenic composition containing at least one antigen presenting cell is pulsed or loaded with one or more peptides of the present invention. Alternatively, peripheral blood mononuclear cells (PBMCs) isolated from a patient may be loaded with peptides ex vivo and injected back into the patient. As an alternative the antigen presenting cell comprises an expression construct encoding a peptide of the present invention. The polynucleotide may be any suitable polynucleotide and it is preferred that it is capable of transducing the dendritic cell, thus resulting in the presentation of a peptide and induction of immunity.

The inventive pharmaceutical composition may be compiled so that the selection, number and/or amount of peptides present in the composition covers a high proportion of subjects in the population. The selection may be dependent on the specific type of cancer, the status of the disease, earlier treatment regimens, and, of course, the HLA-haplotypes present in the patient population.

Pharmaceutical compositions comprising the peptide of the invention may be administered to an individual already suffering from cancer. In therapeutic applications, compositions are administered to a patient in an amount sufficient to elicit an effective CTL response to the tumor antigen and to cure or at least partially arrest symptoms and/or complications. An amount adequate to accomplish this is defined as "therapeutically effective dose." Amounts effective for this use can depend on, e.g., the peptide composition, the manner of administration, the stage and severity of the disease being treated, the weight and general state of health of the patient, and the judgment of the prescribing physician, but generally range for the initial immunization (that is for therapeutic or prophylactic administration) from about 1.0 µg to about 50,000 µg of peptide for a 70 kg patient, followed by boosting dosages or from about 1.0 µg to about 10,000 µg of peptide pursuant to a boosting regimen over weeks to months depending upon the patient's response and condition and possibly by measuring specific CTL activity in the patient's blood. It should be kept in mind that the peptide and compositions of the present invention may generally be employed in serious disease states, that is, life-threatening or potentially life threatening situations, especially when the cancer has metastasized. For therapeutic use, administration should begin as soon as possible after the detection or surgical removal of tumors. This is followed by boosting doses until at least symptoms are substantially abated and for a period thereafter.

The pharmaceutical compositions (e.g., vaccine compositions) for therapeutic treatment are intended for parenteral, topical, nasal, oral or local administration. Preferably, the pharmaceutical compositions are administered parenterally, e.g., intravenously, subcutaneously, intradermally, or intramuscularly. The compositions may be administered at the site of surgical excision to induce a local immune response to the tumor. The invention provides compositions for parenteral administration which comprise a solution of the peptides and vaccine or immunogenic compositions are dissolved or suspended in an acceptable carrier, preferably an aqueous carrier. A variety of aqueous carriers may be used, e.g., water, buffered water, 0.9% saline, 0.3% glycine, hyaluronic acid and the like. These compositions may be sterilized by conventional, well known sterilization techniques, or may be sterile filtered. The resulting aqueous solutions may be packaged for use as is, or lyophilized, the lyophilized preparation being combined with a sterile solution prior to administration. The compositions may contain pharmaceutically acceptable auxiliary substances as required to approximate physiological conditions, such as pH adjusting and buffering agents, tonicity adjusting agents, wetting agents and the like, for example, sodium acetate, sodium lactate, sodium chloride, potassium chloride, calcium chloride, sorbitan monolaurate, triethanolamine oleate, etc.

A liposome suspension containing a peptide may be administered intravenously, locally, topically, etc. in a dose which varies according to, inter alia, the manner of administration, the peptide being delivered, and the stage of the disease being treated. For targeting to the immune cells, a ligand, such as, e.g., antibodies or fragments thereof specific for cell surface determinants of the desired immune system cells, can be incorporated into the liposome.

For solid compositions, conventional or nanoparticle nontoxic solid carriers may be used which include, for example, pharmaceutical grades of mannitol, lactose, starch, magnesium stearate, sodium saccharin, talcum, cellulose, glucose, sucrose, magnesium carbonate, and the like. For oral administration, a pharmaceutically acceptable nontoxic composition is formed by incorporating any of the normally employed excipients, such as those carriers previously listed, and generally 10-95% of active ingredient, that is, one or more peptides of the invention, and more preferably at a concentration of 25%-75%.

For aerosol administration, the immunogenic peptides are preferably supplied in finely divided form along with a surfactant and propellant. Typical percentages of peptides are 0.01%-20% by weight, preferably 1%-10%. The surfactant can, of course, be nontoxic, and preferably soluble in the propellant. Representative of such agents are the esters or partial esters of fatty acids containing from 6 to 22 carbon atoms, such as caproic, octanoic, lauric, palmitic, stearic, linoleic, linolenic, olesteric and oleic acids with an aliphatic polyhydric alcohol or its cyclic anhydride. Mixed esters, such as mixed or natural glycerides may be employed. The surfactant may constitute 0.1%-20% by weight of the composition, preferably 0.25-5%. The balance of the composition is ordinarily propellant. A carrier can also be included as desired, as with, e.g., lecithin for intranasal delivery.

The peptides and polypeptides of the invention can be readily synthesized chemically utilizing reagents that are free of contaminating bacterial or animal substances (Merrifield R B: Solid phase peptide synthesis. I. The synthesis of a tetrapeptide. J. Am. Chem. Soc. 85:2149-54, 1963).

The peptides and polypeptides of the invention can also be expressed by a vector, e.g., a nucleic acid molecule as herein-discussed, e.g., RNA or a DNA plasmid, a viral vector such as a poxvirus, e.g., orthopox virus, avipox virus, or adenovirus, AAV or lentivirus. This approach involves the use of a vector to express nucleotide sequences that encode the peptide of the invention. Upon introduction into an acutely or chronically infected host or into a noninfected host, the vector expresses the immunogenic peptide, and thereby elicits a host CTL response.

For therapeutic or immunization purposes, nucleic acids encoding the peptide of the invention and optionally one or more of the peptides described herein can also be administered to the patient. A number of methods are conveniently used to deliver the nucleic acids to the patient. For instance, the nucleic acid can be delivered directly, as "naked DNA". This approach is described, for instance, in Wolff et al., Science 247: 1465-1468 (1990) as well as U.S. Pat. Nos. 5,580,859 and 5,589,466. The nucleic acids can also be administered using ballistic delivery as described, for instance, in U.S. Pat. No. 5,204,253. Particles comprised solely of DNA can be administered. Alternatively, DNA can be adhered to particles, such as gold particles. Generally, a plasmid for a vaccine or immunological composition can comprise DNA encoding an antigen (e.g., one or more neoantigens) operatively linked to regulatory sequences which control expression or expression and secretion of the antigen from a host cell, e.g., a mammalian cell; for instance, from upstream to downstream, DNA for a promoter, such as a mammalian virus promoter (e.g., a CMV promoter such as an hCMV or mCMV promoter, e.g., an early-intermediate promoter, or an SV40 promoter-see documents cited or incorporated herein for useful promoters), DNA for a eukaryotic leader peptide for secretion (e.g., tissue plasminogen activator), DNA for the neoantigen(s), and DNA encoding a terminator (e.g., the 3' UTR transcriptional terminator from the gene encoding Bovine Growth Hormone or bGH polyA). A composition can contain more than one plasmid or vector, whereby each vector contains and expresses a different neoantigen. Mention is also made of Wasmoen U.S. Pat. No. 5,849,303, and Dale U.S. Pat. No. 5,811,104, whose text may be useful. DNA or DNA plasmid formulations can be formulated with or inside cationic lipids; and, as to cationic lipids, as well as adjuvants, mention is also made of Loosmore U.S. Patent Application 2003/0104008. Also, teachings in Audonnet U.S. Pat. Nos. 6,228,846 and 6,159,477 may be relied upon for DNA plasmid teachings that can be employed in constructing and using DNA plasmids that contain and express in vivo.

The nucleic acids can also be delivered complexed to cationic compounds, such as cationic lipids. Lipid-mediated gene delivery methods are described, for instance, in W01996/18372; WO 1993/24640; Mannino & Gould-Fogerite, BioTechniques 6(7): 682-691 (1988); U.S. Pat. No. 5,279,833; WO 1991/06309; and Feigner et al., Proc. Natl. Acad. Sci. USA 84: 7413-7414 (1987).

RNA encoding the peptide of interest (e.g., mRNA) can also be used for delivery (see, e.g., Kiken et al, 2011; Su et al, 2011; see also U.S. Pat. No. 8,278,036; Halabi et al. J Clin Oncol (2003) 21: 1232-1237; Petsch et al, Nature Biotechnology 2012 Dec. 7; 30(12): 1210-6).

Viral vectors as described herein can also be used to deliver the neoantigenic peptides of the invention. Vectors can be administered so as to have in vivo expression and response akin to doses and/or responses elicited by antigen administration.

A preferred means of administering nucleic acids encoding the peptide of the invention uses minigene constructs encoding multiple epitopes. To create a DNA sequence encoding the selected CTL epitopes (minigene) for expression in human cells, the amino acid sequences of the epitopes are reverse translated. A human codon usage table is used to guide the codon choice for each amino acid. These epitope-encoding DNA sequences are directly adjoined, creating a continuous polypeptide sequence. To optimize expression and/or immunogenicity, additional elements can be incorporated into the minigene design. Examples of amino acid sequence that could be reverse translated and included in the minigene sequence include: helper T lymphocyte, epitopes, a leader (signal) sequence, and an endoplasmic reticulum retention signal. In addition, MHC presentation of CTL epitopes may be improved by including synthetic (e.g. poly-alanine) or naturally-occurring flanking sequences adjacent to the CTL epitopes.

The minigene sequence is converted to DNA by assembling oligonucleotides that encode the plus and minus strands of the minigene. Overlapping oligonucleotides (30-100 bases long) are synthesized, phosphorylated, purified and annealed under appropriate conditions using well known techniques. The ends of the oligonucleotides are joined using T4 DNA ligase. This synthetic minigene, encoding the CTL epitope polypeptide, can then cloned into a desired expression vector.

Standard regulatory sequences well known to those of skill in the art are included in the vector to ensure expression in the target cells. Several vector elements are required: a promoter with a down-stream cloning site for minigene insertion; a polyadenylation signal for efficient transcription termination; an E. coli origin of replication; and an E. coli selectable marker (e.g. ampicillin or kanamycin resistance). Numerous promoters can be used for this purpose, e.g., the human cytomegalovirus (hCMV) promoter. See, U.S. Pat. Nos. 5,580,859 and 5,589,466 for other suitable promoter sequences.

Additional vector modifications may be desired to optimize minigene expression and immunogenicity. In some cases, introns are required for efficient gene expression, and one or more synthetic or naturally-occurring introns could be incorporated into the transcribed region of the minigene. The inclusion of mRNA stabilization sequences can also be considered for increasing minigene expression. It has recently been proposed that immuno stimulatory sequences (ISSs or CpGs) play a role in the immunogenicity of DNA' vaccines. These sequences could be included in the vector, outside the minigene coding sequence, if found to enhance immunogenicity.

In some embodiments, a bicistronic expression vector, to allow production of the minigene-encoded epitopes and a second protein included to enhance or decrease immunogenicity can be used. Examples of proteins or polypeptides that could beneficially enhance the immune response if co-expressed include cytokines (e.g., IL2, IL12, GM-CSF), cytokine-inducing molecules (e.g. LeIF) or costimulatory molecules. Helper (HTL) epitopes could be joined to intracellular targeting signals and expressed separately from the CTL epitopes. This would allow direction of the HTL epitopes to a cell compartment different than the CTL epitopes. If required, this could facilitate more efficient entry of HTL epitopes into the MHC class II pathway, thereby improving CTL induction. In contrast to CTL induction, specifically decreasing the immune response by co-expression of immunosuppressive molecules (e.g. TGF-β) may be beneficial in certain diseases.

Once an expression vector is selected, the minigene is cloned into the polylinker region downstream of the promoter. This plasmid is transformed into an appropriate E. coli strain, and DNA is prepared using standard techniques. The orientation and DNA sequence of the minigene, as well as all other elements included in the vector, are confirmed using restriction mapping and DNA sequence analysis. Bacterial cells harboring the correct plasmid can be stored as a master cell bank and a working cell bank.

Purified plasmid DNA can be prepared for injection using a variety of formulations. The simplest of these is reconstitution of lyophilized DNA in sterile phosphate-buffer saline (PBS). A variety of methods have been described, and new techniques may become available. As noted herein, nucleic acids are conveniently formulated with cationic lipids. In addition, glycolipids, fusogenic liposomes, peptides and compounds referred to collectively as protective, interactive, non-condensing (PINC) could also be complexed to purified plasmid DNA to influence variables such as stability, intramuscular dispersion, or trafficking to specific organs or cell types.

Target cell sensitization can be used as a functional assay for expression and MHC class I presentation of minigene-encoded CTL epitopes. The plasmid DNA is introduced into a mammalian cell line that is suitable as a target for standard CTL chromium release assays. The transfection method used is dependent on the final formulation. Electroporation can be used for "naked" DNA, whereas cationic lipids allow direct in vitro transfection. A plasmid expressing green fluorescent protein (GFP) can be co-transfected to allow enrichment of transfected cells using fluorescence activated cell sorting (FACS). These cells are then chromium-51 labeled and used as target cells for epitope-specific CTL lines. Cytolysis, detected by 51 Cr release, indicates production of MHC presentation of mini gene-encoded CTL epitopes.

In vivo immunogenicity is a second approach for functional testing of minigene DNA formulations. Transgenic mice expressing appropriate human MHC molecules are immunized with the DNA product. The dose and route of administration are formulation dependent (e.g. FM for DNA in PBS, IP for lipid-complexed DNA). Twenty-one days after immunization, splenocytes are harvested and restimulated for 1 week in the presence of peptides encoding each epitope being tested. These effector cells (CTLs) are assayed for cytolysis of peptide-loaded, chromium-51 labeled target cells using standard techniques. Lysis of target cells sensitized by MHC loading of peptides corresponding to minigene-encoded epitopes demonstrates DNA vaccine function for in vivo induction of CTLs.

Peptides may be used to elicit CTL ex vivo, as well. The resulting CTL, can be used to treat chronic tumors in patients in need thereof that do not respond to other conventional forms of therapy, or does not respond to a peptide vaccine approach of therapy. Ex vivo CTL responses to a particular tumor antigen are induced by incubating in tissue culture the patient's CTL precursor cells (CTLp) together with a source of antigen-presenting cells (APC) and the appropriate peptide. After an appropriate incubation time (typically 1-4 weeks), in which the CTLp are activated and mature and expand into effector CTL, the cells are infused back into the patient, where they destroy their specific target cell (i.e., a tumor cell). In order to optimize the in vitro conditions for the generation of specific cytotoxic T cells, the culture of stimulator cells are maintained in an appropriate serum-free medium.

Prior to incubation of the stimulator cells with the cells to be activated, e.g., precursor CD8+ cells, an amount of antigenic peptide is added to the stimulator cell culture, of sufficient quantity to become loaded onto the human Class I molecules to be expressed on the surface of the stimulator cells. In the present invention, a sufficient amount of peptide is an amount that allows about 200, and preferably 200 or more, human Class I MHC molecules loaded with peptide to be expressed on the surface of each stimulator cell. Preferably, the stimulator cells are incubated with >2 μg/ml peptide. For example, the stimulator cells are incubated with >3, 4, 5, 10, 15, or more g/ml peptide.

Resting or precursor CD8+ cells are then incubated in culture with the appropriate stimulator cells for a time period sufficient to activate the CD8+ cells. Preferably, the CD8+ cells are activated in an antigen-specific manner. The ratio of resting or precursor CD8+(effector) cells to stimulator cells may vary from individual to individual and may further depend upon variables such as the amenability of an individual's lymphocytes to culturing conditions and the nature and severity of the disease condition or other condition for which the within-described treatment modality is used. Preferably, however, the lymphocyte: stimulator cell ratio is in the range of about 30:1 to 300:1. The effector/stimulator culture may be maintained for as long a time as is necessary to stimulate a therapeutically useable or effective number of CD8+ cells.

The induction of CTL in vitro requires the specific recognition of peptides that are bound to allele specific MHC class I molecules on APC. The number of specific MHC/peptide complexes per APC is crucial for the stimulation of CTL, particularly in primary immune responses. While small amounts of peptide/MHC complexes per cell are sufficient to render a cell susceptible to lysis by CTL, or to stimulate a secondary CTL response, the successful activation of a CTL precursor (pCTL) during primary response requires a significantly higher number of MHC/peptide complexes. Peptide loading of empty major histocompatability complex molecules on cells allows the induction of primary cytotoxic T lymphocyte responses.

Since mutant cell lines do not exist for every human MHC allele, it is advantageous to use a technique to remove endogenous MHC-associated peptides from the surface of APC, followed by loading the resulting empty MHC molecules with the immunogenic peptides of interest. The use of non-transformed (non-tumorigenic), noninfected cells, and preferably, autologous cells of patients as APC is desirable for the design of CTL induction protocols directed towards development of ex vivo CTL therapies. This application discloses methods for stripping the endogenous MHC-associated peptides from the surface of APC followed by the loading of desired peptides.

A stable MHC class I molecule is a trimeric complex formed of the following elements: 1) a peptide usually of 8-10 residues, 2) a transmembrane heavy polymorphic protein chain which bears the peptide-binding site in its a1 and a2 domains, and 3) a non-covalently associated non-polymorphic light chain, p2microglobuiin. Removing the bound peptides and/or dissociating the p2microglobulin from the complex renders the MHC class I molecules nonfunctional and unstable, resulting in rapid degradation. All MHC class I molecules isolated from PBMCs have endogenous peptides bound to them. Therefore, the first step is to remove all endogenous peptides bound to MHC class I molecules on the APC without causing their degradation before exogenous peptides can be added to them.

Two possible ways to free up MHC class I molecules of bound peptides include lowering the culture temperature from 37° C. to 26° C. overnight to destabilize p2microglobulin and stripping the endogenous peptides from the cell using a mild acid treatment. The methods release previously bound peptides into the extracellular environment allowing new exogenous peptides to bind to the empty class I molecules. The cold-temperature incubation method enables exogenous peptides to bind efficiently to the MHC complex, but requires an overnight incubation at 26° C. which may slow the cell's metabolic rate. It is also likely that cells not actively synthesizing MHC molecules (e.g., resting PBMC) would not produce high amounts of empty surface MHC molecules by the cold temperature procedure.

Harsh acid stripping involves extraction of the peptides with trifluoroacetic acid, pH 2, or acid denaturation of the immunoaffinity purified class I-peptide complexes. These methods are not feasible for CTL induction, since it is important to remove the endogenous peptides while preserving APC viability and an optimal metabolic state which is critical for antigen presentation. Mild acid solutions of pH 3 such as glycine or citrate-phosphate buffers have been used to identify endogenous peptides and to identify tumor associated T cell epitopes. The treatment is especially effective, in that only the MHC class I molecules are destabilized (and associated peptides released), while other surface antigens remain intact, including MHC class II molecules. Most importantly, treatment of cells with the mild acid solutions do not affect the cell's viability or metabolic state. The mild acid treatment is rapid since the stripping of the endogenous peptides occurs in two minutes at 4° C. and the APC is ready to perform its function after the appropriate peptides are loaded. The technique is utilized herein to make peptide-specific APCs for the generation of primary antigen-specific CTL. The resulting APC are efficient in inducing peptide-specific CD8+CTL.

Activated CD8+ cells may be effectively separated from the stimulator cells using one of a variety of known methods. For example, monoclonal antibodies specific for the stimulator cells, for the peptides loaded onto the stimulator cells, or for the CD8+ cells (or a segment thereof) may be utilized to bind their appropriate complementary ligand. Antibody-tagged molecules may then be extracted from the stimulator-effector cell admixture via appropriate means, e.g., via well-known immunoprecipitation or immunoassay methods.

Effective, cytotoxic amounts of the activated CD8+ cells can vary between in vitro and in vivo uses, as well as with the amount and type of cells that are the ultimate target of these killer cells. The amount can also vary depending on the condition of the patient and should be determined via consideration of all appropriate factors by the practitioner. Preferably, however, about $1 \times 10^6$ to about $1 \times 10^{12}$, more preferably about $1 \times 10^8$ to about $1 \times 10^{11}$, and even more preferably, about $1 \times 10^9$ to about $1 \times 10^{10}$ activated CD8+ cells are utilized for adult humans, compared to about $5 \times 10^6$-$5 \times 10^7$ cells used in mice.

Preferably, as discussed herein, the activated CD 8+ cells are harvested from the cell culture prior to administration of the CD8+ cells to the individual being treated. It is important to note, however, that unlike other present and proposed treatment modalities, the present method uses a cell culture system that is not tumorigenic. Therefore, if complete separation of stimulator cells and activated CD8+ cells are not achieved, there is no inherent danger known to be associated with the administration of a small number of stimulator cells, whereas administration of mammalian tumor-promoting cells may be extremely hazardous.

Methods of re-introducing cellular components are known in the art and include procedures such as those exemplified in U.S. Pat. No. 4,844,893 to Honsik, et al. and U.S. Pat. No. 4,690,915 to Rosenberg. For example, administration of activated CD8+ cells via intravenous infusion is appropriate.

The practice of the present invention employs, unless otherwise indicated, conventional techniques of molecular biology (including recombinant techniques), microbiology, cell biology, biochemistry and immunology, which are well within the purview of the skilled artisan. Such techniques are explained fully in the literature, such as, "Molecular Cloning: A Laboratory Manual", second edition (Sambrook, 1989); "Oligonucleotide Synthesis" (Gait, 1984); "Animal Cell Culture" (Freshney, 1987); "Methods in Enzymology" "Handbook of Experimental Immunology" (Wei, 1996); "Gene Transfer Vectors for Mammalian Cells" (Miller and Calos, 1987); "Current Protocols in Molecular Biology" (Ausubel, 1987); "PCR: The Polymerase Chain Reaction", (Mullis, 1994); "Current Protocols in Immunology" (Coligan, 1991). These techniques are applicable to the production of the polynucleotides and polypeptides of the invention, and, as such, may be considered in making and practicing the invention. Particularly useful techniques for particular embodiments are discussed in the sections that follow.

The present invention provides methods of inducing a neoplasia/tumor specific immune response in a subject, vaccinating against a neoplasia/tumor, treating, alleviating a symptom of cancer, preventing or treating an infection, treating an autoimmune disease, or preventing transplant rejection in a subject by administering the subject a plurality of antigenic peptides or composition of the invention. According to the invention, the herein-described vaccine or immunogenic composition may be used for a patient that has been diagnosed as having cancer, or at risk of developing cancer.

The claimed combination of the invention is administered in an amount sufficient to induce a CTL response.

Any compositions or methods provided herein can be combined with one or more of any of the other compositions and methods provided herein.

The tumor specific neoantigen peptides and pharmaceutical compositions described herein can also be administered in a combination therapy with another agent, for example a therapeutic agent. By "agent" is meant any small molecule chemical compound, antibody, nucleic acid molecule, or polypeptide, or fragments thereof. In certain embodiments, the additional agents can be, but are not limited to, chemotherapeutic agents, anti-angiogenesis agents and agents that reduce immune-suppression.

"Combination therapy" is intended to embrace administration of therapeutic agents (e.g. neoantigenic peptides described herein) in a sequential manner, that is, wherein each therapeutic agent is administered at a different time, as well as administration of these therapeutic agents, or at least two of the therapeutic agents, in a substantially simultaneous manner. Substantially simultaneous administration can be accomplished, for example, by administering to the subject a single capsule having a fixed ratio of each therapeutic agent or in multiple, single capsules for each of the therapeutic agents. For example, one combination of the present invention may comprise a pooled sample of neoantigenic peptides administered at the same or different times, or they can be formulated as a single, co-formulated pharmaceutical composition comprising the peptides. As another example, a combination of the present invention (e.g., a pooled sample of tumor specific neoantigens) may be formulated as separate pharmaceutical compositions that can be administered at the same or different time. As used herein, the term "simultaneously" is meant to refer to administration of one or more agents at the same time. For example, in certain embodiments, the neoantigenic peptides are administered simultaneously. Simultaneously includes administration contemporaneously, that is during the same period of time. In certain embodiments, the one or more agents are administered simultaneously in the same hour, or simultaneously in the same day. Sequential or substantially simultaneous administration of each therapeutic agent can be effected by any appropriate route including, but not limited to, oral routes, intravenous routes, sub-cutaneous routes, intramuscular routes, direct absorption through mucous membrane tissues (e.g., nasal, mouth, vaginal, and rectal), and ocular routes (e.g., intravitreal, intraocular, etc.). The therapeutic agents can be administered by the same route or by different routes. For example, one component of a particular combination may be administered by intravenous injection while the other component(s) of the combination may be administered orally. The components may be administered in any therapeutically effective sequence. The phrase "combination" embraces groups of compounds or non-drug therapies useful as part of a combination therapy.

The neoplasia vaccine or immunogenic composition can be administered before, during, or after administration of the additional agent. In embodiments, the neoplasia vaccine or immunogenic composition is administered before the first administration of the additional agent. In other embodiments, the neoplasia vaccine or immunogenic composition is administered after the first administration of the additional therapeutic agent (e.g., 1, 2, 3, 4, 5, 6, 7, 8, 9, 10, 11, 12, 13, 14 days or more). In embodiments, the neoplasia vaccine or immunogenic composition is administered simultaneously with the first administration of the additional therapeutic agent.

The therapeutic agent is for example, a chemotherapeutic or biotherapeutic agent, radiation, or immunotherapy. Any suitable therapeutic treatment for a particular cancer may be administered. Examples of chemotherapeutic and biotherapeutic agents include, but are not limited to, an angiogenesis inhibitor, such as hydroxyangiostatin Kl-3, DL-a-Difluorom ethyl—ornithine, endostatin, fumagillin, genistein, minocycline, staurosporine, and thalidomide; a DNA intercaltor/ cross-linker, such as Bleomycin, Carboplatin, Carmustine, Chlorambucil, Cyclophosphamide, cis-Diammineplatinum (II) dichloride (Cisplatin), Melphalan, Mitoxantrone, and Oxaliplatin; a DNA synthesis inhibitor, such as (±)-Amethopterin (Methotrexate), 3-Amino-1,2,4-benzotriazine 1,4-di oxide, Aminopterin, Cytosine β-D-arabinofuranoside, 5-Fluoro-5'-deoxyuridine, 5-Fluorouracil, Ganciclovir, Hydroxyurea, and Mitomycin C; a DNA-RNA transcription regulator, such as Actinomycin D, Daunorubicin, Doxorubicin, Homoharringtonine, and Idarubicin; an enzyme inhibitor, such as S(+)-Camptothecin, Curcumin, (−)-Deguelin, 5,6-Dichlorobenzimidazole I-β-D-ribofuranoside, Etoposide, Formestane, Fostriecin, Hispidin, 2-Imino-l-imidazoli-dineacetic acid (Cyclocreatine), Mevinolin, Trichostatin A, Tyrphostin AG 34, and Tyrphostin AG 879; a gene regulator, such as 5-Aza-2'-deoxycytidine, 5-Azacytidine, Cholecalciferol (Vitamin D3), 4-Hydroxytamoxifen, Melatonin, Mifepristone, Raloxifene, all trans-Retinal (Vitamin A aldehyde), Retinoic acid all trans (Vitamin A acid), 9-cis-Retinoic Acid, 13-cis-Retinoic acid, Retinol (Vitamin A), Tamoxifen, and Troglitazone; a microtubule inhibitor, such as Colchicine, docetaxel, Dolastatin 15, Nocodazole, Paclitaxel, Podophyllotoxin, Rhizoxin, Vinblastine, Vincristine, Vindesine, and Vinorelbine (Navelbine); and an unclassified therapeutic agent, such as 17-(Allylamino)-17-demethoxygeldanamycin, 4-Amino-1,8-naphthalimide, Apigenin, Brefeldin A, Cimetidine, Dichloromethylene-diphosphonic acid, Leuprolide (Leuprorelin), Luteinizing Hormone-Releasing Hormone, Pifithrin-a, Rapamycin, Sex hormone-binding globulin, Thapsigargin, and Urinary trypsin inhibitor fragment (Bikunin). The therapeutic agent may be altretamine, amifostine, asparaginase, capecitabine, cladribine, cisapride, cytarabine, dacarbazine (DTIC), dactinomycin, dronabinol, epoetin alpha, filgrastim, fludarabine, gemcitabine, granisetron, ifosfamide, irinotecan, lansoprazole, levamisole, leucovorin, megestrol, mesna, metoclopramide, mitotane, omeprazole, ondansetron, pilocarpine, prochlorperazine, or topotecan hydrochloride. The therapeutic agent may be a monoclonal antibody or small molecule such as rituximab (Rituxan®), alemtuzumab (Campath®), Bevacizumab (Avastin®), Cetuximab (Erbitux®), panitumumab (Vectibix®), and trastuzumab (Herceptin®), Vemurafenib (Zelboraf®) imatinib mesylate (Gleevec®), erlotinib (Tarceva®), gefitinib (Iressa®), Vismodegib (Erivedge™), 90Y-ibritumomab tiuxetan, 131I-tositumomab, ado-trastuzumab emtansine, lapatinib (Tykerb®), pertuzumab (Perjeta™), ado-trastuzumab emtansine (Kadcyla™) regorafenib (Stivarga®), sunitinib (Sutent®), Denosumab (Xgeva®), sorafenib (Nexavar®), pazopanib (Votrient®), axitinib (Inlyta®), dasatinib (Sprycel®), nilotinib (Tasigna®), bosutinib (Bosulif®), ofatumumab (Arzerra®), obinutuzumab (Gazyva™), ibrutinib (Imbruvica™) idelalisib (Zydelig®), crizotinib (Xalkori®), erlotinib (Tarceva®), afatinib dimaleate (Gilotrif®), ceritinib (LDK378/Zykadia), Tositumomab and 131I-tositumomab (Bexxar®), ibritumomab tiuxetan (Zevalin®), brentuximab vedotin (Adcetris®), bortezomib (Velcade®), siltuximab (Sylvant™), trametinib (Mekinist®), dabrafenib (Tafinlar®), pembrolizumab (Keytruda®), carfilzomib (Kyprolis®), Ramucirumab (Cyramza™), Cabozantinib (Cometriq™), vandetanib (Caprelsa®), Optionally, the therapeutic agent is a neoantigen. The therapeutic agent may be a cytokine such as interferons (INFs), interleukins (TLs), or hematopoietic growth factors. The therapeutic agent may be INF-α, IL-2, Aldesleukin, IL-2, Erythropoietin, Granulocyte-macrophage colony-stimulating factor (GM-CSF) or granulocyte colony-stimulating factor. The therapeutic agent may be a targeted therapy such as toremifene (Fareston®), fulvestrant (Faslodex®), anastrozole (Arimidex®), exemestane (Aromasin®), letrozole (Femara®), ziv-aflibercept (Zaltrap®), Alitretinoin (Panretin®), temsirolimus (Torisel®), Tretinoin (Vesanoid®), denileukin diftitox (Ontak®), vorinostat (Zolinza®), romidepsin (Istodax®), bexarotene (Targretin®), pralatrexate (Folotyn®), lenalidomide (Revlimid®), belinostat (Beleodaq™), lenaliomide (Revlimid®), pomalidomide (Pomalyst®), Cabazitaxel (Jevtana®), enzalutamide (Xtandi®), abiraterone acetate (Zytiga®), radium 223 chloride (Xofigo®), or everolimus (Afinitor®). Additionally, the therapeutic agent may be an epigenetic targeted drug such as FIDAC inhibitors, kinase inhibitors, DNA methyltransferase inhibitors, histone demethylase inhibitors, or histone methylation inhibitors. The epigenetic drugs may be Azacitidine (Vidaza), Decitabine (Dacogen), Vorinostat (Zolinza), Romidepsin (Istodax), or Ruxolitinib (Jakafi). For prostate cancer treatment, a preferred chemotherapeutic agent with which anti-CTLA-4 can be combined is paclitaxel (TAXOL).

In certain embodiments, the one or more additional agents are one or more anti-glucocorticoid-induced tumor necrosis factor family receptor (GITR) agonistic antibodies. GITR is a costimulatory molecule for T lymphocytes, modulates innate and adaptive immune system and has been found to participate in a variety of immune responses and inflammatory processes. GITR was originally described by Nocentini et al. after being cloned from dexamethasone-treated murine T cell hybridomas (Nocentini et al. Proc Natl Acad Sci USA 94:6216-6221.1997). Unlike CD28 and CTLA-4, GITR has a very low basal expression on naive CD4+ and CD8+ T cells (Ronchetti et al. Eur J Immunol 34:613-622. 2004). The observation that GITR stimulation has immunostimulatory effects in vitro and induced autoimmunity in vivo prompted the investigation of the antitumor potency of triggering this pathway. A review of Modulation Of Ctla 4 And Gitr For Cancer Immunotherapy can be found in Cancer Immunology and Immunotherapy (Avogadri et al. Current Topics in Microbiology and Immunology 344. 2011). Other agents that can contribute to relief of immune suppression include checkpoint inhibitors targeted at another member of the CD28/CTLA4 Ig superfamily such as BTLA, LAG3, ICOS, PDL1 or KIR (Page et a, Annual Review of Medicine 65:27 (2014)). In further additional embodiments, the checkpoint inhibitor is targeted at a member of the TNFR superfamily such as CD40, OX40, CD 137, GITR, CD27 or TEVI-3. In some cases targeting a checkpoint inhibitor is accomplished with an inhibitory antibody or similar molecule. In other cases, it is accomplished with an agonist for the target; examples of this class include the stimulatory targets OX40 and GITR.

In certain embodiments, the one or more additional agents are synergistic in that they increase immunogenicity after treatment. In one embodiment, the additional agent allows for lower toxicity and/or lower discomfort due to lower doses of the additional therapeutic agents or any components of the combination therapy described herein. In another embodiment the additional agent results in longer lifespan due to increased effectiveness of the combination therapy described herein. Chemotherapeutic treatments that enhance the immunological response in a patient have been reviewed (Zitvogel et al., Immunological aspects of cancer chemotherapy. Nat Rev Immunol. 2008 January; 8(1):59-73). Additionally, chemotherapeutic agents can be administered safely with immunotherapy without inhibiting vaccine specific T cell responses (Perez et al., A new era in anticancer peptide vaccines. Cancer May 2010). In one embodiment, the additional agent is administered to increase the efficacy of the therapy described herein. In one embodiment the additional agent is a chemotherapy treatment. In one embodiment, low doses of chemotherapy potentiate delayed-type hypersensitivity (DTH) responses. In one embodiment, the chemotherapy agent targets regulatory T cells. In one embodiment, cyclophosphamide is the therapeutic agent. In one embodiment cyclophosphamide is administered prior to vaccination. In one embodiment, cyclophosphamide is administered as a single dose before vaccination (Walter et al., Multipeptide immune response to cancer vaccine IMA901 after single-dose cyclophosphamide associates with longer patient survival. Nature Medicine; 18:8 2012). In another embodiment, cyclophosphamide is administered according to a metronomic program, where a daily dose is administered for one month (Ghiringhelli et al., Metronomic cyclophosphamide regimen selectively depletes CD4+CD25+ regulatory T cells and restores T and NK effector functions in end stage cancer patients. Cancer Immunol Immunother 2007 56:641-648). In another embodiment, taxanes are administered before vaccination to enhance T-cell and NK-cell functions (Zitvogel et al., 2008, Nat. Rev. Immunol., 8(1):59-73). In another embodiment a low dose of a chemotherapeutic agent is administered with the therapy described herein. In one embodiment the chemotherapeutic agent is estramustine. In one embodiment the cancer is hormone resistant prostate cancer. A >50% decrease in serum prostate specific antigen (PSA) was seen in 8.7% of advanced hormone refractory prostate cancer patients by personalized vaccination alone, whereas such a decrease was seen in 54% of patients when the personalized vaccination was combined with a low dose of estramustine (Itoh et al., Personalized peptide vaccines: A new therapeutic modality for cancer. Cancer Sci 2006; 97: 970-976). In another embodiment glucocorticoids are administered with or before the therapy described herein (Zitvogel et al., 2008, Nat. Rev. Immunol., 8(1):59-73). In another embodiment glucocorticoids are administered after the therapy described herein. In another embodiment Gemcitabine is administered before, simultaneously, or after the therapy described herein to enhance the frequency of tumor specific CTL precursors (Zitvogel et al., 2008, Nat. Rev. Immunol., 8(1):59-73). In another embodiment 5-fluorouracil is administered with the therapy described herein as synergistic effects were seen with a peptide based vaccine (Zitvogel et al., 2008, Nat. Rev. Immunol., 8(1):59-73). In another embodiment an inhibitor of Braf, such as Vemurafenib, is used as an additional agent. Braf inhibition has been shown to be associated with an increase in melanoma antigen expression and T cell infiltrate and a decrease in immunosuppressive cytokines in tumors of treated patients (Frederick et al., BRAF inhibition is associated with enhanced melanoma antigen expression and a more favorable tumor microenvironment in patients with metastatic melanoma. Clin Cancer Res. 2013; 19: 1225-1231). In another embodiment an inhibitor of tyrosine kinases is used as an additional agent. In one embodiment the tyrosine kinase inhibitor is used before vaccination with the therapy described herein. In one embodiment the tyrosine kinase inhibitor is used simultaneously with the therapy described herein. In another embodiment the tyrosine kinase inhibitor is used to create a more immune permissive environment. In another embodiment the tyrosine kinase inhibitor is sunitinib or imatinib mesylate. It has previously been shown that favorable outcomes could be achieved with sequential administration of continuous daily dosing of sunitinib and recombinant vaccine (Farsaci et al., Consequence of dose scheduling of sunitinib on host immune response elements and vaccine combination therapy. Int J Cancer; 130: 1948-1959). Sunitinib has also been shown to reverse type-1 immune suppression using a daily dose of 50 mg/day (Finke et al., Sunitinib Reverses Type-1 Immune Suppression and Decreases T-Regulatory Cells in Renal Cell Carcinoma Patients. Clin Cancer Res 2008; 14(20)). In another embodiment targeted therapies are administered in combination with the therapy described herein. Doses of targeted therapies has been described previously (Alvarez, Present and future evolution of advanced breast cancer therapy. Breast Cancer Research 2010, 12(Suppl 2):S1). In another embodiment temozolomide is administered with the therapy described herein. In one embodiment temozolomide is administered at 200 mg/day for 5 days every fourth week of a combination therapy with the therapy described herein. Results of a similar strategy have been shown to have low toxicity (Kyte et al., Tel om erase Peptide Vaccination Combined with Temozolomide: A Clinical Trial in Stage IV Melanoma Patients. Clin Cancer Res; 17(13) 2011). In another embodiment the therapy is administered with an additional therapeutic agent that results in lymphopenia. In one embodiment the additional agent is temozolomide. An immune response can still be induced under these conditions (Sampson et al., Greater chemotherapy-induced lymphopenia enhances tumor-specific immune responses that eliminate EGFRvIII-expressing tumor cells in patients with glioblastoma. Neuro-Oncology 13(3):324-333, 2011).

Patients in need thereof may receive a series of priming vaccinations with a mixture of tumor-specific peptides. Additionally, over a 4 week period the priming may be followed by two boosts during a maintenance phase. All vaccinations are subcutaneously delivered. The vaccine or immunogenic composition is evaluated for safety, tolerability, immune response and clinical effect in patients and for feasibility of producing vaccine or immunogenic composition and successfully initiating vaccination within an appropriate time frame. The first cohort can consist of 5 patients, and after safety is adequately demonstrated, an additional cohort of 10 patients may be enrolled. Peripheral blood is extensively monitored for peptide-specific T cell responses and patients are followed for up to two years to assess disease recurrence.

Administering a combination therapy consistent with standard of care. In another aspect, the therapy described herein provides selecting the appropriate point to administer a combination therapy in relation to and within the standard of care for the cancer being treated for a patient in need thereof. The studies described herein show that the combination therapy can be effectively administered even within the standard of care that includes surgery, radiation, or chemotherapy. The standards of care for the most common cancers can be found on the website of National Cancer Institute (www.cancer.gov/cancertopics). The standard of care is the current treatment that is accepted by medical experts as a proper treatment for a certain type of disease and that is widely used by healthcare professionals. Standard or care is also called best practice, standard medical care, and standard therapy. Standards of Care for cancer generally include surgery, lymph node removal, radiation, chemotherapy, targeted therapies, antibodies targeting the tumor, and immunotherapy. Immunotherapy can include checkpoint blockers (CBP), chimeric antigen receptors (CARs), and adoptive T cell therapy. The combination therapy described herein can be incorporated within the standard of care. The combination therapy described herein may also be administered where the standard of care has changed due to advances in medicine.

Incorporation of the combination therapy described herein may depend on a treatment step in the standard of care that can lead to activation of the immune system. Treatment steps that can activate and function synergistically with the combination therapy have been described herein. The therapy can be advantageously administered simultaneously or after a treatment that activates the immune system.

Incorporation of the combination therapy described herein may depend on a treatment step in the standard of care that causes the immune system to be suppressed. Such treatment steps may include irradiation, high doses of alkylating agents and/or methotrexate, steroids such as glucoteroids, surgery, such as to remove the lymph nodes, imatinib mesylate, high doses of T F, and taxanes (Zitvogel et al., 2008, Nat. Rev. Immunol., 8(1):59-73). The combination therapy may be administered before such steps or may be administered after.

In one embodiment the combination therapy may be administered after bone marrow transplants and peripheral blood stem cell transplantation. Bone marrow transplantation and peripheral blood stem cell transplantation are procedures that restore stem cells that were destroyed by high doses of chemotherapy and/or radiation therapy. After being treated with high-dose anticancer drugs and/or radiation, the patient receives harvested stem cells, which travel to the bone marrow and begin to produce new blood cells. A "mini-transplant" uses lower, less toxic doses of chemotherapy and/or radiation to prepare the patient for transplant. A "tandem transplant" involves two sequential courses of high-dose chemotherapy and stem cell transplant. In autologous transplants, patients receive their own stem cells. In syngeneic transplants, patients receive stem cells from their identical twin. In allogeneic transplants, patients receive stem cells from their brother, sister, or parent. A person who is not related to the patient (an unrelated donor) also may be used. In some types of leukemia, the graft-versus-tumor (GVT) effect that occurs after allogeneic BMT and PBSCT is crucial to the effectiveness of the treatment. GVT occurs when white blood cells from the donor (the graft) identify the cancer cells that remain in the patient's body after the chemotherapy and/or radiation therapy (the tumor) as foreign and attack them. Immunotherapy with the combination therapy described herein can take advantage of this by vaccinating after a transplant. Additionally, the transferred cells may be presented with neoantigens of the combination therapy described herein before transplantation.

In one embodiment the combination therapy is administered to a patient in need thereof with a cancer that requires surgery. In one embodiment the combination therapy described herein is administered to a patient in need thereof in a cancer where the standard of care is primarily surgery followed by treatment to remove possible micro-metastases, such as breast cancer. Breast cancer is commonly treated by various combinations of surgery, radiation therapy, chemotherapy, and hormone therapy based on the stage and grade of the cancer. Adjuvant therapy for breast cancer is any treatment given after primary therapy to increase the chance of long-term survival. Neoadjuvant therapy is treatment given before primary therapy. Adjuvant therapy for breast cancer is any treatment given after primary therapy to increase the chance of long-term disease-free survival. Primary therapy is the main treatment used to reduce or eliminate the cancer. Primary therapy for breast cancer usually includes surgery, a mastectomy (removal of the breast) or a lumpectomy (surgery to remove the tumor and a small amount of normal tissue around it; a type of breast-conserving surgery). During either type of surgery, one or more nearby lymph nodes are also removed to see if cancer cells have spread to the lymphatic system. When a woman has breast-conserving surgery, primary therapy almost always includes radiation therapy. Even in early-stage breast cancer, cells may break away from the primary tumor and spread to other parts of the body (metastasize). Therefore, doctors give adjuvant therapy to kill any cancer cells that may have spread, even if they cannot be detected by imaging or laboratory tests.

In one embodiment the combination therapy is administered consistent with the standard of care for Ductal carcinoma in situ (DCIS). The standard of care for this breast cancer type is: 1. Breast-conserving surgery and radiation therapy with or without tamoxifen; 2. Total mastectomy with or without tamoxifen; 3. Breast-conserving surgery without radiation therapy. The combination therapy may be administered before breast conserving surgery or total mastectomy to shrink the tumor before surgery. In another embodiment the combination therapy can be administered as an adjuvant therapy to remove any remaining cancer cells.

In another embodiment patients diagnosed with stage I, II, IIIA, and Operable IIIC breast cancer are treated with the combination therapy as described herein. The standard of care for this breast cancer type is: 1. Local-regional treatment: Breast-conserving therapy (lumpectomy, breast radiation, and surgical staging of the axilla), Modified radical mastectomy (removal of the entire breast with level I-II axillary dissection) with or without breast reconstruction, Sentinel node biopsy. 2. Adjuvant radiation therapy postmastectomy in axillary node-positive tumors: For one to three nodes: unclear role for regional radiation (infra/supraclavicular nodes, internal mammary nodes, axillary nodes, and chest wall). For more than four nodes or extranodal involvement: regional radiation is advised. 3. Adjuvant systemic therapy. In one embodiment the combination therapy is administered as a neoadjuvant therapy to shrink the tumor. In another embodiment the combination is administered as an adjuvant systemic therapy.

In another embodiment patients diagnosed with inoperable stage IIIB or IIIC or inflammatory breast cancer are treated with the combination therapy as described herein. The standard of care for this breast cancer type is: 1. Multimodality therapy delivered with curative intent is the standard of care for patients with clinical stage IIIB disease.

2. Initial surgery is generally limited to biopsy to permit the determination of histology, estrogen-receptor (ER) and progesterone-receptor (PR) levels, and human epidermal growth factor receptor 2 (HER2/neu) overexpression. Initial treatment with anthracycline-based chemotherapy and/or taxane-based therapy is standard. For patients who respond to neoadjuvant chemotherapy, local therapy may consist of total mastectomy with axillary lymph node dissection followed by postoperative radiation therapy to the chest wall and regional lymphatics. Breast-conserving therapy can be considered in patients with a good partial or complete response to neoadjuvant chemotherapy. Subsequent systemic therapy may consist of further chemotherapy. Hormone therapy should be administered to patients whose tumors are ER-positive or unknown. All patients should be considered candidates for clinical trials to evaluate the most appropriate fashion in which to administer the various components of multimodality regimens.

In one embodiment the combination therapy is administered as part of the various components of multimodality regimens. In another embodiment the combination therapy is administered before, simultaneously with, or after the multimodality regimens. In another embodiment the combination therapy is administered based on synergism between the modalities. In another embodiment the combination therapy is administered after treatment with anthracycline-based chemotherapy and/or taxane-based therapy (Zitvogel et al., 2008, Nat. Rev. Immunol., 8(1):59-73). Treatment after administering the combination therapy may negatively affect dividing effector T cells. The combination therapy may also be administered after radiation.

In another embodiment the combination therapy described herein is used in the treatment in a cancer where the standard of care is primarily not surgery and is primarily based on systemic treatments, such as Chronic Lymphocytic Leukemia (CLL).

In another embodiment patients diagnosed with stage I, II, III, and IV Chronic Lymphocytic Leukemia are treated with the combination therapy as described herein. The standard of care for this cancer type is: 1. Observation in asymptomatic or minimally affected patients, 2. Rituximab, 3. Ofatumumab, 4. Oral alkylating agents with or without corticosteroids, 5. Fludarabine, 2-chlorodeoxyadenosine, or pentostatin, 6. Bendamustine, 7. Lenalidomide and 8. Combination chemotherapy. Combination chemotherapy regimens include the following: Fludarabine plus cyclophosphamide plus rituximab. o Fludarabine plus rituximab as seen in the CLB-9712 and CLB-9011 trials, o Fludarabine plus cyclophosphamide versus fludarabine plus cyclophosphamide plus rituximab, Pentostatin plus cyclophosphamide plus rituximab as seen in the MAYO-MC0183 trial, for example, Ofatumumab plus fludarabine plus cyclophosphamide, CVP: cyclophosphamide plus vincristine plus prednisone, CHOP: cyclophosphamide plus doxorubicin plus vincristine plus prednisone, Fludarabine plus cyclophosphamide versus fludarabine as seen in the E2997 trial [NCT00003764] and the LRF-CLL4 trial, for example, Fludarabine plus chlorambucil as seen in the CLB-9011 trial, for example. 9. Involved-field radiation therapy. 10. Alemtuzumab 11. Bone marrow and peripheral stem cell transplantations are under clinical evaluation. 12. Ibrutinib.

In one embodiment the combination therapy is administered before, simultaneously with or after treatment with Rituximab or Ofatumumab. As these are monoclonal antibodies that target B-cells, treatment with the combination therapy may be synergistic. In another embodiment the combination therapy is administered after treatment with oral alkylating agents with or without corticosteroids, and Fludarabine, 2-chlorodeoxyadenosine, or pentostatin, as these treatments may negatively affect the immune system if administered before. In one embodiment bendamustine is administered with the combination therapy in low doses based on the results for prostate cancer described herein. In one embodiment the combination therapy is administered after treatment with bendamustine.

In another embodiment, therapies targeted to specific recurrent mutations in genes that include extracellular domains are used in the treatment of a patient in need thereof suffering from cancer. The genes may advantageously be well-expressed genes. Well expressed may be expressed in "transcripts per million" (TPM). A TPM greater than 100 is considered well expressed. Well expressed genes may be FGFR3, ERBB3, EGFR, MUC4, PDGFRA, MMP12, TMEM52, and PODXL. The therapies may be a ligand capable of binding to an extracellular neoantigen epitope. Such ligands are well known in the art and may include therapeutic antibodies or fragments thereof, antibody-drug conjugates, engineered T cells, or aptamers. Engineered T cells may be chimeric antigen receptors (CARs). Antibodies may be fully humanized, humanized, or chimeric. The antibody fragments may be a nanobody, Fab, Fab', (Fab')2, Fv, ScFv, diabody, triabody, tetrabody, Bis-scFv, minibody, Fab2, or Fab3 fragment. Antibodies may be developed against tumor-specific neoepitopes using known methods in the art.

Adoptive Cell Transfer (ACT)

In certain embodiments, immune cells specific to an identified antigenic peptide that binds to a subject specific HLA allele is used in treatment. For example, CD8+ T cells that express a TCR or CAR specific for the peptide, or dendritic cells that are loaded with one or more peptides are transferred to a subject in need thereof. As used herein, "ACT", "adoptive cell therapy" and "adoptive cell transfer" may be used interchangeably. In certain embodiments, Adoptive cell therapy (ACT) can refer to the transfer of cells to a patient with the goal of transferring the functionality and characteristics into the new host by engraftment of the cells (see, e.g., Mettananda et al., Editing an α-globin enhancer in primary human hematopoietic stem cells as a treatment for β-thalassemia, Nat Commun. 2017 Sep. 4; 8(1):424). As used herein, the term "engraft" or "engraftment" refers to the process of cell incorporation into a tissue of interest in vivo through contact with existing cells of the tissue. Adoptive cell therapy (ACT) can refer to the transfer of cells, most commonly immune-derived cells, back into the same patient or into a new recipient host with the goal of transferring the immunologic functionality and characteristics into the new host. If possible, use of autologous cells helps the recipient by minimizing GVHD issues. The adoptive transfer of autologous tumor infiltrating lymphocytes (TIL) (Besser et al., (2010) Clin. Cancer Res 16 (9) 2646-55; Dudley et al., (2002) Science 298 (5594): 850-4; and Dudley et al., (2005) Journal of Clinical Oncology 23 (10): 2346-57.) or genetically re-directed peripheral blood mononuclear cells (Johnson et al., (2009) Blood 114 (3): 535-46; and Morgan et al., (2006) Science 314(5796) 126-9) has been used to successfully treat patients with advanced solid tumors, including melanoma and colorectal carcinoma, as well as patients with CD19-expressing hematologic malignancies (Kalos et al., (2011) Science Translational Medicine 3 (95): 95ra73). In certain embodiments, allogenic cells immune cells are transferred (see, e.g., Ren et al., (2017) Clin Cancer Res 23 (9) 2255-2266). As described further herein, allogenic cells can be edited to reduce alloreactivity and prevent graft-versushost disease. Thus, use of allogenic cells allows for cells to be obtained from healthy donors and prepared for use in patients as opposed to preparing autologous cells from a patient after diagnosis.

Aspects of the invention involve the adoptive transfer of immune system cells, such as T cells, specific for selected antigens, such as tumor associated antigens or tumor specific neoantigens (see, e.g., Maus et al., 2014, Adoptive Immunotherapy for Cancer or Viruses, Annual Review of Immunology, Vol. 32: 189-225; Rosenberg and Restifo, 2015, Adoptive cell transfer as personalized immunotherapy for human cancer, Science Vol. 348 no. 6230 pp. 62-68; Restifo et al., 2015, Adoptive immunotherapy for cancer: harnessing the T cell response. Nat. Rev. Immunol. 12(4): 269-281; and Jenson and Riddell, 2014, Design and implementation of adoptive therapy with chimeric antigen receptor-modified T cells. Immunol Rev. 257(1): 127-144; and Rajasagi et al., 2014, Systematic identification of personal tumor-specific neoantigens in chronic lymphocytic leukemia. Blood. 2014 Jul. 17; 124(3):453-62).

In certain embodiments, an antigen to be targeted in adoptive cell therapy (such as particularly CAR or TCR T cell therapy) of a disease (such as particularly of tumor or cancer) is a tumor-specific antigen (TSA).

In certain embodiments, an antigen to be targeted in adoptive cell therapy (such as particularly CAR or TCR T cell therapy) of a disease (such as particularly of tumor or cancer) is a neoantigen.

In certain embodiments, an antigen to be targeted in adoptive cell therapy (such as particularly CAR or TCR T cell therapy) of a disease (such as particularly of tumor or cancer) is a tumor-associated antigen (TAA).

Various strategies may for example be employed to genetically modify T cells by altering the specificity of the T cell receptor (TCR) for example by introducing new TCR a and R chains with selected peptide specificity (see U.S. Pat. No. 8,697,854; PCT Patent Publications: WO2003020763, WO2004033685, WO2004044004, WO2005114215, WO2006000830, WO2008038002, WO2008039818, WO2004074322, WO2005113595, WO2006125962, WO2013166321, WO2013039889, WO2014018863, WO2014083173; U.S. Pat. No. 8,088, 379).

As an alternative to, or addition to, TCR modifications, chimeric antigen receptors (CARs) may be used in order to generate immunoresponsive cells, such as T cells, specific for selected targets, such as malignant cells, with a wide variety of receptor chimera constructs having been described (see U.S. Pat. Nos. 5,843,728; 5,851,828; 5,912,170; 6,004, 811; 6,284,240; 6,392,013; 6,410,014; 6,753,162; 8,211, 422; and, PCT Publication WO9215322).

In general, CARs are comprised of an extracellular domain, a transmembrane domain, and an intracellular domain, wherein the extracellular domain comprises an antigen-binding domain that is specific for a predetermined target. While the antigen-binding domain of a CAR is often an antibody or antibody fragment (e.g., a single chain variable fragment, scFv), the binding domain is not particularly limited so long as it results in specific recognition of a target. For example, in some embodiments, the antigen-binding domain may comprise a receptor, such that the CAR is capable of binding to the ligand of the receptor. Alternatively, the antigen-binding domain may comprise a ligand, such that the CAR is capable of binding the endogenous receptor of that ligand.

The antigen-binding domain of a CAR is generally separated from the transmembrane domain by a hinge or spacer. The spacer is also not particularly limited, and it is designed to provide the CAR with flexibility. For example, a spacer domain may comprise a portion of a human Fc domain, including a portion of the CH3 domain, or the hinge region of any immunoglobulin, such as IgA, IgD, IgE, IgG, or IgM, or variants thereof. Furthermore, the hinge region may be modified so as to prevent off-target binding by FcRs or other potential interfering objects. For example, the hinge may comprise an IgG4 Fc domain with or without a S228P, L235E, and/or N297Q mutation (according to Kabat numbering) in order to decrease binding to FcRs. Additional spacers/hinges include, but are not limited to, CD4, CD8, and CD28 hinge regions.

The transmembrane domain of a CAR may be derived either from a natural or from a synthetic source. Where the source is natural, the domain may be derived from any membrane bound or transmembrane protein. Transmembrane regions of particular use in this disclosure may be derived from CD8, CD28, CD3, CD45, CD4, CD5, CDS, CD9, CD 16, CD22, CD33, CD37, CD64, CD80, CD86, CD 134, CD137, CD 154, TCR. Alternatively, the transmembrane domain may be synthetic, in which case it will comprise predominantly hydrophobic residues such as leucine and valine. Preferably a triplet of phenylalanine, tryptophan and valine will be found at each end of a synthetic transmembrane domain. Optionally, a short oligo- or polypeptide linker, preferably between 2 and 10 amino acids in length may form the linkage between the transmembrane domain and the cytoplasmic signaling domain of the CAR. A glycine-serine doublet provides a particularly suitable linker.

Alternative CAR constructs may be characterized as belonging to successive generations. First-generation CARs typically consist of a single-chain variable fragment of an antibody specific for an antigen, for example comprising a VL linked to a VH of a specific antibody, linked by a flexible linker, for example by a CD8a hinge domain and a CD8a transmembrane domain, to the transmembrane and intracellular signaling domains of either CD3ζ or FcRγ (scFv-CD3ζ or scFv-FcRγ; see U.S. Pat. Nos. 7,741,465; 5,912,172; 5,906,936). Second-generation CARs incorporate the intracellular domains of one or more costimulatory molecules, such as CD28, OX40 (CD134), or 4-1BB (CD137) within the endodomain (for example scFv-CD28/OX40/4-1BB-CD3ζ; see U.S. Pat. Nos. 8,911,993; 8,916,381; 8,975,071; 9,101,584; 9,102,760; 9,102,761). Third-generation CARs include a combination of costimulatory endodomains, such a CD3ζ-chain, CD97, GDI la-CD18, CD2, ICOS, CD27, CD154, CDS, OX40, 4-1BB, CD2, CD7, LIGHT, LFA-1, NKG2C, B7-H3, CD30, CD40, PD-1, or CD28 signaling domains (for example scFv-CD28-4-1BB-CD3ζ or scFv-CD28-OX40-CD3ζ; see U.S. Pat. Nos. 8,906,682; 8,399, 645; 5,686,281; PCT Publication No. WO2014134165; PCT Publication No. WO2012079000). In certain embodiments, the primary signaling domain comprises a functional signaling domain of a protein selected from the group consisting of CD3 zeta, CD3 gamma, CD3 delta, CD3 epsilon, common FcR gamma (FCERIG), FcR beta (Fc Epsilon Rib), CD79a, CD79b, Fc gamma RIIa, DAP10, and DAP12. In certain preferred embodiments, the primary signaling domain comprises a functional signaling domain of CD3ζ or FcRγ. In certain embodiments, the one or more costimulatory signaling domains comprise a functional signaling domain of a protein selected, each independently, from the group consisting of: CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, a ligand that specifically binds with CD83, CDS, ICAM-1, GITR, BAFFR, HVEM (LIGHTR), SLAMF7, NKp80 (KLRF1), CD160, CD19, CD4, CD8 alpha, CD8 beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, ITGB7, TNFR2, TRANCE/RANKL, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), CD69, SLAMF6 (NTB-A, Lyl08), SLAM (SLAMFI, CD150, IPO-3), BLAME (SLAMF8), SELPLG (CD162), LTBR, LAT, GADS, SLP-76, PAG/Cbp, NKp44, NKp30, NKp46, and NKG2D. In certain embodiments, the one or more costimulatory signaling domains comprise a functional signaling domain of a protein selected, each independently, from the group consisting of: 4-1BB, CD27, and CD28. In certain embodiments, a chimeric antigen receptor may have the design as described in U.S. Pat. No. 7,446,190, comprising an intracellular domain of CD3ζ chain (such as amino acid residues 52-163 of the human CD3 zeta chain, as shown in SEQ ID NO: 14 of U.S. Pat. No. 7,446,190), a signaling region from CD28 and an antigen-binding element (or portion or domain; such as scFv). The CD28 portion, when between the zeta chain portion and the antigen-binding element, may suitably include the transmembrane and signaling domains of CD28 (such as amino acid residues 114-220 of SEQ ID NO: 10, full sequence shown in SEQ ID NO: 6 of U.S. Pat. No. 7,446,190; these can include the following portion of CD28 as set forth in Genbank identifier NM_006139 (sequence version 1, 2 or 3): IEVMYPPPYLD-NEKSNGTIIHVKGKHLCPSPLFPGPSKPFWVLVVVGGV-LACYSLLVTVA FIIFWVRSKRSRLLHSDYMNMTPRRPGPTRKHYQPY-APPRDFAAYRS (SEQ ID NO: 173478)). Alternatively, when the zeta sequence lies between the CD28 sequence and the antigen-binding element, intracellular domain of CD28 can be used alone (such as amino sequence set forth in SEQ ID NO: 9 of U.S. Pat. No. 7,446,190). Hence, certain embodiments employ a CAR comprising (a) a zeta chain portion comprising the intracellular domain of human CD3ζ chain, (b) a costimulatory signaling region, and (c) an antigen-binding element (or portion or domain), wherein the costimulatory signaling region comprises the amino acid sequence encoded by SEQ ID NO: 6 of U.S. Pat. No. 7,446,190.

Alternatively, costimulation may be orchestrated by expressing CARs in antigen-specific T cells, chosen so as to be activated and expanded following engagement of their native αβTCR, for example by antigen on professional antigen-presenting cells, with attendant costimulation. In addition, additional engineered receptors may be provided on the immunoresponsive cells, for example to improve targeting of a T cell attack and/or minimize side effects.

By means of an example and without limitation, Kochenderfer et al., (2009) J Immunother. 32 (7): 689-702 described anti-CD19 chimeric antigen receptors (CAR). FMC63-28Z CAR contained a single chain variable region moiety (scFv) recognizing CD19 derived from the FMC63 mouse hybridoma (described in Nicholson et al., (1997) Molecular Immunology 34: 1157-1165), a portion of the human CD28 molecule, and the intracellular component of the human TCR-ζ molecule. FMC63-CD828BBZ CAR contained the FMC63 scFv, the hinge and transmembrane regions of the CD8 molecule, the cytoplasmic portions of CD28 and 4-1BB, and the cytoplasmic component of the TCR-ζ molecule. The exact sequence of the CD28 molecule included in the FMC63-28Z CAR corresponded to Genbank identifier NM_006139; the sequence included all amino acids starting with the amino acid sequence IEVMYPPPY (SEQ ID NO: 173479) and continuing all the way to the carboxy-terminus of the protein. To encode the anti-CD19 scFv component of the vector, the authors designed a DNA sequence which was based on a portion of a previously published CAR (Cooper et al., (2003) Blood 101: 1637-1644). This sequence encoded the following components in frame from the 5' end to the 3' end: an XhoI site, the human granulocyte-macrophage colony-stimulating factor (GM-CSF) receptor α-chain signal sequence, the FMC63 light chain variable region (as in Nicholson et al., supra), a linker peptide (as in Cooper et al., supra), the FMC63 heavy chain variable region (as in Nicholson et al., supra), and a NotI site. A plasmid encoding this sequence was digested with XhoI and NotI. To form the MSGV-FMC63-28Z retroviral vector, the XhoI and NotI-digested fragment encoding the FMC63 scFv was ligated into a second XhoI and NotI-digested fragment that encoded the MSGV retroviral backbone (as in Hughes et al., (2005) Human Gene Therapy 16: 457-472) as well as part of the extracellular portion of human CD28, the entire transmembrane and cytoplasmic portion of human CD28, and the cytoplasmic portion of the human TCR-ζ molecule (as in Maher et al., 2002) Nature Biotechnology 20: 70-75). The FMC63-28Z CAR is included in the KTE-C19 (axicabtagene ciloleucel) anti-CD19 CAR-T therapy product in development by Kite Pharma, Inc. for the treatment of inter alia patients with relapsed/refractory aggressive B-cell non-Hodgkin lymphoma (NHL). Accordingly, in certain embodiments, cells intended for adoptive cell therapies, more particularly immunoresponsive cells such as T cells, may express the FMC63-28Z CAR as described by Kochenderfer et al. (supra). Hence, in certain embodiments, cells intended for adoptive cell therapies, more particularly immunoresponsive cells such as T cells, may comprise a CAR comprising an extracellular antigen-binding element (or portion or domain; such as scFv) that specifically binds to an antigen, an intracellular signaling domain comprising an intracellular domain of a CD3ζ chain, and a costimulatory signaling region comprising a signaling domain of CD28. Preferably, the CD28 amino acid sequence is as set forth in Genbank identifier NM_006139 (sequence version 1, 2 or 3) starting with the amino acid sequence IEVMYPPPY (SEQ ID NO: 173479) and continuing all the way to the carboxy-terminus of the protein. The sequence is reproduced herein: IEVMYPPPYLD-NEKSNGTIIHVKGKHLCPSPLFPGPSKPFWVLVVVGGV-LACYSLLVTVA FIIFWVRSKRSRLLHSDYMNMT-PRRPGPTRKHYQPYAPPRDFAAYRS (SEQ ID NO: 173478). Preferably, the antigen is CD19, more preferably the antigen-binding element is an anti-CD19 scFv, even more preferably the anti-CD19 scFv as described by Kochenderfer et al. (supra).

Additional anti-CD19 CARs are further described in WO2015187528. More particularly Example 1 and Table 1 of WO2015187528, incorporated by reference herein, demonstrate the generation of anti-CD19 CARs based on a fully human anti-CD19 monoclonal antibody (47G4, as described in US20100104509) and murine anti-CD19 monoclonal antibody (as described in Nicholson et al. and explained above). Various combinations of a signal sequence (human CD8-alpha or GM-CSF receptor), extracellular and transmembrane regions (human CD8-alpha) and intracellular T cell signaling domains (CD28-CD3ζ; 4-1BB-CD3ζ; CD27-

CD3ζ; CD28-CD27-CD3ζ, 4-1BB-CD27-CD3ζ; CD27-4-1BB-CD3ζ; CD28-CD27-FcεRI gamma chain; or CD28-FcεRI gamma chain) were disclosed. Hence, in certain embodiments, cells intended for adoptive cell therapies, more particularly immunoresponsive cells such as T cells, may comprise a CAR comprising an extracellular antigen-binding element that specifically binds to an antigen, an extracellular and transmembrane region as set forth in Table 1 of WO2015187528 and an intracellular T cell signaling domain as set forth in Table 1 of WO2015187528. Preferably, the antigen is CD19, more preferably the antigen-binding element is an anti-CD19 scFv, even more preferably the mouse or human anti-CD19 scFv as described in Example 1 of WO2015187528. In certain embodiments, the CAR comprises, consists essentially of or consists of an amino acid sequence of SEQ ID NO: 1, SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, or SEQ ID NO: 13 as set forth in Table 1 of WO2015187528.

By means of an example and without limitation, chimeric antigen receptor that recognizes the CD70 antigen is described in WO2012058460A2 (see also, Park et al., CD70 as a target for chimeric antigen receptor T cells in head and neck squamous cell carcinoma, Oral Oncol. 2018 March; 78:145-150; and Jin et al., CD70, a novel target of CAR T cell therapy for gliomas, Neuro Oncol. 2018 Jan. 10; 20(1): 55-65). CD70 is expressed by diffuse large B-cell and follicular lymphoma and also by the malignant cells of Hodgkins lymphoma, Waldenstrom's macroglobulinemia and multiple myeloma, and by HTLV-1- and EBV-associated malignancies. (Agathanggelou et al. Am. J. Pathol. 1995; 147: 1152-1160; Hunter et al., Blood 2004; 104:4881. 26; Lens et al., J Immunol. 2005; 174:6212-6219; Baba et al., J Virol. 2008; 82:3843-3852.) In addition, CD70 is expressed by non-hematological malignancies such as renal cell carcinoma and glioblastoma. (Junker et al., J Urol. 2005; 173:2150-2153; Chahlavi et al., Cancer Res 2005; 65:5428-5438) Physiologically, CD70 expression is transient and restricted to a subset of highly activated T, B, and dendritic cells.

By means of an example and without limitation, chimeric antigen receptor that recognizes BCMA has been described (see, e.g., US20160046724A1; WO2016014789A2; WO2017211900A1; WO2015158671A1; US20180085444A1; WO2018028647A1; US20170283504A1; and WO2013154760A1).

In certain embodiments, the immune cell may, in addition to a CAR or exogenous TCR as described herein, further comprise a chimeric inhibitory receptor (inhibitory CAR) that specifically binds to a second target antigen and is capable of inducing an inhibitory or immunosuppressive or repressive signal to the cell upon recognition of the second target antigen. In certain embodiments, the chimeric inhibitory receptor comprises an extracellular antigen-binding element (or portion or domain) configured to specifically bind to a target antigen, a transmembrane domain, and an intracellular immunosuppressive or repressive signaling domain. In certain embodiments, the second target antigen is an antigen that is not expressed on the surface of a cancer cell or infected cell or the expression of which is downregulated on a cancer cell or an infected cell. In certain embodiments, the second target antigen is an MHC-class I molecule. In certain embodiments, the intracellular signaling domain comprises a functional signaling portion of an immune checkpoint molecule, such as for example PD-1 or CTLA4. Advantageously, the inclusion of such inhibitory CAR reduces the chance of the engineered immune cells attacking non-target (e.g., non-cancer) tissues.

Alternatively, T cells expressing CARs may be further modified to reduce or eliminate expression of endogenous TCRs in order to reduce off-target effects. Reduction or elimination of endogenous TCRs can reduce off-target effects and increase the effectiveness of the T cells (U.S. Pat. No. 9,181,527). T cells stably lacking expression of a functional TCR may be produced using a variety of approaches. T cells internalize, sort, and degrade the entire T cell receptor as a complex, with a half-life of about 10 hours in resting T cells and 3 hours in stimulated T cells (von Essen, M. et al. 2004. J. Immunol. 173:384-393). Proper functioning of the TCR complex requires the proper stoichiometric ratio of the proteins that compose the TCR complex. TCR function also requires two functioning TCR zeta proteins with ITAM motifs. The activation of the TCR upon engagement of its MHC-peptide ligand requires the engagement of several TCRs on the same T cell, which all must signal properly. Thus, if a TCR complex is destabilized with proteins that do not associate properly or cannot signal optimally, the T cell will not become activated sufficiently to begin a cellular response.

Accordingly, in some embodiments, TCR expression may eliminated using RNA interference (e.g., shRNA, siRNA, miRNA, etc.), CRISPR, or other methods that target the nucleic acids encoding specific TCRs (e.g., TCR-α and TCR-β) and/or CD3 chains in primary T cells. By blocking expression of one or more of these proteins, the T cell will no longer produce one or more of the key components of the TCR complex, thereby destabilizing the TCR complex and preventing cell surface expression of a functional TCR.

In some instances, CAR may also comprise a switch mechanism for controlling expression and/or activation of the CAR. For example, a CAR may comprise an extracellular, transmembrane, and intracellular domain, in which the extracellular domain comprises a target-specific binding element that comprises a label, binding domain, or tag that is specific for a molecule other than the target antigen that is expressed on or by a target cell. In such embodiments, the specificity of the CAR is provided by a second construct that comprises a target antigen binding domain (e.g., an scFv or a bispecific antibody that is specific for both the target antigen and the label or tag on the CAR) and a domain that is recognized by or binds to the label, binding domain, or tag on the CAR. See, e.g., WO 2013/044225, WO 2016/000304, WO 2015/057834, WO 2015/057852, WO 2016/070061, U.S. Pat. No. 9,233,125, US 2016/0129109. In this way, a T cell that expresses the CAR can be administered to a subject, but the CAR cannot bind its target antigen until the second composition comprising an antigen-specific binding domain is administered.

Alternative switch mechanisms include CARs that require multimerization in order to activate their signaling function (see, e.g., US 2015/0368342, US 2016/0175359, US 2015/0368360) and/or an exogenous signal, such as a small molecule drug (US 2016/0166613, Yung et al., Science, 2015), in order to elicit a T cell response. Some CARs may also comprise a "suicide switch" to induce cell death of the CAR T cells following treatment (Buddee et al., PLoS One, 2013) or to downregulate expression of the CAR following binding to the target antigen (WO 2016/011210).

Alternative techniques may be used to transform target immunoresponsive cells, such as protoplast fusion, lipofection, transfection or electroporation. A wide variety of vectors may be used, such as retroviral vectors, lentiviral vectors, adenoviral vectors, adeno-associated viral vectors, plasmids or transposons, such as a Sleeping Beauty transposon (see U.S. Pat. Nos. 6,489,458; 7,148,203; 7,160,682; 7,985,739; 8,227,432), may be used to introduce CARs, for example using 2nd generation antigen-specific CARs signaling through CD3ζ and either CD28 or CD137. Viral vectors may for example include vectors based on HIV, SV40, EBV, HSV or BPV.

Cells that are targeted for transformation may for example include T cells, Natural Killer (NK) cells, cytotoxic T lymphocytes (CTL), regulatory T cells, human embryonic stem cells, tumor-infiltrating lymphocytes (TIL) or a pluripotent stem cell from which lymphoid cells may be differentiated. T cells expressing a desired CAR may for example be selected through co-culture with γ-irradiated activating and propagating cells (AaPC), which co-express the cancer antigen and co-stimulatory molecules. The engineered CAR T cells may be expanded, for example by co-culture on AaPC in presence of soluble factors, such as IL-2 and IL-21. This expansion may for example be carried out so as to provide memory CAR+ T cells (which may for example be assayed by non-enzymatic digital array and/or multi-panel flow cytometry). In this way, CAR T cells may be provided that have specific cytotoxic activity against antigen-bearing tumors (optionally in conjunction with production of desired chemokines such as interferon-γ). CAR T cells of this kind may for example be used in animal models, for example to treat tumor xenografts.

In certain embodiments, ACT includes co-transferring CD4+Th1 cells and CD8+CTLs to induce a synergistic antitumour response (see, e.g., Li et al., Adoptive cell therapy with CD4+T helper 1 cells and CD8+ cytotoxic T cells enhances complete rejection of an established tumour, leading to generation of endogenous memory responses to non-targeted tumour epitopes. Clin Transl Immunology. 2017 October; 6(10): e160).

In certain embodiments, Th17 cells are transferred to a subject in need thereof. Th17 cells have been reported to directly eradicate melanoma tumors in mice to a greater extent than Th1 cells (Muranski P, et al., Tumor-specific Th17-polarized cells eradicate large established melanoma. Blood. 2008 Jul. 15; 112(2):362-73; and Martin-Orozco N, et al., T helper 17 cells promote cytotoxic T cell activation in tumor immunity. Immunity. 2009 Nov. 20; 31(5):787-98). Those studies involved an adoptive T cell transfer (ACT) therapy approach, which takes advantage of CD4+ T cells that express a TCR recognizing tyrosinase tumor antigen. Exploitation of the TCR leads to rapid expansion of Th17 populations to large numbers ex vivo for reinfusion into the autologous tumor-bearing hosts.

In certain embodiments, ACT may include autologous iPSC-based vaccines, such as irradiated iPSCs in autologous anti-tumor vaccines (see e.g., Kooreman, Nigel G. et al., Autologous iPSC-Based Vaccines Elicit Anti-tumor Responses In vivo, Cell Stem Cell 22, 1-13, 2018, doi.org/10.1016/j.stem.2018.01.016).

Unlike T cell receptors (TCRs) that are MHC restricted, CARs can potentially bind any cell surface-expressed antigen and can thus be more universally used to treat patients (see Irving et al., Engineering Chimeric Antigen Receptor T-Cells for Racing in Solid Tumors: Don't Forget the Fuel, Front. Immunol., 3 Apr. 2017, doi.org/10.3389/fimmu.2017.00267). In certain embodiments, in the absence of endogenous T cell infiltrate (e.g., due to aberrant antigen processing and presentation), which precludes the use of TIL therapy and immune checkpoint blockade, the transfer of CAR T cells may be used to treat patients (see, e.g., Hinrichs C S, Rosenberg S A. Exploiting the curative potential of adoptive T-cell therapy for cancer. Immunol Rev (2014) 257(1):56-71. doi:10.1111/imr.12132).

Approaches such as the foregoing may be adapted to provide methods of treating and/or increasing survival of a subject having a disease, such as a neoplasia, for example by administering an effective amount of an immunoresponsive cell comprising an antigen recognizing receptor that binds a selected antigen, wherein the binding activates the immunoresponsive cell, thereby treating or preventing the disease (such as a neoplasia, a pathogen infection, an autoimmune disorder, or an allogeneic transplant reaction).

In certain embodiments, the treatment can be administered after lymphodepleting pretreatment in the form of chemotherapy (typically a combination of cyclophosphamide and fludarabine) or radiation therapy. Initial studies in ACT had short lived responses and the transferred cells did not persist in vivo for very long (Houot et al., T-cell-based immunotherapy: adoptive cell transfer and checkpoint inhibition. Cancer Immunol Res (2015) 3(10):1115-22; and Kamta et al., Advancing Cancer Therapy with Present and Emerging Immuno-Oncology Approaches. Front. Oncol. (2017) 7:64). Immune suppressor cells like Tregs and MDSCs may attenuate the activity of transferred cells by outcompeting them for the necessary cytokines. Not being bound by a theory lymphodepleting pretreatment may eliminate the suppressor cells allowing the TILs to persist.

In one embodiment, the treatment can be administrated into patients undergoing an immunosuppressive treatment (e.g., glucocorticoid treatment). The cells or population of cells, may be made resistant to at least one immunosuppressive agent due to the inactivation of a gene encoding a receptor for such immunosuppressive agent. In certain embodiments, the immunosuppressive treatment provides for the selection and expansion of the immunoresponsive T cells within the patient.

In certain embodiments, the treatment can be administered before primary treatment (e.g., surgery or radiation therapy) to shrink a tumor before the primary treatment. In another embodiment, the treatment can be administered after primary treatment to remove any remaining cancer cells.

In certain embodiments, immunometabolic barriers can be targeted therapeutically prior to and/or during ACT to enhance responses to ACT or CAR T cell therapy and to support endogenous immunity (see, e.g., Irving et al., Engineering Chimeric Antigen Receptor T-Cells for Racing in Solid Tumors: Don't Forget the Fuel, Front. Immunol., 3 Apr. 2017, doi.org/10.3389/fimmu.2017.00267).

The administration of cells or population of cells, such as immune system cells or cell populations, such as more particularly immunoresponsive cells or cell populations, as disclosed herein may be carried out in any convenient manner, including by aerosol inhalation, injection, ingestion, transfusion, implantation or transplantation. The cells or population of cells may be administered to a patient subcutaneously, intradermally, intratumorally, intranodally, intramedullary, intramuscularly, intrathecally, by intravenous or intralymphatic injection, or intraperitoneally. In some embodiments, the disclosed CARs may be delivered or administered into a cavity formed by the resection of tumor tissue (i.e. intracavity delivery) or directly into a tumor prior to resection (i.e. intratumoral delivery). In one embodiment, the cell compositions of the present invention are preferably administered by intravenous injection.

The administration of the cells or population of cells can consist of the administration of $10^4$-$10^9$ cells per kg body weight, preferably $10^5$ to $10^6$ cells/kg body weight including all integer values of cell numbers within those ranges.

Dosing in CAR T cell therapies may for example involve administration of from $10^6$ to $10^9$ cells/kg, with or without a course of lymphodepletion, for example with cyclophosphamide. The cells or population of cells can be administrated in one or more doses. In another embodiment, the effective amount of cells are administrated as a single dose. In another embodiment, the effective amount of cells are administrated as more than one dose over a period time. Timing of administration is within the judgment of managing physician and depends on the clinical condition of the patient. The cells or population of cells may be obtained from any source, such as a blood bank or a donor. While individual needs vary, determination of optimal ranges of effective amounts of a given cell type for a particular disease or conditions are within the skill of one in the art. An effective amount means an amount which provides a therapeutic or prophylactic benefit. The dosage administrated will be dependent upon the age, health and weight of the recipient, kind of concurrent treatment, if any, frequency of treatment and the nature of the effect desired.

In another embodiment, the effective amount of cells or composition comprising those cells are administrated parenterally. The administration can be an intravenous administration. The administration can be directly done by injection within a tumor.

To guard against possible adverse reactions, engineered immunoresponsive cells may be equipped with a transgenic safety switch, in the form of a transgene that renders the cells vulnerable to exposure to a specific signal. For example, the herpes simplex viral thymidine kinase (TK) gene may be used in this way, for example by introduction into allogeneic T lymphocytes used as donor lymphocyte infusions following stem cell transplantation (Greco, et al., Improving the safety of cell therapy with the TK-suicide gene. Front. Pharmacol. 2015; 6: 95). In such cells, administration of a nucleoside prodrug such as ganciclovir or acyclovir causes cell death. Alternative safety switch constructs include inducible caspase 9, for example triggered by administration of a small-molecule dimerizer that brings together two nonfunctional icasp9 molecules to form the active enzyme. A wide variety of alternative approaches to implementing cellular proliferation controls have been described (see U.S. Patent Publication No. 20130071414; PCT Patent Publication No. WO2011146862; PCT Patent Publication WO2014011987; PCT Patent Publication WO2013040371; Zhou et al. BLOOD, 2014, 123/25:3895-3905; Di Stasi et al., The New England Journal of Medicine 2011; 365:1673-1683; Sadelain M, The New England Journal of Medicine 2011; 365:1735-173; Ramos et al., Stem Cells 28(6):1107-15 (2010)).

In a further refinement of adoptive therapies, genome editing may be used to tailor immunoresponsive cells to alternative implementations, for example providing edited CAR T cells (see Poirot et al., 2015, Multiplex genome edited T-cell manufacturing platform for "off-the-shelf" adoptive T-cell immunotherapies, Cancer Res 75 (18): 3853; Ren et al., 2017, Multiplex genome editing to generate universal CAR T cells resistant to PD1 inhibition, Clin Cancer Res. 2017 May 1; 23(9):2255-2266. doi: 10.1158/1078-0432.CCR-16-1300. Epub 2016 Nov. 4; Qasim et al., 2017, Molecular remission of infant B-ALL after infusion of universal TALEN gene-edited CAR T cells, Sci Transl Med. 2017 Jan. 25; 9(374); Legut, et al., 2018, CRISPR-mediated TCR replacement generates superior anticancer transgenic T cells. Blood, 131(3), 311-322; and Georgiadis et al., Long Terminal Repeat CRISPR-CAR-Coupled "Universal" T Cells Mediate Potent Anti-leukemic Effects, Molecular Therapy, In Press, Corrected Proof, Available online 6 Mar. 2018). Cells may be edited using any CRISPR system and method of use thereof as described herein. CRISPR systems may be delivered to an immune cell by any method described herein. In preferred embodiments, cells are edited ex vivo and transferred to a subject in need thereof. Immunoresponsive cells, CAR T cells or any cells used for adoptive cell transfer may be edited. Editing may be performed for example to insert or knock-in an exogenous gene, such as an exogenous gene encoding a CAR or a TCR, at a preselected locus in a cell (e.g. TRAC locus); to eliminate potential alloreactive T cell receptors (TCR) or to prevent inappropriate pairing between endogenous and exogenous TCR chains, such as to knock-out or knock-down expression of an endogenous TCR in a cell; to disrupt the target of a chemotherapeutic agent in a cell; to block an immune checkpoint, such as to knock-out or knock-down expression of an immune checkpoint protein or receptor in a cell; to knock-out or knock-down expression of other gene or genes in a cell, the reduced expression or lack of expression of which can enhance the efficacy of adoptive therapies using the cell; to knock-out or knock-down expression of an endogenous gene in a cell, said endogenous gene encoding an antigen targeted by an exogenous CAR or TCR; to knock-out or knock-down expression of one or more IHC constituent proteins in a cell; to activate a T cell; to modulate cells such that the cells are resistant to exhaustion or dysfunction; and/or increase the differentiation and/or proliferation of functionally exhausted or dysfunctional CD8+ T cells (see PCT Patent Publications: WO2013176915, WO2014059173, WO2014172606, WO2014184744, and WO2014191128).

In certain embodiments, editing may result in inactivation of a gene. By inactivating a gene, it is intended that the gene of interest is not expressed in a functional protein form. In a particular embodiment, the CRISPR system specifically catalyzes cleavage in one targeted gene thereby inactivating said targeted gene. The nucleic acid strand breaks caused are commonly repaired through the distinct mechanisms of homologous recombination or non-homologous end joining (NHEJ). However, NHEJ is an imperfect repair process that often results in changes to the DNA sequence at the site of the cleavage. Repair via non-homologous end joining (NHEJ) often results in small insertions or deletions (Indel) and can be used for the creation of specific gene knockouts. Cells in which a cleavage induced mutagenesis event has occurred can be identified and/or selected by well-known methods in the art. In certain embodiments, homology directed repair (HDR) is used to concurrently inactivate a gene (e.g., TRAC) and insert an endogenous TCR or CAR into the inactivated locus.

Hence, in certain embodiments, editing of cells (such as by CRISPR/Cas), particularly cells intended for adoptive cell therapies, more particularly immunoresponsive cells such as T cells, may be performed to insert or knock-in an exogenous gene, such as an exogenous gene encoding a CAR or a TCR, at a preselected locus in a cell. Conventionally, nucleic acid molecules encoding CARs or TCRs are transfected or transduced to cells using randomly integrating vectors, which, depending on the site of integration, may lead to clonal expansion, oncogenic transformation, variegated transgene expression and/or transcriptional silencing of the transgene. Directing of transgene(s) to a specific locus in a cell can minimize or avoid such risks and advantageously provide for uniform expression of the transgene(s) by the cells. Without limitation, suitable 'safe harbor' loci for directed transgene integration include CCR5 or AAVS1.

Homology-directed repair (HDR) strategies are known and described elsewhere in this specification allowing to insert transgenes into desired loci (e.g., TRAC locus).

Further suitable loci for insertion of transgenes, in particular CAR or exogenous TCR transgenes, include without limitation loci comprising genes coding for constituents of endogenous T cell receptor, such as T cell receptor alpha locus (TRA) or T cell receptor beta locus (TRB), for example T cell receptor alpha constant (TRAC) locus, T cell receptor beta constant 1 (TRBC1) locus or T cell receptor beta constant 2 (TRBC1) locus. Advantageously, insertion of a transgene into such locus can simultaneously achieve expression of the transgene, potentially controlled by the endogenous promoter, and knock-out expression of the endogenous TCR. This approach has been exemplified in Eyquem et al., (2017) Nature 543: 113-117, wherein the authors used CRISPR/Cas9 gene editing to knock-in a DNA molecule encoding a CD19-specific CAR into the TRAC locus downstream of the endogenous promoter; the CAR-T cells obtained by CRISPR were significantly superior in terms of reduced tonic CAR signaling and exhaustion.

T cell receptors (TCR) are cell surface receptors that participate in the activation of T cells in response to the presentation of antigen. The TCR is generally made from two chains, a and 3, which assemble to form a heterodimer and associates with the CD3-transducing subunits to form the T cell receptor complex present on the cell surface. Each a and p chain of the TCR consists of an immunoglobulin-like N-terminal variable (V) and constant (C) region, a hydrophobic transmembrane domain, and a short cytoplasmic region. As for immunoglobulin molecules, the variable region of the a and p chains are generated by V(D)J recombination, creating a large diversity of antigen specificities within the population of T cells. However, in contrast to immunoglobulins that recognize intact antigen, T cells are activated by processed peptide fragments in association with an MHC molecule, introducing an extra dimension to antigen recognition by T cells, known as MHC restriction. Recognition of MHC disparities between the donor and recipient through the T cell receptor leads to T cell proliferation and the potential development of graft versus host disease (GVHD). The inactivation of TCRα or TCRβ can result in the elimination of the TCR from the surface of T cells preventing recognition of alloantigen and thus GVHD. However, TCR disruption generally results in the elimination of the CD3 signaling component and alters the means of further T cell expansion.

Hence, in certain embodiments, editing of cells (such as by CRISPR/Cas), particularly cells intended for adoptive cell therapies, more particularly immunoresponsive cells such as T cells, may be performed to knock-out or knock-down expression of an endogenous TCR in a cell. For example, NHEJ-based or HDR-based gene editing approaches can be employed to disrupt the endogenous TCR alpha and/or beta chain genes. For example, gene editing system or systems, such as CRISPR/Cas system or systems, can be designed to target a sequence found within the TCR beta chain conserved between the beta 1 and beta 2 constant region genes (TRBC1 and TRBC2) and/or to target the constant region of the TCR alpha chain (TRAC) gene.

Allogeneic cells are rapidly rejected by the host immune system. It has been demonstrated that, allogeneic leukocytes present in non-irradiated blood products will persist for no more than 5 to 6 days (Boni, Muranski et al. 2008 Blood 1; 112(12):4746-54). Thus, to prevent rejection of allogeneic cells, the host's immune system usually has to be suppressed to some extent. However, in the case of adoptive cell transfer the use of immunosuppressive drugs also have a detrimental effect on the introduced therapeutic T cells. Therefore, to effectively use an adoptive immunotherapy approach in these conditions, the introduced cells would need to be resistant to the immunosuppressive treatment. Thus, in a particular embodiment, the present invention further comprises a step of modifying T cells to make them resistant to an immunosuppressive agent, preferably by inactivating at least one gene encoding a target for an immunosuppressive agent. An immunosuppressive agent is an agent that suppresses immune function by one of several mechanisms of action. An immunosuppressive agent can be, but is not limited to a calcineurin inhibitor, a target of rapamycin, an interleukin-2 receptor α-chain blocker, an inhibitor of inosine monophosphate dehydrogenase, an inhibitor of dihydrofolic acid reductase, a corticosteroid or an immunosuppressive antimetabolite. The present invention allows conferring immunosuppressive resistance to T cells for immunotherapy by inactivating the target of the immunosuppressive agent in T cells. As non-limiting examples, targets for an immunosuppressive agent can be a receptor for an immunosuppressive agent such as: CD52, glucocorticoid receptor (GR), a FKBP family gene member and a cyclophilin family gene member.

In certain embodiments, editing of cells (such as by CRISPR/Cas), particularly cells intended for adoptive cell therapies, more particularly immunoresponsive cells such as T cells, may be performed to block an immune checkpoint, such as to knock-out or knock-down expression of an immune checkpoint protein or receptor in a cell. Immune checkpoints are inhibitory pathways that slow down or stop immune reactions and prevent excessive tissue damage from uncontrolled activity of immune cells. In certain embodiments, the immune checkpoint targeted is the programmed death-1 (PD-1 or CD279) gene (PDCD1). In other embodiments, the immune checkpoint targeted is cytotoxic T-lymphocyte-associated antigen (CTLA-4). In additional embodiments, the immune checkpoint targeted is another member of the CD28 and CTLA4 Ig superfamily such as BTLA, LAG3, ICOS, PDL1 or KIR. In further additional embodiments, the immune checkpoint targeted is a member of the TNFR superfamily such as CD40, OX40, CD137, GITR, CD27 or TIM-3.

Additional immune checkpoints include Src homology 2 domain-containing protein tyrosine phosphatase 1 (SHP-1) (Watson H A, et al., SHP-1: the next checkpoint target for cancer immunotherapy?Biochem Soc Trans. 2016 Apr. 15; 44(2):356-62). SHP-1 is a widely expressed inhibitory protein tyrosine phosphatase (PTP). In T cells, it is a negative regulator of antigen-dependent activation and proliferation. It is a cytosolic protein, and therefore not amenable to antibody-mediated therapies, but its role in activation and proliferation makes it an attractive target for genetic manipulation in adoptive transfer strategies, such as chimeric antigen receptor (CAR) T cells. Immune checkpoints may also include T cell immunoreceptor with Ig and ITIM domains (TIGIT/Vstm3/WUCAM/VSIG9) and VISTA (Le Mercier I, et al., (2015) Beyond CTLA-4 and PD-1, the generation Z of negative checkpoint regulators. Front. Immunol. 6:418).

WO2014172606 relates to the use of MT1 and/or MT2 inhibitors to increase proliferation and/or activity of exhausted CD8+ T cells and to decrease CD8+ T cell exhaustion (e.g., decrease functionally exhausted or unresponsive CD8+ immune cells). In certain embodiments, metallothioneins are targeted by gene editing in adoptively transferred T cells.

In certain embodiments, targets of gene editing may be at least one targeted locus involved in the expression of an immune checkpoint protein. Such targets may include, but are not limited to CTLA4, PPP2CA, PPP2CB, PTPN6, PTPN22, PDCD1, ICOS (CD278), PDL1, KIR, LAG3, HAVCR2, BTLA, CD160, TIGIT, CD96, CRTAM, LAIR1, SIGLEC7, SIGLEC9, CD244 (2B4), TNFRSF10B, TNFRSF10A, CASP8, CASP10, CASP3, CASP6, CASP7, FADD, FAS, TGFBRII, TGFRBRI, SMAD2, SMAD3, SMAD4, SMAD10, SKI, SKIL, TGIF1, IL10RA, IL10RB, HMOX2, IL6R, IL6ST, EIF2AK4, CSK, PAG1, SIT1, FOXP3, PRDM1, BATF, VISTA, GUCY1A2, GUCY1A3, GUCY1B2, GUCY1B3, MT1, MT2, CD40, OX40, CD137, GITR, CD27, SHP-1, TIM-3, CEACAM-1, CEACAM-3, or CEACAM-5. In preferred embodiments, the gene locus involved in the expression of PD-1 or CTLA-4 genes is targeted. In other preferred embodiments, combinations of genes are targeted, such as but not limited to PD-1 and TIGIT.

By means of an example and without limitation, WO2016196388 concerns an engineered T cell comprising (a) a genetically engineered antigen receptor that specifically binds to an antigen, which receptor may be a CAR; and (b) a disrupted gene encoding a PD-L1, an agent for disruption of a gene encoding a PD-L1, and/or disruption of a gene encoding PD-L1, wherein the disruption of the gene may be mediated by a gene editing nuclease, a zinc finger nuclease (ZFN), CRISPR/Cas9 and/or TALEN. WO2015142675 relates to immune effector cells comprising a CAR in combination with an agent (such as CRISPR, TALEN or ZFN) that increases the efficacy of the immune effector cells in the treatment of cancer, wherein the agent may inhibit an immune inhibitory molecule, such as PD1, PD-L1, CTLA-4, TIM-3, LAG-3, VISTA, BTLA, TIGIT, LAIR1, CD160, 2B4, TGFR beta, CEACAM-1, CEACAM-3, or CEACAM-5. Ren et al., (2017) Clin Cancer Res 23 (9) 2255-2266 performed lentiviral delivery of CAR and electro-transfer of Cas9 mRNA and gRNAs targeting endogenous TCR, β-2 microglobulin (B2M) and PD1 simultaneously, to generate gene-disrupted allogeneic CAR T cells deficient of TCR, HLA class I molecule and PD1.

In certain embodiments, cells may be engineered to express a CAR, wherein expression and/or function of methylcytosine dioxygenase genes (TET1, TET2 and/or TET3) in the cells has been reduced or eliminated, such as by CRISPR, ZNF or TALEN (for example, as described in WO201704916).

In certain embodiments, editing of cells (such as by CRISPR/Cas), particularly cells intended for adoptive cell therapies, more particularly immunoresponsive cells such as T cells, may be performed to knock-out or knock-down expression of an endogenous gene in a cell, said endogenous gene encoding an antigen targeted by an exogenous CAR or TCR, thereby reducing the likelihood of targeting of the engineered cells. In certain embodiments, the targeted antigen may be one or more antigen selected from the group consisting of CD38, CD138, CS-1, CD33, CD26, CD30, CD53, CD92, CD100, CD148, CD150, CD200, CD261, CD262, CD362, human telomerase reverse transcriptase (hTERT), survivin, mouse double minute 2 homolog (MDM2), cytochrome P450 1B1 (CYP1B), HER2/neu, Wilms' tumor gene 1 (WT1), livin, alphafetoprotein (AFP), carcinoembryonic antigen (CEA), mucin 16 (MUC16), MUC1, prostate-specific membrane antigen (PSMA), p53, cyclin (D1), B cell maturation antigen (BCMA), transmembrane activator and CAML Interactor (TACI), and B-cell activating factor receptor (BAFF-R) (for example, as described in WO2016011210 and WO2017011804).

In certain embodiments, editing of cells (such as by CRISPR/Cas), particularly cells intended for adoptive cell therapies, more particularly immunoresponsive cells such as T cells, may be performed to knock-out or knock-down expression of one or more MHC constituent proteins, such as one or more HLA proteins and/or beta-2 microglobulin (B2M), in a cell, whereby rejection of non-autologous (e.g., allogeneic) cells by the recipient's immune system can be reduced or avoided. In preferred embodiments, one or more HLA class I proteins, such as HLA-A, B and/or C, and/or B2M may be knocked-out or knocked-down. Preferably, B2M may be knocked-out or knocked-down. By means of an example, Ren et al., (2017) Clin Cancer Res 23 (9) 2255-2266 performed lentiviral delivery of CAR and electro-transfer of Cas9 mRNA and gRNAs targeting endogenous TCR, β-2 microglobulin (B2M) and PD1 simultaneously, to generate gene-disrupted allogeneic CAR T cells deficient of TCR, HLA class I molecule and PD1.

In other embodiments, at least two genes are edited. Pairs of genes may include, but are not limited to PD1 and TCRα, PD1 and TCRβ, CTLA-4 and TCRα, CTLA-4 and TCRβ, LAG3 and TCRα, LAG3 and TCRβ, Tim3 and TCRα, Tim3 and TCRβ, BTLA and TCRα, BTLA and TCRβ, BY55 and TCRα, BY55 and TCRβ, TIGIT and TCRα, TIGIT and TCRβ, B7H5 and TCRα, B7H5 and TCRβ, LAIR1 and TCRα, LAIR1 and TCRβ, SIGLEC10 and TCRα, SIGLEC10 and TCRβ, 2B4 and TCRα, 2B4 and TCRβ, B2M and TCRα, B2M and TCRβ.

In certain embodiments, a cell may be multiply edited (multiplex genome editing) as taught herein to (1) knock-out or knock-down expression of an endogenous TCR (for example, TRBC1, TRBC2 and/or TRAC), (2) knock-out or knock-down expression of an immune checkpoint protein or receptor (for example PD1, PD-L1 and/or CTLA4); and (3) knock-out or knock-down expression of one or more MHC constituent proteins (for example, HLA-A, B and/or C, and/or B2M, preferably B2M).

Whether prior to or after genetic modification of the T cells, the T cells can be activated and expanded generally using methods as described, for example, in U.S. Pat. Nos. 6,352,694; 6,534,055; 6,905,680; 5,858,358; 6,887,466; 6,905,681; 7,144,575; 7,232,566; 7,175,843; 5,883,223; 6,905,874; 6,797,514; 6,867,041; and 7,572,631. T cells can be expanded in vitro or in vivo.

Immune cells may be obtained using any method known in the art. In one embodiment, allogenic T cells may be obtained from healthy subjects. In one embodiment T cells that have infiltrated a tumor are isolated. T cells may be removed during surgery. T cells may be isolated after removal of tumor tissue by biopsy. T cells may be isolated by any means known in the art. In one embodiment, T cells are obtained by apheresis. In one embodiment, the method may comprise obtaining a bulk population of T cells from a tumor sample by any suitable method known in the art. For example, a bulk population of T cells can be obtained from a tumor sample by dissociating the tumor sample into a cell suspension from which specific cell populations can be selected. Suitable methods of obtaining a bulk population of T cells may include, but are not limited to, any one or more of mechanically dissociating (e.g., mincing) the tumor, enzymatically dissociating (e.g., digesting) the tumor, and aspiration (e.g., as with a needle).

The bulk population of T cells obtained from a tumor sample may comprise any suitable type of T cell. Preferably, the bulk population of T cells obtained from a tumor sample comprises tumor infiltrating lymphocytes (TILs).

The tumor sample may be obtained from any mammal. Unless stated otherwise, as used herein, the term "mammal" refers to any mammal including, but not limited to, mammals of the order Lagomorpha, such as rabbits; the order Carnivora, including Felines (cats) and Canines (dogs); the order Artiodactyla, including Bovines (cows) and Swines (pigs); or of the order Perissodactyla, including Equines (horses). The mammals may be non-human primates, e.g., of the order Primates, Ceboids, or Simoids (monkeys) or of the order Anthropoids (humans and apes). In some embodiments, the mammal may be a mammal of the order Rodentia, such as mice and hamsters. Preferably, the mammal is a non-human primate or a human. An especially preferred mammal is the human.

T cells can be obtained from a number of sources, including peripheral blood mononuclear cells (PBMC), bone marrow, lymph node tissue, spleen tissue, and tumors. In certain embodiments of the present invention, T cells can be obtained from a unit of blood collected from a subject using any number of techniques known to the skilled artisan, such as Ficoll separation. In one preferred embodiment, cells from the circulating blood of an individual are obtained by apheresis or leukapheresis. The apheresis product typically contains lymphocytes, including T cells, monocytes, granulocytes, B cells, other nucleated white blood cells, red blood cells, and platelets. In one embodiment, the cells collected by apheresis may be washed to remove the plasma fraction and to place the cells in an appropriate buffer or media for subsequent processing steps. In one embodiment of the invention, the cells are washed with phosphate buffered saline (PBS). In an alternative embodiment, the wash solution lacks calcium and may lack magnesium or may lack many if not all divalent cations. Initial activation steps in the absence of calcium lead to magnified activation. As those of ordinary skill in the art would readily appreciate a washing step may be accomplished by methods known to those in the art, such as by using a semi-automated "flow-through" centrifuge (for example, the Cobe 2991 cell processor) according to the manufacturer's instructions. After washing, the cells may be resuspended in a variety of biocompatible buffers, such as, for example, Ca-free, Mg-free PBS. Alternatively, the undesirable components of the apheresis sample may be removed and the cells directly resuspended in culture media.

In another embodiment, T cells are isolated from peripheral blood lymphocytes by lysing the red blood cells and depleting the monocytes, for example, by centrifugation through a PERCOLL™ gradient. A specific subpopulation of T cells, such as CD28+, CD4+, CDC, CD45RA+, and CD45RO+ T cells, can be further isolated by positive or negative selection techniques. For example, in one preferred embodiment, T cells are isolated by incubation with anti-CD3/anti-CD28 (i.e., 3×28)-conjugated beads, such as DYNABEADS® M-450 CD3/CD28 T, or XCYTE DYNABEADS™ for a time period sufficient for positive selection of the desired T cells. In one embodiment, the time period is about 30 minutes. In a further embodiment, the time period ranges from 30 minutes to 36 hours or longer and all integer values there between. In a further embodiment, the time period is at least 1, 2, 3, 4, 5, or 6 hours. In yet another preferred embodiment, the time period is 10 to 24 hours. In one preferred embodiment, the incubation time period is 24 hours. For isolation of T cells from patients with leukemia, use of longer incubation times, such as 24 hours, can increase cell yield. Longer incubation times may be used to isolate T cells in any situation where there are few T cells as compared to other cell types, such in isolating tumor infiltrating lymphocytes (TIL) from tumor tissue or from immunocompromised individuals. Further, use of longer incubation times can increase the efficiency of capture of CD8+ T cells.

Enrichment of a T cell population by negative selection can be accomplished with a combination of antibodies directed to surface markers unique to the negatively selected cells. A preferred method is cell sorting and/or selection via negative magnetic immunoadherence or flow cytometry that uses a cocktail of monoclonal antibodies directed to cell surface markers present on the cells negatively selected. For example, to enrich for CD4+ cells by negative selection, a monoclonal antibody cocktail typically includes antibodies to CD14, CD20, CD11b, CD16, HLA-DR, and CD8.

Further, monocyte populations (i.e., CD14+ cells) may be depleted from blood preparations by a variety of methodologies, including anti-CD14 coated beads or columns, or utilization of the phagocytotic activity of these cells to facilitate removal. Accordingly, in one embodiment, the invention uses paramagnetic particles of a size sufficient to be engulfed by phagocytotic monocytes. In certain embodiments, the paramagnetic particles are commercially available beads, for example, those produced by Life Technologies under the trade name Dynabeads™. In one embodiment, other non-specific cells are removed by coating the paramagnetic particles with "irrelevant" proteins (e.g., serum proteins or antibodies). Irrelevant proteins and antibodies include those proteins and antibodies or fragments thereof that do not specifically target the T cells to be isolated. In certain embodiments, the irrelevant beads include beads coated with sheep anti-mouse antibodies, goat anti-mouse antibodies, and human serum albumin.

In brief, such depletion of monocytes is performed by preincubating T cells isolated from whole blood, apheresed peripheral blood, or tumors with one or more varieties of irrelevant or non-antibody coupled paramagnetic particles at any amount that allows for removal of monocytes (approximately a 20:1 bead:cell ratio) for about 30 minutes to 2 hours at 22 to 37 degrees C., followed by magnetic removal of cells which have attached to or engulfed the paramagnetic particles. Such separation can be performed using standard methods available in the art. For example, any magnetic separation methodology may be used including a variety of which are commercially available, (e.g., DYNAL® Magnetic Particle Concentrator (DYNAL MPC®)). Assurance of requisite depletion can be monitored by a variety of methodologies known to those of ordinary skill in the art, including flow cytometric analysis of CD14 positive cells, before and after depletion.

For isolation of a desired population of cells by positive or negative selection, the concentration of cells and surface (e.g., particles such as beads) can be varied. In certain embodiments, it may be desirable to significantly decrease the volume in which beads and cells are mixed together (i.e., increase the concentration of cells), to ensure maximum contact of cells and beads. For example, in one embodiment, a concentration of 2 billion cells/ml is used. In one embodiment, a concentration of 1 billion cells/ml is used. In a further embodiment, greater than 100 million cells/ml is used. In a further embodiment, a concentration of cells of 10, 15, 20, 25, 30, 35, 40, 45, or 50 million cells/ml is used. In yet another embodiment, a concentration of cells from 75, 80, 85, 90, 95, or 100 million cells/ml is used. In further embodiments, concentrations of 125 or 150 million cells/ml can be used. Using high concentrations can result in increased cell yield, cell activation, and cell expansion. Further, use of high cell concentrations allows more efficient capture of cells that may weakly express target antigens of interest, such as CD28-negative T cells, or from samples where there are many tumor cells present (i.e., leukemic blood, tumor tissue, etc). Such populations of cells may have therapeutic value and would be desirable to obtain. For example, using high concentration of cells allows more efficient selection of CD8+ T cells that normally have weaker CD28 expression.

In a related embodiment, it may be desirable to use lower concentrations of cells. By significantly diluting the mixture of T cells and surface (e.g., particles such as beads), interactions between the particles and cells is minimized. This selects for cells that express high amounts of desired antigens to be bound to the particles. For example, CD4+ T cells express higher levels of CD28 and are more efficiently captured than CD8+ T cells in dilute concentrations. In one embodiment, the concentration of cells used is 5×10$^6$/ml. In other embodiments, the concentration used can be from about 1×10$^5$/ml to 1×10$^6$/ml, and any integer value in between.

T cells can also be frozen. Wishing not to be bound by theory, the freeze and subsequent thaw step provides a more uniform product by removing granulocytes and to some extent monocytes in the cell population. After a washing step to remove plasma and platelets, the cells may be suspended in a freezing solution. While many freezing solutions and parameters are known in the art and will be useful in this context, one method involves using PBS containing 20% DMSO and 8% human serum albumin, or other suitable cell freezing media, the cells then are frozen to −80° C. at a rate of 1° per minute and stored in the vapor phase of a liquid nitrogen storage tank. Other methods of controlled freezing may be used as well as uncontrolled freezing immediately at −20° C. or in liquid nitrogen.

T cells for use in the present invention may also be antigen-specific T cells. For example, tumor-specific T cells can be used. In certain embodiments, antigen-specific T cells can be isolated from a patient of interest, such as a patient afflicted with a cancer or an infectious disease. In one embodiment, neoepitopes are determined for a subject and T cells specific to these antigens are isolated. Antigen-specific cells for use in expansion may also be generated in vitro using any number of methods known in the art, for example, as described in U.S. Patent Publication No. US 20040224402 entitled, Generation and Isolation of Antigen-Specific T Cells, or in U.S. Pat. Nos. 6,040,177. Antigen-specific cells for use in the present invention may also be generated using any number of methods known in the art, for example, as described in Current Protocols in Immunology, or Current Protocols in Cell Biology, both published by John Wiley & Sons, Inc., Boston, Mass.

In a related embodiment, it may be desirable to sort or otherwise positively select (e.g. via magnetic selection) the antigen specific cells prior to or following one or two rounds of expansion. Sorting or positively selecting antigen-specific cells can be carried out using peptide-MHC tetramers (Altman, et al., Science. 1996 Oct. 4; 274(5284):94-6). In another embodiment, the adaptable tetramer technology approach is used (Andersen et al., 2012 Nat Protoc. 7:891-902). Tetramers are limited by the need to utilize predicted binding peptides based on prior hypotheses, and the restriction to specific HLAs. Peptide-MHC tetramers can be generated using techniques known in the art and can be made with any MHC molecule of interest and any antigen of interest as described herein. Specific epitopes to be used in this context can be identified using numerous assays known in the art. For example, the ability of a polypeptide to bind to MHC class I may be evaluated indirectly by monitoring the ability to promote incorporation of $^{125}$I labeled β2-microglobulin (β2m) into MHC class I/β2m/peptide heterotrimeric complexes (see Parker et al., J. Immunol. 152:163, 1994).

In one embodiment cells are directly labeled with an epitope-specific reagent for isolation by flow cytometry followed by characterization of phenotype and TCRs. In one embodiment, T cells are isolated by contacting with T cell specific antibodies. Sorting of antigen-specific T cells, or generally any cells of the present invention, can be carried out using any of a variety of commercially available cell sorters, including, but not limited to, MoFlo sorter (DakoCytomation, Fort Collins, Colo.), FACSAria™, FACSArray™, FACSVantage™, BD™ LSR II, and FACSCalibur™ (BD Biosciences, San Jose, Calif.).

In a preferred embodiment, the method comprises selecting cells that also express CD3. The method may comprise specifically selecting the cells in any suitable manner. Preferably, the selecting is carried out using flow cytometry. The flow cytometry may be carried out using any suitable method known in the art. The flow cytometry may employ any suitable antibodies and stains. Preferably, the antibody is chosen such that it specifically recognizes and binds to the particular biomarker being selected. For example, the specific selection of CD3, CD8, TIM-3, LAG-3, 4-1BB, or PD-1 may be carried out using anti-CD3, anti-CD8, anti-TIM-3, anti-LAG-3, anti-4-1BB, or anti-PD-1 antibodies, respectively. The antibody or antibodies may be conjugated to a bead (e.g., a magnetic bead) or to a fluorochrome. Preferably, the flow cytometry is fluorescence-activated cell sorting (FACS). TCRs expressed on T cells can be selected based on reactivity to autologous tumors. Additionally, T cells that are reactive to tumors can be selected for based on markers using the methods described in patent publication Nos. WO2014133567 and WO2014133568, herein incorporated by reference in their entirety. Additionally, activated T cells can be selected for based on surface expression of CD107a.

In one embodiment of the invention, the method further comprises expanding the numbers of T cells in the enriched cell population. Such methods are described in U.S. Pat. No. 8,637,307 and is herein incorporated by reference in its entirety. The numbers of T cells may be increased at least about 3-fold (or 4-, 5-, 6-, 7-, 8-, or 9-fold), more preferably at least about 10-fold (or 20-, 30-, 40-, 50-, 60-, 70-, 80-, or 90-fold), more preferably at least about 100-fold, more preferably at least about 1,000 fold, or most preferably at least about 100,000-fold. The numbers of T cells may be expanded using any suitable method known in the art. Exemplary methods of expanding the numbers of cells are described in patent publication No. WO 2003057171, U.S. Pat. No. 8,034,334, and U.S. Patent Application Publication No. 2012/0244133, each of which is incorporated herein by reference.

In one embodiment, ex vivo T cell expansion can be performed by isolation of T cells and subsequent stimulation or activation followed by further expansion. In one embodiment of the invention, the T cells may be stimulated or activated by a single agent. In another embodiment, T cells are stimulated or activated with two agents, one that induces a primary signal and a second that is a co-stimulatory signal. Ligands useful for stimulating a single signal or stimulating a primary signal and an accessory molecule that stimulates a second signal may be used in soluble form. Ligands may be attached to the surface of a cell, to an Engineered Multivalent Signaling Platform (EMSP), or immobilized on a surface. In a preferred embodiment both primary and secondary agents are co-immobilized on a surface, for example a bead or a cell. In one embodiment, the molecule providing the primary activation signal may be a CD3 ligand, and the co-stimulatory molecule may be a CD28 ligand or 4-1BB ligand.

In certain embodiments, T cells comprising a CAR or an exogenous TCR, may be manufactured as described in WO2015120096, by a method comprising: enriching a population of lymphocytes obtained from a donor subject; stimulating the population of lymphocytes with one or more T cell stimulating agents to produce a population of activated T cells, wherein the stimulation is performed in a closed system using serum-free culture medium; transducing the population of activated T cells with a viral vector comprising a nucleic acid molecule which encodes the CAR or TCR, using a single cycle transduction to produce a population of transduced T cells, wherein the transduction is performed in a closed system using serum-free culture medium; and expanding the population of transduced T cells for a predetermined time to produce a population of engineered T cells, wherein the expansion is performed in a closed system using serum-free culture medium. In certain embodiments, T cells comprising a CAR or an exogenous TCR, may be manufactured as described in WO2015120096, by a method comprising: obtaining a population of lymphocytes; stimulating the population of lymphocytes with one or more stimulating agents to produce a population of activated T cells, wherein the stimulation is performed in a closed system using serum-free culture medium; transducing the population of activated T cells with a viral vector comprising a nucleic acid molecule which encodes the CAR or TCR, using at least one cycle transduction to produce a population of transduced T cells, wherein the transduction is performed in a closed system using serum-free culture medium; and expanding the population of transduced T cells to produce a population of engineered T cells, wherein the expansion is performed in a closed system using serum-free culture medium. The predetermined time for expanding the population of transduced T cells may be 3 days. The time from enriching the population of lymphocytes to producing the engineered T cells may be 6 days. The closed system may be a closed bag system. Further provided is population of T cells comprising a CAR or an exogenous TCR obtainable or obtained by said method, and a pharmaceutical composition comprising such cells.

In certain embodiments, T cell maturation or differentiation in vitro may be delayed or inhibited by the method as described in WO2017070395, comprising contacting one or more T cells from a subject in need of a T cell therapy with an AKT inhibitor (such as, e.g., one or a combination of two or more AKT inhibitors disclosed in claim 8 of WO2017070395) and at least one of exogenous Interleukin-7 (IL-7) and exogenous Interleukin-15 (IL-15), wherein the resulting T cells exhibit delayed maturation or differentiation, and/or wherein the resulting T cells exhibit improved T cell function (such as, e.g., increased T cell proliferation; increased cytokine production; and/or increased cytolytic activity) relative to a T cell function of a T cell cultured in the absence of an AKT inhibitor.

In certain embodiments, a patient in need of a T cell therapy may be conditioned by a method as described in WO2016191756 comprising administering to the patient a dose of cyclophosphamide between 200 mg/m2/day and 2000 mg/m2/day and a dose of fludarabine between 20 mg/m2/day and 900 mg/m$^2$/day.

Vaccine or Immunogenic Composition Kits and Co-Packaging

In an aspect, the invention provides kits containing any one or more of the elements discussed herein to allow administration of the therapy. Elements may be provided individually or in combinations, and may be provided in any suitable container, such as a vial, a bottle, or a tube. In some embodiments, the kit includes instructions in one or more languages, for example in more than one language. In some embodiments, a kit comprises one or more reagents for use in a process utilizing one or more of the elements described herein. Reagents may be provided in any suitable container. For example, a kit may provide one or more delivery or storage buffers. Reagents may be provided in a form that is usable in a particular process, or in a form that requires addition of one or more other components before use (e.g. in concentrate or lyophilized form). A buffer can be any buffer, including but not limited to a sodium carbonate buffer, a sodium bicarbonate buffer, a borate buffer, a Tris buffer, a MOPS buffer, a HEPES buffer, and combinations thereof. In some embodiments, the buffer is alkaline. In some embodiments, the buffer has a pH from about 7 to about 10. In some embodiments, the kit comprises one or more of the vectors, proteins and/or one or more of the polynucleotides described herein. The kit may advantageously allow the provision of all elements of the systems of the invention. Kits can involve vector(s) and/or particle(s) and/or nanoparticle(s) containing or encoding RNA(s) for 1-50 or more neoantigen mutations to be administered to an animal, mammal, primate, rodent, etc., with such a kit including instructions for administering to such a eukaryote; and such a kit can optionally include any of the anti-cancer agents described herein. The kit may include any of the components above (e.g. vector(s) and/or particle(s) and/or nanoparticle(s) containing or encoding RNA(s) for 1-50 or more neoantigen mutations, neoantigen proteins or peptides) as well as instructions for use with any of the methods of the present invention. In one embodiment the kit contains at least one vial with an immunogenic composition or vaccine. In one embodiment the kit contains at least one vial with an immunogenic composition or vaccine and at least one vial with an anticancer agent. In one embodiment kits may comprise ready to use components that are mixed and ready to administer. In one aspect a kit contains a ready to use immunogenic or vaccine composition and a ready to use anti-cancer agent. The ready to use immunogenic or vaccine composition may comprise separate vials containing different pools of immunogenic compositions. The immunogenic compositions may comprise one vial containing a viral vector or DNA plasmid and the other vial may comprise immunogenic protein. The ready to use anticancer agent may comprise a cocktail of anticancer agents or a single anticancer agent. Separate vials may contain different anticancer agents. In another embodiment a kit may contain a ready to use anti-cancer agent and an immunogenic composition or vaccine in a ready to be reconstituted form. The immunogenic or vaccine composition may be freeze dried or lyophilized. The kit may comprise a separate vial with a reconstitution buffer that can be added to the lyophilized composition so that it is ready to administer. The buffer may advantageously comprise an adjuvant or emulsion according to the present invention. In another embodiment the kit may comprise a ready to reconstitute anticancer agent and a ready to reconstitute immunogenic composition or vaccine. In this aspect both may be lyophilized. In this aspect separate reconstitution buffers for each may be included in the kit. The buffer may advantageously comprise an adjuvant or emulsion according to the present invention. In another embodiment the kit may comprise single vials containing a dose of immunogenic composition and anti-cancer agent that are administered together. In another aspect multiple vials are included so that one vial is administered according to a treatment timeline. One vial may only contain the anti-cancer agent for one dose of treatment, another may contain both the anti-cancer agent and immunogenic composition for another dose of treatment, and one vial may only contain the immunogenic composition for yet another dose. In a further aspect the vials are labeled for their proper administration to a patient in need thereof. The immunogen or anti-cancer agents of any embodiment may be in a lyophilized form, a dried form or in aqueous solution as described herein. The immunogen may be a live attenuated virus, protein, or nucleic acid as described herein.

In one embodiment the anticancer agent is one that enhances the immune system to enhance the effectiveness of the immunogenic composition or vaccine. In a preferred embodiment the anti-cancer agent is a checkpoint inhibitor. In another embodiment the kit contains multiple vials of immunogenic compositions and anti-cancer agents to be administered at different time intervals along a treatment plan. In another embodiment the kit may comprise separate vials for an immunogenic composition for use in priming an immune response and another immunogenic composition to be used for boosting. In one aspect the priming immunogenic composition could be DNA or a viral vector and the boosting immunogenic composition may be protein. Either composition may be lyophilized or ready for administering. In another embodiment different cocktails of anti-cancer agents containing at least one anticancer agent are included in different vials for administration in a treatment plan.

Although the present invention and its advantages have been described in detail, it should be understood that various changes, substitutions and alterations can be made herein without departing from the spirit and scope of the invention as defined in the appended claims.

Further embodiments are illustrated in the following Examples which are given for illustrative purposes only and are not intended to limit the scope of the invention.

EXAMPLES

Example 1—Experimental Procedures

Cell Culture and HLA-Peptide Immunopurification. Applicants tested mono-allelic B cells generated by transduction of B721.221 cells with a retroviral vector coding a single class I HLA allele as described previously (Reche P A, Keskin D B, Hussey R E, Ancuta P, Gabuzda D, Reinherz E L. Elicitation from virus-naive individuals of cytotoxic T lymphocytes directed against conserved HIV-1 epitopes. Med Immunol. 2006; 5:1) (cells expressing HLA-A*02:01, -A*24:02, and -B*44:03 were purchased from the Fred Hutchinson Research Cell Bank, University of Washington; cells expressing HLA-A*03:01 were a gift from Dr. Marcus Altfeld and Dr. Wilfredo F. Garcia-Beltran, Ragon Institute; others were a gift from Dr. E. L. Reinherz, Dana Farber Cancer Institute). Cell lines were confirmed by standard molecular typing (Brigham and Women's Hospital Tissue Typing Laboratory). HLA-peptide immunopurifcation is described in the Supplemental Experimental Procedures of Abelin et al., Mass Spectrometry Profiling of HLA-Associated Peptidomes in Mono-allelic Cells Enables More Accurate Epitope Prediction. Immunity. 2017 Feb. 21; 46(2):315-326.

HLA-Peptide Sequencing by Tandem Mass Spectrometry. All nanoLC-ESI-MS/MS analyses employed the same LC separation conditions, instrument parameters, and data analytics described in the Supplemental Experimental Procedures of Abelin et al., Mass Spectrometry Profiling of HLA-Associated Peptidomes in Mono-allelic Cells Enables More Accurate Epitope Prediction. Immunity. 2017 Feb. 21; 46(2):315-326. The original mass spectra may be downloaded from MassIVE (massive.ucsd.edu) under the identifier MassIVE: MSV000080527. The data are directly accessible via ftp://massive.ucsd.edu/MSV000080527.

Sequence Properties of MS-Identified Peptides Compared to IEDB. A curated set of previously identified class I HLA-bound peptides was downloaded from the Immune Epitope Database (IEDB) at www.iedb.org/ (accessed on Oct. 26, 2015) (Vita R, Overton J A, Greenbaum J A, Ponomarenko J, Clark J D, Cantrell J R, Wheeler D K, Gabbard J L, Hix D, Sette A, Peters B. The immune epitope database (IEDB) 3.0. Nucleic Acids Res. 2015; 43:D405-D412). For each allele, IEDB peptides with a measured affinity <500 nM were compared to MS peptides in terms of their length and positional amino acid frequencies. In addition, a metric was defined for the pairwise "distance" between 9-mers (a Hamming distance calculated with an amino acid substitution matrix [Kim Y, Sidney J, Pinilla C, Sette A, Peters B. Derivation of an amino acid similarity matrix for peptide: MHC binding and its application as a Bayesian prior. BMC Bioinformatics. 2009; 10:394] and inversely weighted according to positional entropy) and used for clustering MS and IEDB peptides in a two-dimensional representation. A machine-learning approach (Supplemental Experimental Procedures of Abelin et al., Mass Spectrometry Profiling of HLA-Associated Peptidomes in Mono-allelic Cells Enables More Accurate Epitope Prediction. Immunity. 2017 Feb. 21; 46(2):315-326) identified peptides with motifs favored in the MS but that were poor-scoring according to NetMHCpan 2.8; the MHC-binding affinities for these peptides were determined by competitive binding per gel filtration protocol (Sidney J, Southwood S, Oseroff C, del Guercio M F, Sette A, Grey H M. Measurement of MHC/peptide interactions by gel filtration. Curr Protoc Immunol Chapter. 2001; 18:3).

Peptide Processing Analyses. For each MS hit, the upstream ten amino acids and downstream ten amino acids were determined. Sequence context was likewise determined for decoy peptides (100 per hit; selected randomly from the proteome and matched according to their first two and last two amino acids). Relative amino acid frequencies were determined at each position upstream and downstream of hits and decoys. Additional previously published MS datasets were analyzed in the same manner. For comparison, peptides with high and low NetChop scores (top 25% and bottom 25% of 1 million randomly selected sites in the genome) were compared, and the motif most favored by NetChop was derived.

Relationship between Expression and Affinity. RNA was isolated from B721.221 cells expressing HLA-A*29:02, B*51:01, B*54:01, and B*57:01 (RNeasy mini kit, QIAGEN), processed to cDNA (Nextera XT kit; Smart-seq2 protocol), sequenced (HiSeq2500, Rapid Run mode; 50 bp paired-end), and aligned (bowtie2-2.2.1 (Langmead B, Salzberg S L. Fast gapped-read alignment with Bowtie 2. Nat Methods. 2012; 9:357-359)); UCSC hg19 annotation). Applicants averaged transcript expression (RSEM-1.2.19

[Li B, Dewey C N. RSEM: Accurate transcript quantification from RNA-Seq data with or without a reference genome. BMC Bioinformatics. 2011; 12:323]; GEO: GSE93315) across the four cell lines and made adjustments by dropping non-coding transcripts and rescaling TPM values to sum to one million. Applicants determined expression of each peptide source protein by summing all transcripts containing the peptide.

Impact of Processing Pathways. MS peptides were compared to decoys (ten decoys per MS peptide; each from a different gene; matched per transcript expression) in terms of various features potentially related to peptide processing: UNIPROT localization (www.uniprot.org), distance from protein N terminus, source protein stability index (Guruprasad K, Reddy B V B, Pandit M W. Correlation between stability of a protein and its dipeptide composition: a novel approach for predicting in vivo stability of a protein from its primary sequence. Protein Eng. 1990; 4:155-161), intrinsically disordered sequence content (d2p2.pro) (Oates M E, Romero P, Ishida T, Ghalwash M, Mizianty M J, Xue B, Dosztinyi Z, Uversky V N, Obradovic Z, Kurgan L, et al. $D^2P^2$: Database of disordered protein predictions. Nucleic Acids Res. 2013; 41:D508-D516), count of known ubiquitination sites (Eichmann M, de Ru A, van Veelen P A, Peakman M, Kronenberg-Versteeg D. Identification and characterisation of peptide binding motifs of six autoimmune disease-associated human leukocyte antigen-class I molecules including HLA-B*39:06. Tissue Antigens. 2014; 84:378-388; Krönke J, Fink E C, Hollenbach P W, MacBeth K J, Hurst S N, Udeshi N D, Chamberlain P P, Mani D R, Man H W, Gandhi A K, et al. Lenalidomide induces ubiquitination and degradation of CK1α in del(5q) MDS. Nature. 2015; 523:183-188; Udeshi N D, Mani D R, Eisenhaure T, Mertins P, Jaffe J D, Clauser K R, Hacohen N, Carr S A. Methods for quantification of in vivo changes in protein ubiquitination following proteasome and deubiquitinase inhibition. Mol Cell Proteomics. 2012; 11:148-159), and physical interaction with known protein turnover regulators (Behrends C, Sowa M E, Gygi S P, Harper J W. Network organization of the human autophagy system. Nature. 2010; 466:68-76).

Development of New Epitope-Selection Algorithms. For each allele, Applicants trained neural-network classifiers (one hidden layer with 50 units) (by using Theano (Theano Development Team, 2016); 5-fold cross-validation) to differentiate MS 9-mers from random decoy 9-mers by using different input feature schemes: dummy encoding, BLOSUM62, PMBEC (Kim Y, Sidney J, Pinilla C, Sette A, Peters B. Derivation of an amino acid similarity matrix for peptide: MHC binding and its application as a Bayesian prior. BMC Bioinformatics. 2009; 10:394), biochemical properties (Bremel R D, Homan E J. An integrated approach to epitope analysis I: Dimensional reduction, visualization and prediction of MHC binding using amino acid principal components and regression approaches. Immunome Res. 2010; 6:7), and peptide-level features (Osorio D, Rondón-Villarreal P, Torres R. Peptides: Calculate indices and theoretical physicochemical properties of peptides and protein sequences. 2014 CRAN.R-project.org/package=Peptides. R Package Version 1.1.0); Applicants averaged the results of these models to obtain a single prediction (called MSIntrinsic). Applicants made a second prediction (MSIntrinsicEC) by adding expression and MS-trained cleavability. Applicants validated performance on external data by measuring PPV (fraction of true MS peptides among the top-scoring 0.1%, where decoys are present at 999:1). For multi-allelic datasets, the evaluation excluded any MS peptides that obviously belonged to an HLA-A or HLA-B allele other than the one in question (e.g., when predicting for A01:01 for a cell line with genotype A01:01/A02:01/B35:01/B44:02, Applicants excluded MS-observed peptides with NetMHCPan 2.8 scores worse than 1,000 nM for A01:01 and better than 150 nM for A02:01, B35:01, or B44:02).

Example 2—Improved Prediction of Endogenously Presented HLA Class I Epitopes in Human Tumors Based on 95 Mono-Allelic Peptidomes Antigen discovery is a high priority for developing cancer immunotherapies, but remains challenging because of inter-individual variation in tumor-specific antigens and rules of antigen presentation. To enable prediction of endogenous HLA-associated peptides across a large fraction of the human population, Applicants used mass spectrometry (MS) to profile >185,000 peptides eluted from 95 HLA-A, B, C and G mono-allelic cell lines. In addition to identifying canonical peptide motifs for each of these HLA alleles, Applicants found unique and shared binding submotifs across alleles, and distinct motifs associated with different peptide lengths. Based on the full dataset of peptides and quantitative gene expression, Applicants learned allele-and-length-specific and pan-allele-pan-length models that integrate transcript abundance and peptide processing. These models predicted endogenous HLA-associated ligands with a 2-fold improvement in positive predictive value compared to existing tools and correctly identified >75% of HLA-bound peptides that were observed experimentally in 11 patient tumor cell lines by MS. More accurate prediction of class I epitopes will enable antigen discovery in cancer as well as infections, autoimmunity and other immune-related conditions.

The HLA genes are the most polymorphic across the human population, with more than 16,200 distinct class I alleles as of May 2019 (Lefranc et al. 2015; Robinson et al. 2015). Short peptides (8-11mers) bound to the diverse array of class I HLA molecules (HLA-A, -B, —C, and -G) arise from endogenous or foreign proteins that are cleaved by the proteasome and peptidases of the endoplasmic reticulum prior to loading and display by surface HLA class I proteins to cytotoxic T cell lymphocytes (CTLs). Given the diversity in HLA binding, an important question is whether one can accurately predict if a peptide is presented by a specific HLA allele. The accuracy of computational models that predict binding between peptides and HLA alleles, especially HLA-A and -B alleles, has been improving (Jurtz et al. 2017; Abelin et al. 2017; O'Donnell et al. 2018; Gfeller et al. 2018; Bulik-Sullivan et al. 2018). In the field of cancer, these tools are now increasingly used in conjunction with next-generation DNA sequencing of tumors to identify immunogenic cancer neoantigens, which arise from tumor-specific somatic mutations. They have accelerated epitope discovery, as they enable experimental efforts to focus on a narrower list of epitopes with predicted high binding scores. However, even with widely used algorithms such as NetMHCpan (Jurtz et al. 2017; Nielsen and Andreatta 2016), the numbers of falsely discovered binders increase once the predicted binding affinity decreases (i.e. IC50>100 nM)(Rajasagi et al. 2014). Furthermore, while these algorithms are designed to predict the binding affinity of peptides to individual HLA molecules—the final step of antigen presentation, they do not account for intracellular availability of the peptide precursors or their processing by proteases. Finally, because previous research has focused exclusively on the few alleles highly expressed by Caucasian populations, existing algorithms have uneven accuracy in the prediction of epitopes binding to less common alleles in Caucasians, or those highly prevalent in other populations.

Detection and sequencing of HLA-binding peptides by liquid chromatography-tandem mass spectrometry (LC-MS/MS) has the unique advantage that information on endogenously processed and presented peptides from a cell can be directly learned. Characterization of HLA-bound peptides eluted from a limited set of cell lines engineered to express single HLA alleles could reveal novel allele-specific peptide motifs and be used to train predictive algorithms for endogenous allele-specific peptide presentation (Abelin et al. 2017). Here, Applicant greatly expanded the dataset and identified and characterized 186,464 eluted peptides from 95 HLA-A, -B, —C and -G alleles. Applicant included HLA-G peptidomes since this HLA was implicated in maternal-fetal tolerance and was also upregulated in many cancers (de Kruijf et al. 2010; Zhang et al. 2017). Altogether, these data provided the opportunity to compare peptide length preferences, and the spectrum of distinct and shared submotifs across HLA class I alleles, revealing the diversity and complexity of endogenous HLA ligands. Using this information, Applicant trained novel allele-and-length-specific and pan-allele-pan-length predictors, which identified 2-fold more peptides than conventional prediction tools, when evaluating peptides directly detected by MS from 11 patient-derived tumor cell lines generated from diverse malignancies. The datasets of HLA-binding peptides from mono-allelic cells and patient-derived tumors, as well as the prediction models and interactive web tools are all made publicly available.

Results

Figure 32A:
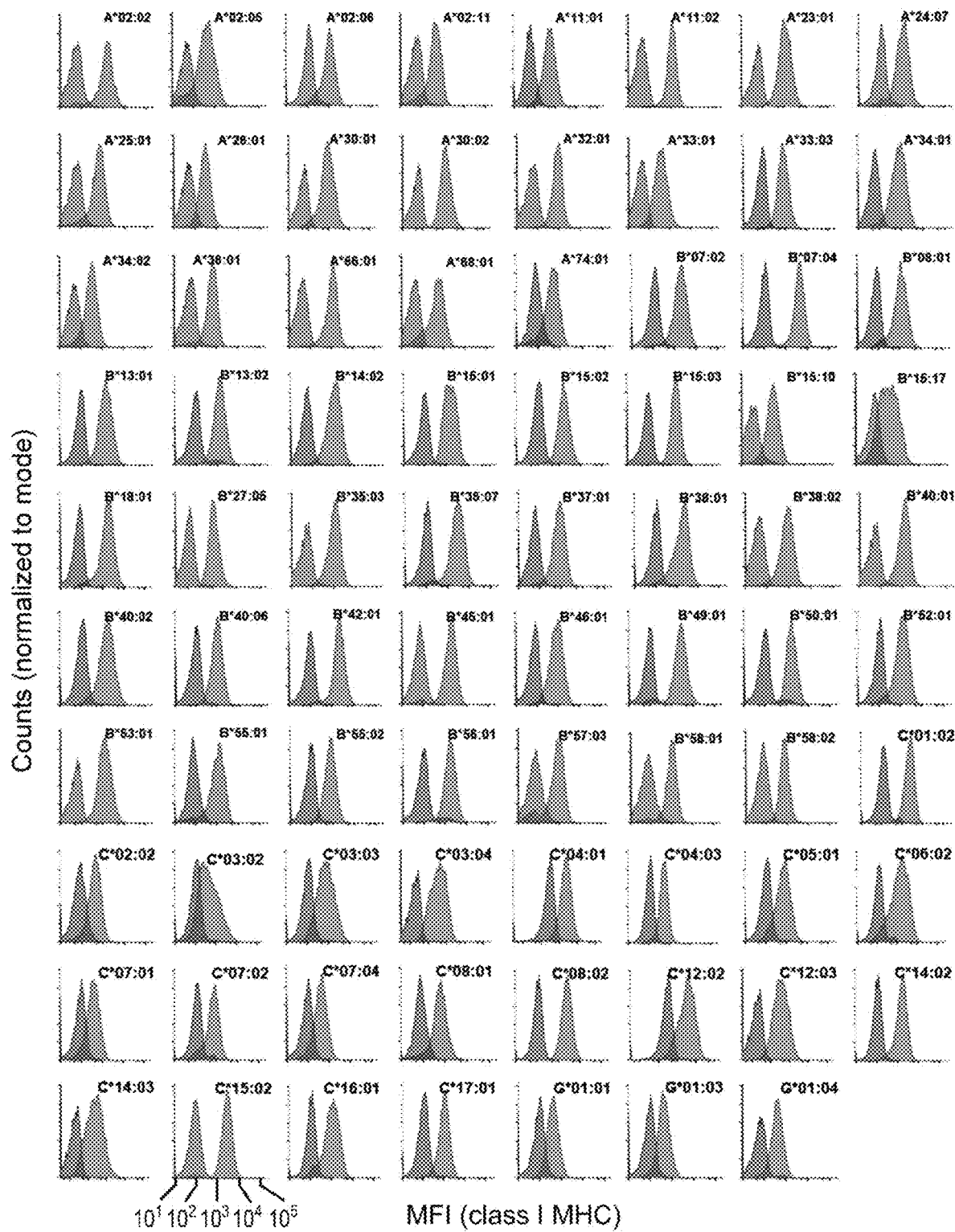
FIGS. 32A-32N—FIG. 32A) Mean Fluorescence Intensity (MFI) plots confirming expression of 76 newly generated mono-allelic cell lines.

Systematic LC-MS/MS Profiling of HLA Class I Ligands from Mono-Allelic Cell Lines Applicant engineered 79 cell lines expressing a single HLA class I allele by stably transfecting individual HLA-A, -B, —C, or -G alleles into the HLA-null B721.221 cell line (FIG. 26A), adding to the 16 lines (Abelin et al. 2017). Surface expression of the alleles was confirmed by flow cytometric detection (FIG. 26B; FIG. 32A). Altogether, the collection of 95 cell lines (31 HLA-A, 40 HLA-B, 21 HLA-C and 3 HLA-G) covered at least one allele in 95% of individuals worldwide for each HLA-A, -B and for HLA-C alleles, respectively (FIG. 26C)(Dawson et al. 2001; Gragert et al. 2013; Solberg et al. 2008).

Figures 32B, 32C, 32D, 32E:
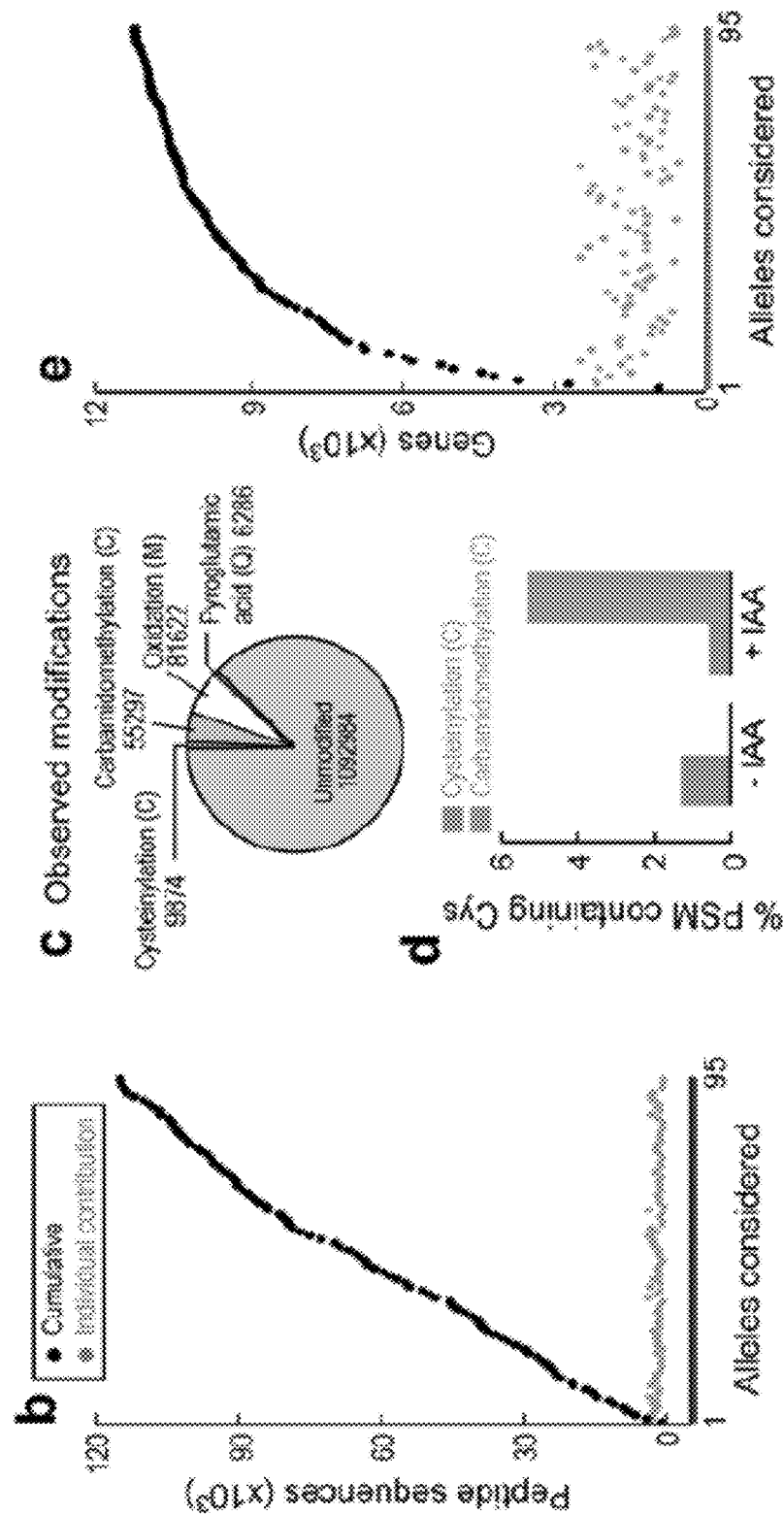
FIG. 32B) Each allele adds unique peptide sequences to the total immunopeptidome (black), number of individual peptide identifications are similar across alleles (blue).
FIG. 32C) Only a small fraction of identified peptides was discovered with a modification (cysteinylation (C), carbamidomethylation (C), oxidation (M) or pyroglutamic acid (Q)).
FIG. 32D) Addition of iodoacetamide (IAA) in the lysis buffer increases recovery of cysteine containing HLA peptides.
FIG. 32E) Number of genes presented by HLA peptides increases with additional allotypes.
Figures 32F, 32G:
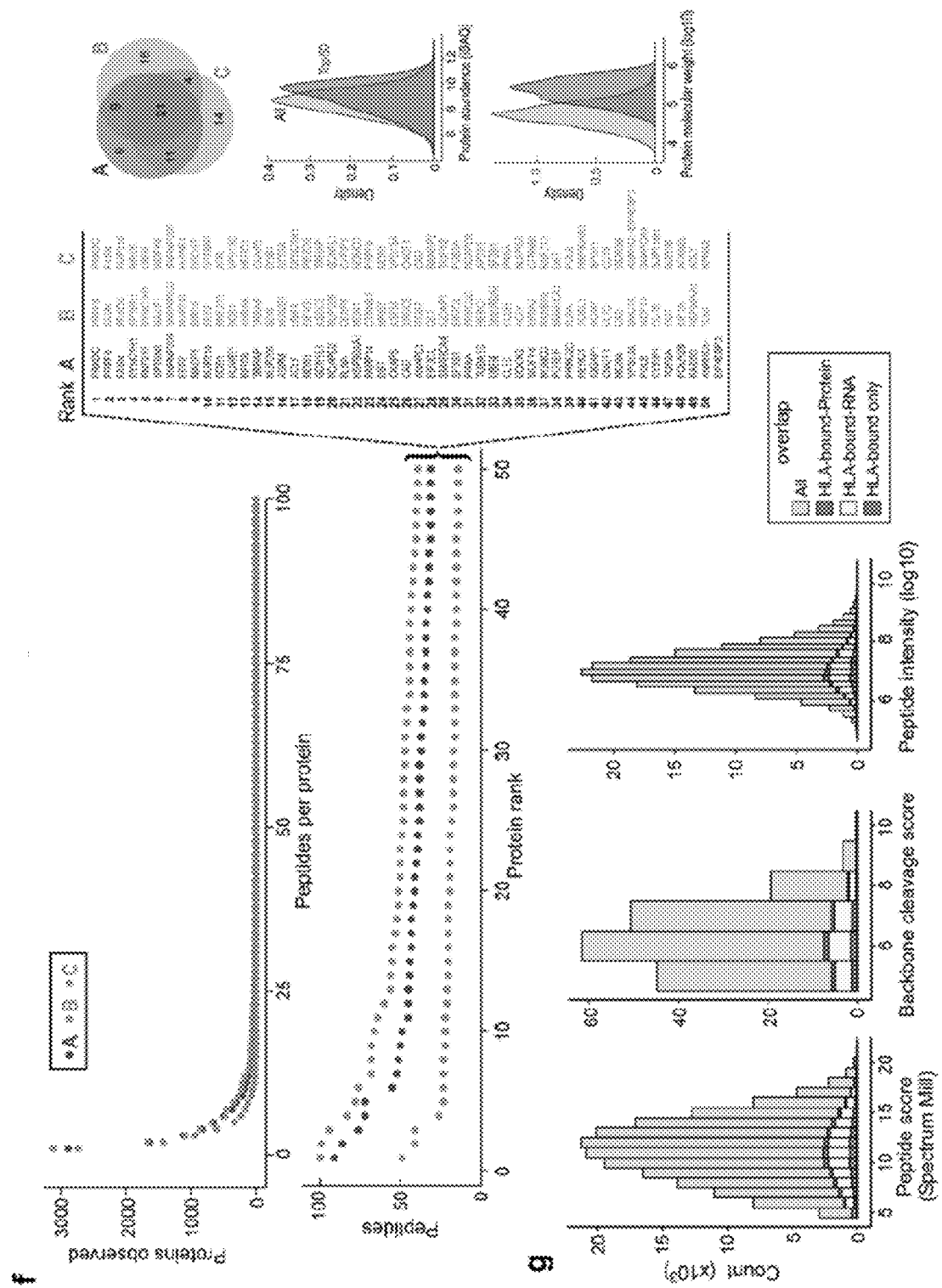
FIG. 32F) Most genes are covered by one or 2 peptide sequences only. Ranked by number of peptides for each protein starting with the most frequently observed gene, the top 50 proteins per HLA-type are similar between A-, B-, and C-alleles and derived from large and abundant proteins.
FIG. 32G) Peptides from genes only identified in HLA experiments show same scores, backbone cleavage scores and intensity distribution as peptides from genes overlapping to RNA and Proteome.
Figures 32H, 32M, 32N:
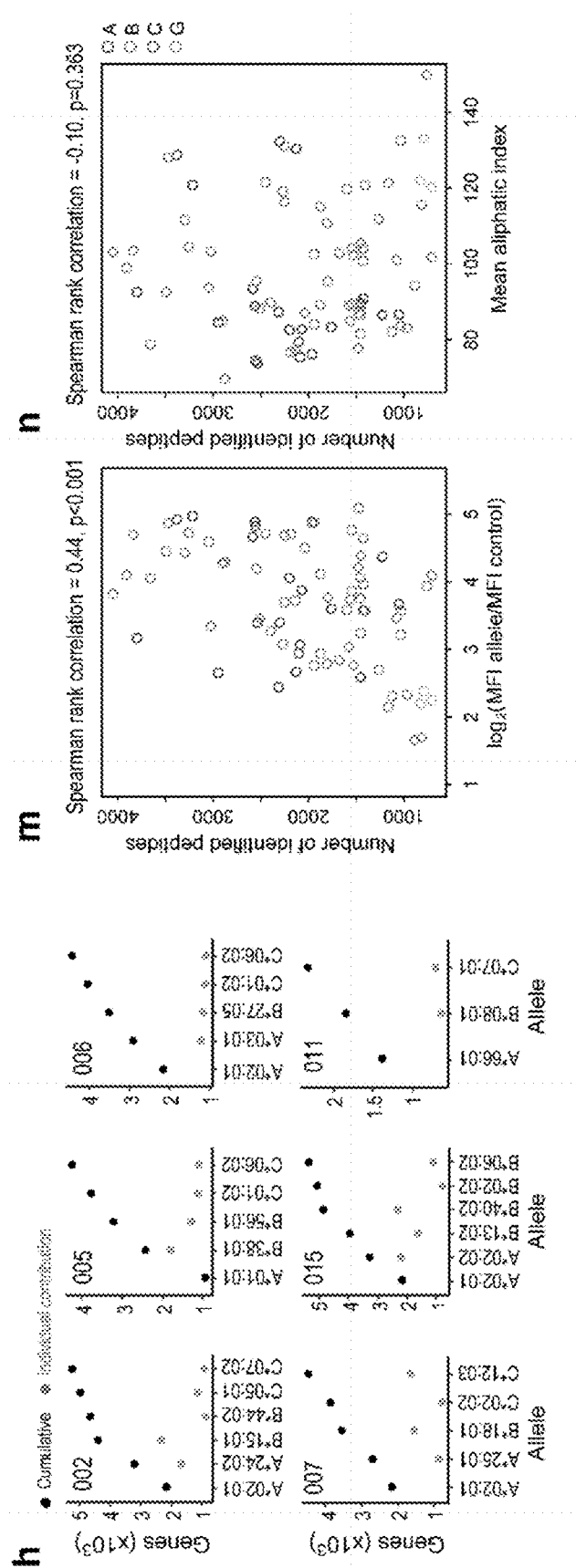
FIG. 32H) Antigens of up to 5000 genes can be presented by 6 alleles, HLA phenotypes reflect those of melanoma patients used in this and other studies (Ott et al. 2017).
FIG. 32M) Surface expression of single alleles measured by flow cytometry correlated weakly with number of identified peptides.
Figure 32I:
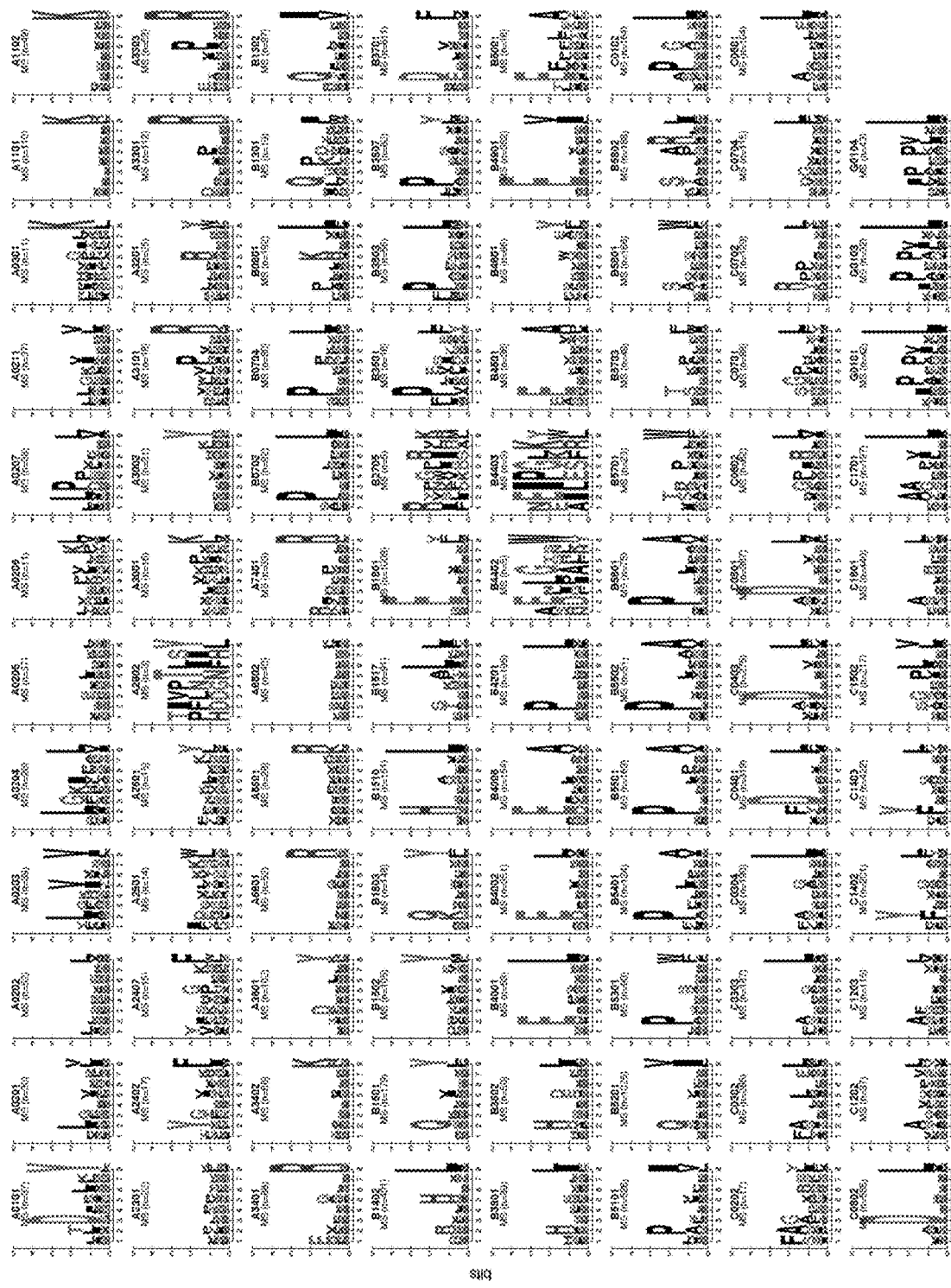
FIG. 32I) Logo plots per peptide length (8-11 mers) for 95 alleles using MS data.
Figure 32I:
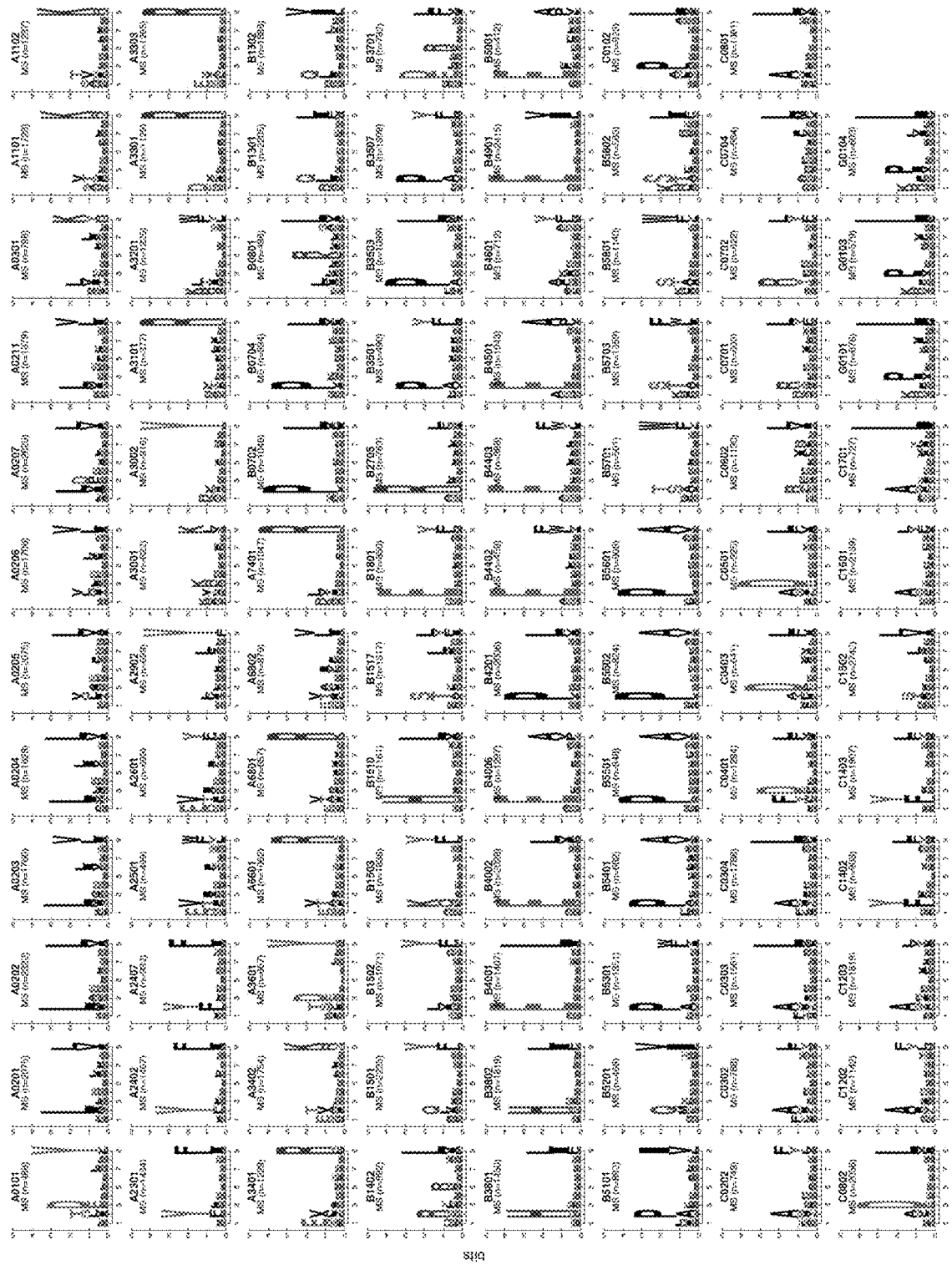
Figure 32I:
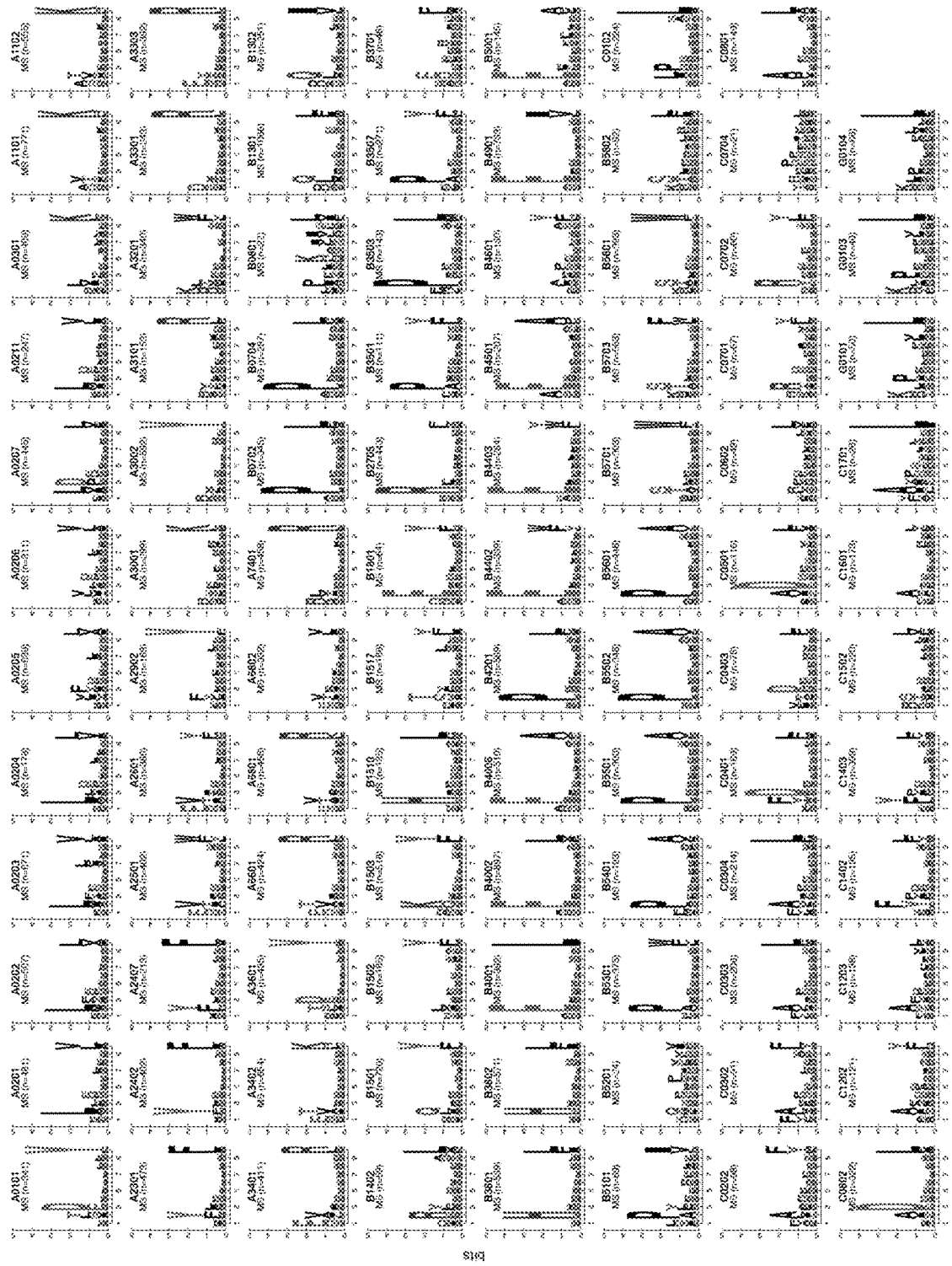
Figure 32I:
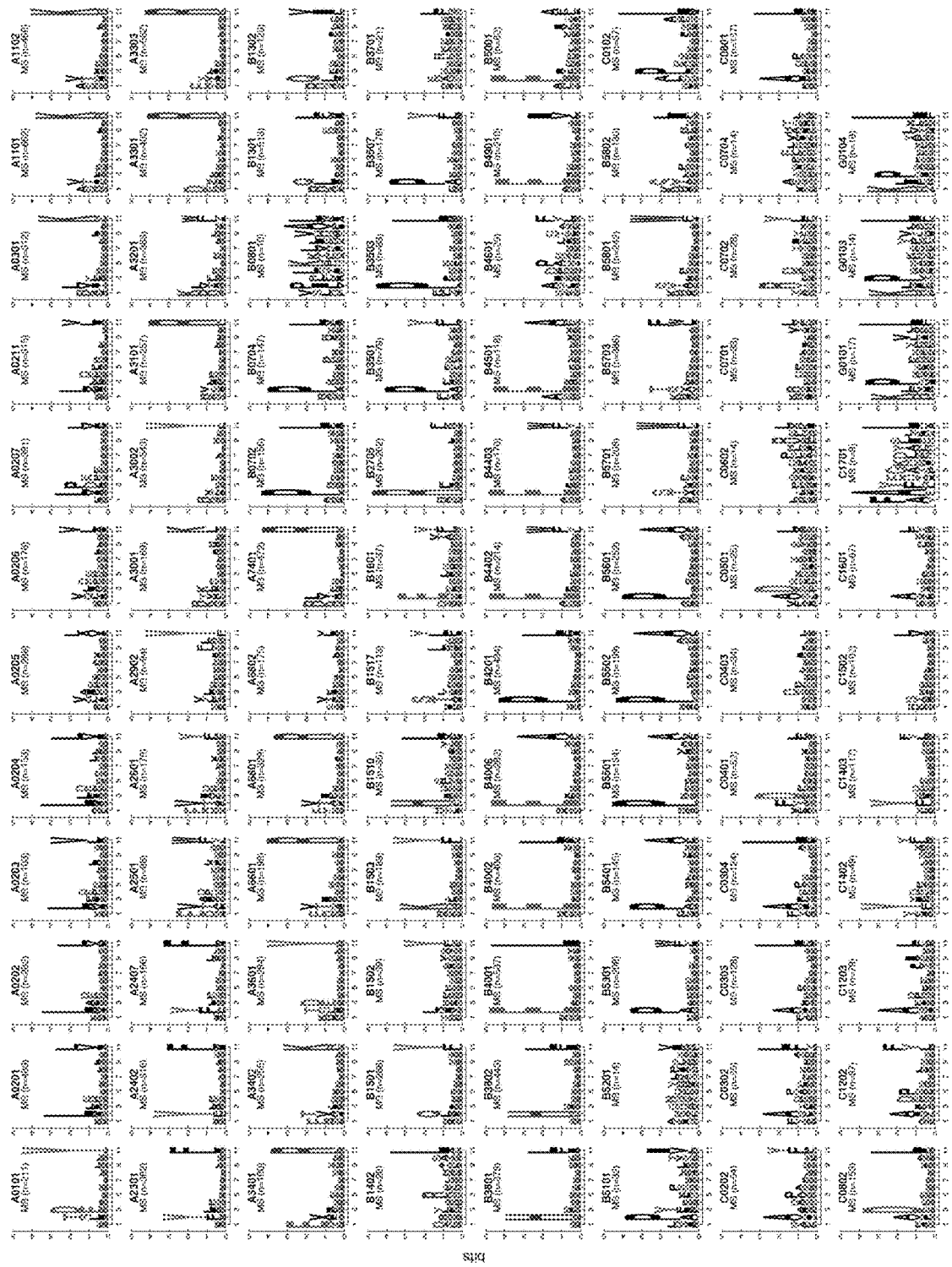
Figure 32J:
FIG. 32J) Logo plots per peptide length (8-11 mers) for 95 alleles as available in IEDB.
Figure 32J:
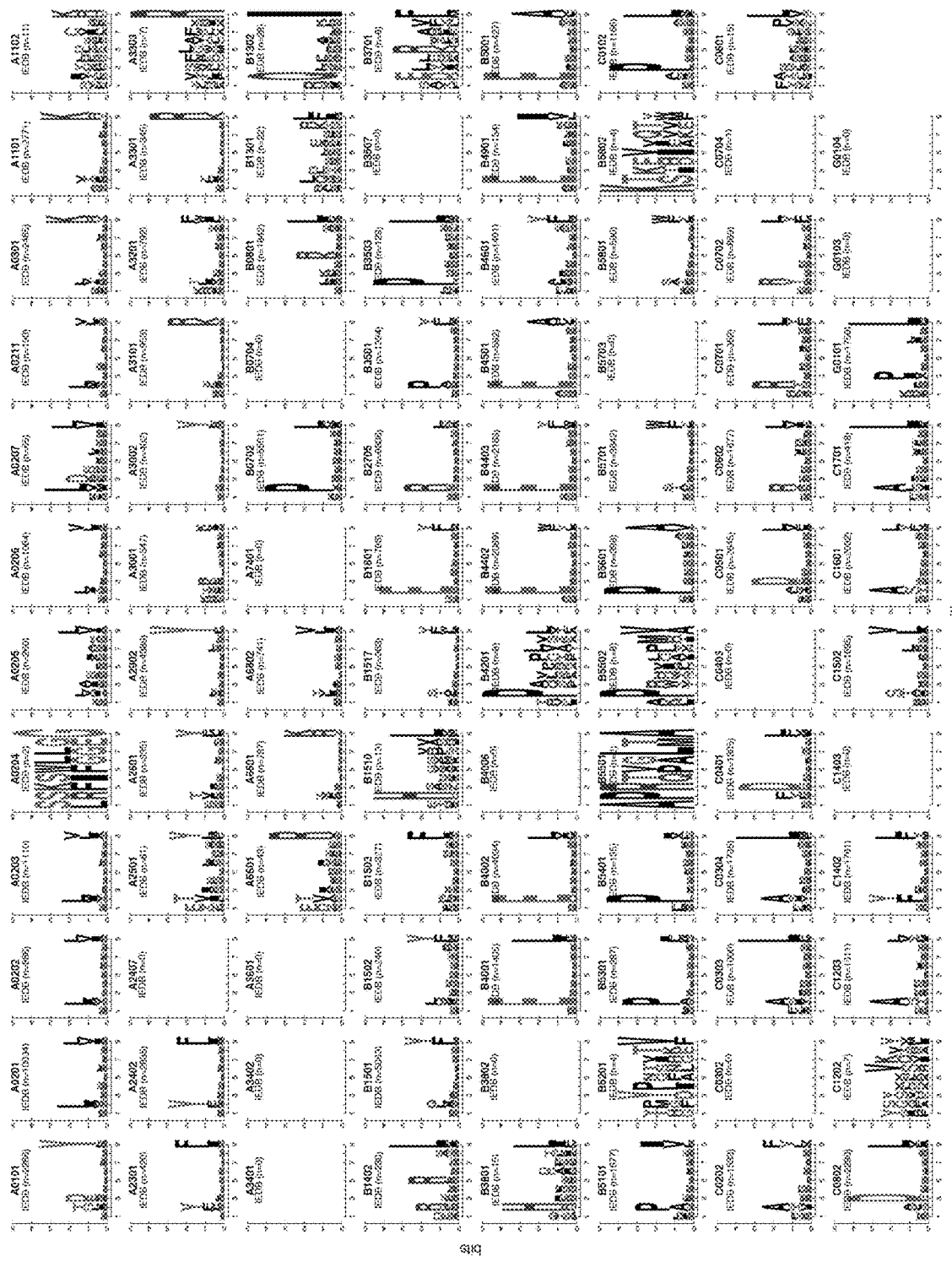
Figure 32J:
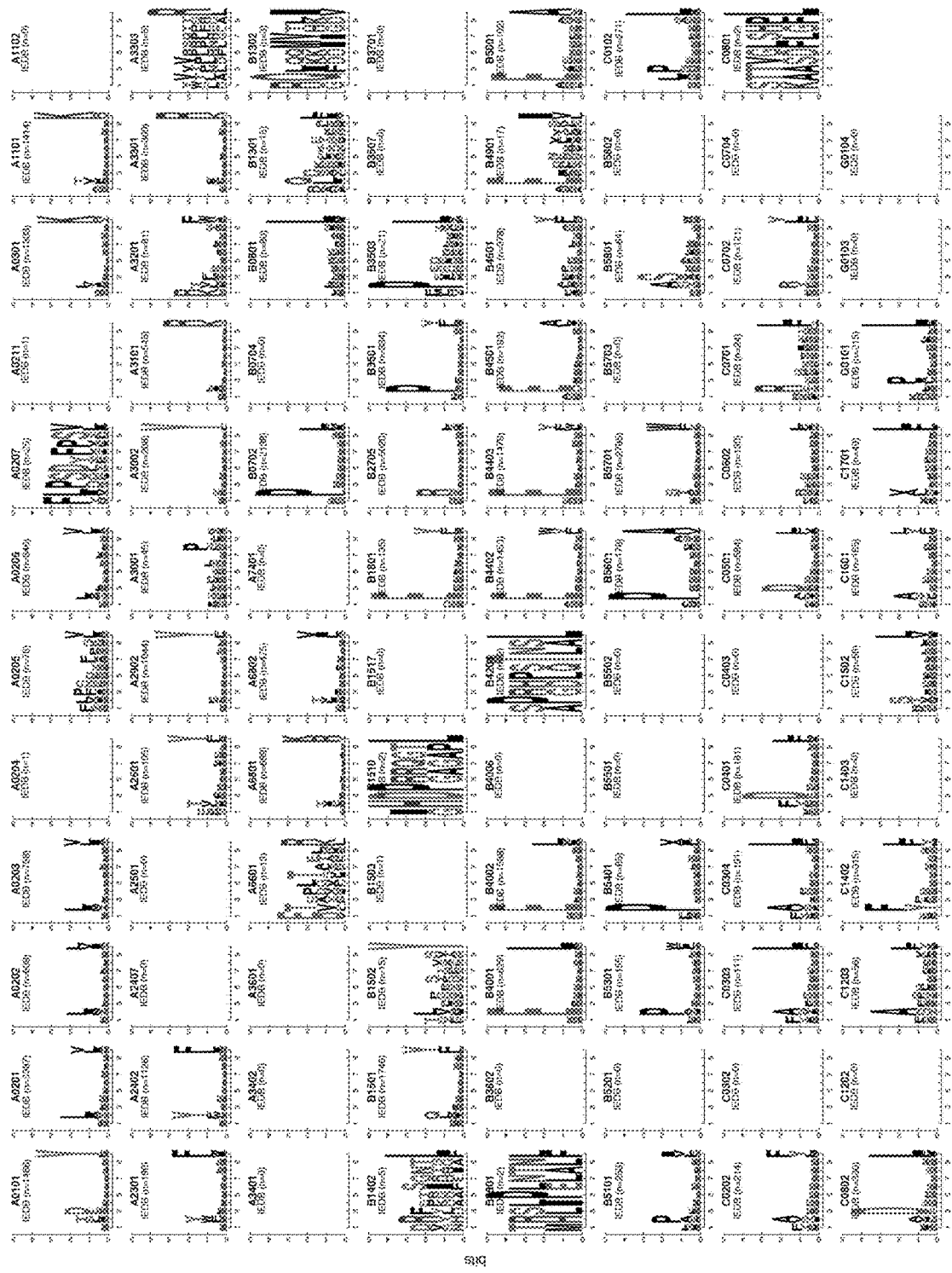
Figure 32J:
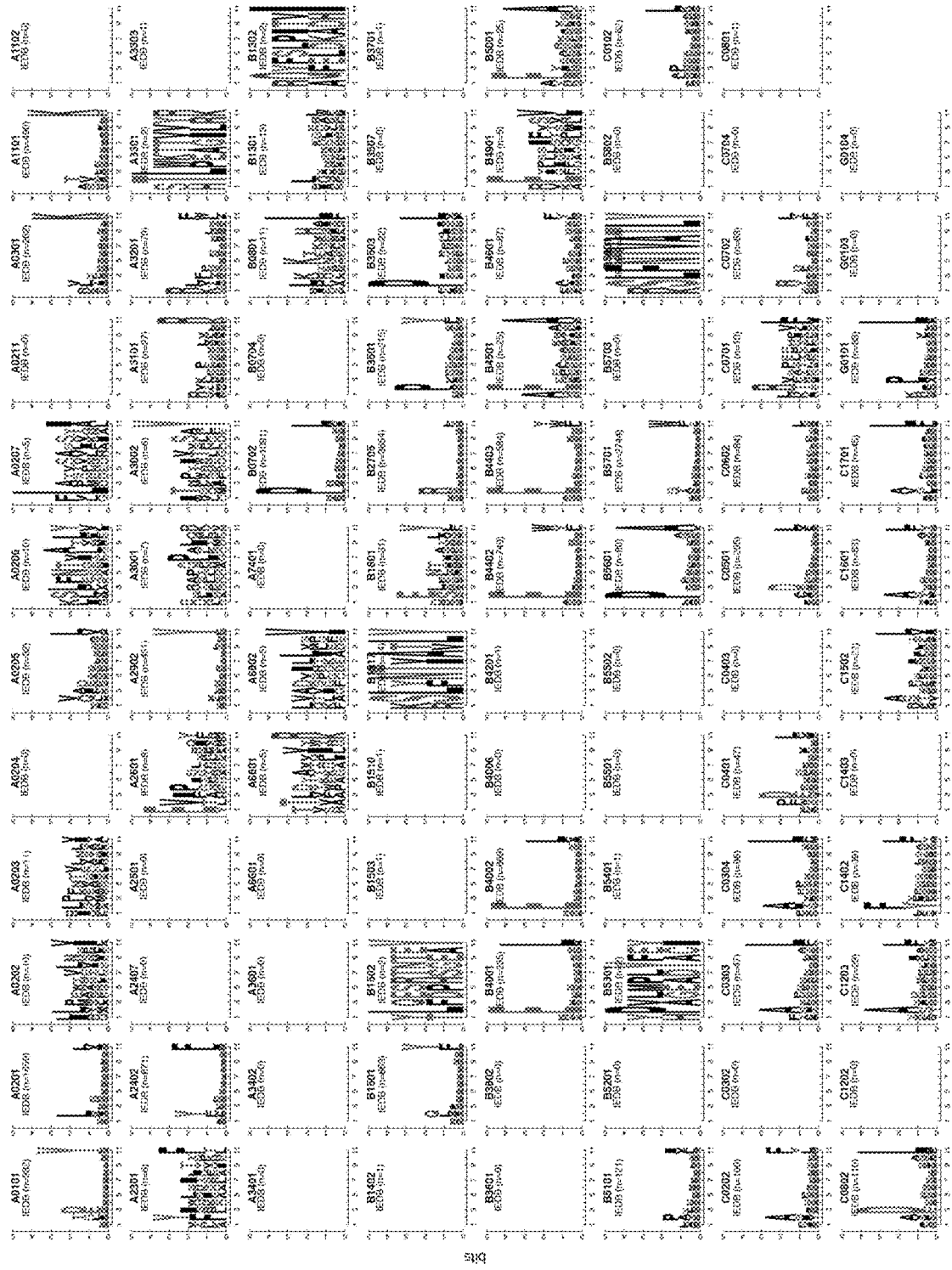

HLA-bound peptides for each engineered cell line were isolated by HLA immunopurification, analyzed by high-resolution LC-MS/MS and sequences identified by a 'no-enzyme' specificity database search at 1% FDR. Applicant identified a median of 1860 peptides per allele (range 692-4,033), or a total of 186,464 peptides across the 95 alleles after excluding non-specifically bound peptides (see, e.g., A*01:01 (SEQ ID Nos: 44-1120); A*02:01 (SEQ ID Nos: 1121-4202); A*02:02 (SEQ ID Nos: 4203-7373); A*02:03 (SEQ ID Nos: 7374-9953); A*02:04 (SEQ ID Nos: 9954-11940); A*02:05 (SEQ ID Nos: 11941-14981); A*02:06 (SEQ ID Nos: 14982-17191); A*02:07 (SEQ ID Nos: 117192-20710); A*02:11 (SEQ ID Nos: 20711-22696); A*03:01 (SEQ ID Nos: 22697-24233); A*11:01 (SEQ ID Nos: 24234-27505); A*11:02 (SEQ ID Nos: 27506-29812); A*23:01 (SEQ ID Nos: 29813-32133); A*24:02 (SEQ ID Nos: 32134-34347); A*24:07 (SEQ ID Nos: 34348-35681); A*25:01 (SEQ ID Nos: 35682-36682); A*26:01 (SEQ ID Nos: 36683-37957); A*29:02 (SEQ ID Nos: 37958-38921); A*30:01 (SEQ ID Nos: 38922-40029); A*30:02 (SEQ ID Nos: 40030-42114); A*31:01 (SEQ ID Nos: 42115-42919); A*32:01 (SEQ ID Nos: 42920-44874); A*33:01 (SEQ ID Nos: 44875-46761); A*33:03 (SEQ ID Nos: 46762-49053); A*34:01 (SEQ ID Nos: 49054-50948); A*34:02 (SEQ ID Nos: 50949-53677); A*36:01 (SEQ ID Nos: 53678-55165); A*66:01 (SEQ ID Nos: 55166-56901); A*68:01 (SEQ ID Nos: 56902-58374); A*68:02 (SEQ ID Nos: 58375-59804); A*74:01 (SEQ ID Nos: 59805-61821); B*07:02 (SEQ ID Nos: 61822-63473); B*07:04 (SEQ ID Nos: 63474-64885); B*08:01 (SEQ ID Nos: 64886-65609); B*13:01 (SEQ ID Nos: 65610-69419); B*13:02 (SEQ ID Nos: 69420-71587); B*14:02 (SEQ ID Nos: 71588-72970); B*15:01 (SEQ ID Nos: 72971-76378); B*15:02 (SEQ ID Nos: 76379-77762); B*15:03 (SEQ ID Nos: 77763-80458); B*15:10 (SEQ ID Nos: 80459-81940); B*15:17 (SEQ ID Nos: 81941-83632); B*18:01 (SEQ ID Nos: 83633-85593); B*27.05 (SEQ ID Nos: 85594-87076); B*35:01 (SEQ ID Nos: 87077-87772); B*35:03 (SEQ ID Nos: 87773-89157); B*35:07 (SEQ ID Nos: 89158-90977); B*37:01 (SEQ ID Nos: 90978-92452); B*38:01 (SEQ ID Nos: 92453-94858); B*38:02 (SEQ ID Nos: 94859-97742); B*40:01 (SEQ ID Nos: 97743-100731); B*40:02 (SEQ ID Nos: 100732-104409); B*40:06 (SEQ ID Nos: 104410-106653); B*42:01 (SEQ ID Nos: 106612-019885); B*44:02 (SEQ ID Nos: 109886-110903); B*44:03 (SEQ ID Nos: 110904-111749); B*45:01 (SEQ ID Nos: 111750-113153); B*46:01 (SEQ ID Nos: 113154-114113); B*49:01 (SEQ ID Nos: 114114-117833); B*50:01 (SEQ ID Nos: 117834-118468); B*51:01 (SEQ ID Nos: 118469-119991); B*52:01 (SEQ ID Nos: 119992-121525); B*53:01 (SEQ ID Nos: 121526-123560); 54:01 (SEQ ID Nos: 123561-124684); B*55:01 (SEQ ID Nos: 124685-126136); B*55:02 (SEQ ID Nos: 126137-127557); B*56:01 (SEQ ID Nos: 127558-129239); B*57:01 (SEQ ID Nos: 129240-130274); B*57:03 (SEQ ID Nos: 130275-132636); B*58:01 (SEQ ID Nos: 132637-134577); B*58:02 (SEQ ID Nos: 134578-135530); C*01:02 (SEQ ID Nos: 135531-136878); C*02:02 (SEQ ID Nos: 136879-137802); C*03:02 (SEQ ID Nos: 137803-138984); C*03:03 (SEQ ID Nos: 138985-141074); C*03:04 (SEQ ID Nos: 141075-143394); C*04:01 (SEQ ID Nos: 143395-145236); C*04:03 (SEQ ID Nos: 145237-146269); C*05:01 (SEQ ID Nos: 146270-147708); C*06:02 (SEQ ID Nos: 147709-149028); C*07:01 (SEQ ID Nos: 149029-149822); C*07:02 (SEQ ID Nos: 149823-150900); C*07:04 (SEQ ID Nos: 150901-151615); C*08:01 (SEQ ID Nos: 151616-153388); C*08:02 (SEQ ID Nos: 153389-156499); C*12:02 (SEQ ID Nos: 156500-157889); C*12:03 (SEQ ID Nos: 157890-160043); C*14:02 (SEQ ID Nos: 160044-161408); C*14:03 (SEQ ID Nos: 161409-164186); C*15:02 (SEQ ID Nos: 164187-167475); C*16:01 (SEQ ID Nos: 167476-170317); C*17:01 (SEQ ID Nos: 170318-171281); G*01:01 (SEQ ID Nos: 171282-172073); G*01:03 (SEQ ID Nos: 172074-172742) and G*01:04 (SEQ ID Nos: 172743-173477); and FIG. 32B), and covering more peptides containing cysteine by adding carbamidomethylation of cysteine into the sample processing workflow. Most of the observed modifications, representing 12% of total identified peptides, could be explained by sample processing artifacts such as oxidation of methionine (FIGS. 32C-32D). The HLA-bound peptides Applicant identified mapped to 10,649 human genes (with >2 HLA-associated peptides per gene), which represent 91% of human gene products detected by LC-MS/MS in an extensively fractionated proteome of the B721.221 cell line (with >2 unique peptides per gene), and 89% of transcribed genes (with >2 transcripts per million (TPM) from RNA-seq) (FIG. 26C; FIG. 32E). While the majority of proteins were represented by more than one HLA peptide, the top 50 most frequently detected proteins in the proteome analysis were large, highly abundant, and consistently observed as eluted peptides across HLA-A, -B, and —C alleles (FIG. 32F). Notably, 1,517 genes represented by HLA-bound peptides were not detected in either of the two expression data sets, suggesting they had very low RNA and protein levels. The respective peptides are reliable identifications because they had peptide identification metrics comparable to the rest of the dataset (FIG. 32G). Subsetting the dataset of peptides to sets of 6 alleles matched to patient-derived melanoma cell lines (Ott et al. 2017) usually recovered 4,000-5,000 genes (FIG. 32H). Applicant concluded that all expressed proteins could undergo processing and presentation by HLA class I molecules, a far higher proportion than previously appreciated (Pearson et al. 2016).

Figure 1:
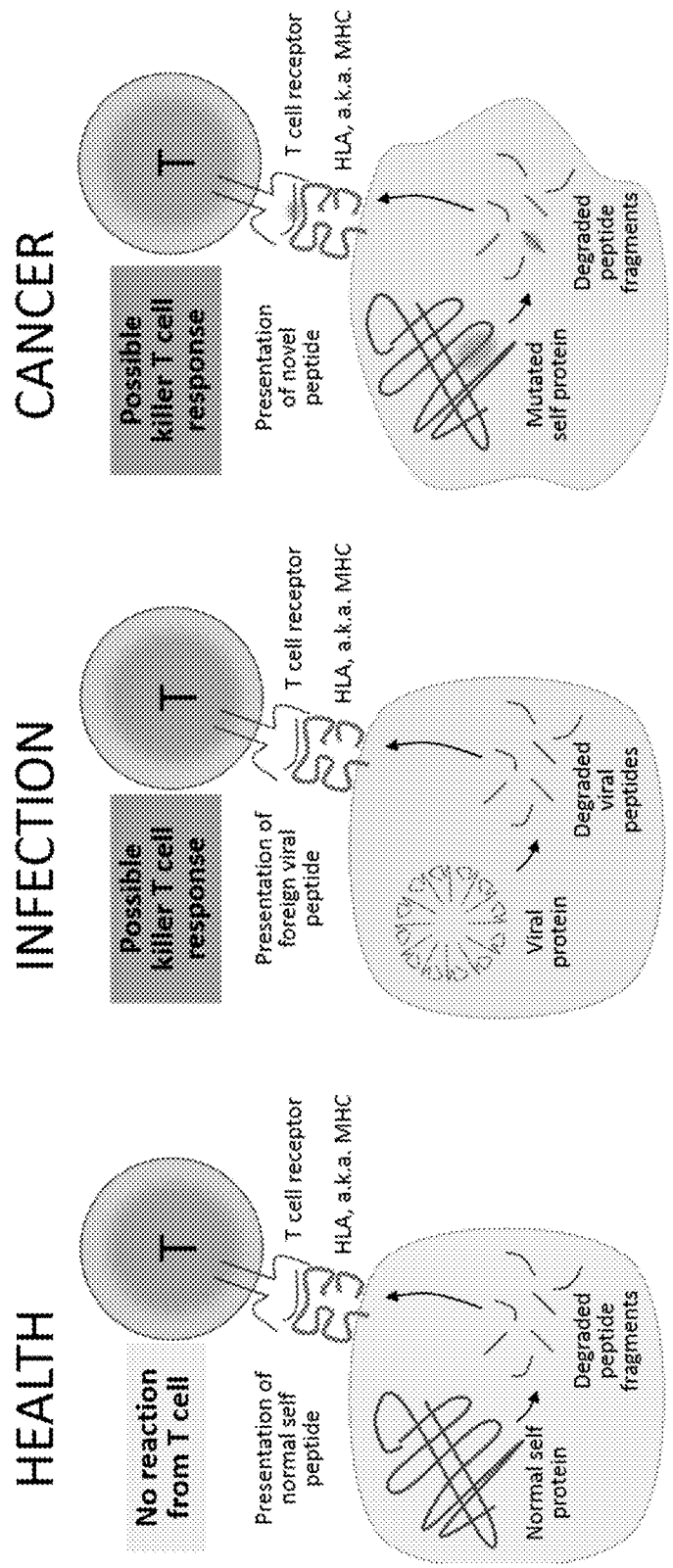
FIG. 1—The human immune system recognizes non-self antigens (e.g. viral or mutated peptides) presented on MHC class I molecules and elicits an immune response upon T cell receptor recognition.
Figure 2:
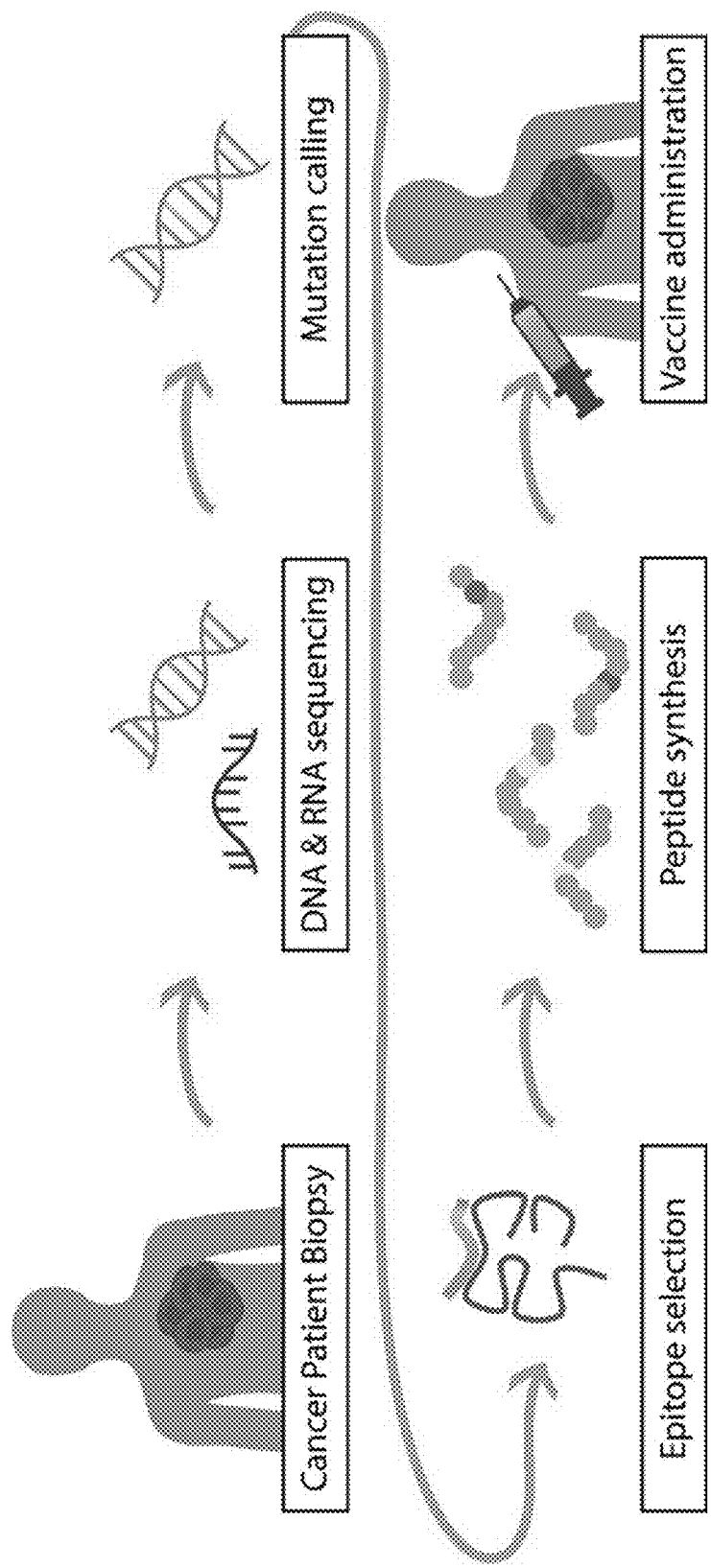
FIG. 2—Cancer vaccine therapeutic workflow. Tumor specific mutations that give rise to protein coding changes are identified and evaluated for their likelihood to produce HLA-binding neoantigens. Selected candidates are synthesized and administered as a vaccine. Tumor-specific antigens can be used to design a personalized cancer vaccine that potentiates a tumor-specific immune response.
Figure 3:
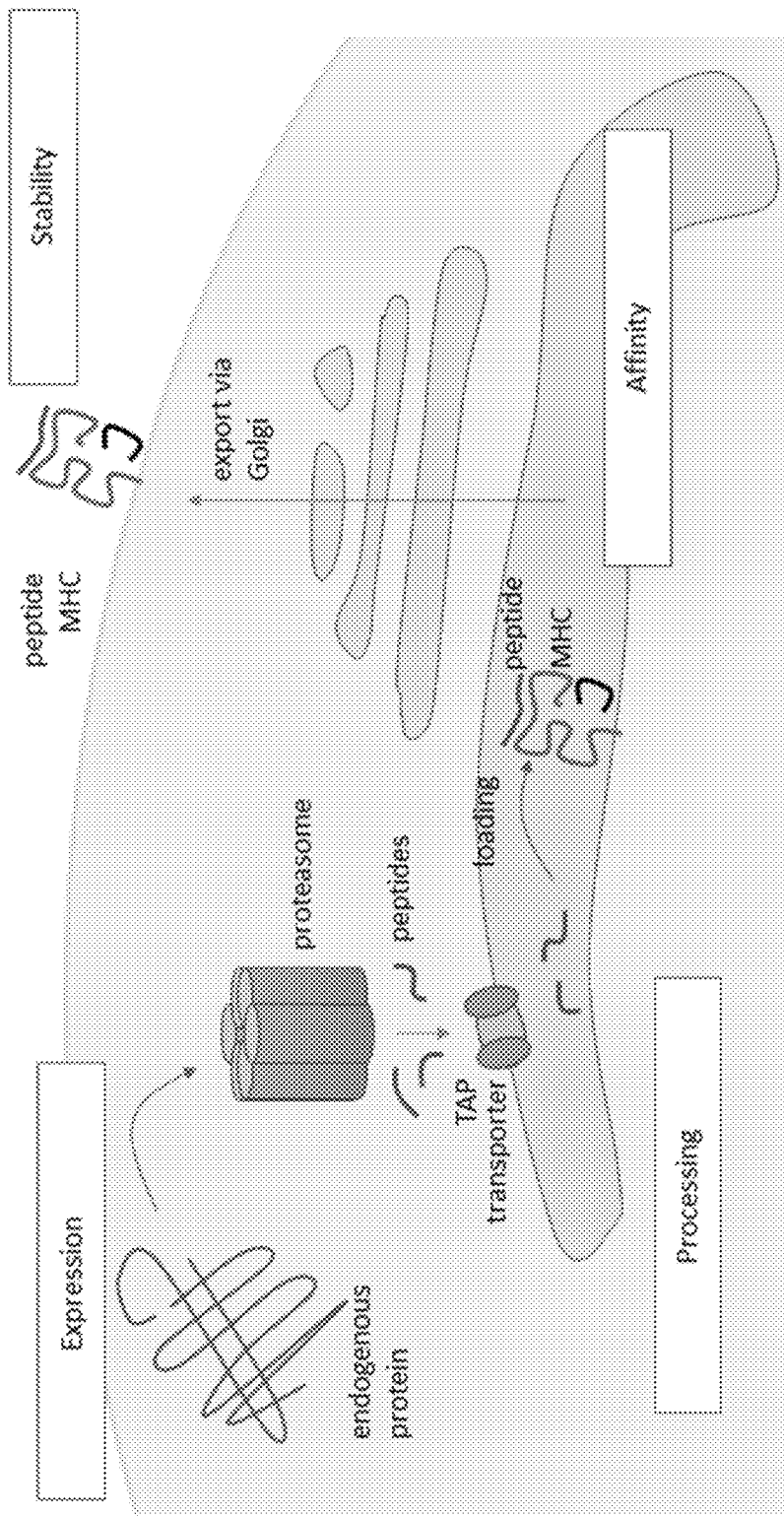
FIG. 3—Intracellular proteins are processed into peptides by the proteasome, transported into the ER and loaded onto MHC molecules. Peptide-MHC complexes are shuttled to the cell surface for T cell recognition. Thus, many endogenous processing steps contribute to peptide presentation.
Figure 4:
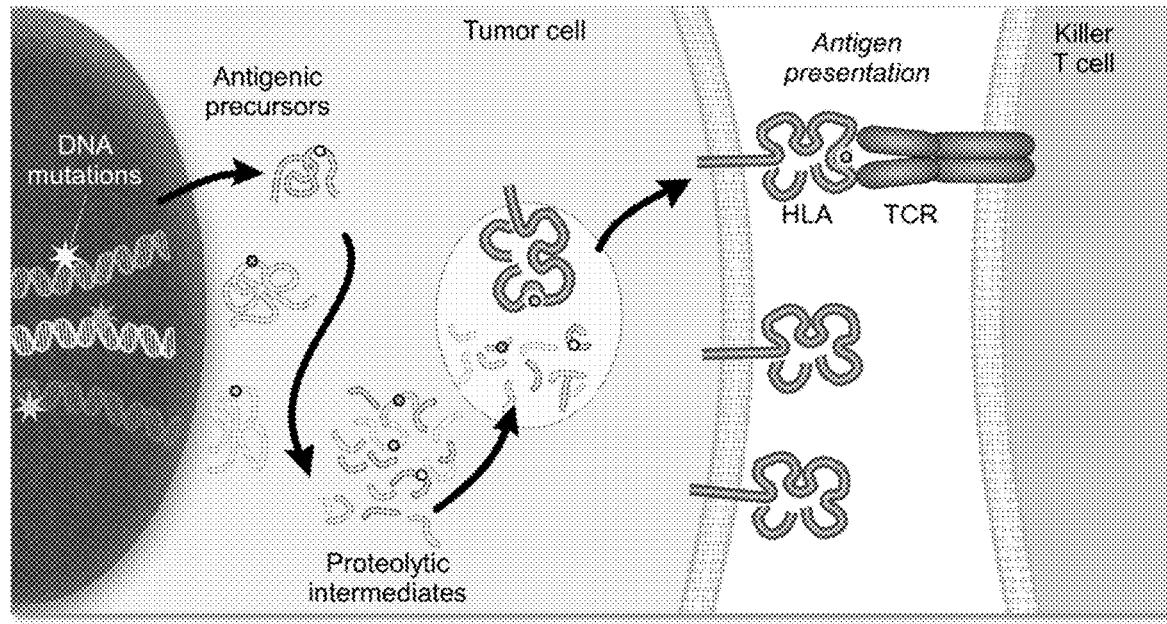
FIG. 4—Disease-specific mutations have the potential to generate neoantigens. Current neoantigen prediction models NetMHCpan solely based on binding affinity. MS provides a platform to better understand rules of antigen processing and presentation. See, e.g., Purroy N et al., Cold Spring Harb Perspect Med 2017.
Figure 5:
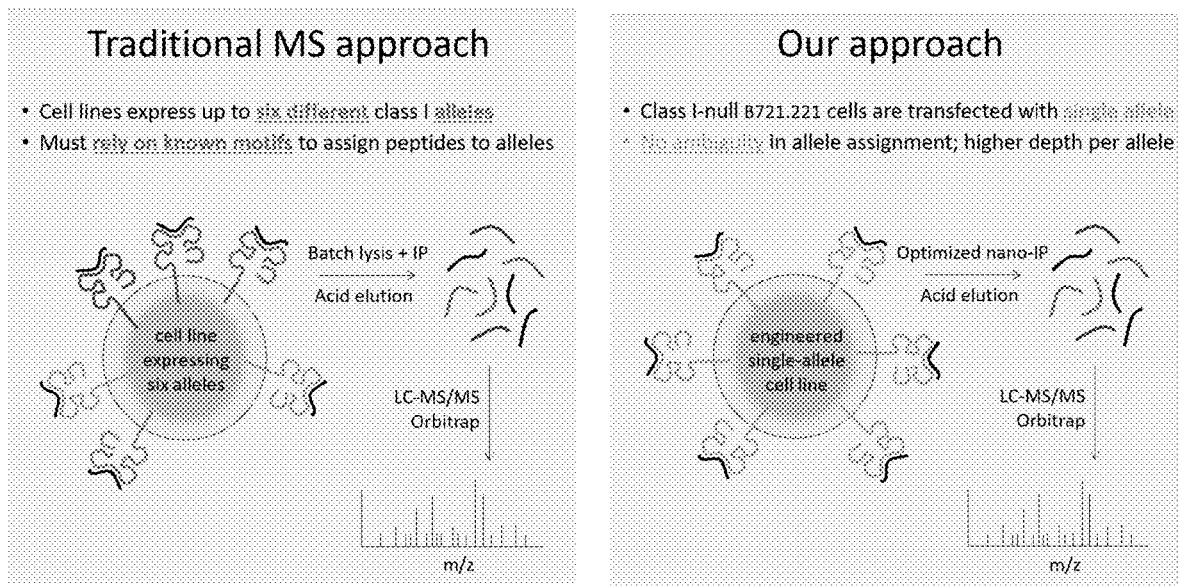
FIG. 5—Cell lines engineered to express a single HLA allele of interest enable high throughput peptide identification via MS and unambiguous assignment of peptides to alleles. Cell lines engineered to express a single HLA allele allow for high-throughput and unambiguous identification of bound peptides.
Figure 6A:
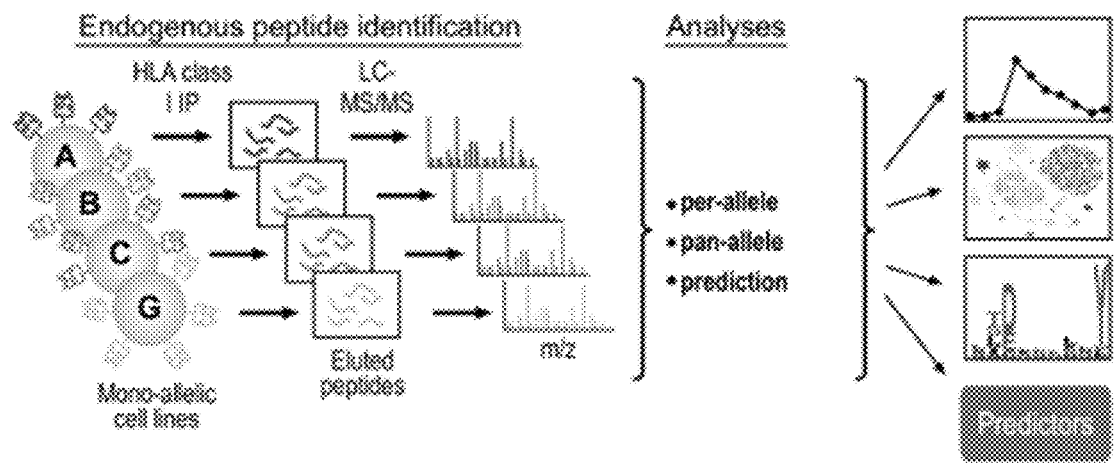
FIGS. 6A-6B—Single-allele approach to improve prediction algorithms.
Figure 6B:
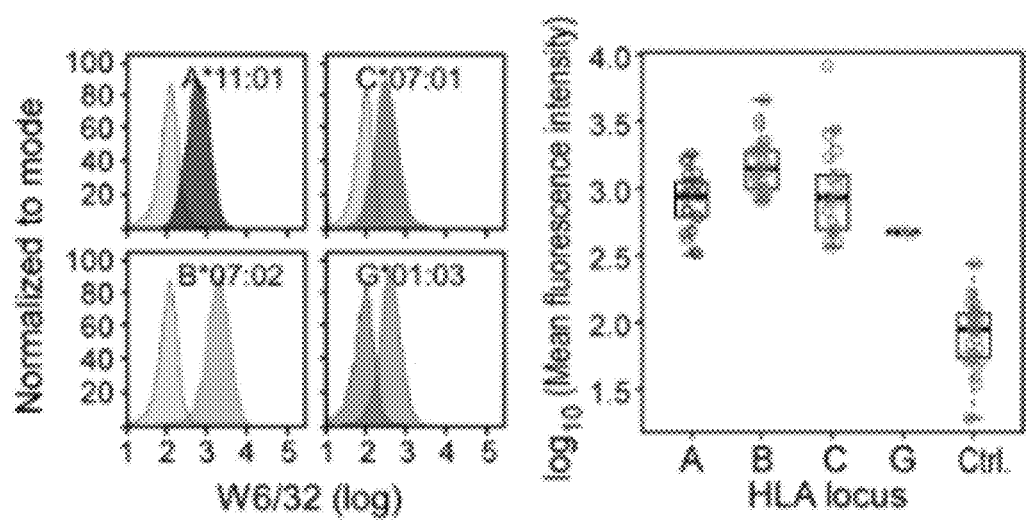
Figure 7:
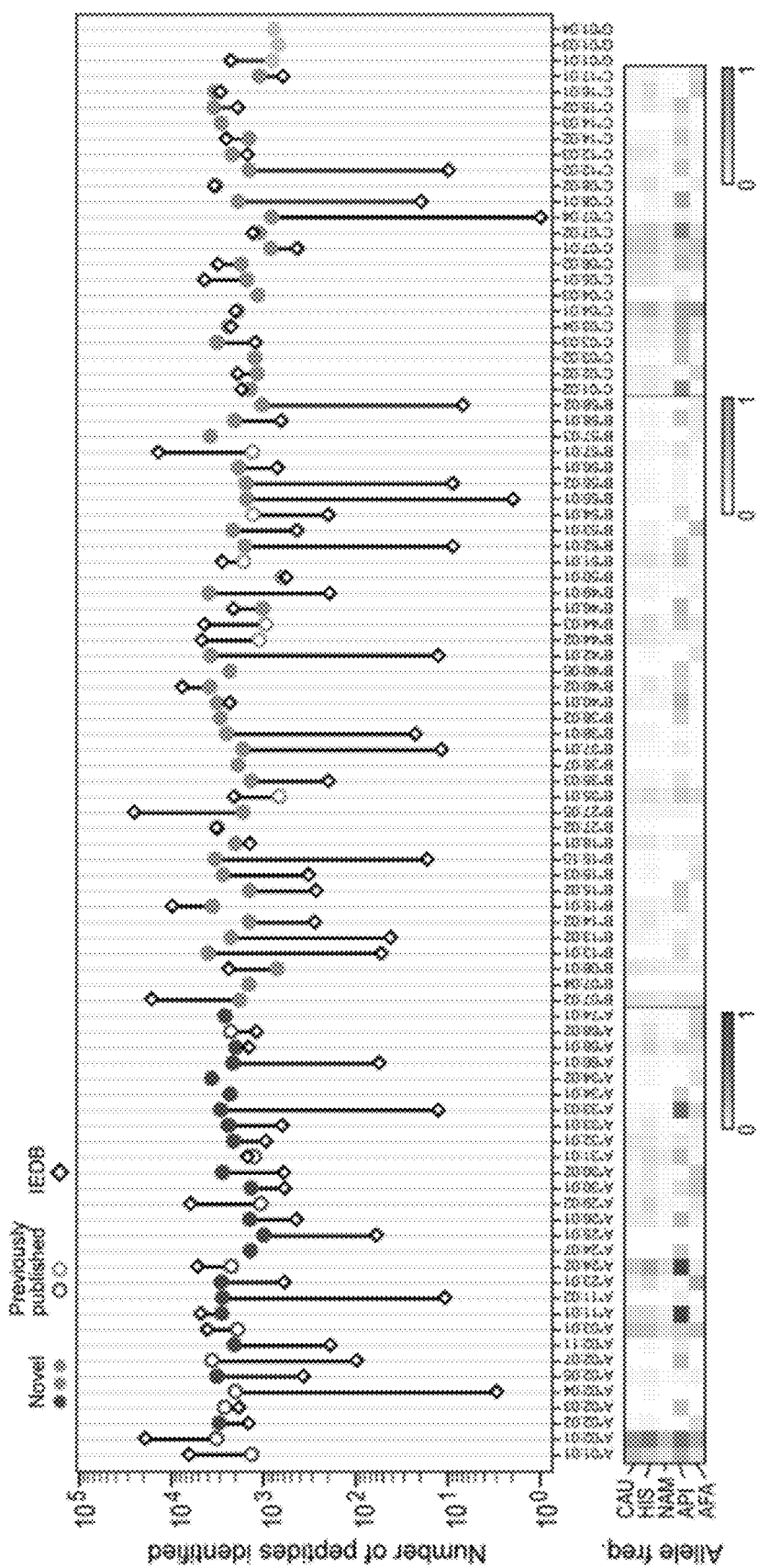
FIG. 7—Over 185,000 peptides were identified across 95 alleles that cover the most frequent alleles in the population. Numbers of HLA-bound peptides identified per allele by MS-based profiling (circles; filled-newly generated data; open-previously reported (Abelin J G, Keskin D B, Sarkizova S, Hartigan C R, Zhang W, Sidney J, Stevens J, Lane W, Zhang G L, Eisenhaure™, Clauser K R, Hacohen N, Rooney M S, Carr S A, Wu C J., 2017. Mass spectrometry profiling of HLA-associated peptidomes in mono-allelic cells enables more accurate epitope prediction. Immunity 46:315-26); or within IEDB (diamonds) (top). Relative population frequency across racial groups per allele (bottom). Massive mono-allelic peptide dataset enables in-depth integrative analysis and improved understanding of epitope presentation rules.
Figure 9:
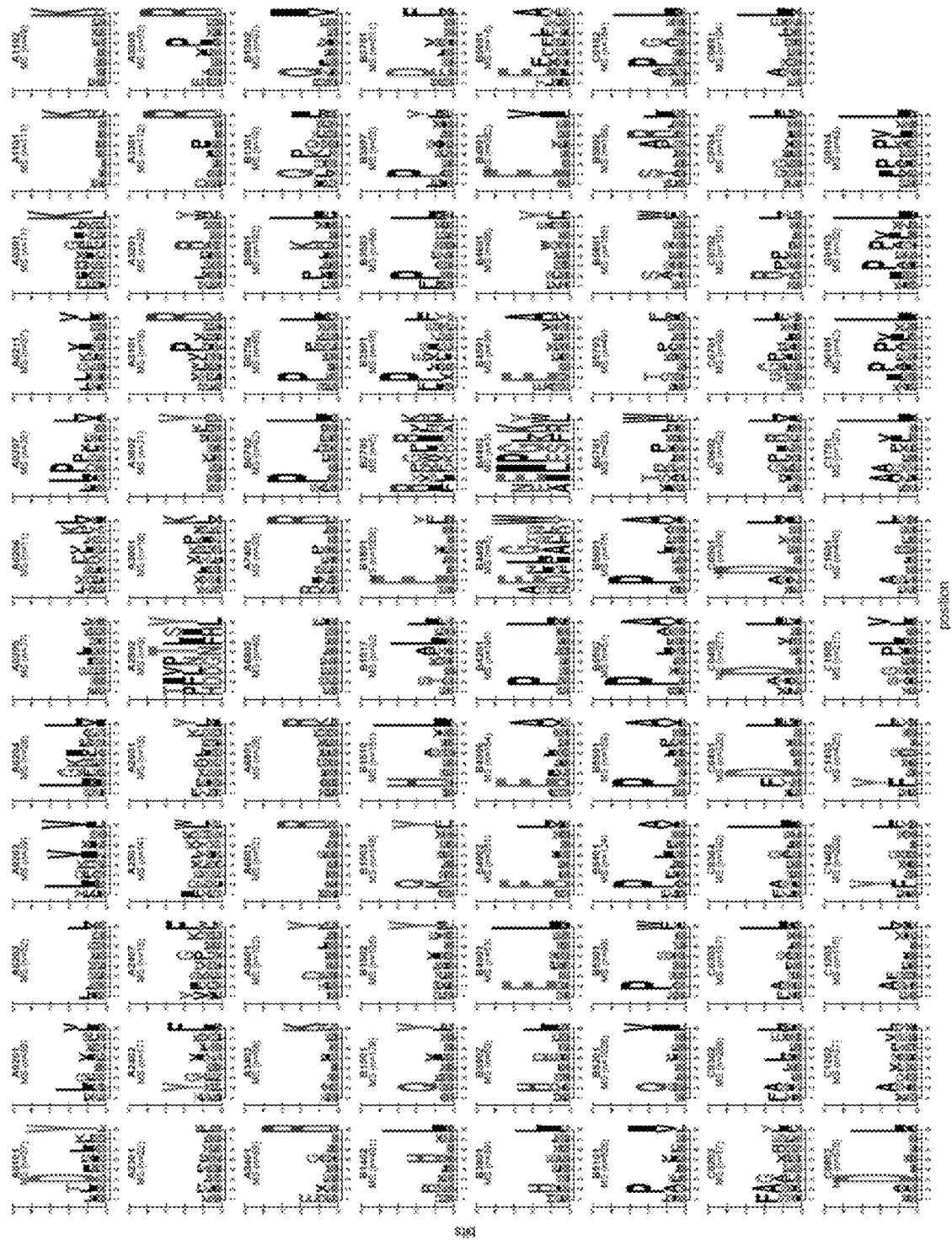
FIG. 9—Profiled 8 mer alleles and motifs.
Figure 10:
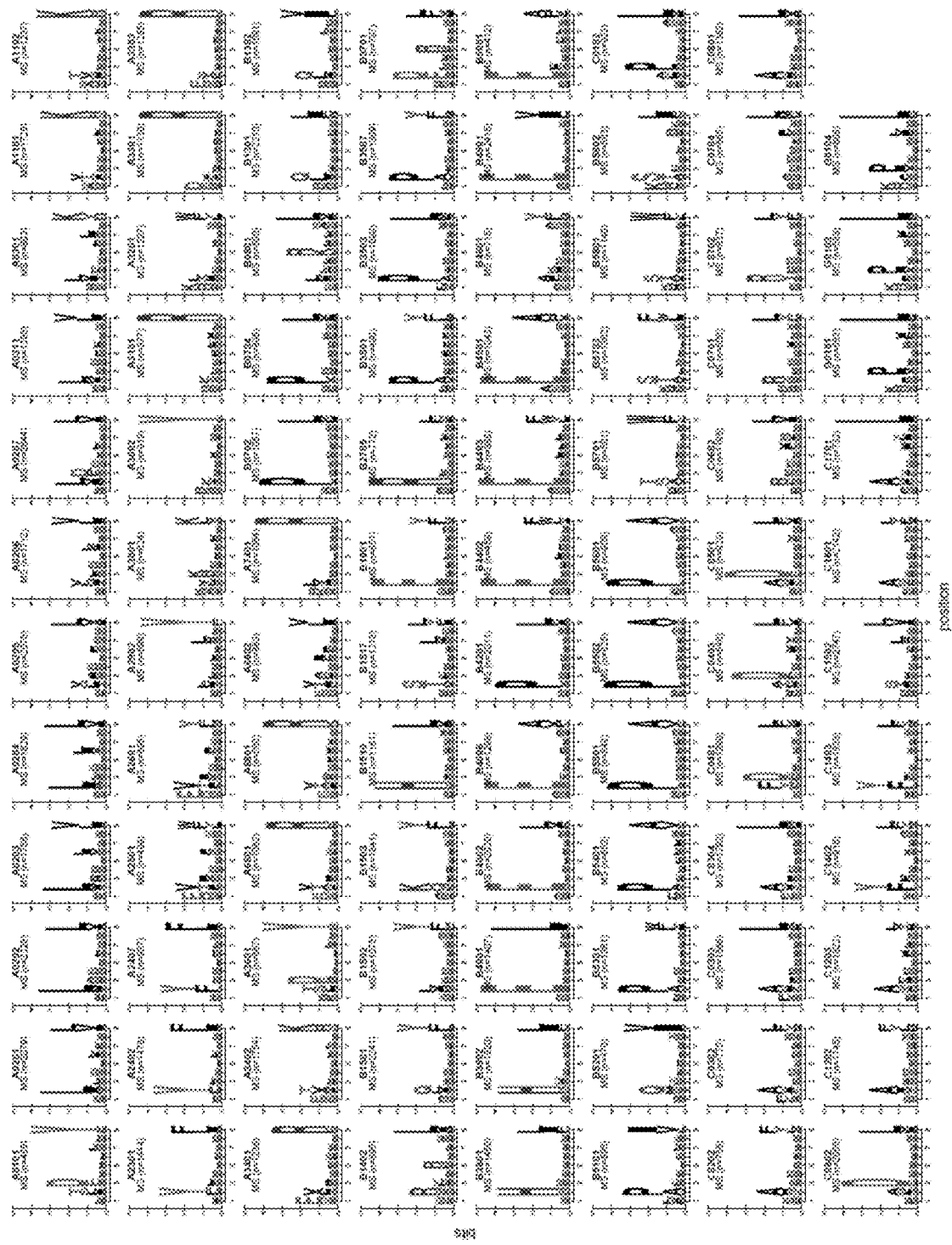
FIG. 10—Profiled 9 mer alleles and motifs.
Figure 11:
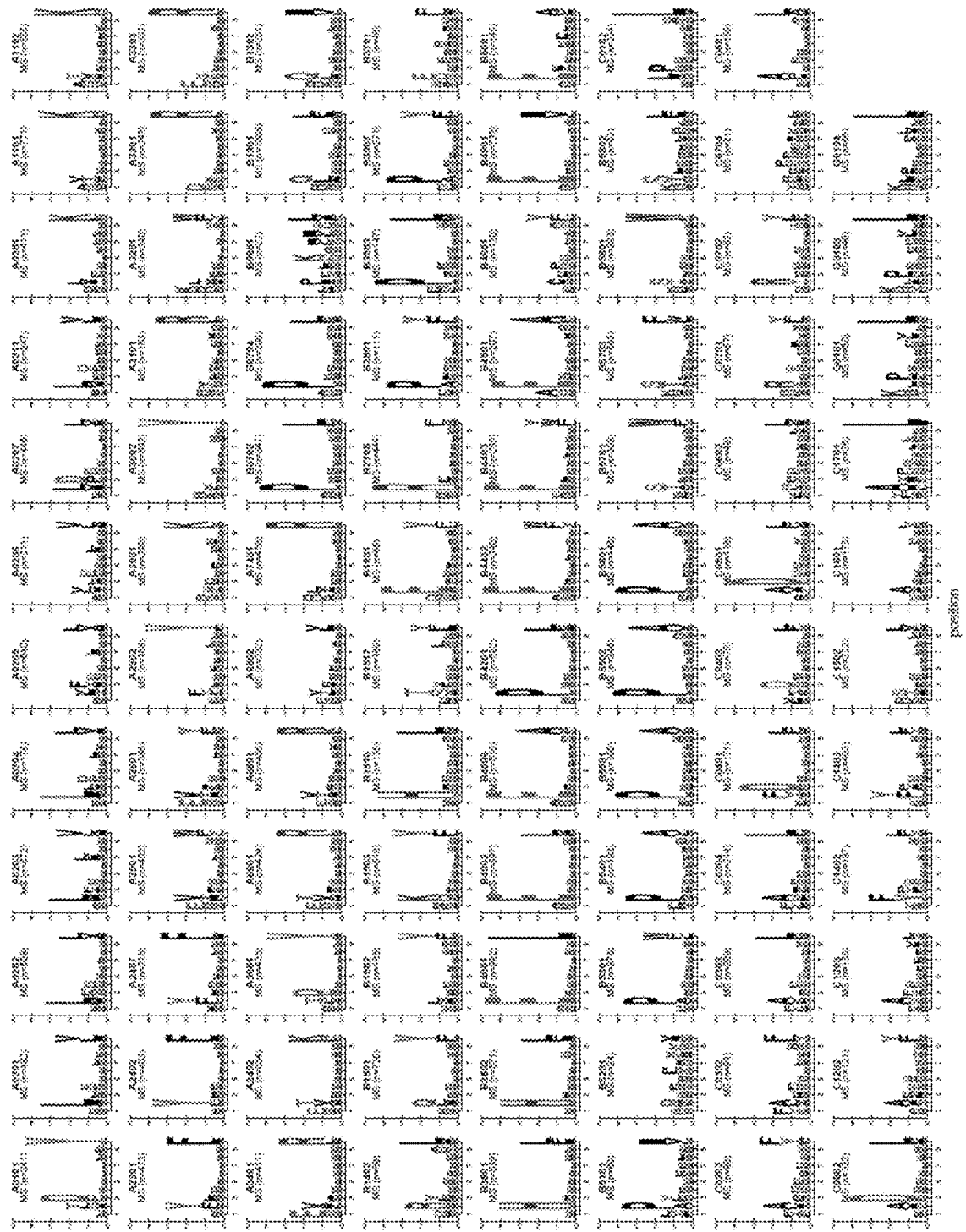
FIG. 11—Profiled 10 mer alleles and motifs.
Figure 12:
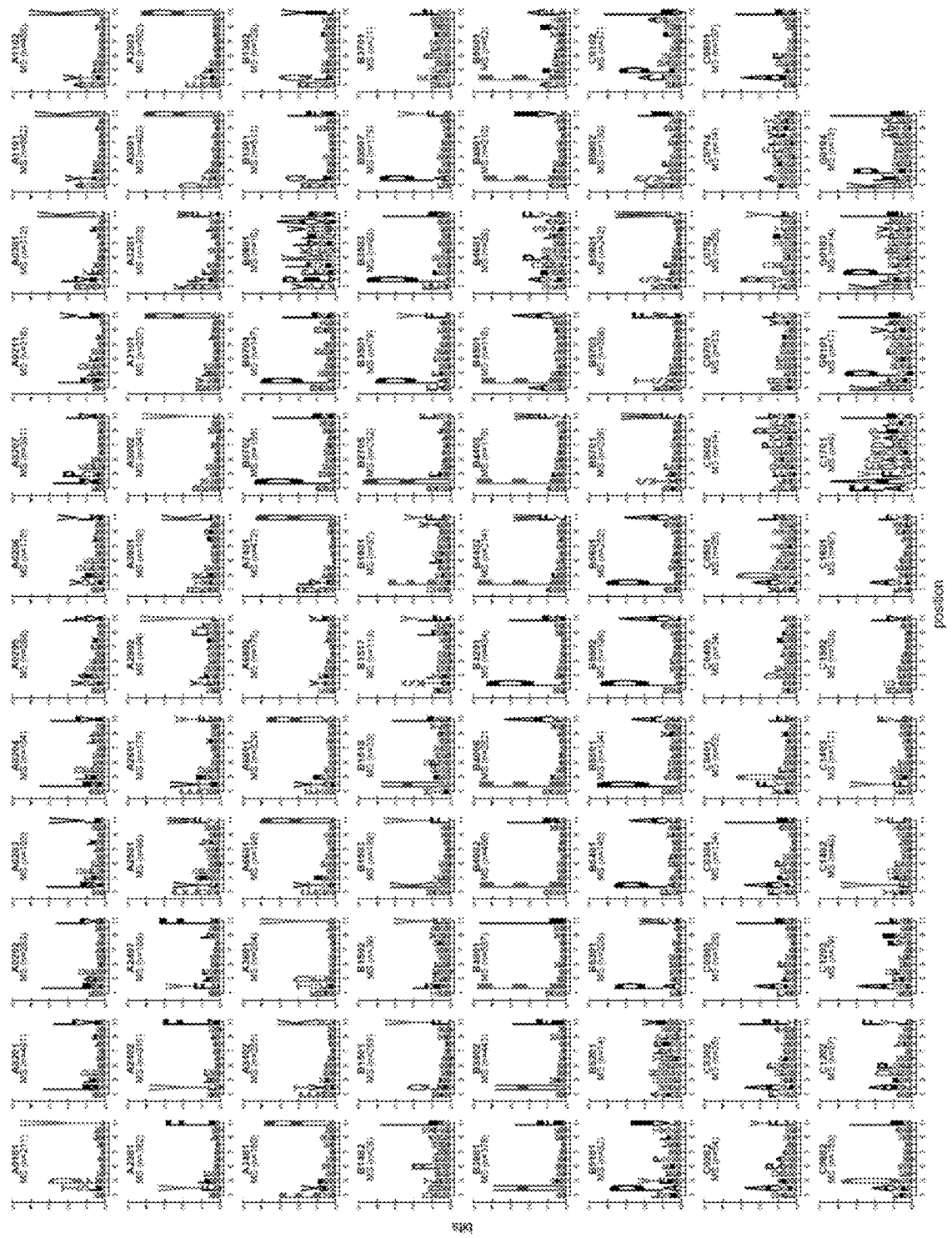
FIG. 12—Profiled 11 mer alleles and motifs.
Figure 13:
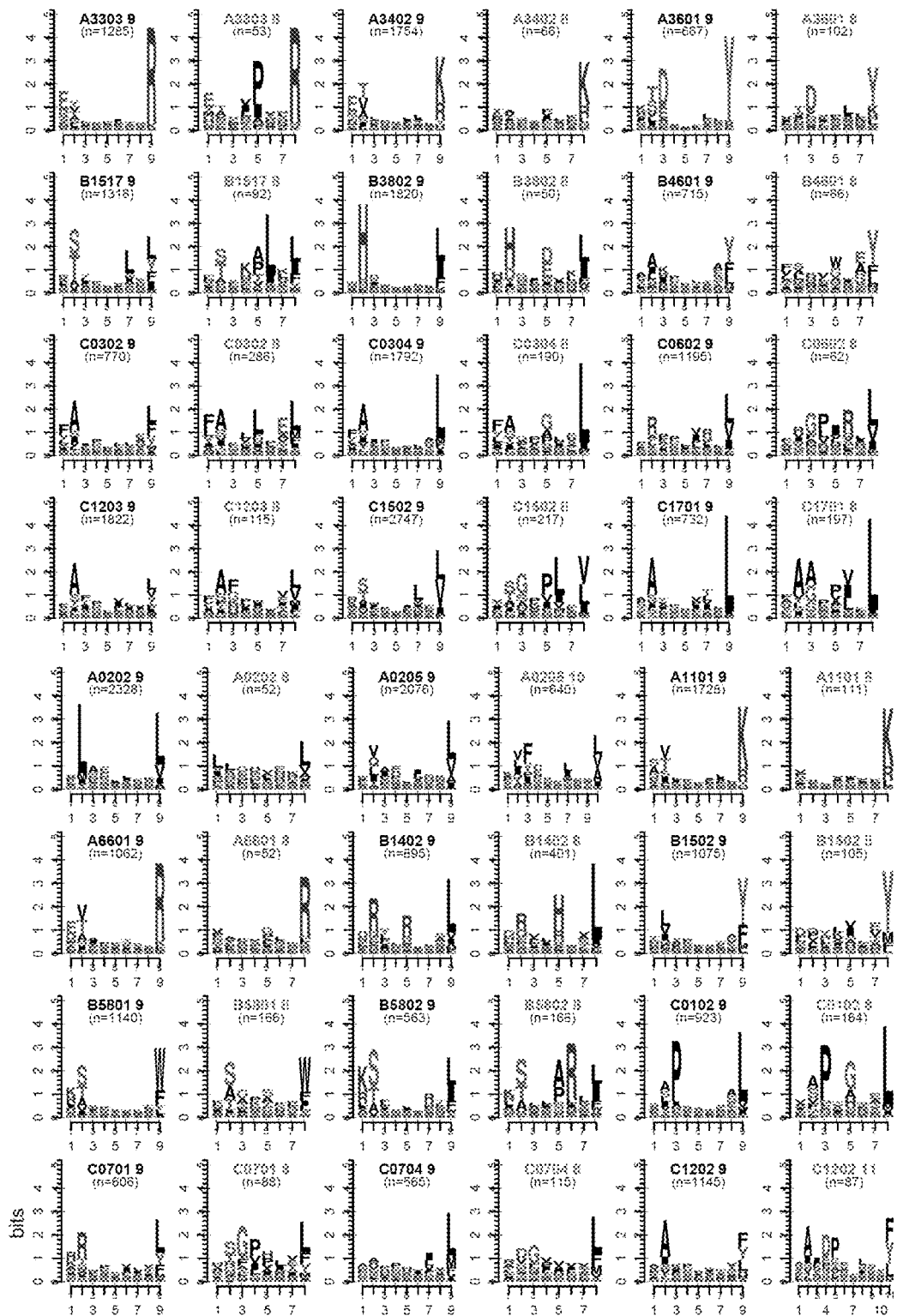
FIG. 13—Alleles with length-specific motifs identified amongst the profiled alleles and motifs. Sequence logos show pairwise comparisons of the 9-mer peptide motif and the non-9-mer motif detected to be different. A alleles tend to have peptides of length 9, 10, and 11. B alleles bind lengths 8 to 12. C alleles present mainly length 8, and 9.
Figure 14:
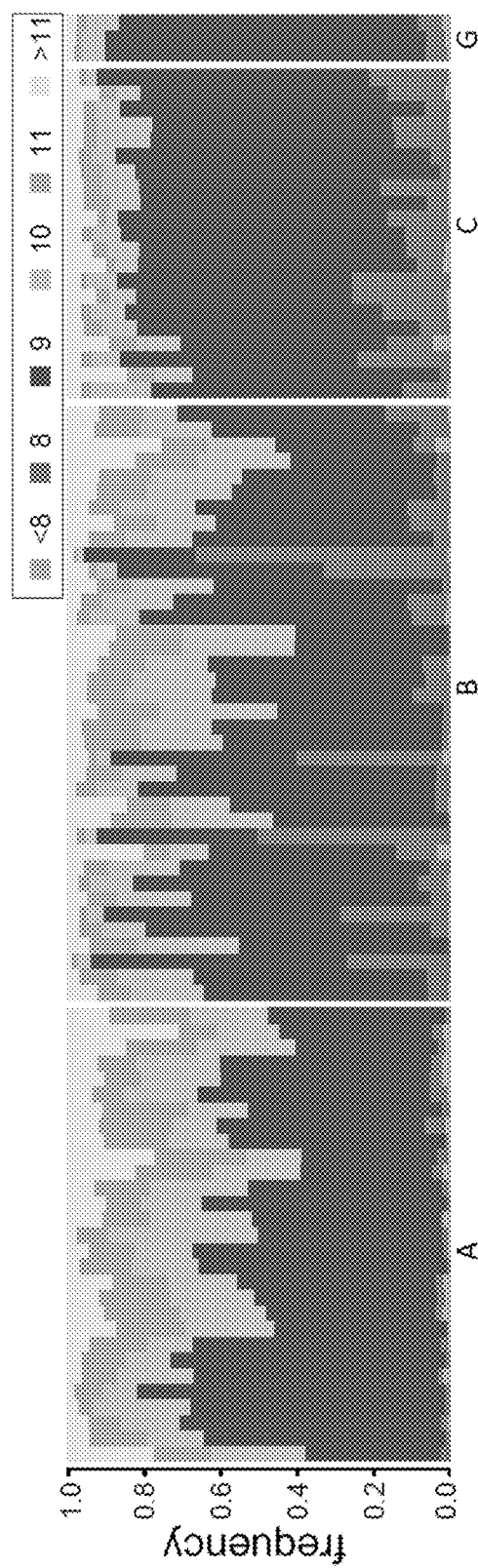
FIG. 14—Peptide length distribution per allele. The frequency of MS-identified peptides of each of the most common binding lengths for HLA class I (8-11) per HLA allele are grouped per HLA gene. Some alleles have the strongest preference for peptides of lengths other than 9. HLA-A alleles present more peptides of length 10 and 11 than B and C alleles. HLA-B and C alleles accommodate shorter peptides better than HLA-A alleles. Differences in the ability to accommodate ligands of various lengths detected amongst HLA-A, B, and C genes.
Figure 15:
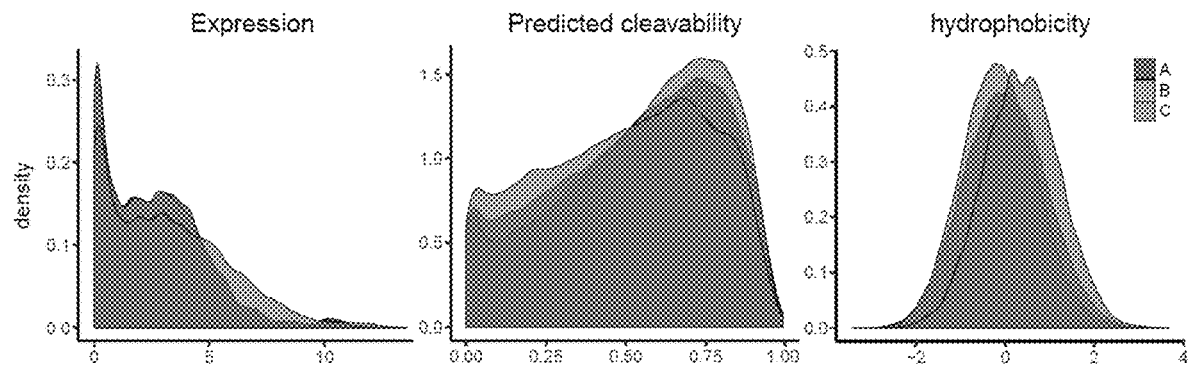
FIG. 15—The distribution of expression (based on RNA-seq), predicted cleavability and hydrophobicity for identified across all alleles. HLA-C alleles bind peptides from proteins with higher expression levels than A, B or G alleles and tend to be more hydrophobic. Intracellular signals, such as expression and proteasomal cleavage, significantly increase the power for predicting endogenously presented epitopes.
Figure 16:
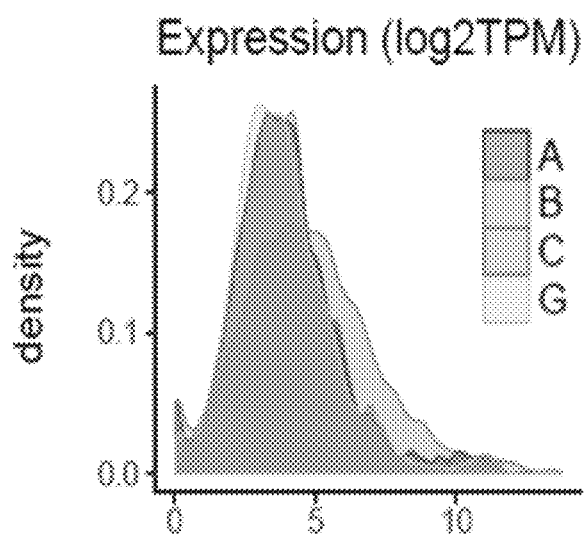
FIG. 16—RNA-Seq. HLA-C alleles favor peptides derived from proteins with higher RNA expression. C alleles have a more shallow binding cleft.
Figure 17:
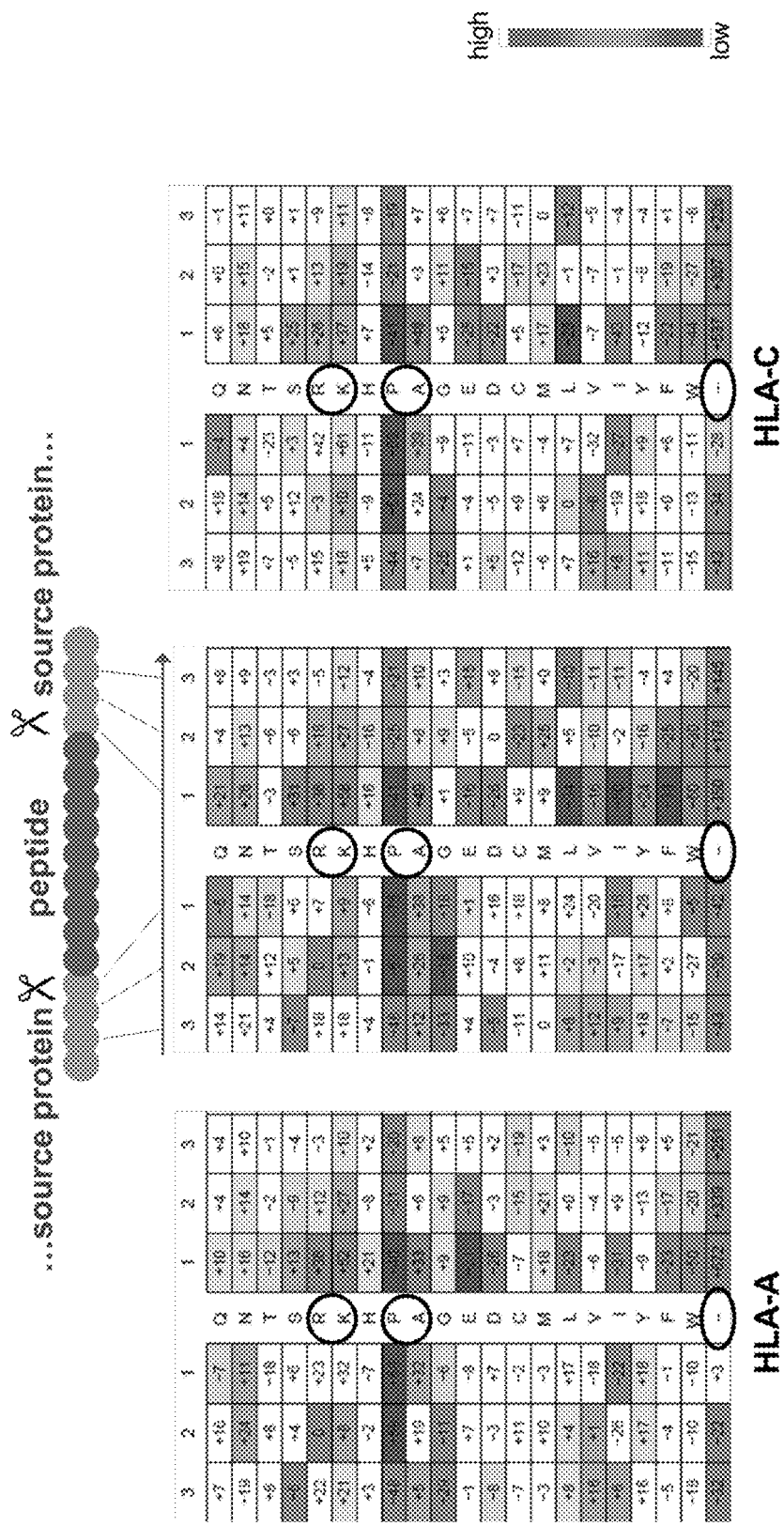
FIG. 17—Cleavage profiles are very similar across HLA-A,B,C alleles. No difference between HLA alleles. Proteasome cleavage happens before peptide loading in the ER. Amino acid distribution up and downstream of HLA-presented peptide. R/K/A are preferred cleavage sites.
Figure 18:
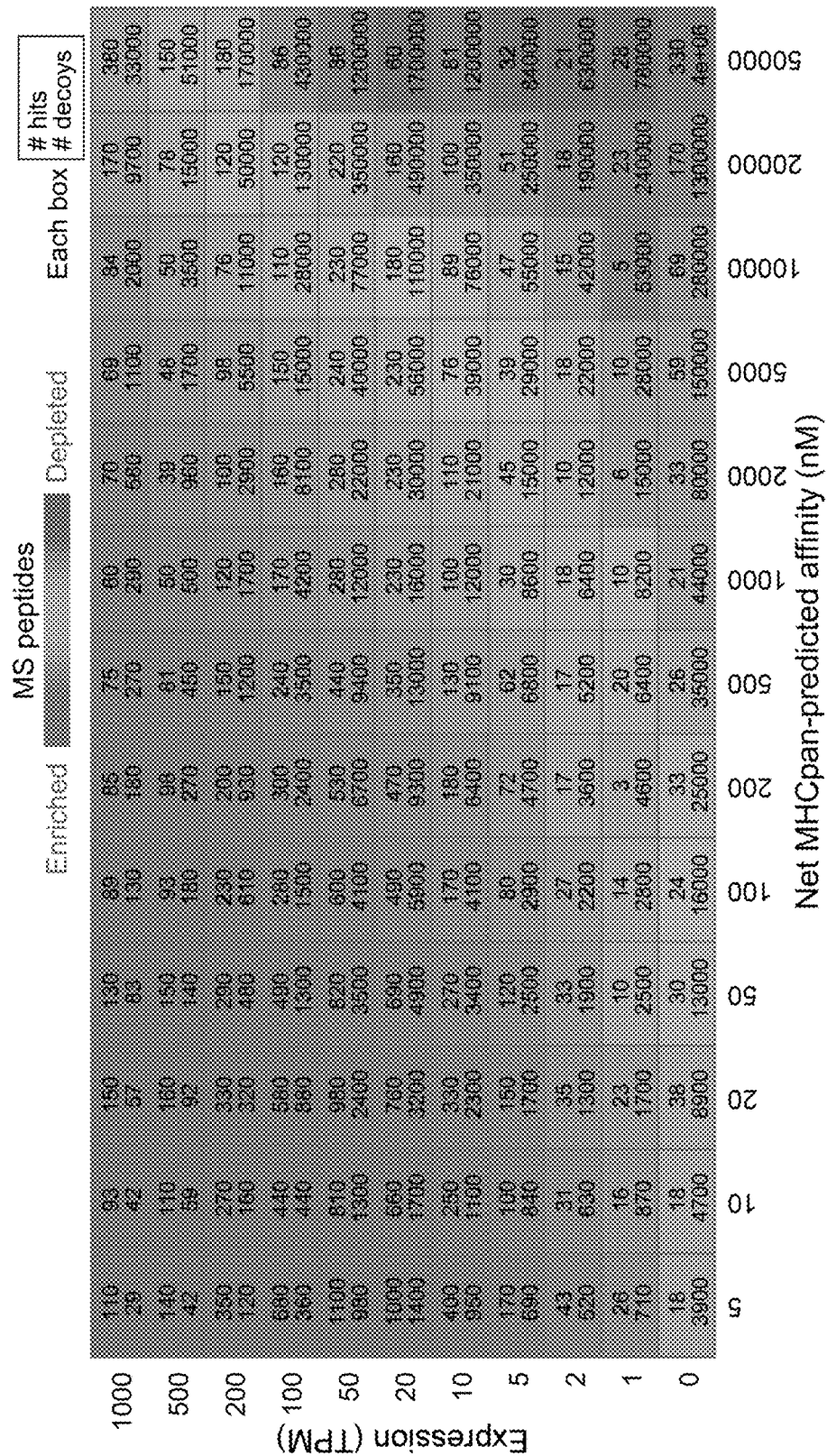
FIG. 18—Hits and decoys are binned according to source transcript expression (based on RNA-seq) and predicted affinity for each allele. Per bin, hit (top) and decoy (bottom) counts are reported. Color is according to the hit:decoy ratio (red: enriched for hits; blue: depleted of hits). High expression compensates for low affinity and vice versa.
Figure 19:
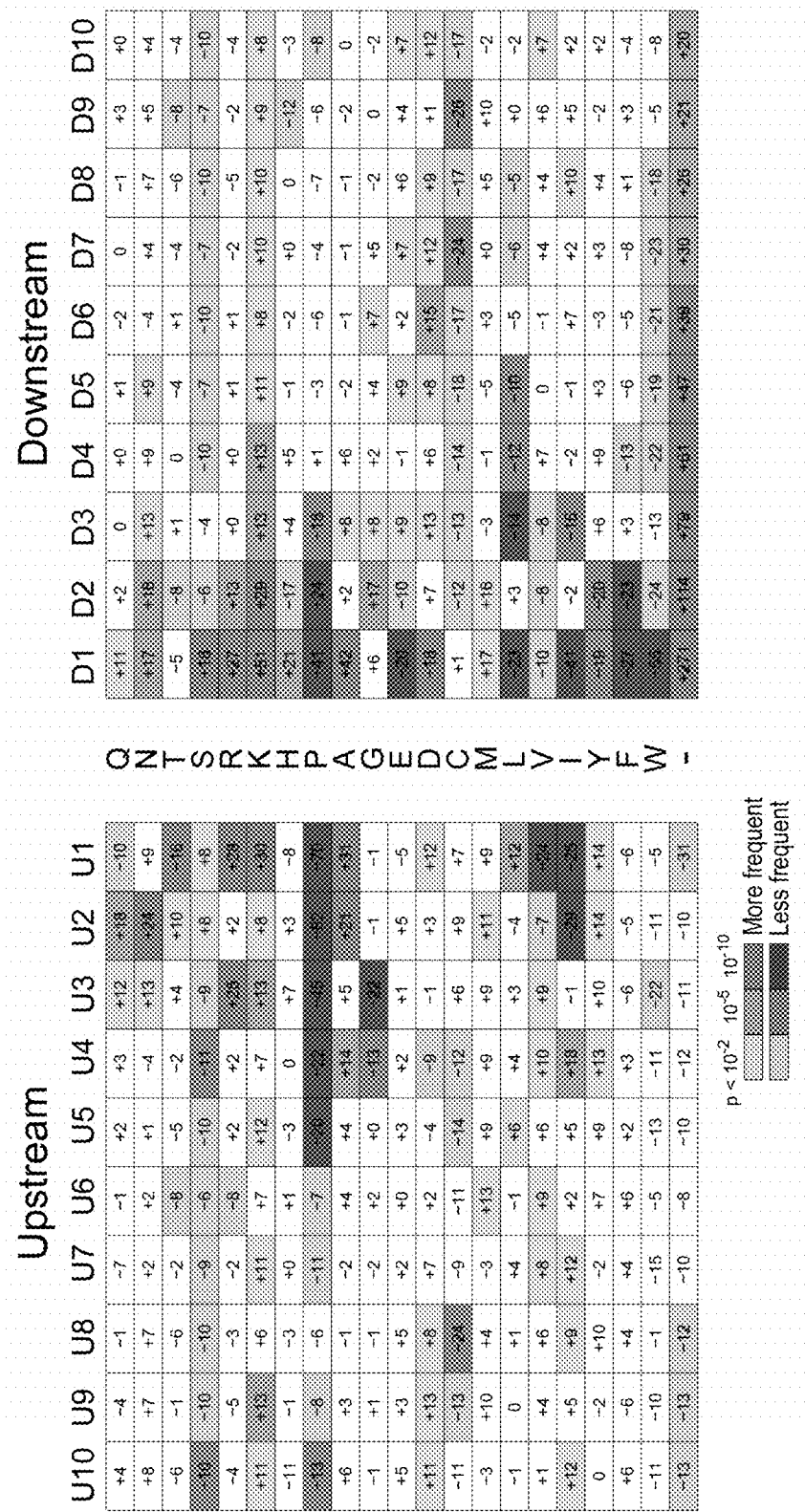
FIG. 19—Heatmap of amino acids frequencies (percent change relative to background) in the protein sequence context (upstream: U10-U1; downstream D1-D10) of HLA peptides identified from mono-allelic cell lines. Colors of heatmap cells indicate directionality (red: enriched; blue: depleted) and p value (see key).
Figure 20:
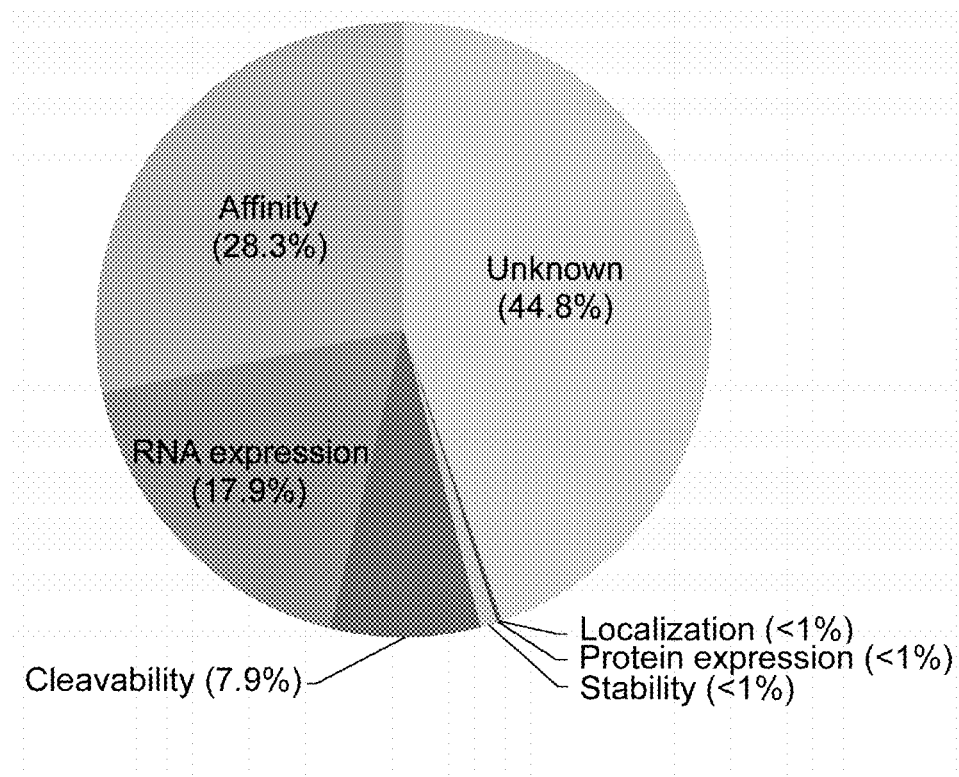
FIG. 20—Contribution of endogenous signals to positive predictive value determined by training linear models, adding the most important feature at a time.
Figure 21:
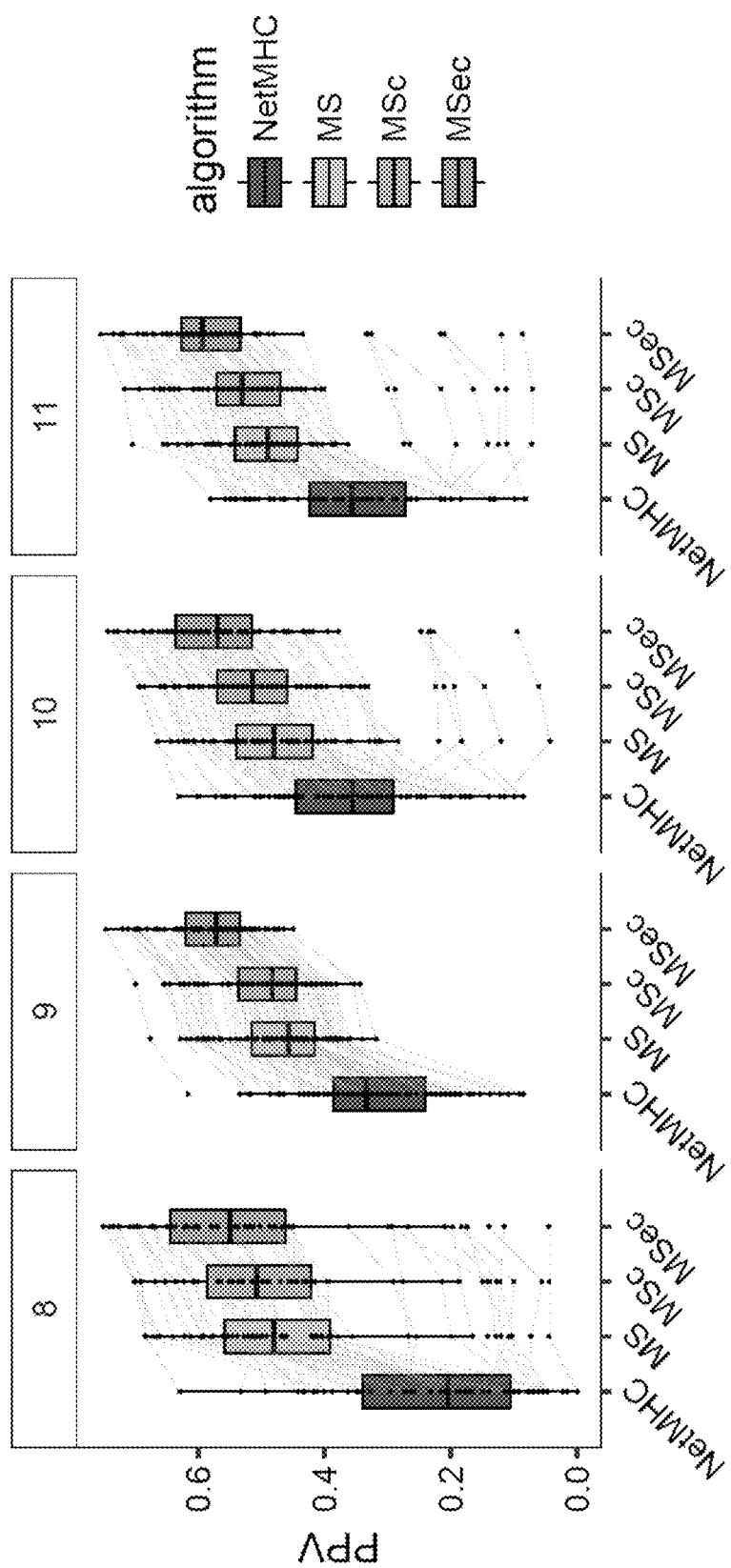
FIG. 21—Neural network models trained on the mono-allelic data outperform state of the art NetMHCpan4-0 algorithm. Gains increase when the likelihood of proteasomal cleavability (C) and expression (E, RNA-seq) are integrated into the model.
Figure 22:
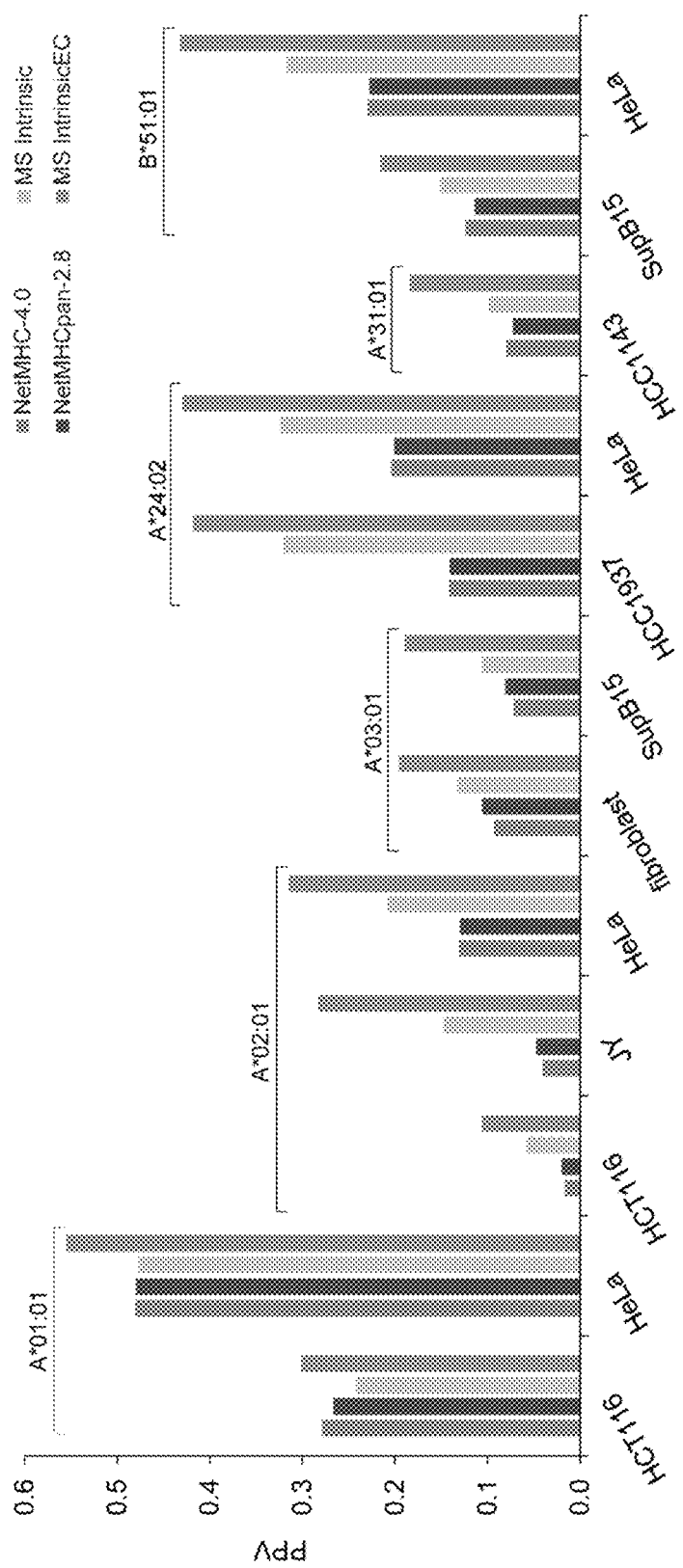
FIG. 22—The ability of Applicants' models to correctly identify peptides presented on HLA were evaluated on external MS datasets spanning multiple cell lines and alleles with a 2× gain in PPV on average.
Figure 23:
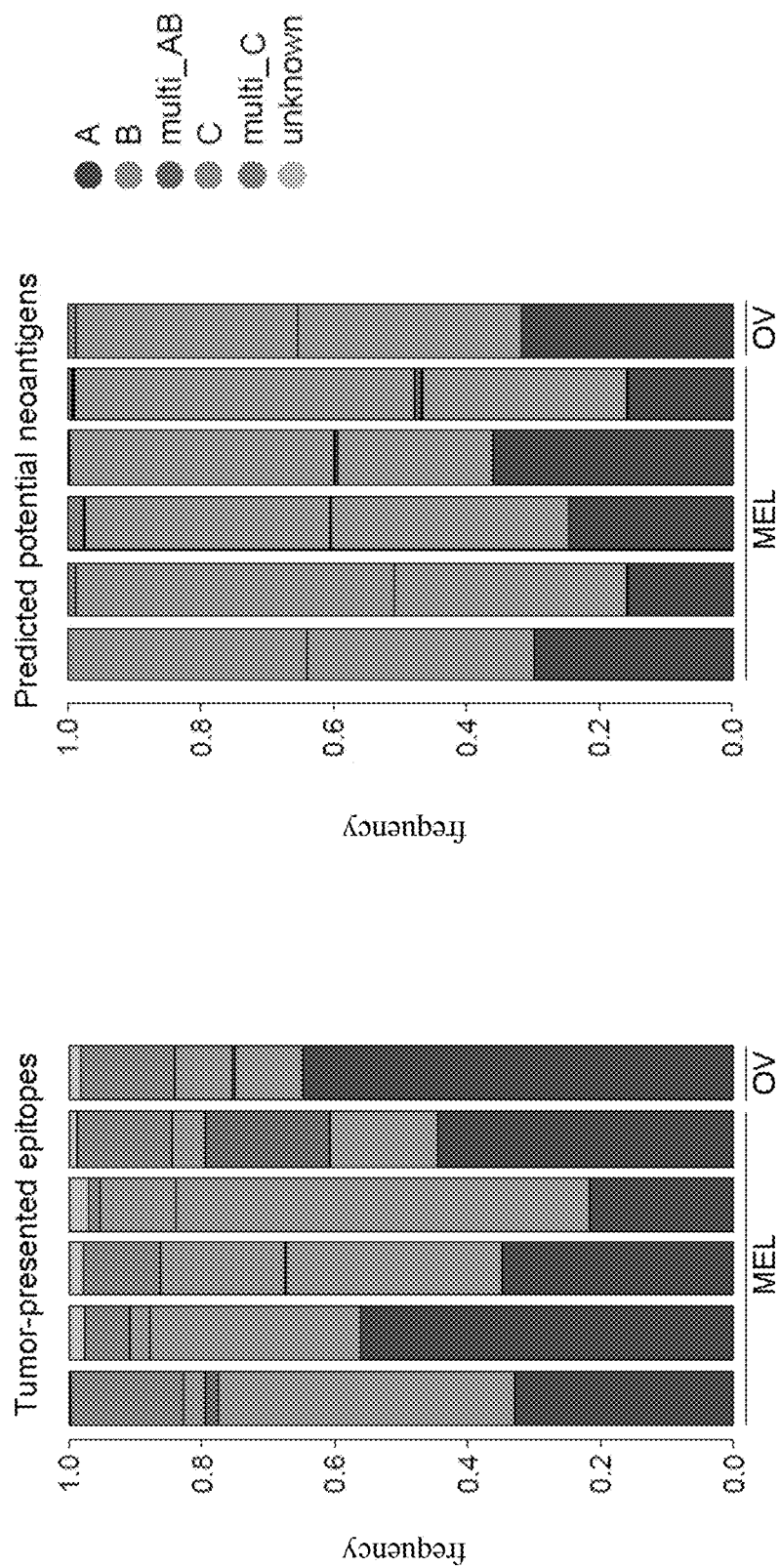
FIG. 23—Applicants evaluated the propensity of HLA-A, B, and C allele to present peptides on the cell surface of fives melanoma and one ovarian patient-derived tumor cell lines. HLA-C peptide amount to 8% of presented peptides while A and B alleles present more than 45% and 33% respectively (left). This is not driven by the identity of tumor specific peptides since peptides derived from tumor-specific mutations distribute evenly across HLA genes (right). Patient-derived tumor cell lines present epitopes on HLA-C alleles.
Figure 24:
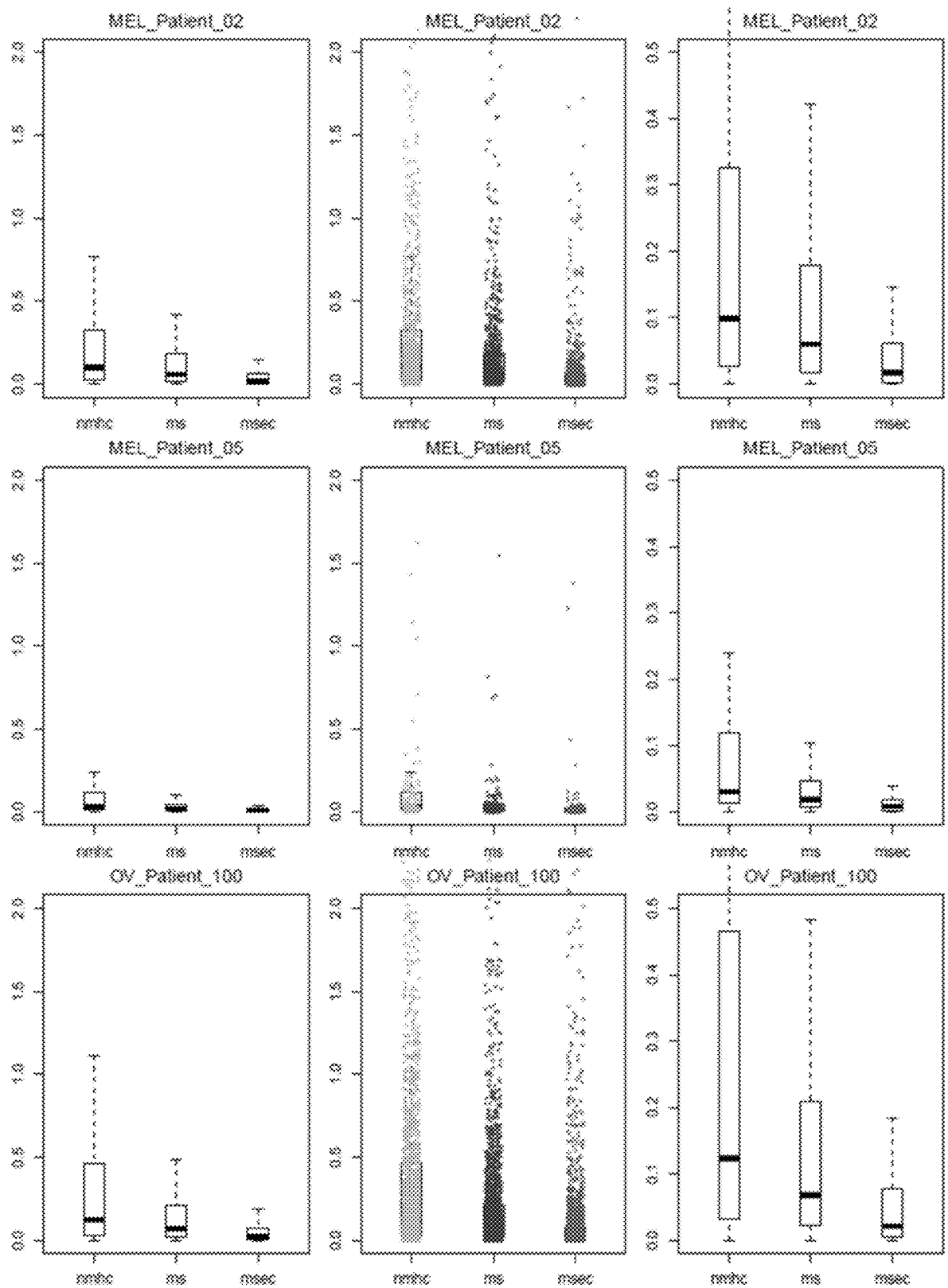
FIG. 24—Model performance on patient discovery data.
Figure 25:
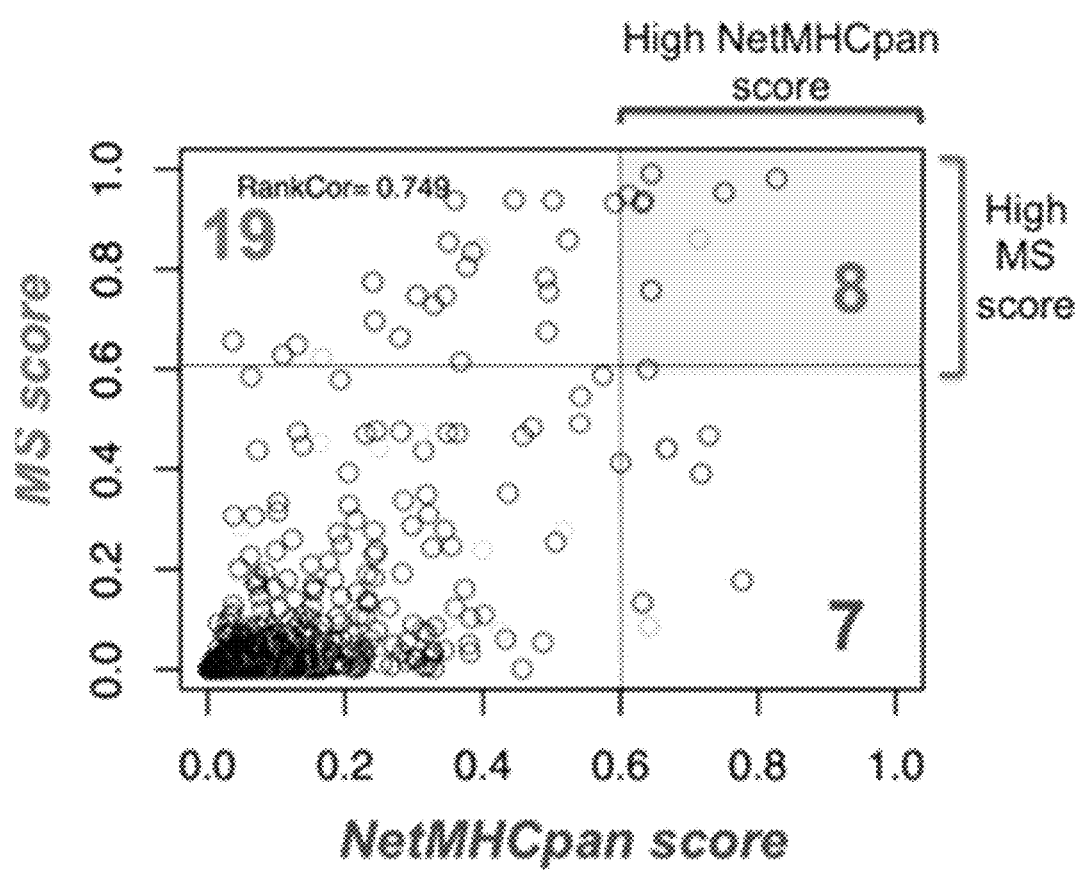
FIG. 25—Comprehensive peptide binding data to single alleles improves antigen prediction. Improvements due in part to inclusion of expression and proteasome cleavability.
Figures 26A, 26B, 26C, 26D:
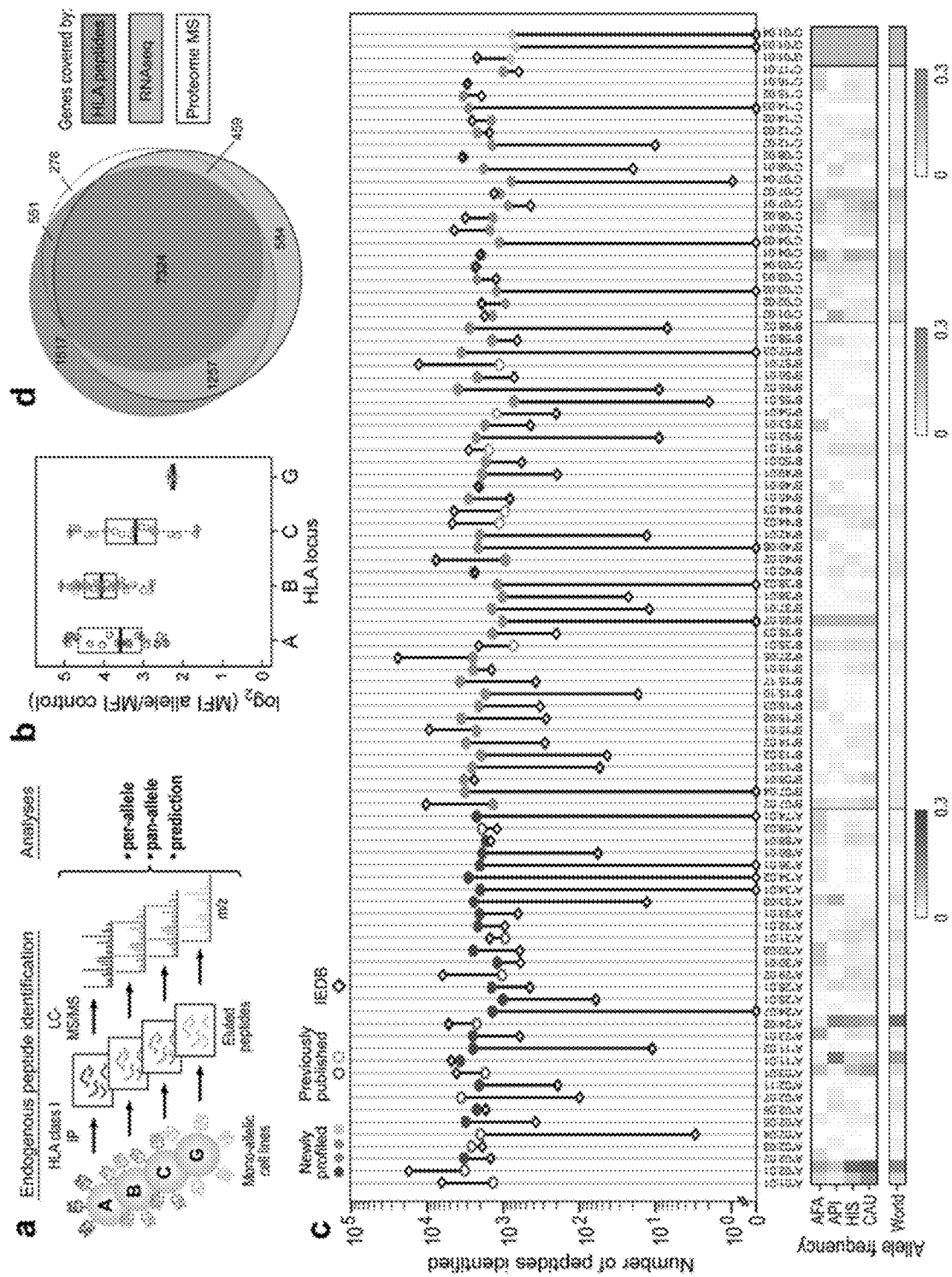
FIGS. 26A-26D—Mass spectrometric characterization of peptides eluted from HLA proteins in mono-allelic cell lines.

The newly generated data nearly doubles the HLA ligands recorded in the Immune Epitope Database (IEDB) which holds 208,885 ligands from 157 human class I alleles, with a mean of 200 peptides per allele (range 1-24,594). Peptides for 80 of 95 alleles were available in IEDB; however, 33 of 95 alleles had fewer than 100 known binders, which hindered reliable motif deduction and accurate de novo prediction (FIG. 26D). For the 15 previously uncharacterized alleles, Applicant identified 1,845 peptides per allele on average (range 693-4,022). From the compiled dataset, Applicant systematically assessed the length distribution, positional entropy, residue frequencies, binding motif, and sub-motif clusters of HLA-bound peptides per allele (FIG. 32I-32L) and created an interactive website for data exploration (mhc.tools). Altogether, these data and tools greatly expand the current knowledge of HLA class I-bound peptides and are publicly available. These tools provide further information on the identified peptides as discussed herein and in sequence listing.

Figures 27A, 27B, 27C, 27D:
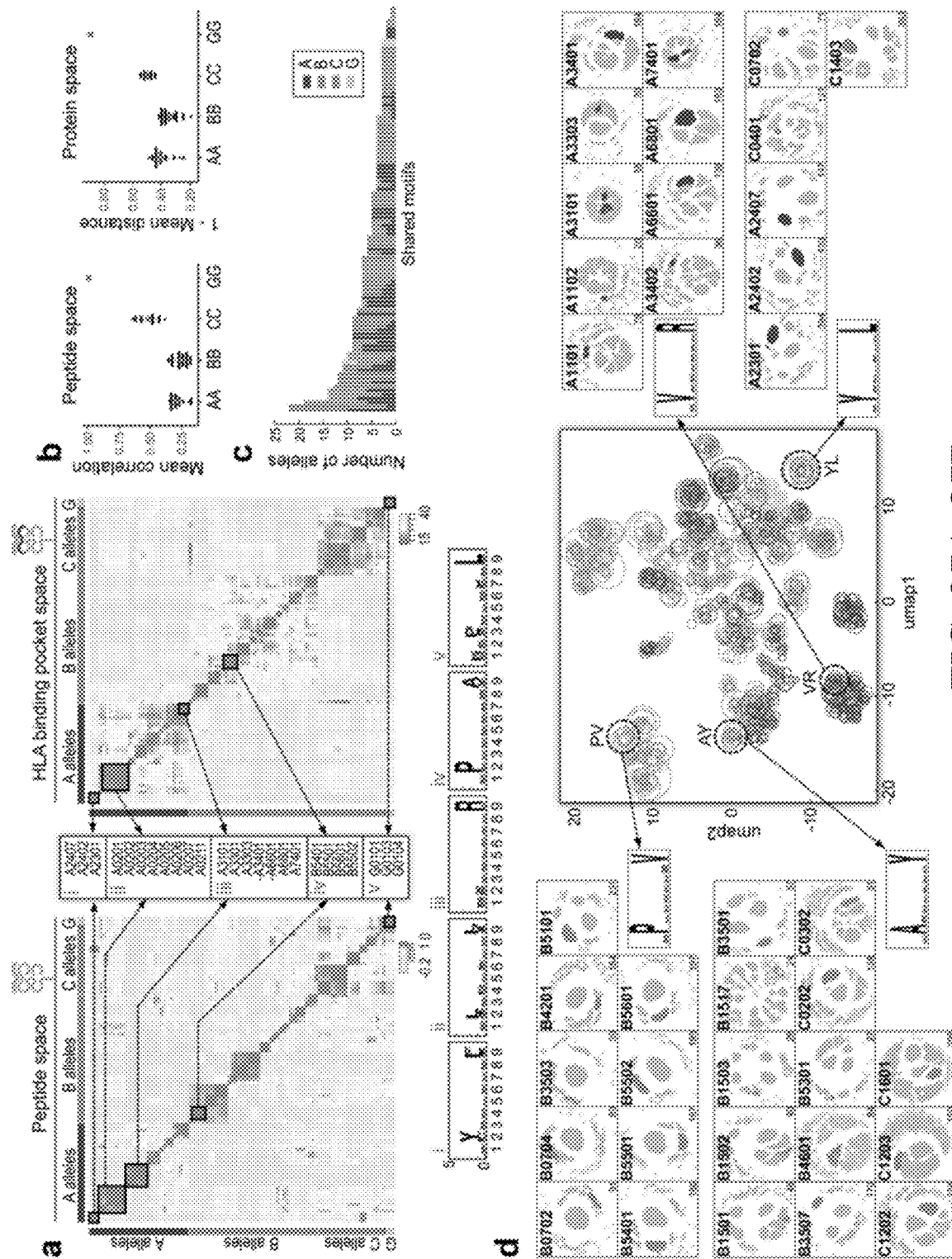
FIGS. 27A-27D—Identification of shared motifs and submotifs amongst HLA-A, B, C and G alleles.
Figure 33A:
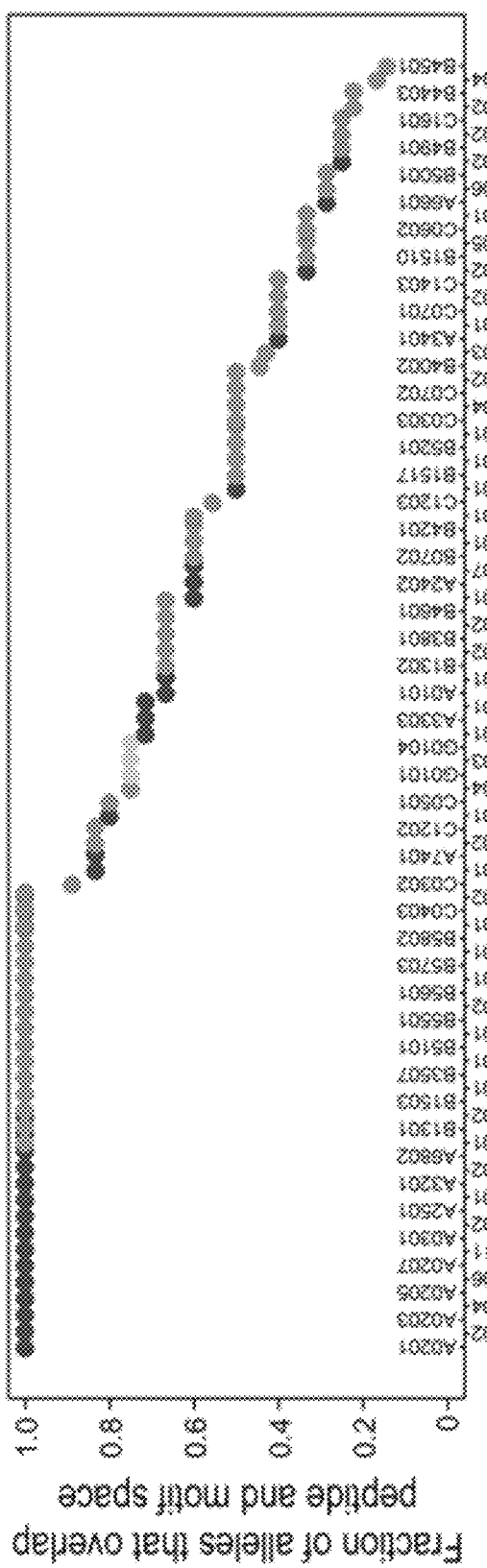
FIGS. 33A-33C—FIG. 33A) Fraction of neighbor alleles in motif space that are also neighbors in HLA-binding pocket space.

Identification of HLA Binding Motifs and Sub-Motifs that were Shared Across Alleles Since the numbers of peptide identifications per allele were only weakly correlated with surface HLA levels (Spearman's ρ=0.44, p<0.001, n=79 newly generated cell lines), differential binding potential likely contributes to the variation in peptide numbers (FIG. 32M-32N). To better understand the basis for differential binding, Applicant compared HLA alleles based on the motifs of their observed ligands and the physicochemical properties of binding pocket residues in the HLA protein. By computing pairwise correlations between the peptide binding motif of each allele (represented as a vector of frequencies of the 20 amino acids at every position), Applicant found groups of alleles sharing unique HLA-A and -B motifs (FIG. 27A—left). HLA alleles belonging to supertypes such as HLA-A*02 clustered together (FIG. 27A—inset ii) as did split antigen serotypes such as HLA-B*54,55,56 and HLA-A*23,24 (FIG. 27A—inset i, iv) (Sette and Sidney 1998; Robinson et al. 2015; Robinson et al. 2000). The pairwise correlations showed minimal motif sharing outside of the dominant groups (mean motif correlation of each HLA-A allele to all other -A alleles; and each HLA-B allele to all other -B alleles was 0.28 and 0.25, respectively, FIG. 27B-left). HLA-C motifs were more similar to each other (mean correlation 0.51), thus sharing more overlapping motifs, consistent with previous studies indicating that HLA-C (and HLA-G) alleles were more evolutionarily recent, with less divergence amongst alleles (Parham, P. & Moffett, A. Variable NK cell receptors and their MHC class I ligands in immunity, reproduction and human evolution. Nat. Rev. Immunol. 13, 133-144 (2013)). The patterns of similarity revealed by binding motifs were mirrored by similarities in the HLA binding clefts, quantified by physicochemical properties of HLA residues in contact with the ligand (FIG. 27A—right;

FIG. 27B—right). To assess the agreement of the two approaches, for each allele, Applicant counted the number of neighboring alleles in motif space analysis that were also proximal in pocket space (FIG. 33A). This correspondence maps the rules of ligand preference onto HLA protein sequence and serves as the basis for creating pan-allele predictors that rely on transfer learning from characterized to uncharacterized alleles (Nielsen et al. 2007).

Figure 33B:
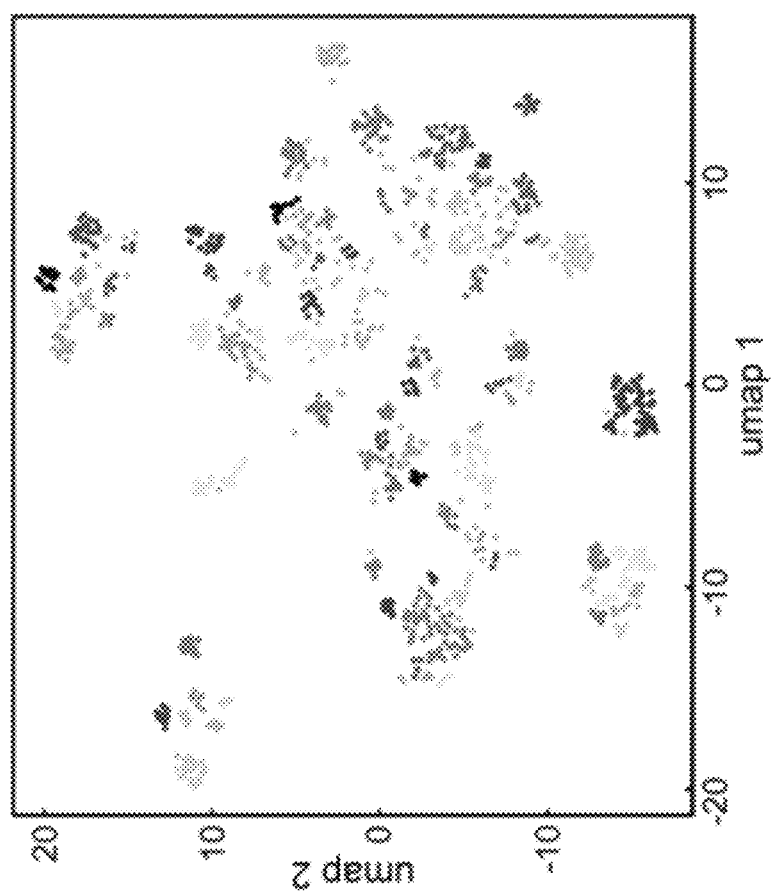
Figure 33B:
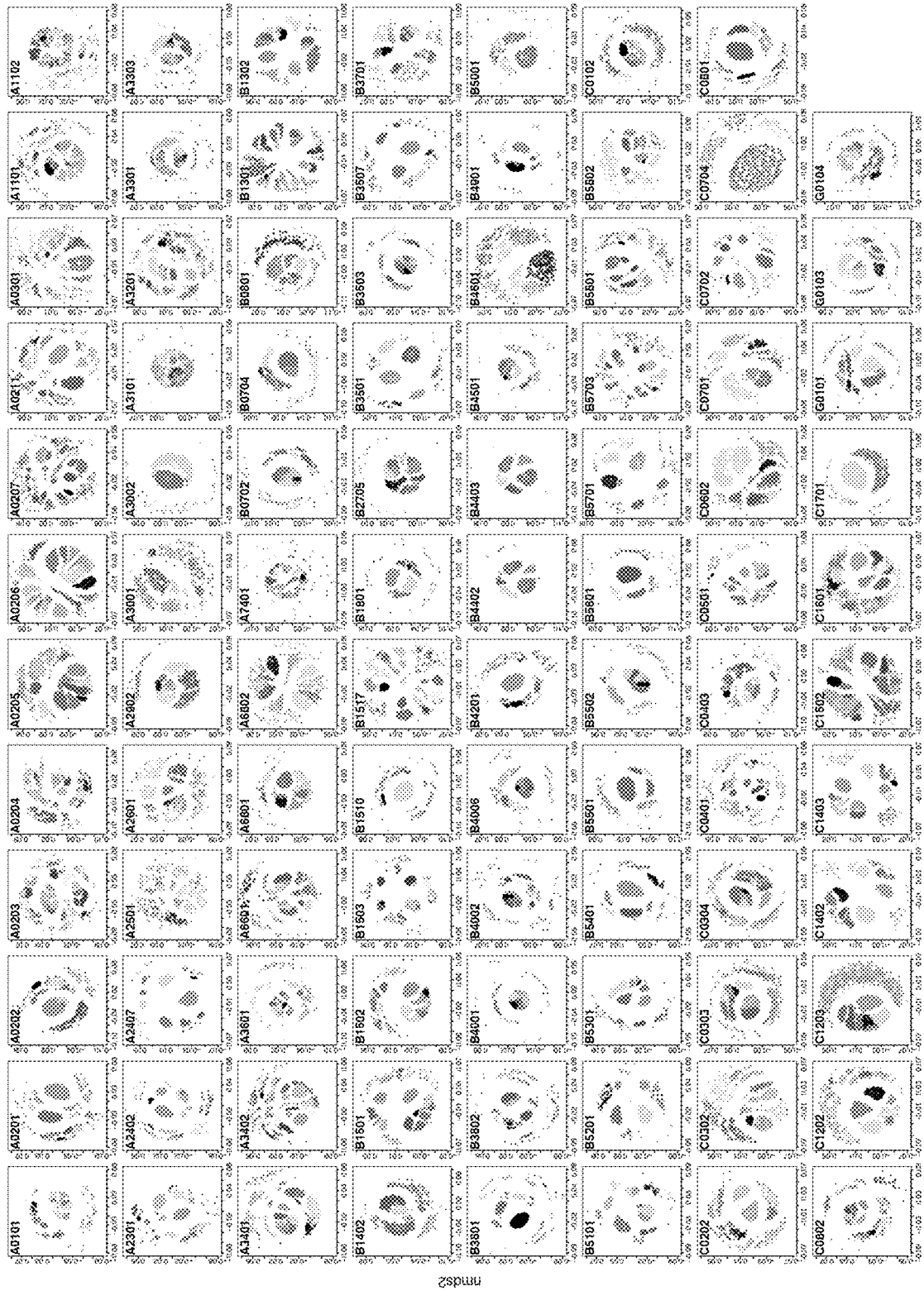

To delineate allele similarity at finer granularity, Applicant decomposed each aggregate motif per allele into sub-motifs by computing inter-peptide distances, projecting them onto 2-dimensional space of peptide coordinates and clustering the peptides, obtaining 1,133 submotifs (>20 peptides per cluster) across the 95 alleles (FIG. 33B). More than half of the clusters containing motifs originating from HLA-A or -B alleles were contributed solely by either HLA-A alleles or HLA-B alleles (FIG. 27C). For example, the motif xVxxxxxxR was found to be shared across subclusters amongst the -11:01, -11:02, -31:01, -33:03, -34:01, -34:02, -66:01, -68:01, and -74:01 alleles of HLA-A; likewise, the motif xPxxxxxxV was shared by subclusters amongst the -07:02, -07:04, -35:03, 42:01, 51:01, -54:01, -55:01, -55:02 and -56:01 alleles of HLA-B. The majority of submotifs that included HLA-C alleles overlapped with subclusters from HLA-A and/or -B alleles (e.g. xYxxxxxxL is shared amongst A*23:01, A*24:02, A*24:07, C*04:01, C*07:02, C*14:03; xAxxxxxxY was shared amongst B*15:01, B*15:02, B*15:03, B*15:17, B*35:03, B*35:07, B*46:01, B*53:01, C*02:02, C*03:02, C*12:01, C*12:03, C*16:01) (FIG. 27D, FIG. 33C), further reinforcing the notion that HLA-A and -B alleles had more divergent structure than the evolutionarily 'younger' HLA-C alleles. The overlaps in submotifs across alleles lended itself as the basis for optimizing epitope selection such that a minimal set of epitopes covers an optimal set of multiple alleles and thus individuals.

Figures 28A, 28B, 28C:
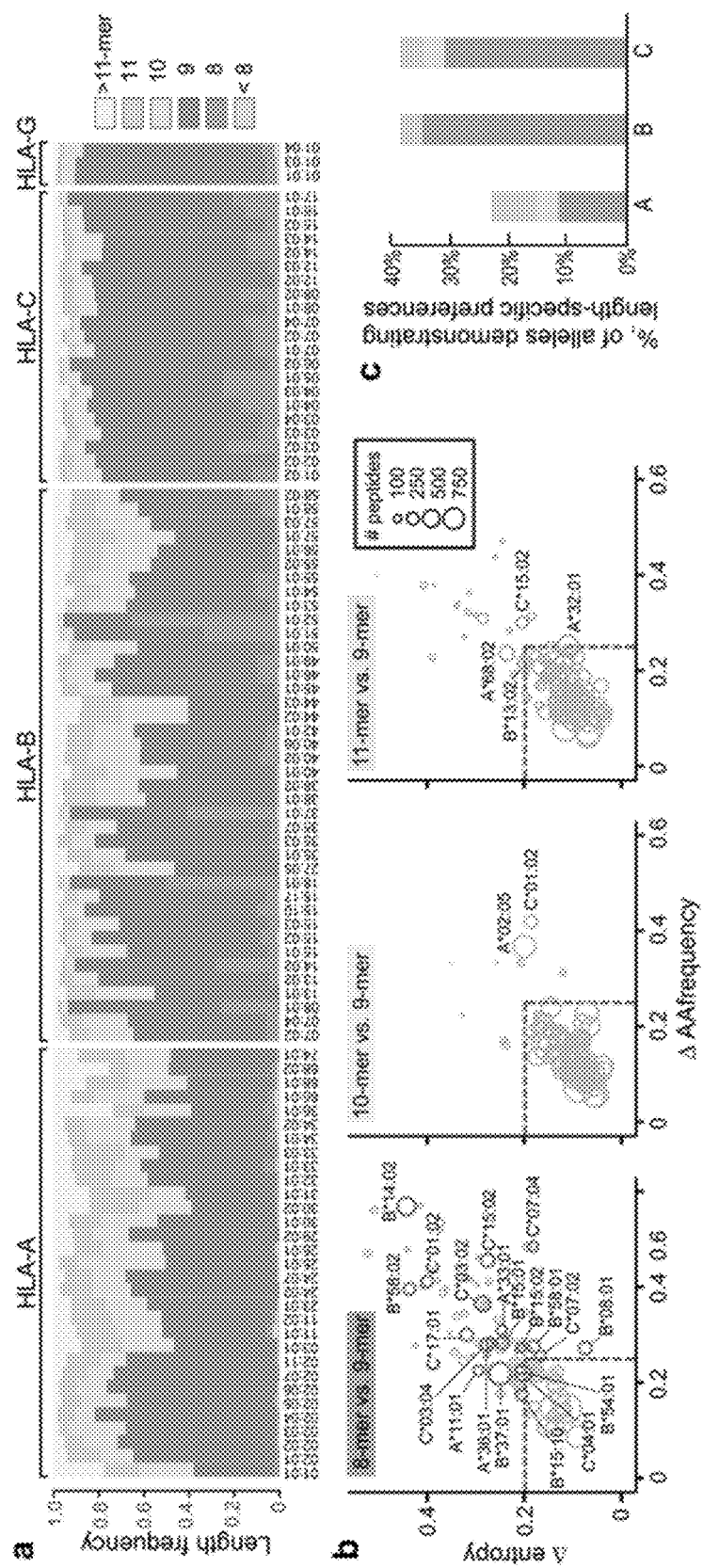

Length-Specific Differences in Ligand Preferences were Detectable Among HLA Alleles and Loci Preferences for varying peptide lengths were observed for specific alleles, with 9-mer peptides as the prevailing HLA ligand length. Unbiased evaluation of length distributions per allele in the dataset of 12,970 8-mers, 111,898 9-mers, 29,956 10-mers, and 18,202 11-mers (FIG. 28A), revealed that 9-mers were consistently the predominant length across alleles, except for a small number of HLA-B alleles that preferred 8-mers. After 9-mers, 10- and 11-mers were frequently found for HLA-A and -B alleles with B alleles having greater variation in length preferences, while 8-mers predominated for HLA-C alleles (p<0.001 all comparisons, Welch's two sample t-test). Applicant also found length-specific variations in motifs. To systematically identify potential length-specific binding motifs, Applicant generated pseudo motifs by dropping middle residues from 10- and 11-mers to compare to 9-mers or from 9-mers to compare to 8-mers, and evaluated the changes in frequency and entropy at every peptide position (FIG. 28B). This analysis yielded 26 differences across HLA-A, -B, and C alleles (20 8-mer, 2 10-mer, and 4 11-mer motifs) out of 178 motifs with at least 100 identified 8-, 10-, or 11-mer peptides, that had an absolute difference in residue frequency with the true 9-mer motif of >0.25 or an absolute difference in entropy of >0.2 at any position (FIGS. 28B-28C). The most notable changes in entropy were at position 5 for 8-mers compared to 9-mers (p<10-8, FIG. 34A). This residue position was implicated in structural changes of certain HLA-alleles upon binding as it allowed embedding of these short peptides in the cleft (Rist et al. 2013; Maenaka et al.

2000). For example, Applicant found the A*33:01 8-mer motif (n=112) to had a strong preference for proline and isoleucine at position 5 which is absent in the 9-, 10-, or 11-mer motifs. B*14:02 8-mers (n=401) were enriched in histidine at position 5 and lacked tyrosine enrichment at position 2 compared to the 9-mer motif (n=913). C*01:02 gained proline as an additional anchor residue in position 3 for all lengths, 8-mers (n=164) had glycine or alanine preference at position 5 whereas most 10-mers (n=224) contained leucine (11-mers alanine and leucine) instead of alanine or serine in position 2. Selected peptides were confirmed as strong binders in in vitro binding assays, despite poor predicted affinity by NetMHC (FIGS. 28D-28E; FIG. 34B). Collectively, these observations motivated a more explicit approach of modeling HLA peptide binding characteristics of different lengths.

Peptide-Extrinsic Properties Varied Per HLA and Length

Since HLA-bound peptides captured from the cell surface were reflective of the cell-endogenous processes that shape the ligandome, Applicant assessed whether HLA-A, -B, —C, and -G ligands of different peptide lengths were preferentially derived from peptides with variable extrinsic properties. Applicant found that HLA-C bound peptides were biased towards higher expression and hydrophobicity ($p<1\times10^{-10}$, Welch's two sample t-test; FIG. 28F). HLA-C also showed a preference toward peptides with poorer proteasome cleavability scores ($p=1\times10^{-10}$; Welch's two sample t-test), although an examination of peptide properties stratified by length revealed that this is likely driven by the higher frequency of 8-mer peptides bound by HLA-C alleles as they were observed to have lower cleavage scores (FIGS. 28f-28G; FIG. 34A). These observations agreed with prior structural analyses that have reported more shallow HLA-C binding clefts (Kaur et al. 2017), as higher abundance and elevated hydrophobicity of cognate peptides could compensate for decreased binding stability. Applicant noted that HLA-G peptides had an even stronger bias towards lower cleavability scores ($p<1\times10^{-10}$; Welch's two sample t-test), possibly due to the lack of HLA-G training data for the cleavability predictor and may suggest differential protease activity in shaping the HLA-G ligandome (Celik et al. 2018). Other differences with smaller effect sizes were also observed which altogether prompted Applicants to model extrinsic properties per HLA loci in pan-allele predictors.

Interferon Stimulation had Minimal Impact on Peptide Trimming Signatures

Figures 29A, 29B, 29C:
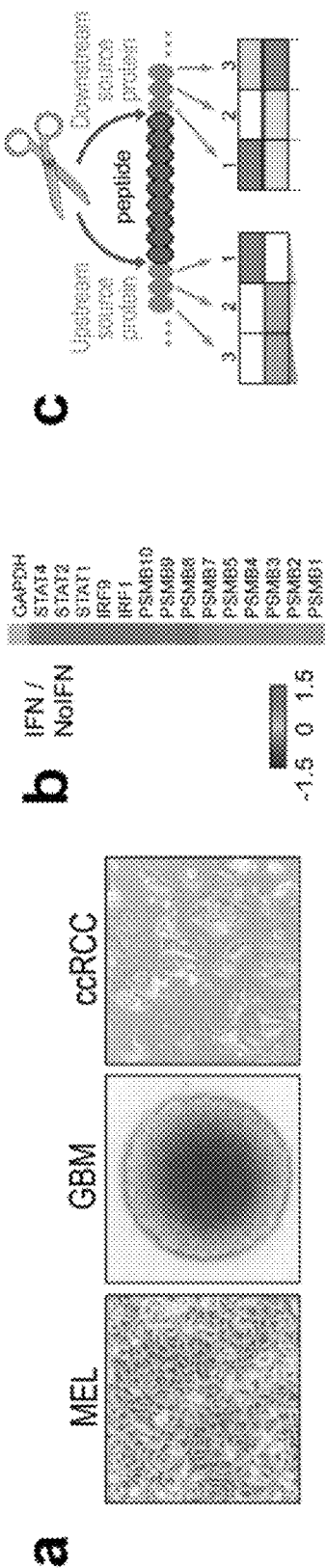
FIGS. 29A-29F—Proteasomal shaping of the HLA-associated peptidome.

Exposure to inflammation can impact proteasomal processing preferences, but the extent to which it alters the HLA-associated peptidome in normal and cancerous human tissues has not been completely elucidated. Therefore, Applicant generated a series of patient tumor cell lines, derived from melanoma (MEL; n=4), glioblastoma (GBM; n=3) and clear cell renal cell carcinoma (ccRCC; n=1) specimens (FIG. 29A), and assessed the effect of IFNγ stimulation on the processing of HLA-bound ligands. As expected, full proteome analysis of one of the GBM samples revealed IFNγ treatment to result in elevated expression of immunoproteasome-specific subunits (PSMB8, PSMB9, PSMB10) and genes involved in interferon regulating pathways (e.g., STAT1, STAT2, STAT4, IRF1, IRF9), along with reduced expression of constitutive proteasome subunits (e.g. PSMB5, PSMB7) (FIG. 29B). Likewise, for all 7 IFNγ-matched samples, Applicant observed an increase of 2.4-5.6% in peptides derived from IFNγ-response genes post stimulation. Applicant also analyzed external datasets from lung epithelial cell lines exposed to IFNγ and TNFα (Javitt et al. 2019) and primary skin fibroblast tissues (Bassani-Sternberg et al. 2015). Finally, Applicant sequenced and examined eluted ligands from a normal primary skin sample.

Figure 29D:
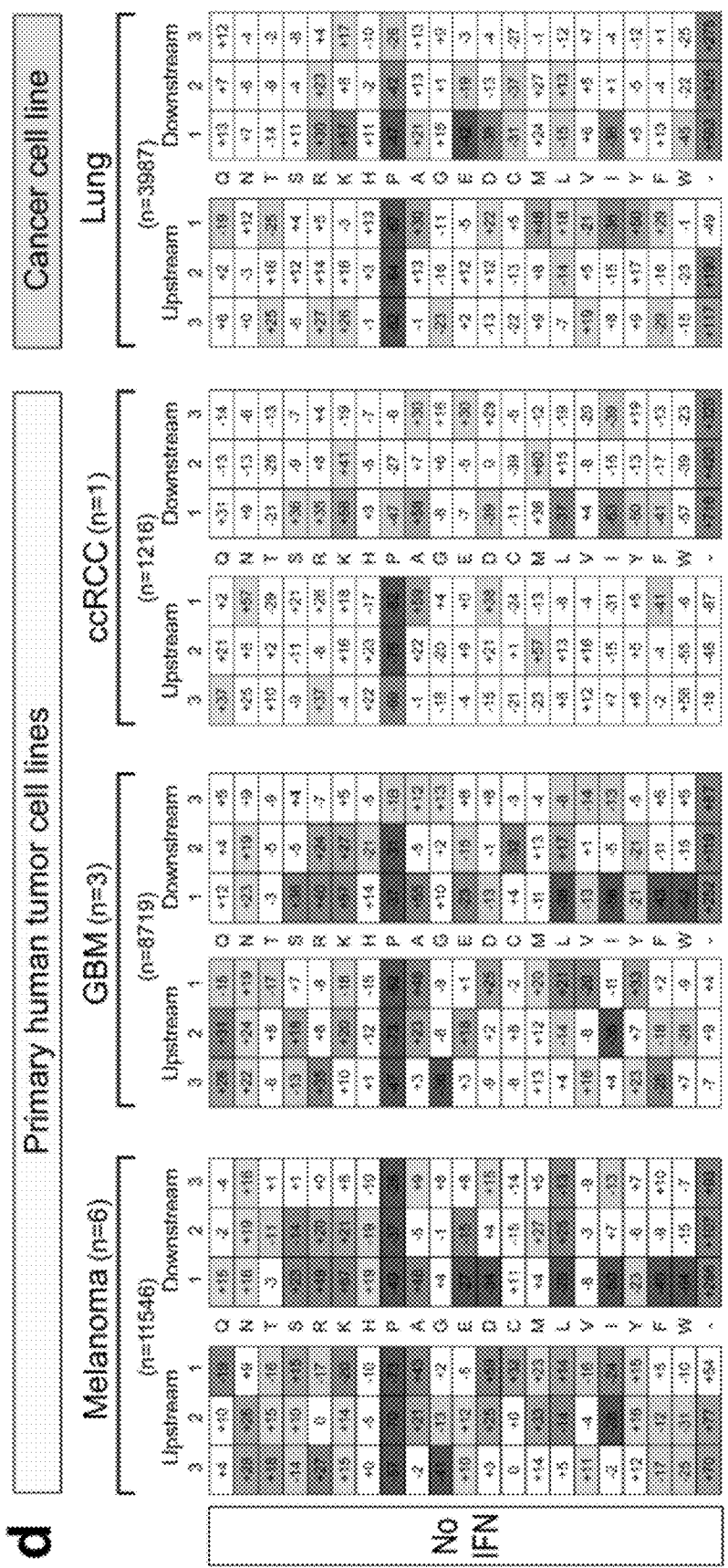
Figure 29D:
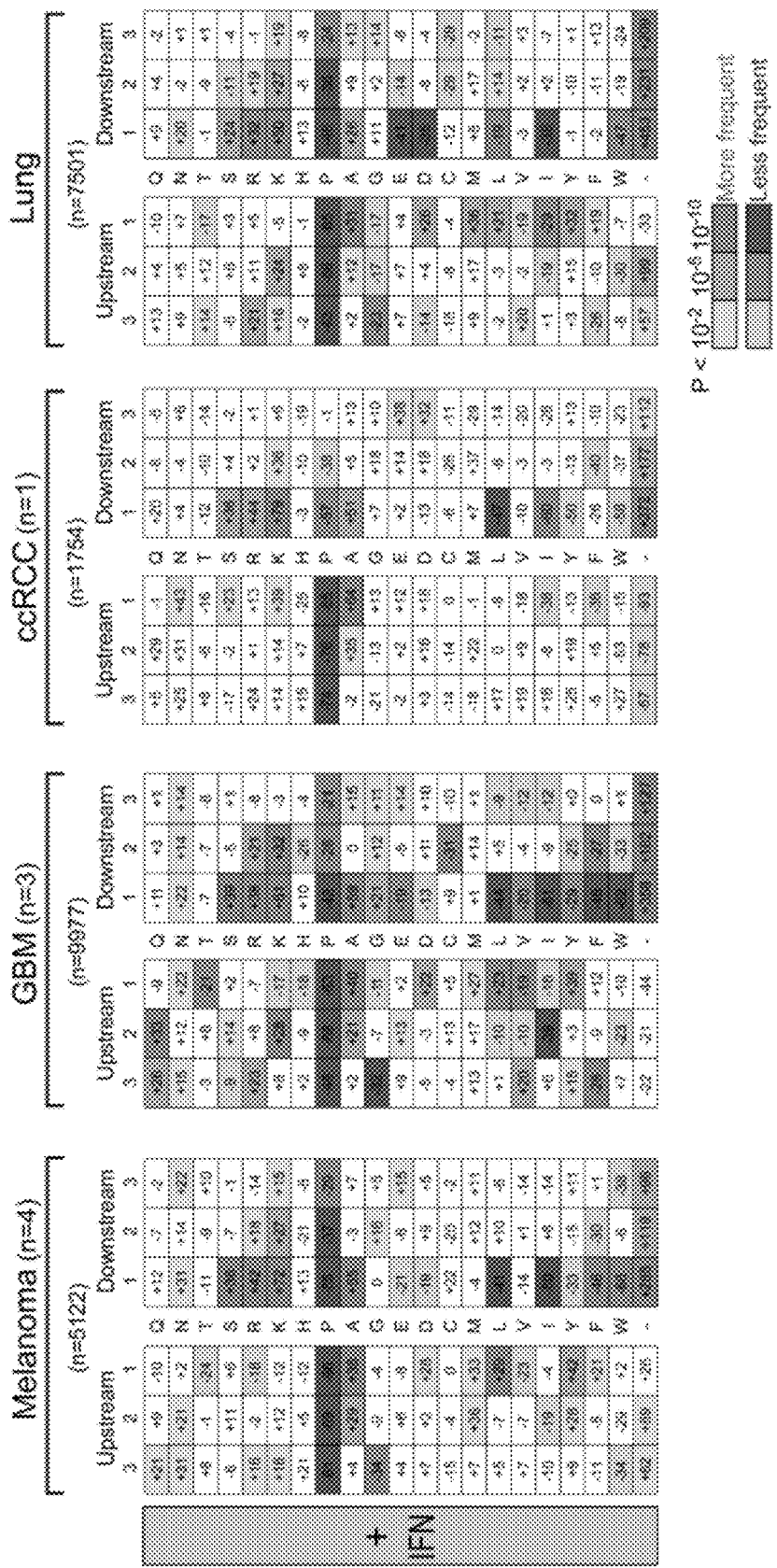
Figures 29E, 29F:
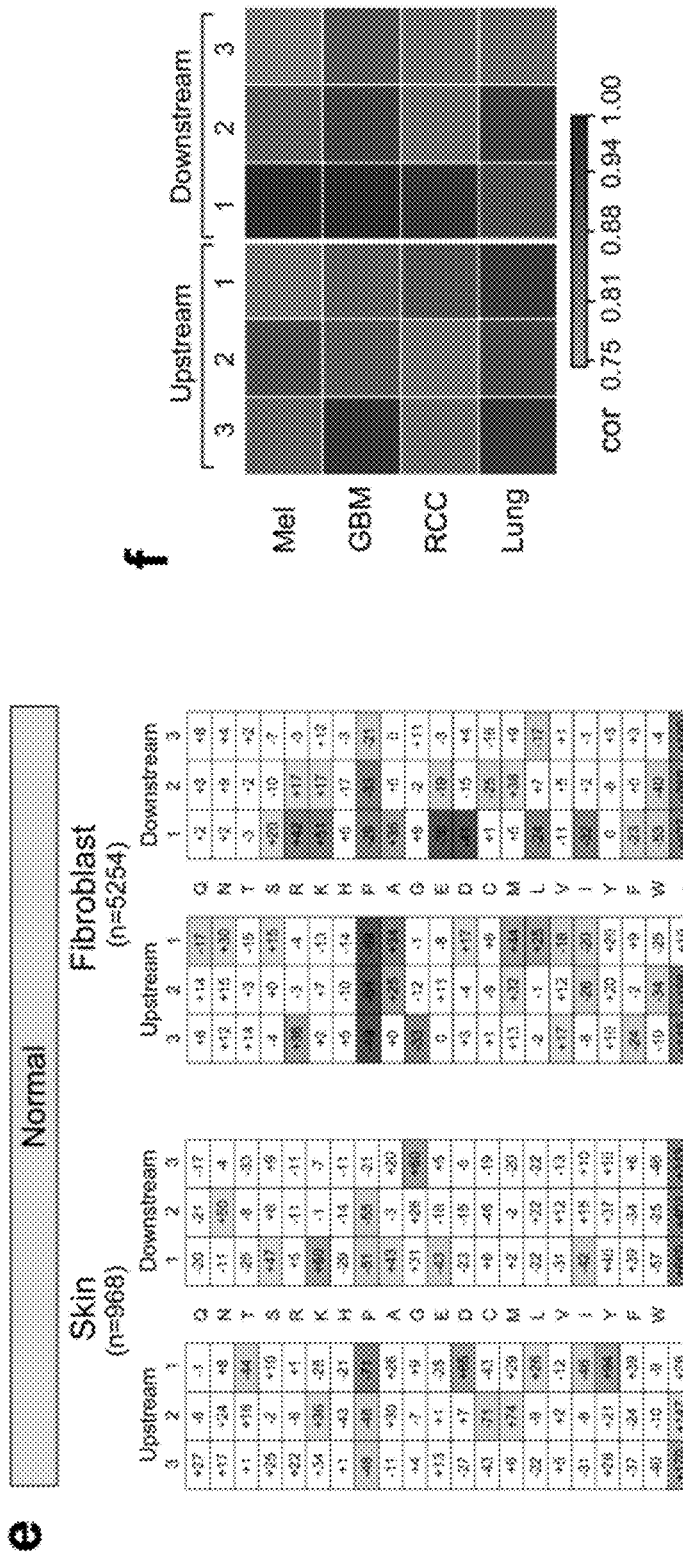

To assess proteolytic cleavage preferences in the untreated and treated dataset, Applicant calculated the enrichment of residues upstream and downstream of observed peptides in the protein sequence versus a set of decoys drawn from the proteome, controlling for HLA motif biases by matching the first two and last two decoy positions to observed peptides (FIG. 29F). As before, in the untreated dataset (FIG. 29D-top), Applicant observed an enrichment for A, K, S and R as downstream residues as well as in peptides derived from protein C-terminus (indicated by '-') (Abelin et al. 2017). Upstream residues R and K were not enriched after Applicant removed potential tryptic peptide contaminants from the datasets. Proline on the other hand was depleted at both termini in all samples, likely due to steric hindrance. Acidic residues (E, D), as well as certain hydrophobic residues (I, L, F, W) were underrepresented downstream of HLA-associated peptides.

Applicant observed strong correlations between proteasomal signatures of untreated and IFNγ-treated samples suggesting that immunoproteasome activation has minimal impact on the processing of HLA-presented ligands in malignant cells (FIG. 29D-29E; Spearman's $\rho>0.76$). Consistently, cleavage preferences in IFNγ-treated and untreated tumor samples had similar differences when compared to non-cancerous primary skin and fibroblast tissues (FIG. 29E; FIG. 35A). Applicant also considered whether IFNγ alters the proportions of allele utilization, especially with regard to C-terminal anchors (see FIG. 31A-31D).

Figures 30A, 30B:
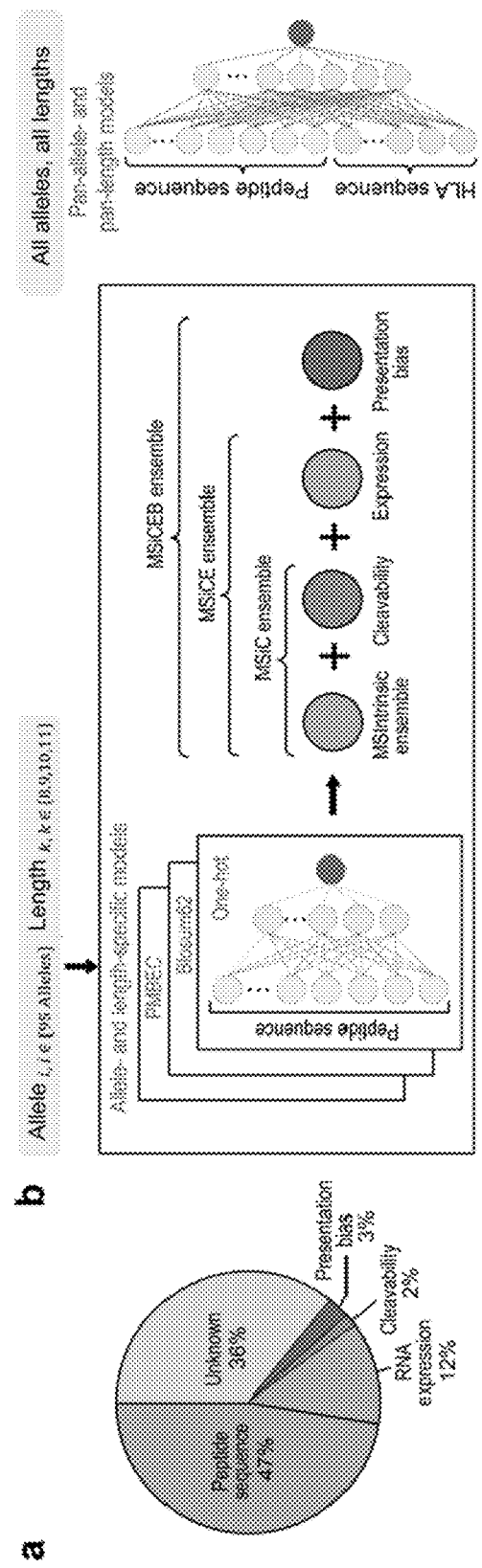
FIGS. 30A-30G—Length-specific and pan-allele MS-based models outperform state of the art predictors.

Generation and Performance of Allele-and-Length-Specific and Pan-Allele-Pan-Length Predictive Models of Antigen Presentation Multivariate models incorporating endogenous HLA-presentation descriptors, such as peptide source abundance and likelihood of proteasomal cleavage, outperform affinity-trained predictors (Abelin et al. 2017; and Bassani-Sternberg, et al. 2015). With the extended dataset of 95 alleles, Applicant re-evaluated the predictive contribution of these variables (FIG. 36A-36B) and also assessed two other features: 1) gene presentation bias; and 2) translation quantification via ribosome profiling. Presentation bias quantified the discrepancy between expected and observed number of MS-identified peptides per gene in a given set of samples and can boost recall of lowly expressed peptides (Bulik-Sullivan et al. 2018), while ribosomal profiling captures actively translated mRNA molecules and could provide a more accurate proxy for peptide precursor abundance (Methods). Additionally, Applicant utilized the MS-trained predictors as the first variable, instead of NetMHC affinity, in order to account for any MS data properties which might have overestimated the contribution of cleavability which was the first MS data-based feature in the previous analysis. To evaluate predictive power, Applicant constructed evaluation datasets consisting of the observed allele- and length-specific binders in the MS data (n) along with 999*n random decoys from the human proteome and considered the fraction of true binders in the top 0.1% peptides in the evaluation dataset ranked by prediction scores (i.e., positive predictive value (PPV)). The MS models trained on peptide sequence features alone (described herein) achieved an average PPV across the 95 alleles of 47% (FIG. 30A). Integrating RNA-seq as a proxy for peptide abundance boosted PPV to 60%, while protein abundance (iBAQ) achieved 54% PPV, respectively. Combining RNA-seq with Ribo-seq reached a PPV of 61% (Ribo-seq data not shown). Protein presentation bias and cleavability were the next most predictive variables adding 2.9% and 1.5% to PPV. Based on these results, Applicant trained prediction models that integrate intrinsic peptide features (MSintrinsic, or MSi) with extrinsic properties: cleavability (C), expression (E) and gene presentation bias (B).

Figures 30C, 30D, 30E, 30F, 30G:
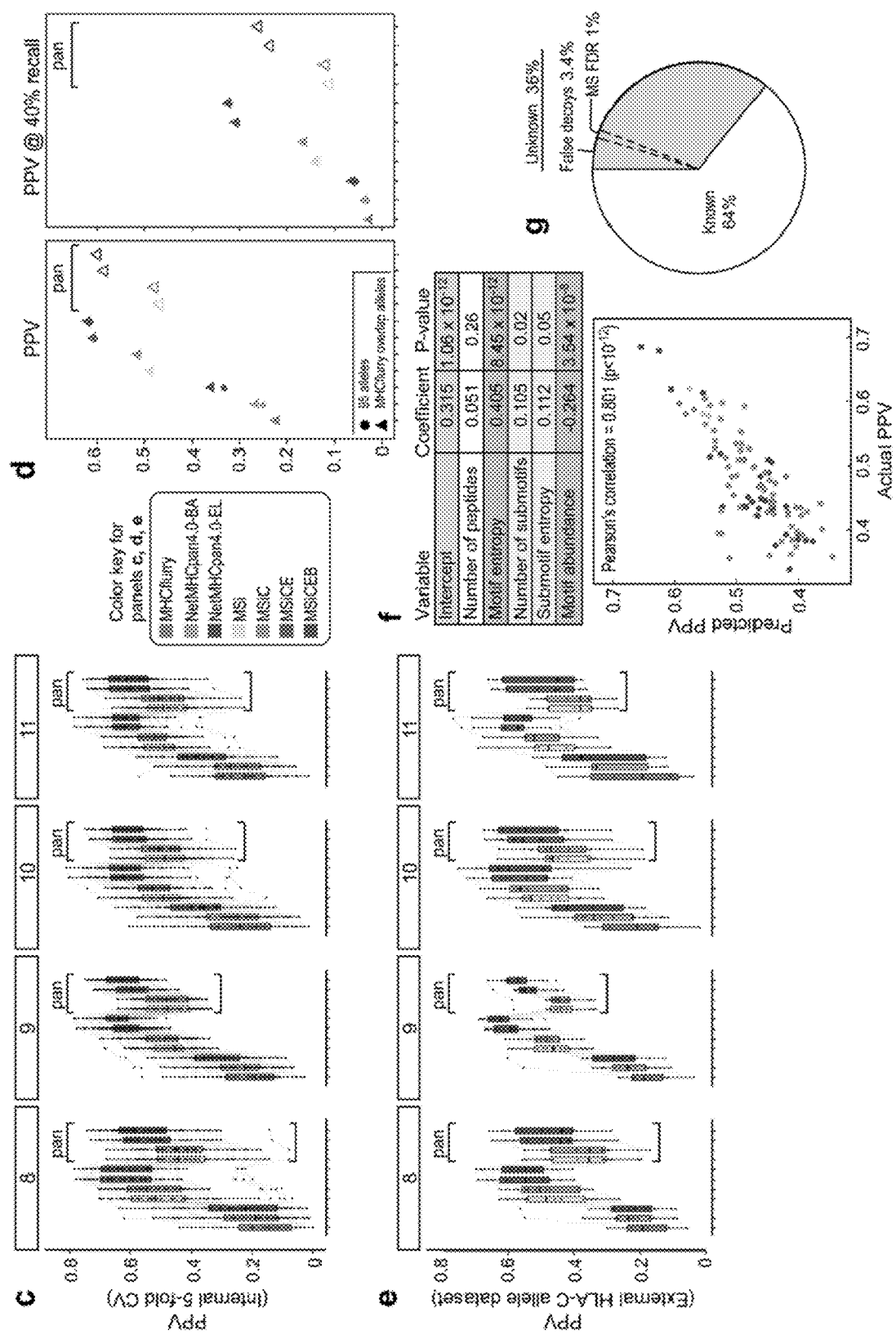

The observed length-specific binding motifs (FIG. 28A-28G) in conjunction with the high frequency of non-9-mer presentation for some alleles motivated the generation of length-specific binding predictors, trained exclusively on ligands of specific lengths (8-, 9-, 10-, or 11-mers), without 'borrowing' information from 9-mer peptides for other lengths (FIG. 30B—left). Additionally, to enable prediction for any HLA allele (beyond the MS dataset), Applicant built a pan-allele-pan-length model (panMSintrinsic or panMSi, FIG. 30B—right). Model performance was compared against the most recent version of NetMHCpan, 4.0 (Jurtz et al. 2017), as it incorporated training data derived from binding affinity (BA) or MS-sequenced eluted peptide (EL) datasets (including previously published 16 alleles), as well as against MHCflurry, reported to outperform NetMHC, especially for non-9-mers (O'Donnell et al. 2018). In a standard 5-fold cross validation (CV) of the length-specific models, Applicant found an average improvement in the MS-based peptide sequence-only models (MSi) across lengths of 2.2-, 1.9- and 1.5-fold compared to MHCflurry (for overlapping alleles), NetMHCpan4.0-BA and NetMHCpan4.0-EL (95 alleles), respectively (FIG. 30C). Models which additionally integrated cleavability (MSiC) added +2.6% to PPV, cleavability and expression (MSiCE) an additional +9.3%, or cleavability expression and gene presentation bias (MSiCEB) a further +1.1% PPV, ultimately achieving 2.7-, 2.4-, and 1.8-fold improvements compared to the benchmark algorithms, and with MSiCEB contributing an additional 1.1% to PPV. Length-specific models for 8-, 10- and 11-mers outperformed the corresponding non-length-specific models currently used (FIG. 30C) with average increases of +15, +18, +26, and +27% PPV for MSi, MSiC, MSiCE and MSiCEB over NetMHCpan4.0-EL, respectively. The largest benefits were observed for 8-mer models, which was not unexpected since 8-mer motifs were most different from 9-mer motifs (FIG. 28B—left). Ultimately, MSiCEB achieved 2.7-, 2.4- and 1.8-fold improvements compared to the three benchmark algorithms.

Although the performance of the pan-allele pan-length models was on average highly comparable to non-pan models (mean and median differences –2% PPV) and improvements over the non-pan models were observed for over 35% of allele-length combinations, Applicant also noted several cases with considerable decrease in predictive power (FIG. 30C). As anticipated, the subpar performance of pan models in these cases largely coincided with alleles for which non-9-mer motifs were different from the 9-mer motif (FIG. 28B). Compared to prior algorithms, the largest gains in PPV were observed for poorly characterized alleles (+20% PPV for HLA-C and +38% for HLA-G for MSi against NetMHCpan4.0-EL as the best scoring amongst the benchmark algorithms), but gains were also observed for all other alleles (+12% for HLA-A and +14% for HLA-B), even when only the 16 previously profiled alleles were considered (+9% for HLA-A and +5% for HLA-B). Length-specific models for 8-, 10-, and 11-mers outperformed the corresponding non-length-specific models currently used (FIG. 30C) with average increases of +15, +18, +26, and +27% PPV for MSi, MSiC, MSiCE, respectively. The largest benefits were observed for 8-mer models, which was not unexpected since 8-mer motifs were most different from 9-mer motifs (FIG. 28B—left).

Applicant proposed PPV at 0.1% of the top hits as a more suitable metric to evaluate HLA presentation predictors[4] because of the importance of assessing true positive rates at the realistic 0.1% prevalence of binders (the approximate rate of true binders among random 9-mers; Methods). A recent study quantified model performance using a different version of PPV, where the fraction of true positive calls out of all predictions necessary to retrieve 40% of the true binders is calculated, and the hits:decoys ratio in the evaluation set was modified from 1:999 to a 1:100007 (i.e. 'PPV at 40% recall'). Due to these differences, the two metrics are not directly comparable. Using a PPV at 40% recall, Applicant found that MSi outperforms MHCflurry, NetMHCpan-BA and NetMHCpan-EL by 5-, 4-, and 2-fold, while MSiCEB achieved 12-, 10-, and 6-fold improvements (FIG. 30D). Finally, Applicant observed similar gains in PPV compared to MHCflurry and NetMHCpan when evaluating an external dataset of HLA-C and -G binders (Di Marco et al. 2017) (FIG. 30E). In summary, Applicant observed a 2× improvement in PPV (using the top 0.1% of the dataset) compared to existing predictors, which corresponds to a 6-12× gain at 40% recall.

Motif Complexity and Motif Abundance Largely Explained PPV Variability

Applicant observed that some allele models were harder to learn than others, with 9-mer-specific models (MSi) PPV values ranging from 37% to 68%. This variation was not readily explained by the amount of training data available as model performance plateaus at several hundred peptides (Abelin et al. 2017) and more than 375 9-mer peptides were identified for all alleles. Since PPVs after the addition of endogenous features (MSiCEB) were strongly correlated with PPVs achieved with the simple model (Pearson's correlation=0.92, p-value<$2.2\times10^{-16}$), and since Applicant observed differences in the allele-specific motifs and sub-motifs (FIG. 32D; FIG. 33B), Applicant posited that PPV variability was driven by differential complexity in the peptide repertoire of each allele. To account for the information content of the main binding motif, Applicant summed the entropy along each peptide position, expecting that higher information content implies more easily-learned motifs. Similarly, Applicant considered all sub-motifs identified per allele by summing positional entropies over the sub-motifs, each weighted by the number of supporting peptides, and the number of submotifs normalized by the total number of peptides. Finally, Applicant utilized the natural frequency of amino acids to model the abundance of each binding motif since motifs that are more likely to occur are also more likely to contribute potential binders to the random decoy set and thereby decrease PPV. To assess if these variables were predictive of PPV, Applicant used a multivariate linear model fit, controlling for the size of the training data (Methods). PPVs predicted by the multivariate linear model strongly correlated to actual PPV values (Pearson's $\rho$=0.8, p-value<2e-16; FIG. 30F). The number of peptides identified per allele was not predictive, while the entropy of the main motif, and the number and entropy of submotifs were positively associated with PPV, and motif abundance strongly negatively contributed to PPV. Based on the model coefficients Applicant estimated that motif abundance could be responsible for ~3.4% of the unexplained PPV. An additional 1% could be due to false positive MS identification at 1% FDR (FIG. 30G). Overall, these findings suggested that limitations in prediction accuracy can be in large part attributed to motif complexity and abundance.

Peptides Proposed to be Derived from Proteasomal Splicing had Poor Predicted Binding Scores Peptides derived from proteasomally-ligated fragments ('spliced peptides') have been recently proposed as a major component of the HLA ligandome (Liepe et al. 2016; Faridi et al. 2018). Since the collection of mono-allelic data covered the HLA alleles evaluated in those studies, Applicant compared the binding potential of reported linear and splice-proposed peptide sets using the de novo predictors. Consistent with previous analyses (Mylonas et al. 2018; Rolfs et al. 2018), Applicant found that the majority of splice-proposed peptides had poor predicted binding. For example, 81% of canonical linear peptides described in Liepe et al. had an HLA-binding likelihood score >0.75 but only 28% of the splice-proposed peptides reported were recovered at the same threshold (FIG. 35B—left; Methods). Similarly, 84% of the linear peptides described in Faridi et al. had an HLA-binding likelihood score >0.75, while only 36% cis- and 37% trans-splice-proposed peptides reported satisfied the same cutoff (FIG. 35B—right). While spliced peptides have been reported to make up 30% of the HLA class I peptidome (Liepe et al. 2016), Applicants computational results suggest that no more than 11% (37% of 30%) of presented HLA ligands could be derived from spliced peptides, a number previously shown likely to be further diminished by factors such as ambiguity in peptide spectral matches and variability in sequence database search strategies (Mylonas et al. 2018).

Figure 31A:
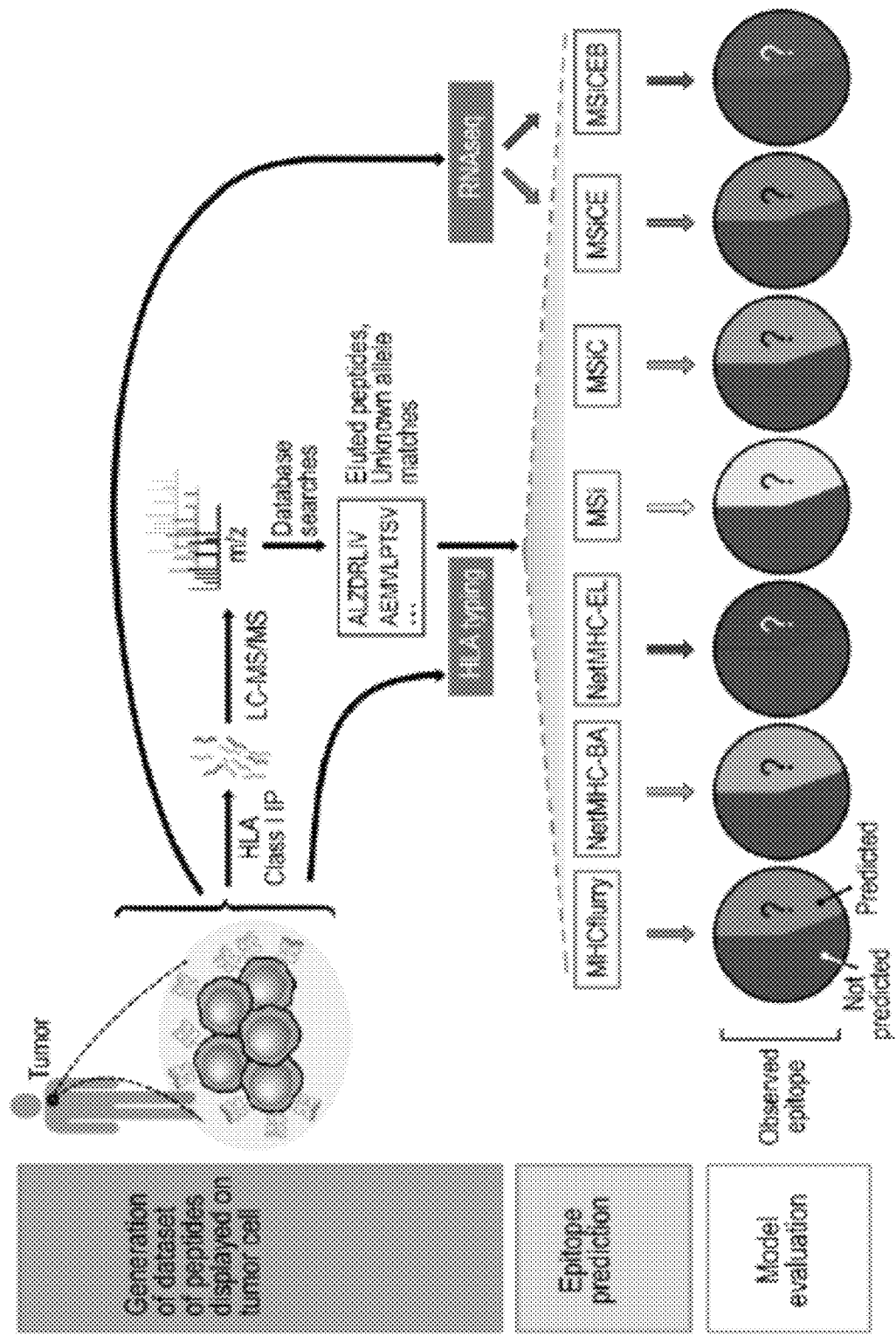
FIGS. 31A-31D—Evaluation of novel MS-based predictors against directly observed peptides displayed on primary tumor cells.
Figure 31B:
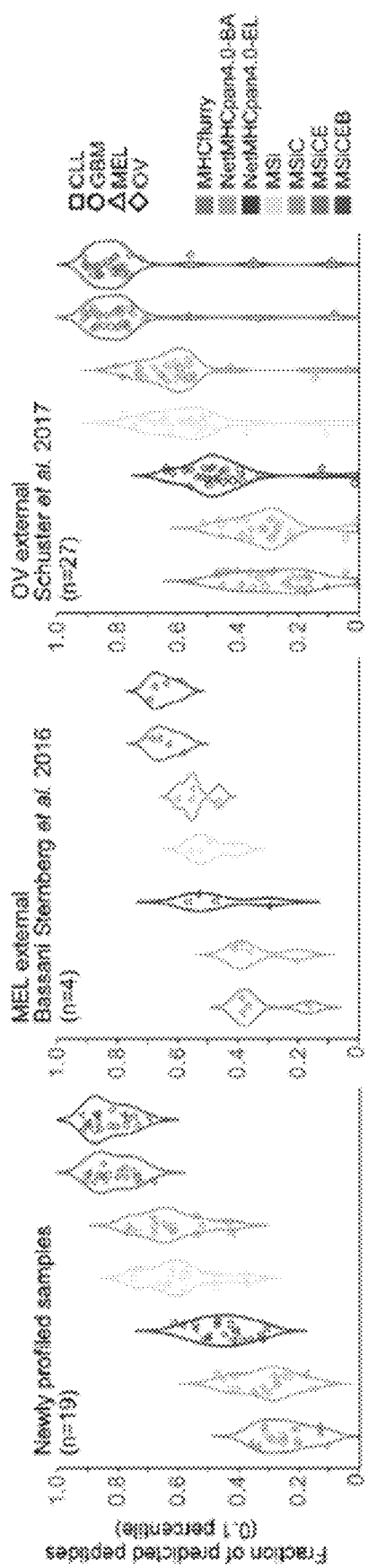

Leading Sensitivity Performance of MS-Trained Integrative Algorithms Validates in HLA-Associated Peptidomes from Patient-Derived Tumors To evaluate the utility of the predictive models for clinical samples, Applicant assessed their sensitivity to retrieve HLA-bound peptides observed on patient-derived tumor cell lines. To this end Applicant (i) used MS to identify 51,531 HLA-associated peptides from 11 tumor samples (3 chronic lymphocytic leukemia, 1 ovarian, 3 glioblastoma, 4 melanoma) and utilized external peptide datasets from 4 melanoma (Bassani-Sternberg et al. 2016) and 27 ovarian (Schuster et al. 2017) tumors; (ii) predicted the likelihood that each observed peptide is presented per HLA allele per sample; (iii) compared the proportions of correctly predicted peptides amongst a large set of random genomic peptides relative to 3 established tools (FIG. 31A). The mono-allelic dataset covered 50 of 57 unique HLA alleles found amongst the 42 patient samples used in the evaluation. For covered alleles, predictions were made with the allele-and-length-specific models, while missing alleles were scored by the pan-allele-pan-length predictors. Observed ligands which scored better than 99.9% of random peptides for at least one allele (top 0.1 percentile) were considered as correct identifications. Across malignancies, Applicant consistently observed a higher proportion of observed peptides predicted by the MS-based models compared to existing algorithms (FIG. 31B, FIG. 37). At the 0.1 percentile threshold, 26% of observed peptides were called by MHCflurry, followed by 31% and 46% predicted by NetMHCpan4.0-BA and -EL, respectively, compared to 56%, 60%, 77%, and 78% predicted by MSi, MSiC, MSiCE, and MSiCEB, on average across all samples.

Figures 31C, 31D:
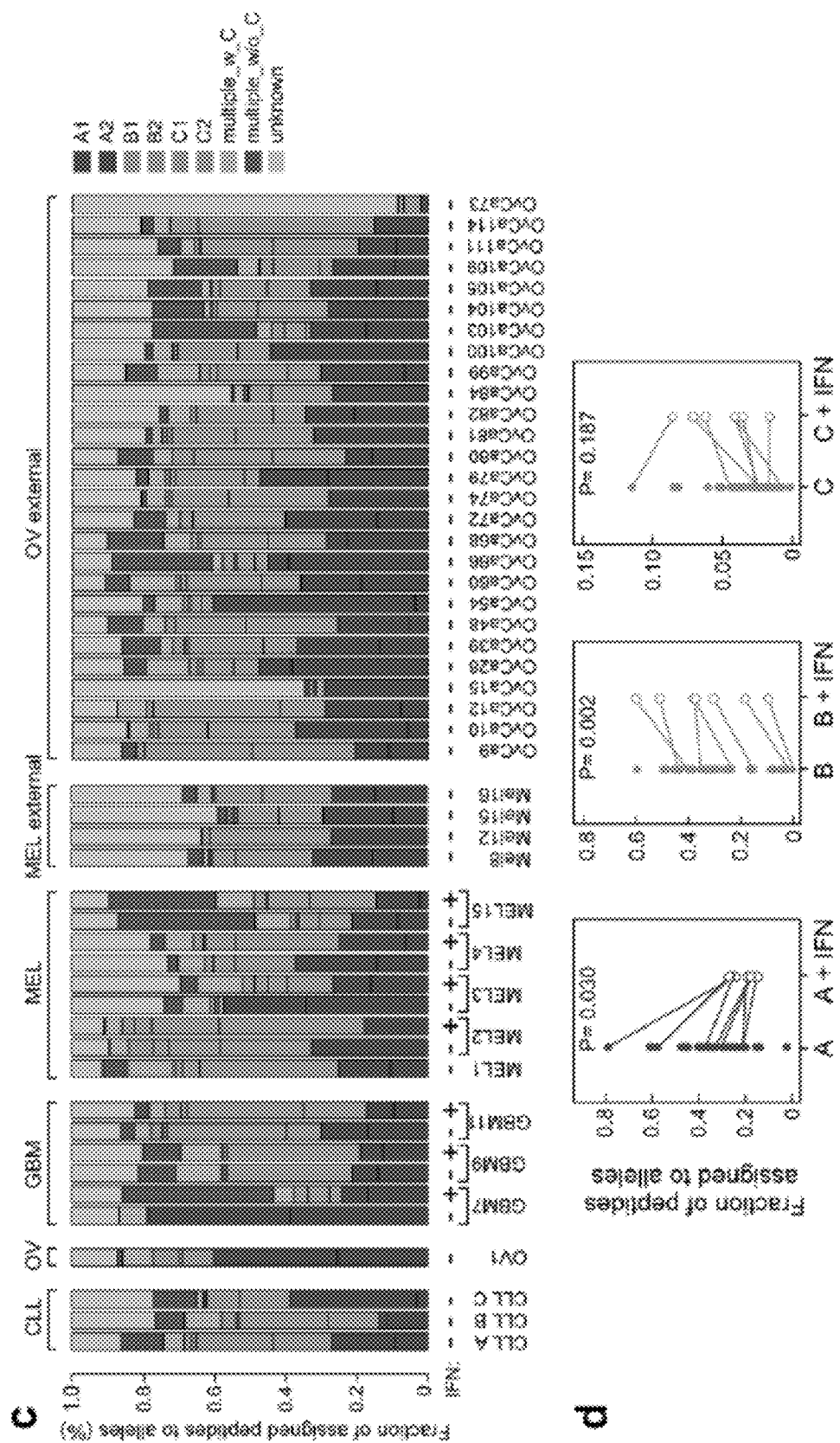

Allele Contribution to Peptide Presentation Varied by Individual and Changed with IFNγ Stimulation Since MS-detected epitopes were assigned to the best-scoring HLA-allele(s), this allowed calculation of allele frequency among the presented peptides (FIG. 31C). Notably, 3% of peptides on average were uniquely assigned to C alleles and an additional 6% of peptides were compatible with a C allele jointly with other alleles, thus suggesting that HLA-C has the potential to harbor neoantigens. In all 6 samples for which Applicant profiled HLA-associated peptidomes +/−IFNγ treatment, Applicant observed a shift towards HLA-B presentation (p=0.007, Wilcoxon signed-rank test), consistent with HLA-B having two IFNγ-inducible promoter elements (Javitt et al. 2019; Girdlestone 1995). An IFNγ-induced shift in peptide presentation from tryptic-like to chymotryptic-like peptides was demonstrated using the UWB.1 289 cell line which expresses HLA class I alleles of C-terminal tryptic motifs (A*03:01, A*68:01) and C-terminal chymotryptic-like motifs (B*07:02) (Chong et al. 2018). Although the proposed cause was different, their result is consistent with the demonstration of a more general HLA-A to HLA-B presentation shift. Consequently, Applicant further examined the +/−IFNγ patient-derived tumor cell line data and the HLA-B allele combinations of each and found elevated presentation for alleles with both tryptic and chymotryptic C-terminal preferences, suggesting that HLA-B upregulation could be at least in part responsible for a shift in presentation from tryptic-like to chymotryptic-like peptides which was observed in a cell line with a C-terminal chymotryptic-like HLA-B motif (Chong, C. et al. 2018). Finally, the contribution of each allele to the antigen repertoire varied by patient suggesting that profiling of endogenous tumor epitopes can inform allele specific contribution to an individual's HLA ligandome and further guide peptide vaccine selection.

DISCUSSION

The current study demonstrated the superior performance of HLA class I predictors trained on large-scale data of peptides eluted from cellular HLA proteins, consistent with growing appreciation of the value of MS derived datasets for the development of epitope prediction algorithms (Gfeller et al. 2018; Bulik-Sullivan et al. 2018; O'Donnell et al. 2018; Jurtz et al. 2017). For example, while earlier versions of NetMHCpan relied on binding affinity data from curated datasets, more recent versions incorporated eluted peptides from MS data to train predictors and demonstrated improved performance (Jurtz et al. 2017). Using an optimized, high-throughput experimental workflow, Applicant eluted peptides from immunoprecipitated HLA proteins and used high performance mass spectrometry followed by a refined database searching approach to build the largest dataset to date of HLA ligands eluted from single HLA-expressing cell lines. The resulting dataset of >185,000 peptides from 95 alleles greatly expands available knowledge of the human HLA-associated peptidome (Vita et al. 2015), such that at least 95% of individuals worldwide have at least one of their A, B, and C alleles within the dataset. All data are publicly available, thus providing a valuable resource for the scientific community including mass spectrometrists, immunologists as well as basic biologists. To facilitate access to the data, Applicant generated a first-in-class web-based tool for data visualization and interactive exploration and have made the predictors publicly available.

The large dataset afforded an unprecedented opportunity to gain more comprehensive insights into the basis of peptide presentation by HLA-A, -B, —C and -G alleles, each of which impacted how Applicant designed and trained the models. First, Applicant ascertained that peptide presentation does access the entire proteome for potential sources of antigen, in contrast to previous reports (Pearson et al. 2016), which relied on a small number of peptides. Second, the analysis revealed 101 peptide submotifs detected within and amongst alleles, many of which were shared across the 95 HLA alleles. Applicant observed strong similarity in physicochemical features of the HLA-C alleles along with their greater promiscuity in binding peptides, compared to the more divergent HLA-A and -B alleles. Moreover, HLA-C alleles only rarely had unique submotif clusters that were not also shared with HLA-A and B alleles, consistent with their recent evolutionary history (Parham and Moffett, 2013). This may increase competition with HLA-A and B alleles for peptides and may explain the observation that HLA-C epitopes originate from more highly expressed genes. Indeed, the degree of complexity and entropy of each allele was a strong determining feature for accuracy in prediction. Third, Applicant detected not only differences in length preference of the HLA bound peptides based on allele, but that ~10% of alleles displayed changes in epitope based on length. Altogether, the detailed knowledge that Applicant gained from the extensive dataset enabled Applicant to generate allele-and-length-specific and pan-allele-pan-length prediction models. Applicant demonstrated that the models outperformed state of the art algorithms, most prominently for understudied alleles or those with length-specific preferences. Fourth, Applicant found no major impact on proteasomal cleavage preferences across primary tumor cells of different lineages when exposed to IFNγ. While IFNγ signaling broadly modulated gene expression thereby altering the genes that HLA ligands derive from and increases presentation on HLA-B owing to its upregulation (Javitt et al. 2019), Applicant did not observe prominent differences in favored protease cleavage sites in malignant cells. This is consistent with the expression of both constitutive and immunoproteasome subunits in cancers and supports the application of a unified cleavability predictor.

Although other investigators have begun to incorporate MS data into their predictors (Jurtz et al. 2017; O'Donnell et al. 2018; Bulik-Sullivan et al. 2018; Gfeller et al. 2018), the validations on internal and external mono-allelic data as well as primary tumor ligandomes reveal that Applicant's models perform better at predicting HLA-presented epitopes compared to current tools. This can be attributed to several factors: (i) Applicant's models are the only ones trained exclusively on MS data of eluted peptides from mono-allelic cell lines; (ii) Applicant integrated several critical endogenous features, such as peptide cleavage and gene expression and make this integrated tool freely available; (iii) Applicant rich dataset reliably captured not only allele-but also length-specific motifs, widely covering the space of HLA binding preferences, and when available, Applicant preferentially predicted with allele-and-length-specific models for their demonstrated accuracy over pan-allele-pan-length predictors which were employed for uncharacterized alleles.

Despite improvements in epitope prediction, Applicant recognizes that further innovations are required if Applicants are to achieve near perfect accuracy. Applicant offers evidence that allele complexity and motif abundance may partially drive the observed variability in prediction power across alleles. The former implies a benefit in obtaining even larger training datasets, while the latter necessitates techniques to determine non-binders at large scale to collect reliable true negative datasets against which to evaluate model performance. Other innovations that could further boost prediction accuracy include increased LC-MS/MS instrument sensitivity and the development of reliable methods for de novo HLA peptide identification. Pertinent to peptide presentation prediction in tumor cells, better accuracy can be achieved by taking into account the uneven allele utilization and weighting predictions accordingly. While Applicant includes expression as a variable in the predictions, it is important to note that RNA-seq of tumors may not be representative of all clones and usually includes non-malignant cells, making it necessary to purify malignant cells for expression measurements. Finally, Applicant emphasizes that the models do not predict whether the HLA-presented peptides can interact with the T cell receptors in an individual, a problem that remains unsolved.

Data Availability

The original mass spectra, the protein sequence database, and tables of peptide spectrum matches for each allele have been deposited in the public proteomics repository MassIVE and are accessible at ftp://MSV?@massive.ucsd.edu when providing the dataset password: immunopeptidome. If requested, also provide the username: MSV?. Data for 16 initial alleles can be downloaded from MassIVE under the identifier MassIVE: MSV000080527.

B721.221 RNA Seq Data is Deposited GSE131267.

Melanoma RNA-seq data are deposited in dbGaP (www.ncbi.nlm.nih.gov/projects/gap/cgi-bin/study.cgi?study_id=phs001451.v1.p1, (Ott et al. 2017)). Glioblastoma bulk RNA-seq data are available through dbGaP (www.ncbi.nlm.nih.gov/gap) with accession number phs001519.v1.p1 ref.

Methods

Generation of HLA-A, B and C single allele cell lines. Single HLA allele-expressing cDNA vectors in a pcDNA-3 backbone were ordered from GenScript@. The HLA class I deficient B721.221 cell line was transfected with the HLA allele expression vectors using lipofectamine, as described previously (Ott, P. A. et al. 2017; and Pearson, H. et al. 2016). Cell lines with stable surface HLA expression were generated first through selection using 800 μg/ml G418 (Thermo Scientific), followed by enrichment of HLA positive cells through up to 2 serial rounds of fluorescence-activated cell sorting (FACS) and isolation using a pan-HLA antibody (W6/32; Santa Cruz) on a FACSAria II instrument (BD Biosciences). Priority was given to HLA alleles with lack of binding data in public databases or over 1% frequency in the US organ donor registry populations13.

Generation of primary human samples. All human tissues were obtained through DFCI or Partners Healthcare approved IRB protocols. Conditions for growth and in vitro propagation of melanoma and GBM tumor cell lines and of monocyte-derived dendritic cells were described previously15,37. PBMC from patients with chronic lymphocytic leukemia (CLL) were enriched for CD19 positive CLL tumor cells and were used in IP/MS analysis. Tumor specimens from patients with clear cell renal cell carcinoma (ccRCC) were collected following informed consent for enrollment on a tissue collection research protocol approved by the Dana-Farber/Harvard Cancer Center Institutional Review Board (IRB). Surgically resected ccRCC tumor tissue was mechanically dissociated with scalpels, and then enzymatically dissociated using a mixture of collagenase D (Roche), Dispase (STEMCELL Technologies), and DNase I (New England BioLabs) at room temperature, and filtered through a 100 micron cell strainer using the sterile plunger of a syringe. Red blood cells were lysed using ammonium-chloride-potassium buffer (Gibco). The cell suspension was stained for viability (Zombie Aqua; BioLegend), anti-CD45 (BV605; BD Biosciences), and anti-carbonic anhydrase IX (PE; R&D Systems). Viable, CD45-negative, CAIX-positive tumor cells were isolated by FACS (BD FACSAria II cell sorter; BD Biosciences). Cells were cultured in a specialized growth medium consisting of OptiMEM GlutaMax media (Gibco), 5% fetal bovine serum, 1 mM sodium pyruvate (Gibco), 100 units/mL penicillin and streptomycin, 50 micrograms/mL gentamicin, 5 micrograms/mL insulin (Sigma), and 5 ng/mL epidermal growth factor (Sigma). Following successive passages, CAIX expression was confirmed by flow cytometry (anti-CAIX, PE-conjugated; R&D Systems) and by immunohistochemical analysis of a cell pellet. Ovarian cancer patient-derived cells were propagated within a xenograft model, which was generated by serial passaging of tumor cells from a patient with advanced ovarian cancer. These cells originated from solid tumor or pleural effusion (3 million cells/mouse) that were injected orthotopically in the abdominal cavity in NOD-SCID mice (8-week old, Jackson labs). Tumor growth was monitored weekly by observing mice for signs of abdominal distension. Cells were harvested 4 months after initial injection and banked for future experiments. For interferon stimulation, cultured cells were stimulated with 2000 Unit/ml of IFNg (Peprotech) for 3 days and were used in IP/MS analysis.

For primary tumors and patient cell lines, HLA-peptide complexes were immunoprecipitated from 0.1 to 0.2 g tissue or up to 50 million cells. Solid tumor samples were dissociated using tissue homogenizer (Fisher Scientific 150) and HLA complexes were enriched as described above. 10 mm skin punch biopsies were obtained from healthy human skin discarded during skin surgeries. Subcutaneous fat was removed and remaining skin was snap frozen prior to processing. For skin HLA immunoprecipitations, frozen samples were dissociated in lysis buffer using TissueRuptor™ before immunoprecipitation (Qiagen).

HLA peptide enrichment and LC-MS/MS analysis. Soluble lysates from up to 50 million single HLA expressing B721-221 cells were immunoprecipitated with W6/32 antibody (sc-32235, Santa Cruz) as described previously (Abelin, J. G. et al. 2017). 10 mM iodoacetamide was added to the lysis buffer to alkylate cysteines for 71 alleles. Peptides of up to three IPs were combined, acid eluted either on StageTips or SepPak cartridges32, and analyzed in technical duplicates using LC-MS/MS. Peptides were resuspended in 3% ACN, 5% FA and loaded onto an analytical column (20-30 cm, 1.9 m C18 Reprosil beads (Dr. Maisch HPLC GmbH), packed in-house PicoFrit 75 M inner diameter, 10 µM emitter (New Objective)). Peptides were eluted with a linear gradient (EasyNanoLC 1000 or 1200, Thermo Scientific) ranging from 6-30% Buffer B (either 0.1% FA or 0.5% AcOH and 80% or 90% ACN) over 84 min, 30-90% B over 9 min and held at 90% Buffer B for 5 min at 200 nl/min. During data dependent acquisition, peptides were analyzed on a QExactive Plus (QE+), QExactive HF (QE-HF) or Fusion Lumos (Thermo Scientific). Full scan MS was acquired at a resolution of 70,000 (QE+) or 60,000 (QE-HF and Lumos) from 300-1,800 m/z or 300-1,700 m/z (Lumos). AGC target was set to 1e6 and 5 msec max injection time for QE type instruments and 4e5 and 50 ms for Lumos. The top 10 (Lumos, QE+), 12 (QE+), 15 (QE-HF) precursors per cycle were subjected to HCD fragmentation at resolution 17,500 (QE+) or 15,000 (QE-HF, Lumos). The isolation width was set to 1.7 m/z with a 0.3 m/z offset for QE and 1.0 m.z and no offset for Lumos, the collision energy was set to optimal for the instrument used ranging from 25 to 30 NCE, AGC target was 5E4 and max fill time 120 ms (QE+ and Lumos) or 100 ms (QE-HF). For Lumos measurements, precursors of 800-1700 m/z were also subjected to fragmentation if they were singly charged. Dynamic exclusion was enabled with a duration of 15 sec (QE+), 10 secs (QE-HF) or 5 sec (Lumos). Up to four IPs were combined, acid eluted and analyzed in inject replicates.

HLA peptide identification using Spectrum Mill. Mass spectra were interpreted using the Spectrum Mill software package v6.1 pre-Release (Agilent Technologies, Santa Clara, CA). MS/MS spectra were excluded from searching if they did not have a precursor MH+ in the range of 600-4000, had a precursor charge >5, or had a minimum of <5 detected peaks. Merging of similar spectra with the same precursor m/z acquired in the same chromatographic peak was disabled. Prior to searches, all MS/MS spectra had to pass the spectral quality filter with a sequence tag length >2 (i.e. minimum of 4 masses separated by the in-chain masses of 3 amino acids). MS/MS spectra were searched against a protein sequence database that contained 98,298 entries, including all UCSC Genome Browser genes with hg19 annotation of the genome and its protein coding transcripts (63,691 entries), common human virus sequences (30,181 entries), recurrently mutated proteins observed in tumors from 26 tissues (4,167 entries), as well as 259 common laboratory contaminants including proteins present in cell culture media and immunoprecipitation reagents. Mutation files for 26 tumor tissue types were obtained from the Broad GDAC portal (gdac.broadinstitute.org). Recurrent mutations in the coding region within each of the 26 tumor types (frequency=3 for stomach adenocarcinoma, uterine corpus endometrial carcinoma; frequency=5 for adrenocortical carcinoma, pancreatic adenocarcinoma, melanoma; frequency=2 for rest) were included. MS/MS search parameters included: no-enzyme specificity; fixed modification: cysteinylation of cysteine; variable modifications: carbamidomethylation of cysteine, oxidation of methionine, and pyroglutamic acid at peptide N-terminal glutamine; precursor mass tolerance of ±10 ppm; product mass tolerance of +10 ppm, and a minimum matched peak intensity of 30%. Variable modification of carbamidomethylation of cysteine was only used for HLA alleles that included an alkylation step (performed in 2017 or later). Peptide spectrum matches (PSMs) for individual spectra were automatically designated as confidently assigned using the Spectrum Mill autovalidation module to apply target-decoy based FDR estimation at the PSM level of <1% FDR. Peptide auto-validation was done separately for each HLA allele with an auto thresholds strategy to optimize score and delta Rank1-Rank2 score thresholds separately for each precursor charge state (1 thru 4) across all LC-MS/MS runs for an HLA allele. Score threshold determination also required that peptides had a minimum sequence length of 7, and PSMs had a minimum backbone cleavage score (BCS) of 5. BCS is a peptide sequence coverage metric and the BCS threshold enforces a uniformly higher minimum sequence coverage for each PSM, at least 4 or 5 residues of unambiguous sequence. The BCS score is a sum after assigning a 1 or 0 between each pair of adjacent AA's in the sequence (max score is peptide length-1). To receive a score, cleavage of the peptide backbone must be supported by the presence of a primary ion type for HCD: b, y, or internal ion C-terminus (i.e. if the internal ion is for PWN then BCS is credited only for the backbone bond after the N). The BCS metric serves to decrease false-positives associated with spectra having fragmentation in a limited portion of the peptide that yields multiple ion types. PSMs were consolidated to the peptide level to generate lists of confidently observed peptides for each allele using the Spectrum Mill Protein/Peptide summary module's Peptide-Distinct mode with filtering distinct peptides set to case sensitive. A distinct peptide was the single highest scoring PSM of a peptide detected for each allele. MS/MS spectra for a particular peptide may have been recorded multiple times (e.g. as different precursor charge states, from replicate IPs, from replicate LC-MS/MS injections). Different modification states observed for a peptide were each reported when containing amino acids configured to allow variable modification; a lowercase letter indicates the variable modification (C-cysteinylated, c-carbamidomethylated).

MS/MS data from patient derived cell lines was handled as described above except that they were searched against the database mentioned above with further inclusion of patient specific neoantigen sequences (Ott, P. A. et al. 2017; and Keskin, D. B. et al. 2019).

Filtering of MS-identified peptides. The list of LC-MS/MS identified peptides was filtered to remove potential contaminants in the following ways: (1) peptides observed in negative controls runs (blank beads and blank IPs); (2) peptides originating from the following species: 'STRSG', 'HEVBR', 'ANGI0432', 'ANGI0394', 'ANGI0785', 'ANGI0530', 'ACHLY', 'PIG', 'ANGI0523', 'RABIT', 'STAAU', 'CHICK', 'Pierce-iRT', 'SOYBN', 'ARMRU', 'SHEEP' as common laboratory contaminants including proteins present immunoprecipitation reagents. Note that BOVINE peptides derived from cell culture media were not excluded as they appear to have undergone processing and presentation and exhibit anchor residue motifs consistent with the human peptides observed for each allele; (3) peptides which were also identified in a tryptically-digested full proteome Jurkat sample; (4) peptides for which both the preceding and C-term amino acids were tryptic residues (R or K); (5) all possible leader peptides of lengths 8-11 from HLA-A, -B, -C, and -G (first exon, n=410) as they are likely to be presented by HLA-E; (6) peptides with negative deltaFwRevScore as likely falling in the 1% false positive MS identifications; (7) peptides identified for 20 or more of the 95 alleles (n=168); (8) peptides identified as potential C*01:02 contaminants in other alleles due to residual C*01:02 expression in B721.221 (n=383). These peptides were identified by scoring all peptides with the allele-specific C*01:02 model and selecting those with predicted likelihood binding score >0.95 that were also outlier for the allele (mean distance to the nearest 10 peptides >90 percentile).

RNA sequencing and quantification of B721.221 mono allelic cell lines and patient cell lines. RNA from 721.221 cells expressing HLA-C*04:01 and C*07:01 was isolated using RNeasy mini kit (QIAGEN). The Nextera XT kit from Illumina and the Smart-seq2 protocol were employed to generate full length cDNA and sequencing libraries that were sequenced with (38 bp paired-end) on a Nextseq 550 (Ilumina). The data were deposited in the NCBI Gene Expression Omnibus (GEO accession number GSE131267). This new data was used in conjunction with RNA-seq data from four previously sequenced alleles: HLA-A*29:02, B*51:01, B*54:01, and B*57:01 (GSE93315)4.

RNA-Seq data were aligned to the UCSC transcriptome annotation (hg19, downloaded June 2015) using Bowtie2 (bowtie2-2.2.1, default parameters38) and gene expression was quantified using to RSEM (rsem-1.2.19, default parameters39). Transcripts per million (TPM) values were averaged across alleles and the expression of each peptide was determined as the sum of the expression of the transcripts containing that peptide.

RNA-seq data from melanoma and glioblastoma patient cell lines were available in dbGaP (www.ncbi.nlm.nih.gov/projects/gap/cgi-bin/study.cgi?study_id=phs001451.v1.p1) 15 and (www.ncbi.nlm.nih.gov/projects/gap/cgi-bin/study.cgi?study_id=phs001519.v1.p1)37.

Deep proteome profiling of the B721.221 cell line and GBM H4512-BT145. Protein expression of B721.221 and GBM H4152-BT145 cell line was assessed as described previously40. Briefly, cell pellets of B721 expressing A*03:01, B*55:01 and C*07:01 as well as pellets of H4512-BT145 with and without IFNγ treatment were lysed in 8M Urea and digested to peptides using LysC and Trypsin (Promega). For GBM, peptides were labeled with TMT before pooling (Thermo Fisher), B721 analysis was performed labelfree with a 1:1:1 mix using the three monoallelic cell lines. 100 µg peptides were pooled and separated into 24 fractions using offline high pH reversed phase fractionation. One g per fraction was loaded onto an analytical column (20-30 cm, 1.9 um C18 Reprosil beads (Dr. Maisch), packed in-house PicoFrit 75 uM inner diameter, 10 uM emitter (New Objective)). Peptides were eluted with a linear gradient (EasyNanoLC 1000 or 1200, Thermo Scientific) ranging from 6-30% Buffer B (either 0.1% FA or 0.5% AcOH and 80% or 90% ACN) over 84 min, 30-90% B over 9 min and held at 90% Buffer B for 5 min at 200 nl/min. During data dependent acquisition, peptides were analyzed on a Fusion Lumos (Thermo Scientific). Full scan MS was acquired at a 60,000 from 300-1,800 m/z. AGC target was set to 4e5 and 50 ms. The top 20 precursors per cycle were subjected to HCD fragmentation at 15,000 resolution with an isolation width of 0.7 m/z, 30 NCE, 3e4 AGC target and 50 ms max injection time. For TMT experiments, resolution was set to 60,000 and 34NCE. Dynamic exclusion was enabled with a duration of 45 sec.

Spectra were searched using Spectrum Mill against the above database, specifying Trypsin/P as digestion enzyme, allowing 4 missed cleavages. Carbamidomethylation was set to fixed, acetylation at the protein N-terminus, oxidized methionine, pyroglutamic acid, deamidated asparagine and pyrocarbamidomethyl cysteine were set as variable modifications. Match tolerances were set to 20 ppm on MS1 and MS2 level. Peptides were filtered to 1% FDR and rolled up into protein groups. For comparison to RNAseq and HLA peptide data, proteins were collapsed to gene level using human identifiers only and filtered for two unique peptides per gene. For label free quantitation, the summed intensities of observed peptides for a given protein was divided by the theoretical count of tryptic peptides in that protein (iBAQ)[41]. For the GBM experiment in FIG. 29B, the ratio of protein level TMT intensity of the 127 channel over the 126 channel was used to evaluate relative protein changes in protein expression upon IFNγ treatment in the GBM sample.

Calculation of HLA Allele population frequencies, related to FIGS. 26A-26D. The HLA-A, -B, and -C allele frequencies are based on a meta-analysis of high-resolution HLA allele frequency data describing 497 population samples representing approximately 66,800 individuals from throughout the world[14]. The cumulative phenotypic frequency (CPF) of the alleles was calculated using $CPF = 1 - (1 - \Sigma_{i \in C} p_i)^2$, assuming Hardy-Weinberg proportions for the genotypes[12], where $p_i$ is the population frequency of the $i^{th}$ alleles within a subset of HLA-A, -B, or C alleles, denoted C.

The top 13 alleles (from A*24:02 to A*34:01) cover more than 95% and the top 29 alleles cover almost 100% of the population, the 39 B-alleles cover more than 95% of the population, the top 13 alleles (from C*07:02 to C*14:02) cover more than 95% of the population and the top 22 alleles cover almost 100% of the population. Frequencies were taken from pypop.org/popdata/2008/byfreq-A.php.html, pypop.org/popdata/2008/byfreq-B.php.html, www.pypop.org/popdata/2008/byfreq-C.php.

Immune Epitope Database (IEDB) data access and preparation, related to FIGS. 26A-26D. A curated set of previously identified HLA class I ligand was downloaded from the Immune Epitope Database (IEDB) at www.iedb.org/ downloader.php?file_name=doc/mhc_ligand_full.zip (accessed on Jun. 14, 2018)[36]. Records were filtered to MHC allele class=I, Epitope Object Type=Linear peptide, and Allele Name consistent with human HLA class I nomenclature with 4-digit typing (i.e. regex: "^HLA-[ABCG]\\*[0-9]{2}:[0-9]{2}$"). Peptides with quantitative measurements in units other than nM were removed and so were the following three assay types due to detected inconsistency between predicted (NetMHC 3.0) and actual affinity: "purified MHC/direct/radioactivity/dissociation constant KD", "purified MHC/direct/fluorescence/half maximal effective concentration (EC50)" and "cellular MHC/direct/fluorescence/half maximal effective concentration (EC50)". A peptide was considered a binder if it had a quantitative affinity of <500 nM or qualitative label of "Positive", "Positive-High", "Positive-Intermediate", or "Positive-Low". In cases where multiple records are available for the same {peptide, allele}pair, Applicant either took the mean affinity or removed the peptide when the difference between the maximum and minimum log-transformed affinities (1−log(nM)/log(50000)) was >0.2. Similarly, peptides with multiple qualitative records were removed if the same number of positive and negative labels were found or kept otherwise. Previously published data for 16 HLA-A and B alleles was removed from the analysis of IEDB counts (PubMedID=28228285).

Computational Analyses of MS-Identified and IEDB Peptides, Related to FIGS. 26A-26d.

Sequence Logo Plots

To capture and compare binding motifs between groups of peptides, sequence logo plots were generated using the motifStack R package for MS-identified peptides (FIG. 32I) and IEDB peptides (FIG. 32J) of length 8, 9, 10, and 11. Sequence logos are a standard way of representing the frequency of each of the 20 amino acids at each peptide position together with the information content (entropy) at each peptide position: the overall height of each position is determined by the entropy at that position and the height of each amino acid within is scaled according to its frequency.

Entropy

Figure 32K:
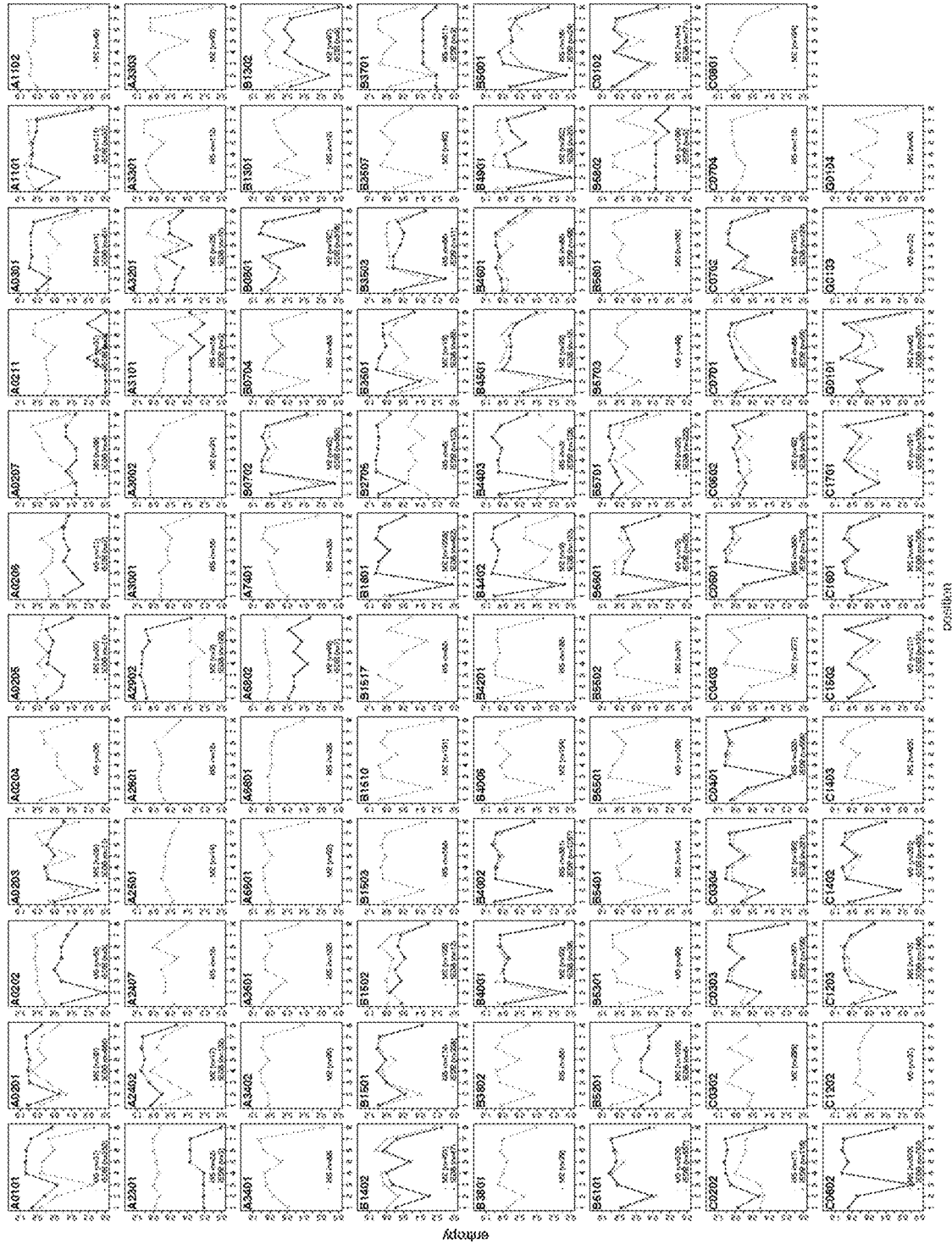
FIG. 32K) Entropy plots per peptide length (8-11 mers) for 95 alleles for MS and IEDB data.
Figure 32K:
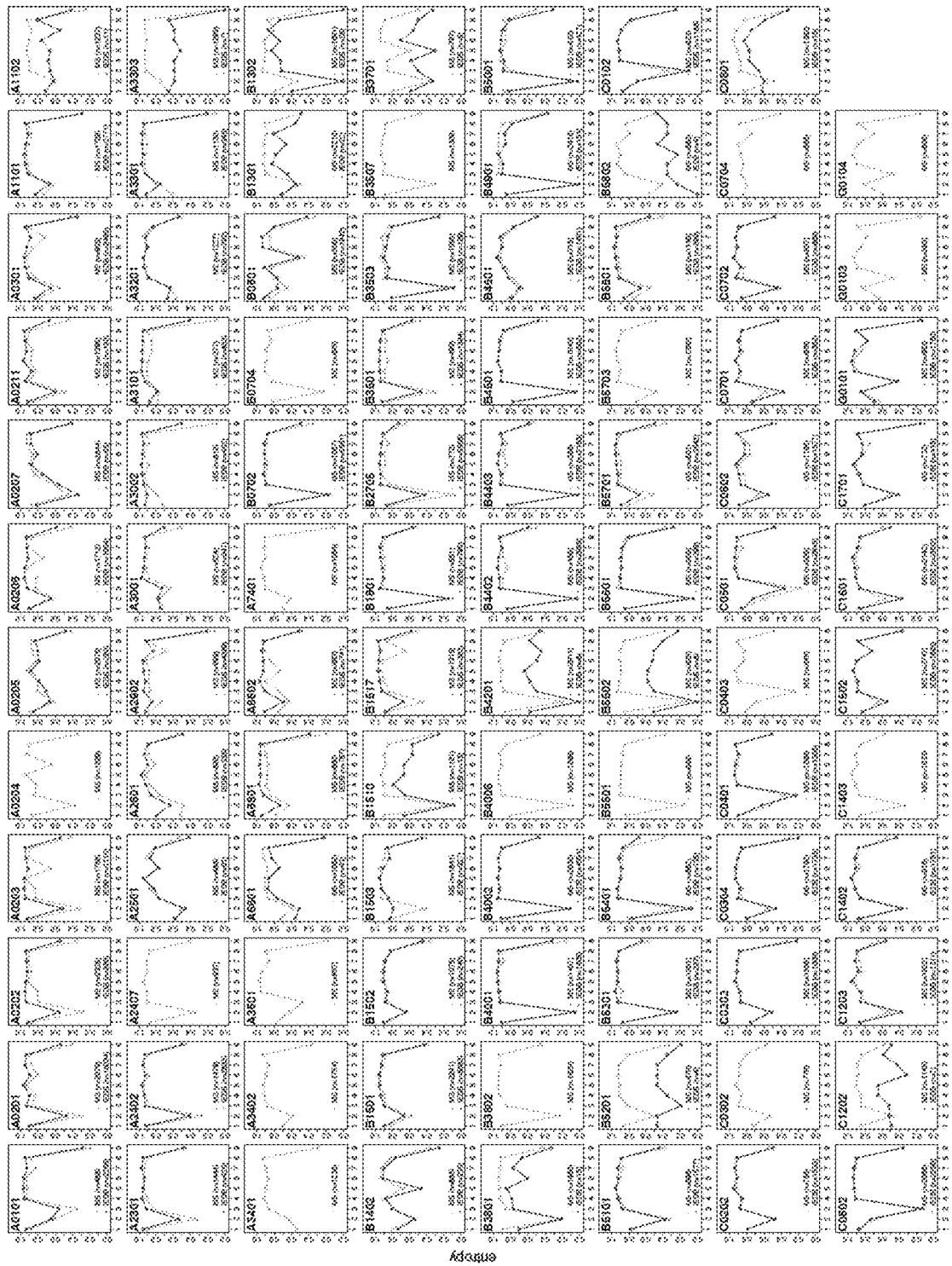
Figure 32K:
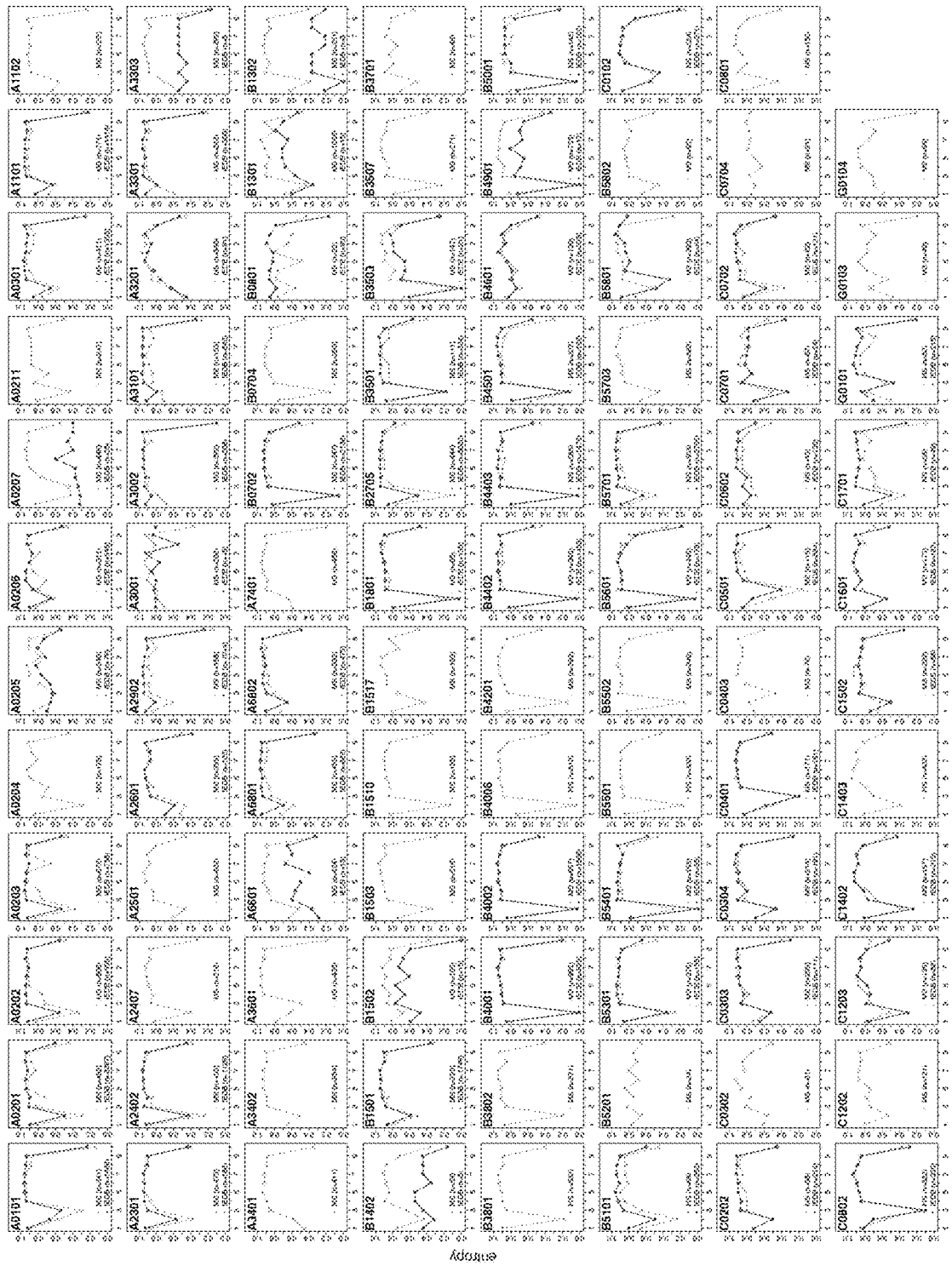
Figure 32K:
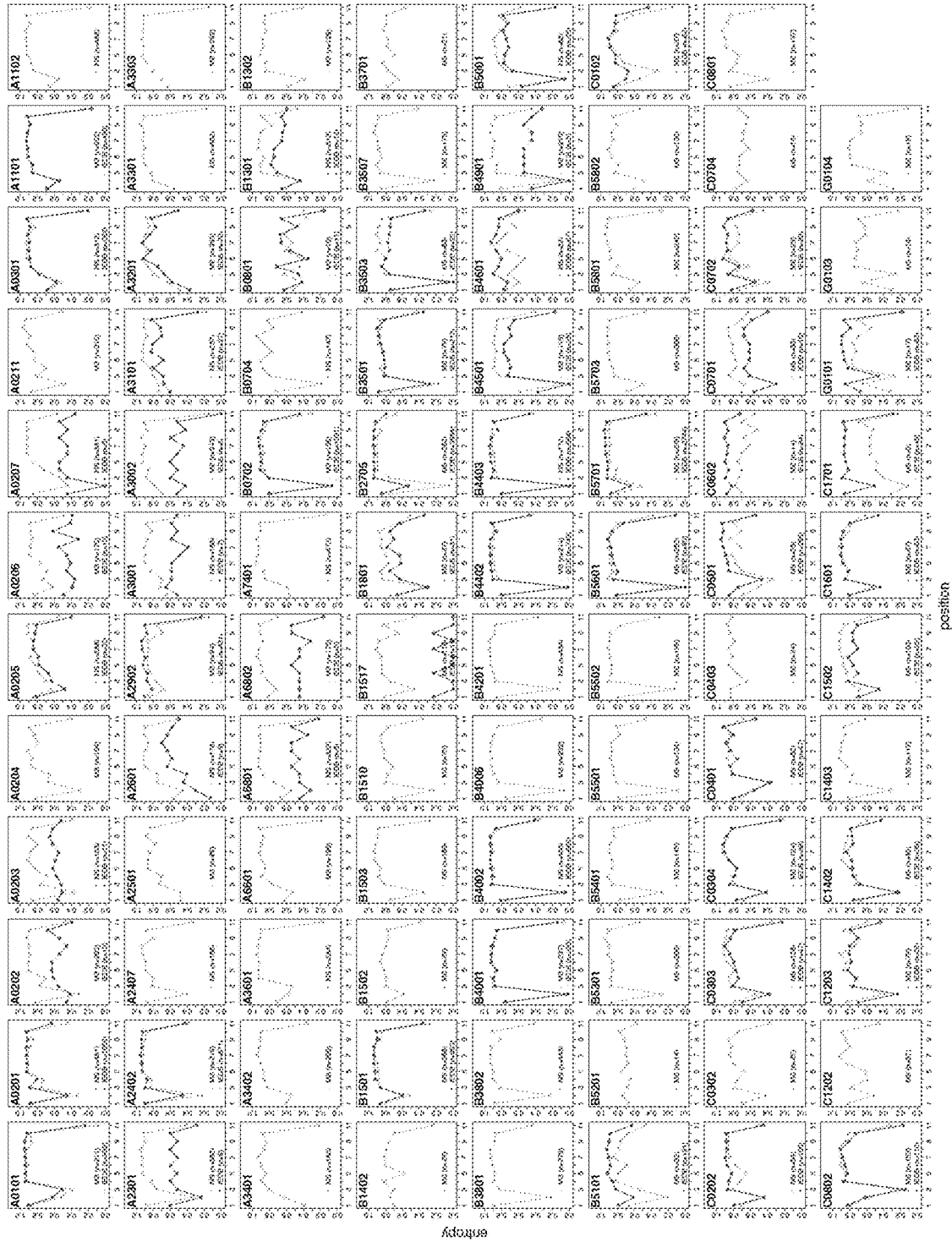
Figure 32L:
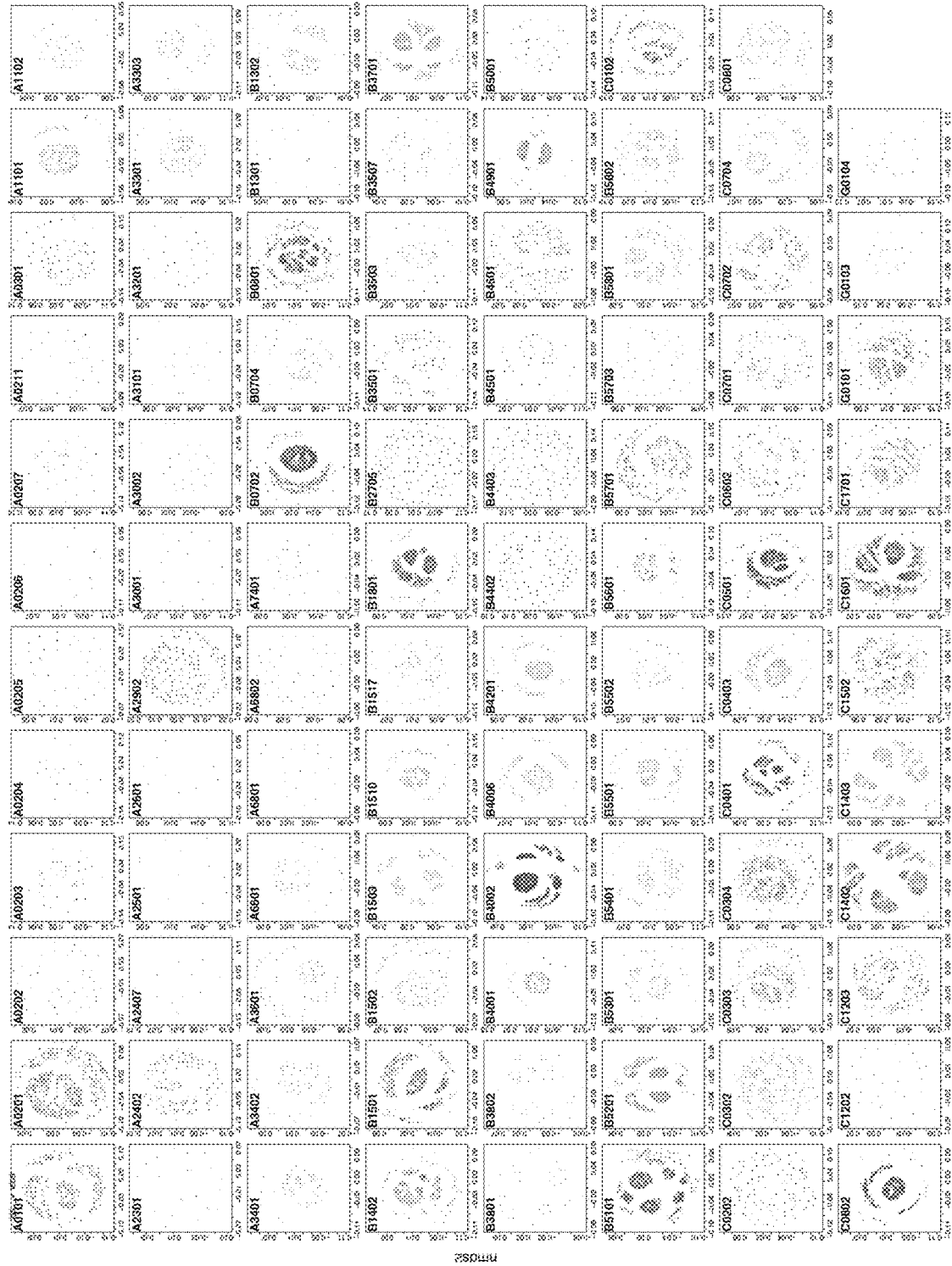
FIG. 32L) NMDS plots per peptide length (8-11 mers) for 95 alleles overlaying MS and IEDB data.
Figure 32L:
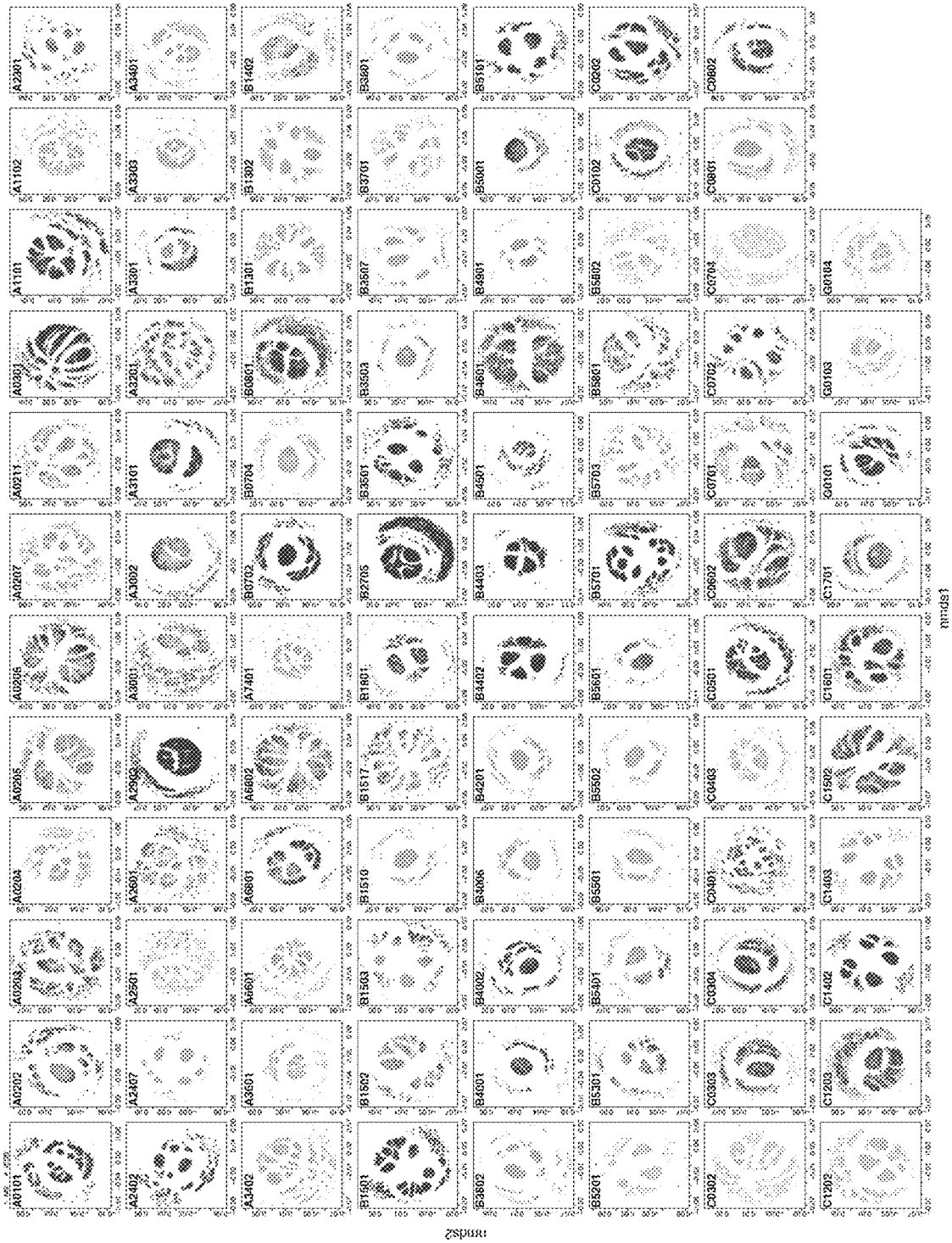
Figure 32L:
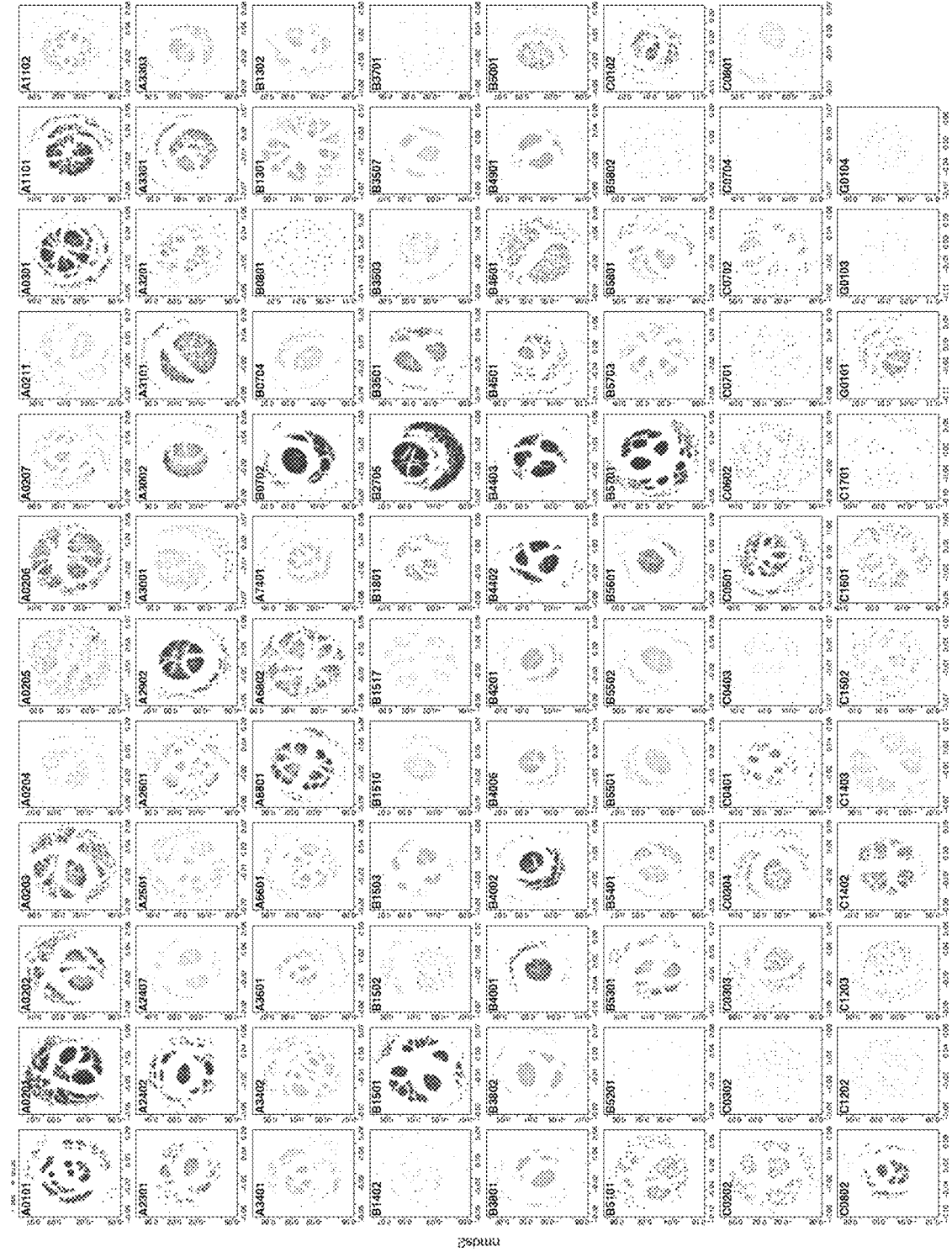
Figure 32L:
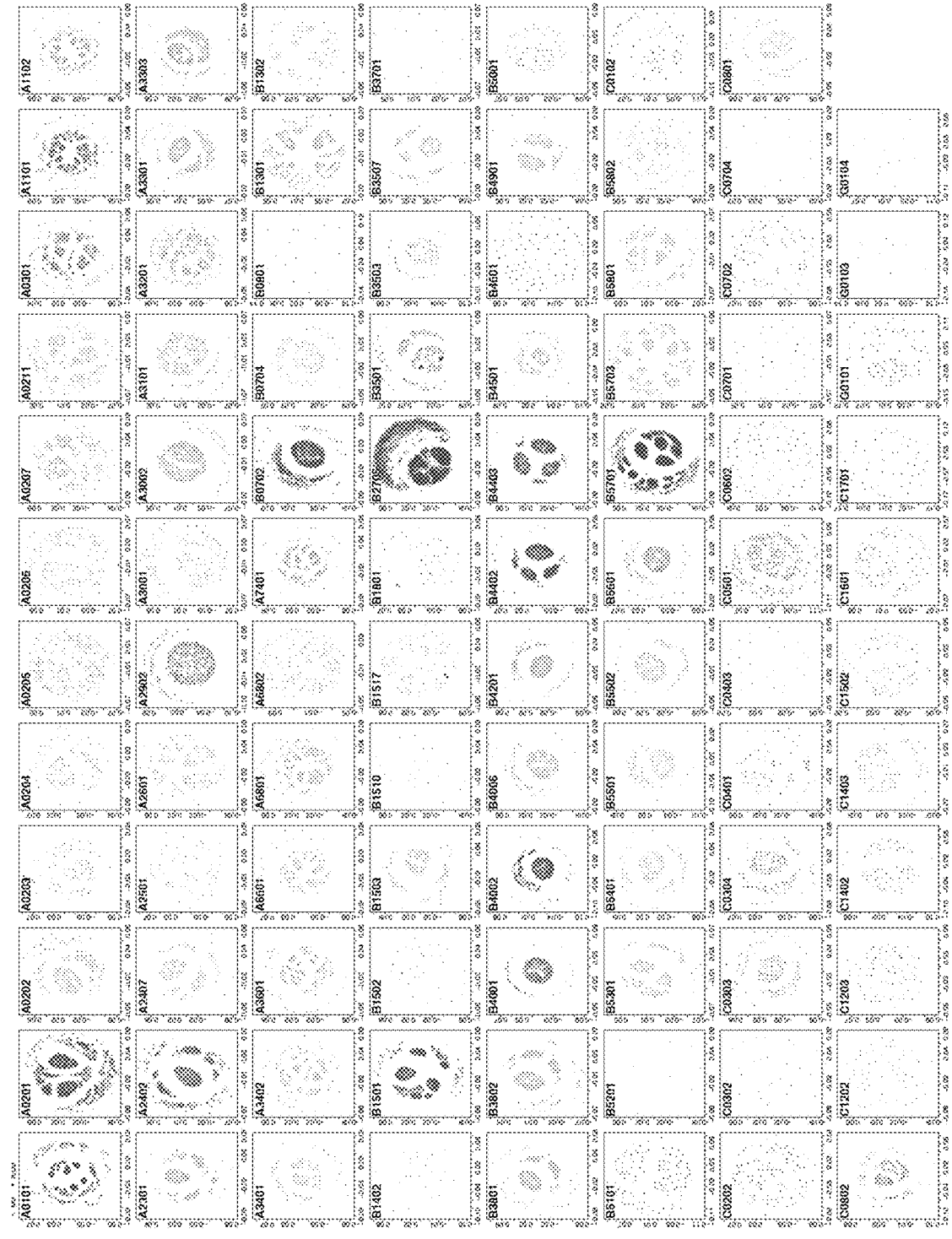

The entropy at each peptide position (i.e. 1 through n for n-mer peptides, n∈{8,9,10,11}) was calculated for each allele based on all MS-identified peptides identified for that allele (MS entropy) and then similarly for all IEDB binders (nM<500) (IEDB entropy). The computation was performed with MolecularEntropy( ) function from HDMD R package, where entropy values are normalized by log(20) such that entropy of 0 indicates a position with no variation while entropy of 1 indicates that all amino acids are equally likely to be observed at that position (FIG. 32K).

Peptide Distance

The following peptide distance metric was defined and computed between every pair of peptides of given length in the MS and IEDB sets:

$$D(A, s_1, s_2) = \frac{1}{L}\sum_{i=1}^{L} distPMBEC(s_{1i}, s_{2i}) * (1 - H_{Ai})$$

where $s_1$ and $s_2$ are peptide sequences; L is the length of the peptide sequences, n∈{8,9,10,11}; distPMBEC=maxPMBEC−PMBEC is a 20×20 matrix of residue dissimilarities derived from a pre-computed matrix of residue similarities biased by their HLA binding properties[42]; $H_{Ai}$ is the [0,1]-scaled entropy at position i for the allele A associated with $s_1$ and $s_2$, computed from the MS data.

Peptide Distance Visualization and Sub-Clustering of Binding Motifs

Pairwise peptide distance matrices per allele and per length (8-11) were computed between every pair of peptides in the MS and IEDB datasets as described above. Since the matrix contains relative peptide distances rather than absolute Cartesian coordinates, Applicant used non-metric multidimensional scaling (NMDS) to visualize the peptides in two demotions, revealing the sub-groups of peptides that make up the main motif (nmds( ) function from ecodist R package) (FIG. 32K). Density based clustering was then performed on the two-dimensional projection to assign peptides to clusters (submotifs) (dbscan( ) function from dbscan R package) (FIG. 32K, FIG. 33B).

Allele similarity analyses, related to FIGS. 27A-27D. To assess which alleles are similar to each other Applicant considered similarity according to the observed binding motifs (peptide space) as well as similarity according to the HLA binding grooves (HLA binding pocket or HLA protein space). Similarity in peptide space was evaluated by tabulating the frequency of each of the 20 amino acids at each position along the peptide sequence (1 through 9) per allele, forming a vector of size 20*9=180. The pairwise correlations of these frequency vectors were used to quantify similarity (FIG. 27A).

To evaluate similarity in HLA binding pocket space, HLA protein sequences were downloaded from IMGT®, the international ImMunoGeneTics information System® www.imgt.org (hla.alleles.org/alleles/text_index.html, accessed May 5, 2018) and aligned. From the full HLA protein sequences Applicants selected positions which are in contact with the peptide (within a distance of 2A) or positions that are most frequently mutated across alleles to represent the binding pocket: {7, 9, 13, 24, 31, 45, 59, 62, 63, 65, 66, 67, 69, 70, 71, 73, 74, 76, 77, 80, 81, 84, 95, 97, 99, 110, 114, 116, 118, 138, 143, 147, 150, 152, 156, 158, 159, 163, 167, 171}(FIG. 27B). The residue at each position of the binding pocket was featurized by its amino acid physical properties encoded as 10 Kidera Factors (available from R package Peptides v2.4, data(AAdata))[43] and 3 principal components derived from a dimensionality reduction of a large set of physicochemical properties[44]. The full binding pocket was represented by the concatenated list of positions and allele similarity was assessed by Euclidean distance.

Given the two approaches to evaluating allele similarity (motif space and pocket space), Applicants assessed how well they agree by identifying the closest neighbors for each allele in motif space and the closest neighbors for each allele in pocket space and counting how many of the former are also found in the latter (FIG. 33A). The closest neighbor in motif space were considered to be alleles with correlation greater than 97.5% of all pairwise correlations. Analogously, closest neighbor alleles in pocket space were considered to be alleles within distance less than 97.5% of all pairwise distances.

Figure 33C:
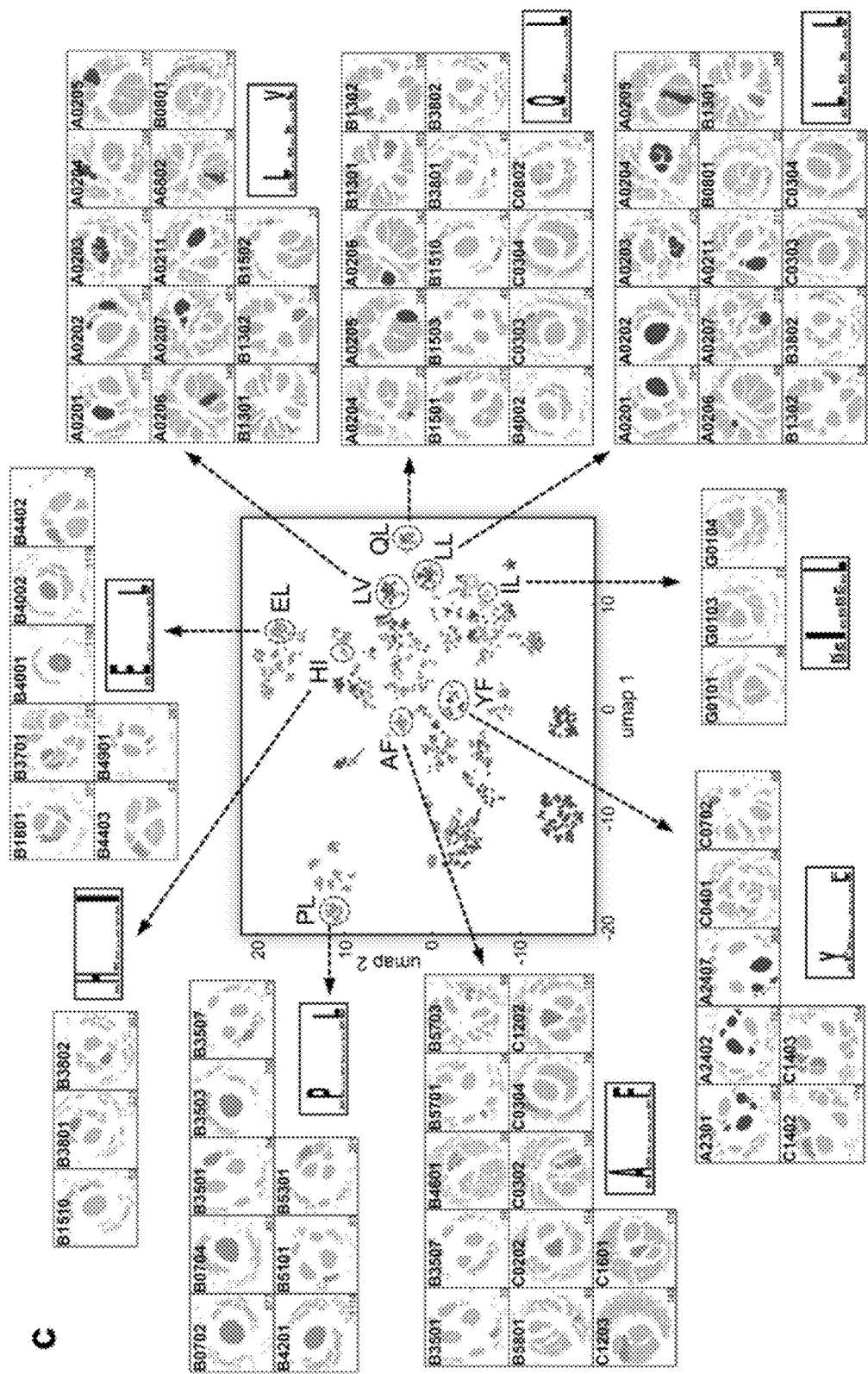

Analysis of submotifs across alleles, related to FIGS. 27A-27D. Grouping the 9-mer peptides identified for each allele into sub-motifs (see Peptide distance visualization and sub-clustering of binding motifs) identified 1133 sub-motifs across the 95 alleles supported by at least 20 peptides (FIG. 27D, FIG. 33C). To determine whether any of those sub-motifs are shared by two or more alleles, each sub-motif was represented as a vector of amino acid frequencies per peptide position (analogously to main motifs representation in allele similarity analysis), projected onto two dimensions (umap( ) function from R package umap v0.2)45, and clustered (dbscan( ) function from dbscan R package). This approach identified 101 distinct clusters of sub-motifs with 1-22 alleles participating in each (FIGS. 27C and 27D, FIGS. 33B, 33C).

Evaluation and validation of length-dependent motif differences, related to FIGS. 28A-28G. To compare 8-mer motifs to 9-mer motifs, Applicant generated pseudo 8-mer motifs from 9-mers by dropping middle residues (positions 4, 5, or 6). To compare 10- and 11-mer motifs to 9-mers Applicant generated pseudo 9-mer motifs by dropping middle residues from 10-mers (positions 5 or 6) and 11-mers (positions 5 and 6, or 6 and 7). The pseudo motif which was most similar to the true motif was used to evaluate the change in frequency and entropy at every peptide position. 8-, 10-, or 11-mer motifs with at least 100 identified peptides, that had an absolute difference in residue frequency with the true motif of >0.25 or an absolute difference in entropy of >0.2 at any position were considered as different. For example, if proline is observed at position 5 in 5% of peptides associated with motif1 but 40% of peptides associated with motif2 the absolute difference in frequency is 10.05-0.40|=0.35>0.25, thus deeming motif1 and motif2 different.

To experimentally validate the observed length-specific motifs Applicant selected 18 peptides from 3 alleles representing 4 length-specific motifs that were predicted to be strong binders by the algorithm (MSi) but weak binders according to NetMHCpan-4.0 and tested them for binding in in vitro binding assays. Peptide affinity measurements were performed at Immunitrack, Copenhagen, Denmark employing their NeoScreen platform as previously described[46].

Computation validation of IFNγ treatment response, related to FIGS. 29A-29F. For each MEL, GBM, and ccRCC sample with and without IFNγ treatment Applicant counted the number of MS-identified HLA-bound peptides that match to IFNγ-induced genes using entries in the HALLMARK_INTERFERON_GAMMA_RESPONSE geneset46 (downloaded from software.broadinstitute.org/gsea/msigdb/download_geneset.jsp?geneSetName=HALLMARK_INTERFERON_GAMMA_RESPONSE&fileType=txt). The fraction of peptides that map to IFNγ genes in untreated vs treated samples was used as a proxy for confirming IFNγ response.

Analysis of Peptide Processing Signatures, Related to FIGS. 29A-29F.

The analysis of preferred cleavage residues upstream and downstream of each MS-identified peptide was performed as in Abelin et al, 2017. Briefly, for each MS-identified peptide (hit), the 3 upstream and 3 downstream amino acids were determined (context), with protein termini denoted as "-". To construct a background set, each hit was matched to 100 random human peptides that have the same first two and last two amino acids as the hit (to control for presentation biases). Peptide processing preferences were identified by calculating the relative enrichment of each amino acid at each context position (percent change in hits over decoys) and significance was assessed by chi-squared test. (FIGS. 29D, 29E).

This approach was applied to all MEL, GBM, and ccRCC+/−IFNγ samples profiled in this study to compare peptide processing signatures with and without IFNγ stimulation. In addition, a published datasets of lung cancer cells, untreated (UT) or treated with TNFα and IFNγ (T+I), was utilized in this analysis25. As the reported peptides were identified using MaxQuant with match between runs enabled, all peptides have an intensity value in both conditions. Thus, to derive the two processing signatures Applicant took peptides with log 10 median intensity >6 from either UT ('-IFNγ' signature) or T+I ('+IFNγ' signature) condition.

PPV vs PPV at 40% Recall, related to FIGS. 30A-30G. To evaluate predictive power, Applicants constructed datasets consisting of the observed allele- and length-specific binders in the MS data (n) along with 999*n random decoys from the human proteome and considered the fraction of correctly predicted binders in the top 0.1% of the dataset (i.e. positive true positive calls true positive calls predictive value, $$\left(\text{i.e. positive predictive value,} \quad PPV = \frac{\text{true positive calls}}{\text{all positive calls}} = \frac{\text{true positive calls}}{n}\right).$$

Applicants advocated for the PPV evaluation metric in Abelin et al.[4], over the commonly used AUC, because it is better suited for the HLA presentation prediction problem space where a relatively small number of true binders need to be identified amongst an excess of non-binders. Each HLA allele is expected to present a repertoire of approximately ~10,000 peptides[36,48-51] among the $1.1 \times 10^7$ 9-mer peptides in the proteome, meaning that approximately only 1 out of a thousand peptides (0.1%) gets presented.

The definition of PPV described above is equivalent to PPV at recall=PPV % since the number of positive calls equals the number of true positives. A different version of this metric used recently to quantify algorithm performance is PPV at recall=40%, that is $$PPV_{40\% \ Recall} = \frac{\text{true positive calls}}{\text{all positive calls}} = \frac{\text{true positive calls}^7}{\text{positive calls when 40\% of the } n \text{ true positives have been called}}.$$

In addition, Bulik-Sullivan et al. used a dataset with a ratio of 1 hit:10,000 decoys for the evaluation of single-allele dataset, rather than a ratio of 1:999 used by Applicants, which reduced PPV. Due to these differences, model performance evaluated with PPV is not comparable to model performance evaluated with $PPV_{40\% \ recall, \ h:d=1:10000}$ (FIG. 30D).

Assessment of Predictive Contribution of Variables, Related to FIGS. 30A-30G.

The potential contribution of intracellular signals to predicting endogenously-presented peptides was assessed by building multivariate logistic regression models with various combinations of the following features4:

RNA-seq expression—the level of expression of each peptide was determined as the sum of the expression of the transcripts containing that peptide, and log-transformed ($\log_2(\text{TPM}+1)$).

Ribo-seq expression—the translation level of each peptide was derived from Ribo-seq data from mono-allelic B721.221 cells analogously to RNA-seq quantification.

Protein expression—iBAQ values, calculated by summing the intensities of observed peptides for a given gene by the theoretical count of tryptic peptides in the gene[41], were log-transformed (with zeros set to one tenth the minimum observed iBAQ value).

Cleavability likelihood: the cleavability score of each peptide was predicted by a de novo cleavability predictor trained on external multi-allelic MS-data[4].

Presentation bias—the HLA-presentation bias of each gene was calculated based on the log ratio of observed to expected MS-identified peptides. The number of observed peptides per gene was the count of unique 9-mers in the collection of B721.221 mono-allelic MS data that map to the gene (protein IDs and GeneSymbol IDs were mapped via tables kgProtAlias, kgXref available from genome.ucsc.edu/cgi-bin/hgTables). The number of expected peptides per gene was defined as all possible unique 9-mers tiled along the length of the protein, multiplied by the expression level of the corresponding gene (to account for the increased likelihood of observing a peptide with higher expression), and scaled to sum to the total number of observed peptides.

Localization—the cellular localization of each peptide was assigned according to the localization(s) of its source protein(s). Protein localization information was obtained from Uniprot (ftp.uniprot.org/pub/databases/uniprot/current_release/knowledgebase/complete/uniprot_sprot.dat.gz) and Uniprot IDs were mapped to UCSC annotations via the following tables ftp.uniprot.org/pub/databases/uniprot/current_release/knowledgebase/idmapping/by_organism/HUMAN_9606_idmapping.dat.gz, genome.ucsc.edu/cgi-bin/hgTables kgProtAlias, kgXref. Protein localization categories were represented by 7 binary variables corresponding to "Cell Membrane" (if the localization field contained the text "cell membrane"), "Mitochondria" ("mitochondr"), "Nucleus" ("nucle"), "Cytoplasm" ("cytoplasm"), "ER" ("Endoplasmic reticulum"), "Secreted" ("secret"), "Late Endosome" ("late endo").

The first feature in each multivariate model was the predicted likelihood of peptide-HLA binding according to the MS-based models (MSi, see next section). The cumulative contribution of each endogenous variable was evaluated by iteratively adding them to the multivariate model one at a time. The most informative feature was retained in the model and the process was repeated with the remaining variables. Multivariate models were built for each allele, utilizing 9-mer peptides only, and performance was evaluated by PPV (see previous section). The incremental gain in average PPV across the 95 alleles was considered as the contribution of each variable.

Prediction of Cleavability, Related to FIG. 30.

A novel cleavability predictor based on MS data was developed as previously described[4]. Briefly, a neural network model was trained on previously published HLA-IP MS identifications[32] where a negative set was generated by selecting 10 length- and termini-matched (first two and last two positions) peptides from the human proteome per positive. To ensure that targets and decoys would be drawn from a similar set of source genes, the 10 were selected at random (with replacement) using a probability weight proportional to the number of positive training examples mapping to the source transcript. Each training example is a sequence that captures 30 upstream residues, the peptide, and 30 downstream residues. Residues were binary encoded (i.e. isA, isC, isD, isE, isF, isG, isH, isI, isK, isL, isM, isN, isP, isQ, isR, isS, isT, isV, isW, isY, and isBlank) where isBlank represents a transcript termini, and also represented by their properties (i.e. pKA, volume, and polarity (www.proteinsandproteomics.org/content/free/tables_1/table08.pdf)). Featurized positions included U3, U2, U1, N1, N2, N3, C3, C2, C1, D1, D2, and D3 as well as a weighted average of positions U30 ... U4 (W=1 ... 27), a weighted average of positions D4 ... D30 (W=27 ... 1), and an unweighted average of positions N3 ... C3. These data were used to train a neural network (2 hidden layers of 50 and 10 nodes; 20% dropout for regularization; keras neural networks library (github.com/fchollet/keras)).

Assessment of predictive contribution of variables, related to FIG. 30. The potential contribution of intracellular signals to predicting endogenously-presented peptides was assessed by building multivariate logistic regression models with various combinations of the following features[4]:

1. RNA-seq expression—the level of expression of each peptide was determined as the sum of the expression of the transcripts containing that peptide, and log-transformed ($\log_2(TPM+1)$).
2. Ribo-seq expression—the translation level of each peptide was derived from Ribo-seq data from monoallelic B721.221 cells analogously to RNA-seq quantification.
3. Protein expression—iBAQ values, calculated by summing the intensities of observed peptides for a given gene by the theoretical count of tryptic peptides in the gene[41], were log-transformed (with zeros set to one tenth the minimum observed iBAQ value).
4. Cleavability likelihood: the cleavability score of each peptide was predicted by a de novo cleavability predictor trained on external multi-allelic MS-data as in Applicants previous work[4] (described in the previous section). When a peptide could be mapped to multiple source proteins the average of the cleavability scores was taken.
5. Presentation bias—the HLA-presentation bias of each gene was calculated based on the log ratio of observed to expected MS-identified peptides. The number of observed peptides per gene was the count of unique 9-mers in the collection of B721.221 mono-allelic MS data that map to the gene (protein IDs and GeneSymbol IDs were mapped via tables kgProtAlias, kgXref available from genome.ucsc.edu/cgi-bin/hgTables). The number of expected peptides per gene was defined as all possible unique 9-mers tiled along the length of the protein, multiplied by the expression level of the corresponding gene (to account for the increased likelihood of observing a peptide with higher expression), and scaled to sum to the total number of observed peptides.
6. Localization—the cellular localization of each peptide was assigned according to the localization(s) of its source protein(s). Protein localization information was obtained from Uniprot (ftp.uniprot.org/pub/databases/uniprot/current_release/knowledgebase/complete/uniprot_sprot.dat.gz) and Uniprot IDs were mapped to UCSC annotations via the following tables ftp.uniprot.org/pub/databases/uniprot/current_release/knowledgebase/idmapping/by_organism/HUMAN_9606_idmapping.dat.gz, genome.ucsc.edu/cgi-bin/hgTables kgProtAlias, kgXref. Protein localization categories were represented by 7 binary variables corresponding to "Cell Membrane" (if the localization field contained the text "cell membrane"), "Mitochondria" ("mitochondr"), "Nucleus" ("nucle"), "Cytoplasm" ("cytoplasm"), "ER" ("Endoplasmic reticulum"), "Secreted" ("secret"), "Late Endosome" ("late endo").

The first feature in each multivariate model was the predicted likelihood of peptide-HLA binding according to the MS-based machine leaning models (MSi, see next section). Applicants utilized the MS-trained predictors as the first variable, instead of NetMHC affinity, in order to account for any MS data properties which might have overestimated the contribution of cleavability which was the first MS data-based feature in the previous analysis. The cumulative contribution of each endogenous variable was evaluated by iteratively adding them to the multivariate model one at a time. The most informative feature was retained in the model and the process was repeated with the remaining variables. Multivariate models were built for each allele, utilizing 9-mer peptides only, and performance was evaluated by PPV (see previous section). The incremental gain in average PPV across the 95 alleles was considered as the contribution of each variable.

Development of Integrative HLA-Binding Prediction Models.

Overview of Model Training Procedure

Machine learning models were created to predict the likelihood that a given peptide will be endogenously presented by a given HLA class I molecule. The positive training set consisted of MS-identified peptides from the set of 95 B721.221 mono-allelic cell lines (hits). The negative set consisted of random peptides drawn from the human proteome which did not overlap with the hits (decoys). Note that one decoys set was used for training and a separate non-overlapping decoy set was used for evaluation. The number of positive and negative training examples were balanced by sampling 10× #hits decoys, and sampling the hits 10 times with replacement (this was done after splitting the data into folds to ensure that each hit is only present in one unique fold). Training was carried out in a standard 5-fold cross validation (CV) procedure: training data was split into 5 equal parts, each part was left out one at a time and a model was trained on the remaining 4 parts, obtaining 5 models each of which is evaluated on its corresponding left out set. The 5-fold CV training was repeated 3 times with different model initialization random seeds. The final predictions score for each peptide was the average of the 3 initializations. Neural network models were trained using the Theano and keras python libraries.

Allele-and-Length-Specific Models

To build models that are both allele- and length-specific only the MS-hits identified for that particular allele and length were used to train the model. This was done for each of the 95 alleles and for lengths 8, 9, 10, and 11 where at least 40 peptides were identified. The MSIntrinsic (or MSi) neural network models were fully-connected with one hidden layer of size 50 and tanh activation. Training was carried out in batches of size 30, for 10 epochs, and early-stopping determined by evaluating on a 20% hold-out partition of the training set to avoid overfitting. Three different models were trained with three different encodings of the peptide sequence: (1) one-hot (a.k.a. Binary or dummy) encoding; (2) similarity encoding using the blosum62 matrix; (3) similarity encoding based on the PMBEC matrix[42]. In addition to the peptide sequence encoding features, the MSi models included the following features:

1. Amino acid properties—each peptide residue was represented by the first three principal components derived from a dimensionality reduction of a large set of physicochemical properties 4.
2. Peptide-level characteristic—8 peptide-level features were computed with the R package peptides: "boman", "hmoment", "hydrophobicity", "helixbend", "sidechain", "xstr", "partspec", "pkc".

The logit-transformed output scores from MSi models were used as input features to train logistic regression models that integrate endogenous signals: MSiC models were trained with two features (MSi scores, and cleavability), MSiCE were trained with three input features (MSi scores, cleavability, and expression), and MSiCEB were trained with four input features (MSi scores, cleavability, expression, and presentation bias). Note that despite expression having a larger predictive contribution over cleavability, the cleavability feature is incorporated first to the integrative models (i.e. MSiC, MSiCE instead of MSiE, MSiEC) to allow for samples which lack expression data to utilize the cleavability since upstream and downstream peptide context sequences are readily available from the source protein.

Pan-Allele-Pan-Length Models

Pan models were trained similarly with some differences. A single panMSi model was trained with all 8-11-mer peptides identified across the 95 alleles. The panMSi neural networks had additional input features to describe the binding pocket of the HLA protein—each binding pocket residue was represented with 10 Kidera factors and 3 PCs (see Allele similarity analyses, related to FIGS. 27A-27D). The size of the hidden layer was 250, batch size was 5000, and the hidden layer activation function was rectified linear unit (ReLU). Training proceeded for 15 epochs with early-stopping determined by lack of improvement in 4 consecutive epochs.

To construct integrative pan models Applicant considered the four HLA genes (HLA-A, HLA-B, HLA-C, and HLA-G) and the four lengths (8, 9, 10, 11) separately: linear panMSiC, panMSiCE, and panMSiCEB models were trained for all HLA-A alleles and peptides of length 8, all HLA-A alleles and peptides of length 9, all HLA-A alleles and peptides of length 10, and all HLA-A alleles and peptides of length 10, and analogously for HLA-B, C, and G.

Modelling PPV Variability, Related to FIGS. 30A-30G

A linear regression model was trained to predict the achieved PPV (MSi, 9-mer models) given the following variables:

1. The total number of 9-mer hits observed for the allele
2. The sum of entropies at positions 1 through 9 (main motif entropy)
3. The number of identified submotifs for the allele
4. The sum of submotif entropies
5. Estimated abundance of the binding motif calculated by weighting the frequency of each residue at each peptide position by the natural abundance frequency of each of the 20 amino acids.

Evaluation of model performance in multi-allelic samples, related to FIGS. 31A-31D. To evaluate model performance in multi-allelic patient samples, each tumor-presented peptide was scored for binding to each of the sample-specific HLA alleles. To compare scores for different alleles, each score was converted to percentile rank. To this end, empirical cumulative distribution functions (R package stats, function ecdf( )) were computed for each model (including benchmark algorithms) from the scores of a background set of 1e6 random decoys. Each decoy set was constructed such that it contains proportions of 8, 9, 10, and 11-mers that are equal to the observed length distribution for the allele (or the HLA gene in the case of pan models). A peptide was considered to be correctly identified as a binder if the predicted binding score for at least one of the alleles in the sample was better than 99.9% of the scores in the corresponding decoy set (0.1 percentile rank; evolution was also performed at different rank thresholds, FIGS. 36). This approach is very similar to the % Ranks introduced by NetMHC8. A peptide was assigned to the allele(s) for which it had % rank score <0.1, where assignment to more than one allele was allowed.

Data availability. The original mass spectra for 79 newly described mono-allelic datasets, the protein sequence database, and tables of peptide spectrum matches for all 95 alleles have been deposited in the public proteomics repository MassIVE (massive.ucsd.edu) and are accessible at ftp://MSV000084172@massive.ucsd.edu when providing the dataset password: monoallelic. If requested, also provide the username: MSV000084172. Mass spectrometry data for the 16 previously published mono-allelic datasets in MassIVE can be downloaded at ftp://massive.ucsd.edu/MSV000080527. Datasets for the patient samples are accessible at ftp://MSV000084198@massive.ucsd.edu when providing the dataset username: MSV000084198 and password: patients.

B721.221 RNA seq data for HLA-C(C*04:01, C*07:01) is deposited under GEO: GSE131267. Melanoma RNA-seq data are deposited in dbGaP (www.ncbi.nlm.nih.gov/projects/gap/cgi-bin/study.cgi?study_id=phs001451.v1.p1[15]). Glioblastoma bulk RNA-seq data are available through dbGaP (www.ncbi.nlm.nih.gov/gap) with accession number phs001519.v1.p1[37].

Example 3—Prediction of Peptide Binding Based on Crystal Structure of HLA Molecules This example describes the method for predicting peptides that are capable of binding to a given HLA molecule based on its crystal structure. HLA protein structure information is used to improve binding prediction. A key step to developing a model is validation of the model using peptides that bind to the HLA allele as described herein (i.e., >185,000 peptides eluted from 95 HLA-A, B, C and G mono-allelic cell lines). In certain embodiments, structural features are combined with the prediction methods based on one or more variables selected from the group consisting of peptide sequence, amino acid physical properties, peptide physical properties, expression level of the source protein of a peptide within a cell, protein stability, protein translation rate, protein degradation rate, translational efficiencies from ribosomal profiling, protein cleavability, protein localization, motifs of host proteins that facilitate TAP transport, whether host protein is subject to autophagy, motifs that favor ribosomal stalling, protein features that favor nonsense-mediated mRNA decay (NMD) and peptide cleavability.

The crystal structures for HLA molecules are obtained from the Protein Data Bank (PDB, www.rcsb.org). The structure of binding pocket for each HLA molecule is provided. Applicants developed a protein-peptide docking tool by modifying FlexPepDock and coarse-grained Monte Carlo protein-peptide docking procedures. The simulation process is initiated by inputting a starting structure (i.e. side-chain prepacked to avoid interference) and a set of peptides (Raveh et al., Rosetta FlexPepDock ab-initio: simultaneous folding, docking and refinement of peptides onto their receptors. PLoS One. 2011; 6:e18934.). For each starting structure, 200 output models are generated. For each peptide, approximately 30 million docking modeling are tested. Feature maps for each peptide are generated, and the total energy, interface energy, peptide energy, and a weighted sum of all energies are assessed (FIG. 38). Based on these simulations, Applicants extract features that are used to train the prediction model. These features are used for training a variety models for predicting the binding of peptides to a given HLA allele molecule.

As a proof of concept, the applicants used three different models for training that use the identical input data sets. These models include DUMMY model, 1D model, and CNN model. The DUMMY model is characterized by using single hidden layer neural network and peptide sequence information only. The features of DUMMY model include dummy peptide encoding, PCA peptide encoding, and Kidera peptide-level features. The 1D model is characterized by single hidden layer neural network and uses of structural feature with 19 channels of 9(peptide)*100 (HLA) positions. The CNN model is characterized by convolutional neural network that convolves along the peptide in windows of 3 residues, using structure feature with 19 channels of 9(peptide)*100 (HLA) positions, and slower to train. The models can be evaluated by using any of the peptides bound to alleles as described herein. The models can be further trained using the features that most closely predict actual peptides identified as binding to an HLA allele as described herein. Three HLA alleles (A02:01, A11:01, and B14:02) were used to evaluate the models. The numbers of positive for the allele (npos) and negative for the allele (nneg) of peptides along with the unique number of decoys (ndec) used in training and evaluation are shown in FIG. 39. The residues with bit score are also shown in FIG. 39. The results show that generally the CNN model has the best performance when evaluated in both metrics of area under the curve for the ROC curve (AUC, FIG. 40A) and positive predictive value (PPV, FIG. 40B). For alleles A02:01 and A11:01, the CNN model and the 1D model achieved high scores for both AUC and PPV, while the DUMMY model yields much lower values in AUC and PPV. For allele B14:02, the three models yield similar values in AUC and PPV (FIG. 40A-40B).

REFERENCES

1. Lefranc, M.-P. et al. IMGT®, the international ImMunoGeneTics information System® 25 years on. *Nucleic Acids Res.* 43, D413-22 (2015).
2. Robinson, J. et al. The IPD and IMGT/HLA database: allele variant databases. *Nucleic Acids Res.* 43, D423-31 (2015).
3. Jurtz, V. et al. NetMHCpan-4.0: Improved Peptide-MHC Class I Interaction Predictions Integrating Eluted Ligand and Peptide Binding Affinity Data. *The Journal of Immunology* 199, 3360-3368 (2017).
4. Abelin, J. G. et al. Mass Spectrometry Profiling of HLA-Associated Peptidomes in Mono-allelic Cells Enables More Accurate Epitope Prediction. *Immunity* 46, 315-326 (2017).
5. O'Donnell, T. J. et al. MHCflurry: Open-Source Class I MHC Binding Affinity Prediction. *Cell Syst* 7, 129-132.e4 (2018).
6. Gfeller, D. et al. The Length Distribution and Multiple Specificity of Naturally Presented HLA-I Ligands. *J. Immunol.* 201, 3705-3716 (2018).
7. Bulik-Sullivan, B. et al. Deep learning using tumor HLA peptide mass spectrometry datasets improves neoantigen identification. *Nat. Biotechnol.* (2018). doi:10.1038/nbt.4313.
8. Nielsen, M. & Andreatta, M. NetMHCpan-3.0; improved prediction of binding to MHC class I molecules integrating information from multiple receptor and peptide length datasets. *Genome Med.* 8, 33 (2016).
9. Rajasagi, M. et al. Systematic identification of personal tumor-specific neoantigens in chronic lymphocytic leukemia. *Blood* 124, 453-462 (2014).
10. de Kruijf, E. M. et al. HLA-E and HLA-G expression in classical HLA class I-negative tumors is of prognostic value for clinical outcome of early breast cancer patients. *J. Immunol.* 185, 7452-7459 (2010).
11. Zhang, R.-L. et al. Predictive value of different proportion of lesion HLA-G expression in colorectal cancer. *Oncotarget* 8, 107441-107451 (2017).
12. Dawson, D. V., Ozgur, M., Sari, K., Ghanayem, M. & Kostyu, D. D. Ramifications of HLA class I polymorphism and population genetics for vaccine development. *Genet. Epidemiol.* 20, 87-106 (2001).
13. Gragert, L., Madbouly, A., Freeman, J. & Maiers, M. Six-locus high resolution HLA haplotype frequencies derived from mixed-resolution DNA typing for the entire US donor registry. *Hum. Immunol.* 74, 1313-1320 (2013).
14. Solberg, O. D. et al. Balancing selection and heterogeneity across the classical human leukocyte antigen loci: a meta-analytic review of 497 population studies. *Hum. Immunol.* 69, 443-464 (2008).
15. Ott, P. A. et al. An immunogenic personal neoantigen vaccine for patients with melanoma. *Nature* 547, 217-221 (2017).
16. Pearson, H. et al. MHC class I-associated peptides derive from selective regions of the human genome. *J. Clin. Invest.* 126, 4690-4701 (2016).
17. Sette, A. & Sidney, J. HLA supertypes and supermotifs: a functional perspective on HLA polymorphism. *Curr. Opin. Immunol.* 10, 478-482 (1998).
18. Robinson, J., Malik, A., Parham, P., Bodmer, J. G. & Marsh, S. G. E. IMGT/HLA Database—a sequence database for the human major histocompatibility complex. *Tissue Antigens* 55, 280-287 (2000).
19. Parham, P. & Moffett, A. Variable NK cell receptors and their MHC class I ligands in immunity, reproduction and human evolution. *Nat. Rev. Immunol.* 13, 133-144 (2013).
20. Nielsen, M. et al. NetMHCpan, a method for quantitative predictions of peptide binding to any HLA-A and -B locus protein of known sequence. *PLoS One* 2, e796 (2007).
21. Rist, M. J. et al. HLA peptide length preferences control CD8+ T cell responses. *J. Immunol.* 191, 561-571 (2013).
22. Maenaka, K. et al. Nonstandard Peptide Binding Revealed by Crystal Structures of HLA-B*5101 Complexed with HIV Immunodominant Epitopes. *The Journal of Immunology* 165, 3260-3267 (2000).
23. Kaur, G. et al. Structural and regulatory diversity shape HLA-C protein expression levels. *Nat. Commun.* 8, 15924 (2017).
24. Celik, A. A., Simper, G. S., Hiemisch, W., Blasczyk, R. & Bade-Döding, C. HLA-G peptide preferences change in transformed cells: impact on the binding motif *Immunogenetics* 70, 485-494 (2018).
25. Javitt, A. et al. Pro-inflammatory Cytokines Alter the Immunopeptidome Landscape by Modulation of HLA-B Expression. *Front. Immunol.* 10, 141 (2019).
26. Bassani-Sternberg, M., Pletscher-Frankild, S., Jensen, L. J. & Mann, M. Mass spectrometry of human leukocyte antigen class I peptidomes reveals strong effects of protein abundance and turnover on antigen presentation. *Mol. Cell. Proteomics* 14, 658-673 (2015).
27. Liepe, J. et al. A large fraction of HLA class I ligands are proteasome-generated spliced peptides. *Science* 354, 354-358 (2016).
28. Faridi, P. et al. A subset of HLA-I peptides are not genomically templated: Evidence for cis- and trans-spliced peptide ligands. *Sci Immunol* 3, (2018).
29. Mylonas, R. et al. Estimating the contribution of proteasomal spliced peptides to the HLA-I ligandome. *Mol. Cell. Proteomics* 17, 2347-2357 (2018).
30. Rolfs, Z., Solntsev, S. K., Shortreed, M. R., Frey, B. L. & Smith, L. M. Global Identification of Post-Translationally Spliced Peptides with Neo-Fusion. *J Proteome Res.* (2018). doi:10.1021/acs.jproteome.8b00651.
31. Di Marco, M. et al. Unveiling the Peptide Motifs of HLA-C and HLA-G from Naturally Presented Peptides and Generation of Binding Prediction Matrices. *J. Immunol.* 199, 2639-2651 (2017).
32. Bassani-Sternberg, M. et al. Direct identification of clinically relevant neoepitopes presented on native human melanoma tissue by mass spectrometry. *Nat. Commun.* 7, 13404 (2016).
33. Schuster, H. et al. The immunopeptidomic landscape of ovarian carcinomas. *Proc. Natl. Acad. Sci. U.S.A.* 114, E9942-E9951 (2017).
34. Girdlestone, J. Regulation of HLA Class I Loci by Interferons. *Immunobiology* 193, 229-237 (1995).
35. Chong, C. et al. High-throughput and Sensitive Immunopeptidomics Platform Reveals Profound Interferonγ-Mediated Remodeling of the Human Leukocyte Antigen (HLA) Ligandome. *Mol. Cell. Proteomics* 17, 533-548 (2018).
36. Vita, R. et al. The immune epitope database (IEDB) 3.0. *Nucleic Acids Res.* 43, D405-12 (2015).
37. Keskin, D. B. et al. Neoantigen vaccine generates intratumoral T cell responses in phase Ib glioblastoma trial. *Nature* 565, 234-239 (2019).
38. Langmead, B. & Salzberg, S. L. Fast gapped-read alignment with Bowtie 2. *Nat. Methods* 9, 357-359 (2012).
39. Li, B. & Dewey, C. N. RSEM: accurate transcript quantification from RNA-Seq data with or without a reference genome. *BMC Bioinformatics* 12, 323 (2011).
40. Mertins, P. et al. Reproducible workflow for multiplexed deep-scale proteome and phosphoproteome analysis of tumor tissues by liquid chromatography-mass spectrometry. *Nat. Protoc.* 13, 1632-1661 (2018).
41. Ishihama, Y. et al. Exponentially modified protein abundance index (emPAI) for estimation of absolute protein amount in proteomics by the number of sequenced peptides per protein. *Mol. Cell. Proteomics* 4, 1265-1272 (2005).
42. Kim, Y., Sidney, J., Pinilla, C., Sette, A. & Peters, B. Derivation of an amino acid similarity matrix for peptide: MHC binding and its application as a Bayesian prior. *BMC Bioinformatics* 10, 394 (2009).
43. Kidera, A., Konishi, Y., Oka, M., Ooi, T. & Scheraga, H. A. Statistical analysis of the physical properties of the 20 naturally occurring amino acids. *J. Protein Chem.* 4, 23-55 (1985).
44. Bremel, R. D. & Homan, E. J. An integrated approach to epitope analysis I: Dimensional reduction, visualization and prediction of MHC binding using amino acid principal components and regression approaches. *Immunome Res.* 6, 7 (2010).
45. McInnes, L., Healy, J. & Melville, J. UMAP: Uniform Manifold Approximation and Projection for Dimension Reduction. arXiv [stat.ML] (2018).
46. Harndahl, M. et al. Peptide binding to HLA class I molecules: homogenous, high-throughput screening, and affinity assays. *J. Biomol. Screen.* 14, 173-180 (2009).
47. Liberzon, A. et al. The Molecular Signatures Database (MSigDB) hallmark gene set collection. *Cell Syst* 1, 417-425 (2015).
48. Bassani-Sternberg, M., Pletscher-Frankild, S., Jensen, L. J. & Mann, M. Mass Spectrometry of Human Leukocyte Antigen Class I Peptidomes Reveals Strong Effects of Protein Abundance and Turnover on Antigen Presentation. *Molecular & Cellular Proteomics* 14, 658-673 (2015).
49. Hunt, D. F. et al. Characterization of peptides bound to the class I MHC molecule HLA-A2.1 by mass spectrometry. *Science* 255, 1261-1263 (1992).
50. Rammensee, H. G., Friede, T. & Stevanoviic, S. MHC ligands and peptide motifs: first listing. *Immunogenetics* 41, 178-228 (1995).
51. Rammensee, H., Bachmann, J., Emmerich, N. P., Bachor, O. A. & Stevanović, S. SYFPEITHI: database for MHC ligands and peptide motifs. *Immunogenetics* 50, 213-219 (1999).
52. Raveh B1, London N, Zimmerman L, & Schueler-Furman O. Rosetta FlexPepDock ab-initio: simultaneous folding, docking and refinement of peptides onto their receptors. *PLoS One.* 6:e18934 (2011).

Various modifications and variations of the described methods, pharmaceutical compositions, and kits of the invention will be apparent to those skilled in the art without departing from the scope and spirit of the invention. Although the invention has been described in connection with specific embodiments, it will be understood that it is capable of further modifications and that the invention as claimed should not be unduly limited to such specific embodiments. Indeed, various modifications of the described modes for carrying out the invention that are obvious to those skilled in the art are intended to be within the scope of the invention. This application is intended to cover any variations, uses, or adaptations of the invention following, in general, the principles of the invention and including such departures from the present disclosure come within known customary practice within the art to which the invention pertains and may be applied to the essential features herein before set forth.

SEQUENCE LISTING (173497 sequences)

SEQ ID NO: 1 - protein, 9 aa, Artificial Sequence
  Synthetic Peptide
FLWPEAFLY

SEQ ID NO: 2 - protein, 9 aa, Artificial Sequence
  Synthetic Peptide
YVPEHWEYY

SEQ ID NO: 3 - protein, 9 aa, Artificial Sequence
  Synthetic Peptide
KLDLLEQEY

SEQ ID NO: 4 - protein, 9 aa, Artificial Sequence
  Synthetic Peptide
TTDGYLLRL

SEQ ID NO: 5 - protein, 9 aa, Artificial Sequence
  Synthetic Peptide
DTEFPNFKY

SEQ ID NO: 6 - protein, 9 aa, Artificial Sequence
  Synthetic Peptide
ATDGKVLLW

SEQ ID NO: 7 - protein, 9 aa, Artificial Sequence
  Synthetic Peptide
DGLLRVLTV

SEQ ID NO: 8 - protein, 9 aa, Artificial Sequence
  Synthetic Peptide
DAPLNIRSI

SEQ ID NO: 9 - protein, 9 aa, Artificial Sequence
  Synthetic Peptide
DGLRDLPSI

SEQ ID NO: 10 - protein, 9 aa, Artificial Sequence
  Synthetic Peptide
DGYVVKETI

SEQ ID NO: 11 - protein, 9 aa, Artificial Sequence
  Synthetic Peptide
DGRLVINRV

SEQ ID NO: 12 - protein, 9 aa, Artificial Sequence
  Synthetic Peptide
DAYPQRIKF

SEQ ID NO: 13 - protein, 9 aa, Artificial Sequence
  Synthetic Peptide
IIYPTPKVV

SEQ ID NO: 14 - protein, 9 aa, Artificial Sequence
  Synthetic Peptide
VPPLVPKVL

SEQ ID NO: 15 - protein, 9 aa, Artificial Sequence
  Synthetic Peptide
TPESKIRFV

SEQ ID NO: 16 - protein, 9 aa, Artificial Sequence
  Synthetic Peptide
VALLVGEKV

SEQ ID NO: 17 - protein, 9 aa, Artificial Sequence
  Synthetic Peptide
YIIEREPLI

SEQ ID NO: 18 - protein, 9 aa, Artificial Sequence
  Synthetic Peptide
FYPELKLAY

SEQ ID NO: 19 - protein, 9 aa, Artificial Sequence
  Synthetic Peptide
HFLDRHLVF

SEQ ID NO: 20 - protein, 9 aa, Artificial Sequence
  Synthetic Peptide
YLPALKVEY

SEQ ID NO: 21 - protein, 9 aa, Artificial Sequence
  Synthetic Peptide
LPLDIQIFY

SEQ ID NO: 22 - protein, 9 aa, Artificial Sequence
  Synthetic Peptide
ALSDLALHF

SEQ ID NO: 23 - protein, 9 aa, Artificial Sequence
  Synthetic Peptide
GLDDKLLHY

SEQ ID NO: 24 - protein, 9 aa, Artificial Sequence
  Synthetic Peptide
GLPDLVAKY

SEQ ID NO: 25 - protein, 9 aa, Artificial Sequence
  Synthetic Peptide
YPVYQPVGP

SEQ ID NO: 26 - protein, 9 aa, Artificial Sequence
  Synthetic Peptide
YGFVNYVTA

SEQ ID NO: 27 - protein, 9 aa, Artificial Sequence
  Synthetic Peptide
FVEILIPVA

SEQ ID NO: 28 - protein, 9 aa, Artificial Sequence
  Synthetic Peptide
FPKETFEGP

SEQ ID NO: 29 - protein, 9 aa, Artificial Sequence
  Synthetic Peptide
SAPVNFISA

SEQ ID NO: 30 - protein, 31 aa, Artificial Sequence
  Synthetic Peptide
  MISC_FEATURE (1)..(1): Xaa = any amino acid
  MISC_FEATURE (3)..(3): Xaa = any amino acid
  MISC_FEATURE (4)..(7): Xaa = E or D
  MISC_FEATURE (8)..(8): Xaa = any amino acid
  MISC_FEATURE (9)..(14): Xaa = L, V, or I
  MISC_FEATURE (15)..(21): Xaa = I, V, or A
  MISC_FEATURE (22)..(22): Xaa = any amino acid
  MISC_FEATURE (23)..(31): Xaa = L or V
XLXXXXXXXXXXXXXXXXXXXXXXXXXXXXX

SEQ ID NO: 31 - protein, 9 aa, Artificial Sequence
  Synthetic Peptide
  MISC_FEATURE (1)..(1): Xaa = any amino acid
  MISC_FEATURE (3)..(3): Xaa = any amino acid
  MISC_FEATURE (5)..(6): Xaa = any amino acid
  MISC_FEATURE (7)..(7): Xaa = L
  MISC_FEATURE (8)..(8): Xaa = any amino acid
  MISC_FEATURE (9)..(9): Xaa = Y or F
XLXDXXXXX

SEQ ID NO: 32 - protein, 9 aa, Artificial Sequence
  Synthetic Peptide
  MISC_FEATURE (1)..(1): Xaa = any amino acid
  MISC_FEATURE (2)..(2): Xaa = T, S, or L
  MISC_FEATURE (3)..(3): Xaa = D or E
  MISC_FEATURE (4)..(4): Xaa = I, V, or A
  MISC_FEATURE (5)..(8): Xaa = any amino acid
XXXXXXXXY

SEQ ID NO: 33 - protein, 9 aa, Artificial Sequence
  Synthetic Peptide
  MISC_FEATURE (1)..(1): Xaa = any amino acid
  MISC_FEATURE (3)..(5): Xaa = any amino acid
  MISC_FEATURE (6)..(6): Xaa = L or V
  MISC_FEATURE (7)..(8): Xaa = any amino acid
  MISC_FEATURE (9)..(9): Xaa = V or L
XLXXXXXXX

SEQ ID NO: 34 - protein, 9 aa, Artificial Sequence
  Synthetic Peptide
  MISC_FEATURE (1)..(1): Xaa = any amino acid
  MISC_FEATURE (3)..(3): Xaa = any amino acid
  MISC_FEATURE (4)..(4): Xaa = E or D
  MISC_FEATURE (5)..(5): Xaa = any amino acid
  MISC_FEATURE (6)..(6): Xaa = L or V
  MISC_FEATURE (7)..(8): Xaa = any amino acid
  MISC_FEATURE (9)..(9): Xaa = V or L
XLXXXXXXX

SEQ ID NO: 35 - protein, 9 aa, Artificial Sequence
  Synthetic Peptide
  MISC_FEATURE (1)..(1): Xaa = any amino acid
  MISC_FEATURE (4)..(8): Xaa = any amino acid
  MISC_FEATURE (9)..(9): Xaa = L or V
XLDXXXXXX

SEQ ID NO: 36 - protein, 9 aa, Artificial Sequence
  Synthetic Peptide
  MISC_FEATURE (1)..(6): Xaa = any amino acid
  MISC_FEATURE (8)..(8): Xaa = any amino acid
  MISC_FEATURE (9)..(9): Xaa = K, Y or R
XXXXXXLXX

SEQ ID NO: 37 - protein, 9 aa, Artificial Sequence
  Synthetic Peptide
  MISC_FEATURE (1)..(1): Xaa = any amino acid
  MISC_FEATURE (2)..(2): Xaa = R or A
  MISC_FEATURE (3)..(8): Xaa = any amino acid
XXXXXXXXR

SEQ ID NO: 38 - protein, 9 aa, Artificial Sequence
  Synthetic Peptide
  MISC_FEATURE (2)..(2): Xaa = V, T, or A
  MISC_FEATURE (3)..(8): Xaa = any amino acid
  MISC_FEATURE (9)..(9): Xaa = V or L
EXXXXXXXX

SEQ ID NO: 39 - protein, 9 aa, Artificial Sequence
  Synthetic Peptide
  MISC_FEATURE (1)..(1): Xaa = any amino acid
  MISC_FEATURE (2)..(2): Xaa = P or A
  MISC_FEATURE (3)..(3): Xaa = any amino acid
  MISC_FEATURE (5)..(8): Xaa = any amino acid
  MISC_FEATURE (9)..(9): Xaa = Y, F, or L
XXXRXXXXX

SEQ ID NO: 40 - protein, 9 aa, Artificial Sequence
  Synthetic Peptide
  MISC_FEATURE (1)..(1): Xaa = A or E
  MISC_FEATURE (3)..(4): Xaa = any amino acid
  MISC_FEATURE (6)..(8): Xaa = any amino acid
  MISC_FEATURE (9)..(9): Xaa = F, W, or L
XEXXLXXXX

SEQ ID NO: 41 - protein, 9 aa, Artificial Sequence
  Synthetic Peptide
  MISC_FEATURE (1)..(1): Xaa = A or E
  MISC_FEATURE (3)..(4): Xaa = any amino acid
  MISC_FEATURE (6)..(6): Xaa = any amino acid
  MISC_FEATURE (8)..(8): Xaa = any amino acid
  MISC_FEATURE (9)..(9): Xaa = F, W, or L
XEXXLXLXX

SEQ ID NO: 42 - protein, 9 aa, Artificial Sequence
  Synthetic Peptide
  MISC_FEATURE (2)..(2): Xaa = P or A
  MISC_FEATURE (3)..(8): Xaa = any amino acid
  MISC_FEATURE (9)..(9): Xaa = I, V, or L
DXXXXXXXX

SEQ ID NO: 43 - protein, 9 aa, Artificial Sequence
  Synthetic Peptide
  MISC_FEATURE (1)..(1): Xaa = M, W, or V
  MISC_FEATURE (3)..(8): Xaa = any amino acid
  MISC_FEATURE (9)..(9): Xaa = F or L
XYXXXXXXX

SEQ ID NO: 44 - protein, 8 aa, Homo Sapiens
ADMGHLKY

SEQ ID NO: 45 - protein, 8 aa, Homo Sapiens
ELDDTLKY

SEQ ID NO: 46 - protein, 8 aa, Homo Sapiens
FSDNIEFY

SEQ ID NO: 47 - protein, 8 aa, Homo Sapiens
FTELAILY

SEQ ID NO: 48 - protein, 8 aa, Homo Sapiens
GLDEPLLK

SEQ ID NO: 49 - protein, 8 aa, Homo Sapiens
GLDQPLLK

SEQ ID NO: 50 - protein, 8 aa, Homo Sapiens
HIDFAIQY

SEQ ID NO: 51 - protein, 8 aa, Homo Sapiens
HIDLGIKY

SEQ ID NO: 52 - protein, 8 aa, Homo Sapiens
ITDIHIKY

SEQ ID NO: 53 - protein, 8 aa, Homo Sapiens
ITDIVNKY

SEQ ID NO: 54 - protein, 8 aa, Homo Sapiens
ITDLPIKL

SEQ ID NO: 55 - protein, 8 aa, Homo Sapiens
IVDEAIYY

SEQ ID NO: 56 - protein, 8 aa, Homo Sapiens
LIQSAVLY

SEQ ID NO: 57 - protein, 8 aa, Homo Sapiens
LKDDLLLY

SEQ ID NO: 58 - protein, 8 aa, Homo Sapiens
LLDLMKNL

SEQ ID NO: 59 - protein, 8 aa, Homo Sapiens
LLDSSLEY

SEQ ID NO: 60 - protein, 8 aa, Homo Sapiens
LLDVGLRY

SEQ ID NO: 61 - protein, 8 aa, Homo Sapiens
LSDIGLEY

SEQ ID NO: 62 - protein, 8 aa, Homo Sapiens
LTDEGLLY

SEQ ID NO: 63 - protein, 8 aa, Homo Sapiens
LTDFIQKY

SEQ ID NO: 64 - protein, 8 aa, Homo Sapiens
LTDIGVLY

SEQ ID NO: 65 - protein, 8 aa, Homo Sapiens
LTDIIAAY

SEQ ID NO: 66 - protein, 8 aa, Homo Sapiens
LTEILDRY

SEQ ID NO: 67 - protein, 8 aa, Homo Sapiens
LVDDPLEY

SEQ ID NO: 68 - protein, 8 aa, Homo Sapiens
MSDVNLKY

SEQ ID NO: 69 - protein, 8 aa, Homo Sapiens
NIDYPVLY

SEQ ID NO: 70 - protein, 8 aa, Homo Sapiens
NTDSPLRY

SEQ ID NO: 71 - protein, 8 aa, Homo Sapiens
QTDINLPY

SEQ ID NO: 72 - protein, 8 aa, Homo Sapiens
TIDIGVKY

SEQ ID NO: 73 - protein, 8 aa, Homo Sapiens
VADMALHY

SEQ ID NO: 74 - protein, 8 aa, Homo Sapiens
VLDGTIEY

SEQ ID NO: 75 - protein, 8 aa, Homo Sapiens
VLDIPSKY

SEQ ID NO: 76 - protein, 8 aa, Homo Sapiens
WTDLALQY

SEQ ID NO: 77 - protein, 8 aa, Homo Sapiens
YADLSLKY

SEQ ID NO: 78 - protein, 8 aa, Homo Sapiens
YLDFINHY

SEQ ID NO: 79 - protein, 8 aa, Homo Sapiens
YLDQISRY

SEQ ID NO: 80 - protein, 8 aa, Homo Sapiens
YTDVSTRY

SEQ ID NO: 81 - protein, 9 aa, Homo Sapiens
AADIFYSRY

SEQ ID NO: 82 - protein, 9 aa, Homo Sapiens
AADLNLVLY

SEQ ID NO: 83 - protein, 9 aa, Homo Sapiens
AADLVEALY

SEQ ID NO: 84 - protein, 9 aa, Homo Sapiens
AIDEDVLRY

SEQ ID NO: 85 - protein, 9 aa, Homo Sapiens
AIDLLKEIY

SEQ ID NO: 86 - protein, 9 aa, Homo Sapiens
AIDQLHLEY

SEQ ID NO: 87 - protein, 9 aa, Homo Sapiens
AIDRLVNIY

SEQ ID NO: 88 - protein, 9 aa, Homo Sapiens
ALDAAVLAY

SEQ ID NO: 89 - protein, 9 aa, Homo Sapiens
ALDDFTICY

SEQ ID NO: 90 - protein, 9 aa, Homo Sapiens
ALDSHILDY

SEQ ID NO: 91 - protein, 9 aa, Homo Sapiens
ALDTLIIEY

SEQ ID NO: 92 - protein, 9 aa, Homo Sapiens
ALDVVNLVY

SEQ ID NO: 93 - protein, 9 aa, Homo Sapiens
AMDVYKNLY

SEQ ID NO: 94 - protein, 9 aa, Homo Sapiens
ASAVIGLLY

SEQ ID NO: 95 - protein, 9 aa, Homo Sapiens
ASDMLQLEY

SEQ ID NO: 96 - protein, 9 aa, Homo Sapiens
ASDPFFRHY

SEQ ID NO: 97 - protein, 9 aa, Homo Sapiens
ASDPYQVHV

SEQ ID NO: 98 - protein, 9 aa, Homo Sapiens
ASDSIVLFY

SEQ ID NO: 99 - protein, 9 aa, Homo Sapiens
ASDYFDQLY

SEQ ID NO: 100 - protein, 9 aa, Homo Sapiens
ASEDSVLLY

SEQ ID NO: 101 - protein, 9 aa, Homo Sapiens
ASETGFLTY

SEQ ID NO: 102 - protein, 9 aa, Homo Sapiens
ASEYDQIRY

SEQ ID NO: 103 - protein, 9 aa, Homo Sapiens
ATALFSFLY

SEQ ID NO: 104 - protein, 9 aa, Homo Sapiens
ATDFDVLSY

SEQ ID NO: 105 - protein, 9 aa, Homo Sapiens
ATDFKFAMY

SEQ ID NO: 106 - protein, 9 aa, Homo Sapiens
ATDGKVLLW

SEQ ID NO: 107 - protein, 9 aa, Homo Sapiens
ATDIKITVY

SEQ ID NO: 108 - protein, 9 aa, Homo Sapiens
ATDLAQHLY

SEQ ID NO: 109 - protein, 9 aa, Homo Sapiens
ATDLAYYLV

SEQ ID NO: 110 - protein, 9 aa, Homo Sapiens
ATDPNILSL

SEQ ID NO: 111 - protein, 9 aa, Homo Sapiens
ATDRWYDEY

SEQ ID NO: 112 - protein, 9 aa, Homo Sapiens
ATDYTFAMY

SEQ ID NO: 113 - protein, 9 aa, Homo Sapiens
ATEFIMNEY

SEQ ID NO: 114 - protein, 9 aa, Homo Sapiens
ATEVLMWFY

SEQ ID NO: 115 - protein, 9 aa, Homo Sapiens
ATSKVALVY

SEQ ID NO: 116 - protein, 9 aa, Homo Sapiens
AVDPGLLGY

SEQ ID NO: 117 - protein, 9 aa, Homo Sapiens
AVDPRFLAY

SEQ ID NO: 118 - protein, 9 aa, Homo Sapiens
CLDHVISYY

SEQ ID NO: 119 - protein, 9 aa, Homo Sapiens
DIDIRKDLY

SEQ ID NO: 120 - protein, 9 aa, Homo Sapiens
DIDIRPGLY

SEQ ID NO: 121 - protein, 9 aa, Homo Sapiens
DLDEIVARY

SEQ ID NO: 122 - protein, 9 aa, Homo Sapiens
DLDLSPLEY

SEQ ID NO: 123 - protein, 9 aa, Homo Sapiens
DLDSRVLYY

SEQ ID NO: 124 - protein, 9 aa, Homo Sapiens
DMDKVLLKY

SEQ ID NO: 125 - protein, 9 aa, Homo Sapiens
DSDMQTLVY

SEQ ID NO: 126 - protein, 9 aa, Homo Sapiens
DSDPWVLMV

SEQ ID NO: 127 - protein, 9 aa, Homo Sapiens
DSEGYLLFY

SEQ ID NO: 128 - protein, 9 aa, Homo Sapiens
DSERFFIRY

SEQ ID NO: 129 - protein, 9 aa, Homo Sapiens
DTDHYFLRY

SEQ ID NO: 130 - protein, 9 aa, Homo Sapiens
DTDISLIRY

SEQ ID NO: 131 - protein, 9 aa, Homo Sapiens
DTDRFVLLV

SEQ ID NO: 132 - protein, 9 aa, Homo Sapiens
DTEFPNFKY

SEQ ID NO: 133 - protein, 9 aa, Homo Sapiens
DVDIRKDLY

SEQ ID NO: 134 - protein, 9 aa, Homo Sapiens
EIDILRTLY

SEQ ID NO: 135 - protein, 9 aa, Homo Sapiens
ELDVVREIY

SEQ ID NO: 136 - protein, 9 aa, Homo Sapiens
ELERLTSLY

SEQ ID NO: 137 - protein, 9 aa, Homo Sapiens
EPFLFNFLY

SEQ ID NO: 138 - protein, 9 aa, Homo Sapiens
ESDLDYIQY

SEQ ID NO: 139 - protein, 9 aa, Homo Sapiens
ESSSVVLRY

SEQ ID NO: 140 - protein, 9 aa, Homo Sapiens
ETALLVDRY

SEQ ID NO: 141 - protein, 9 aa, Homo Sapiens
ETELDGLRY

SEQ ID NO: 142 - protein, 9 aa, Homo Sapiens
ETEPVFWYY

SEQ ID NO: 143 - protein, 9 aa, Homo Sapiens
ETTFLVDKY

SEQ ID NO: 144 - protein, 9 aa, Homo Sapiens
EVDPDTILK

SEQ ID NO: 145 - protein, 9 aa, Homo Sapiens
FADDMYSLY

SEQ ID NO: 146 - protein, 9 aa, Homo Sapiens
FADEGSIFY

SEQ ID NO: 147 - protein, 9 aa, Homo Sapiens
FADFDGVLY

SEQ ID NO: 148 - protein, 9 aa, Homo Sapiens
FADGFVLVY

SEQ ID NO: 149 - protein, 9 aa, Homo Sapiens
FAEAHYLSY

SEQ ID NO: 150 - protein, 9 aa, Homo Sapiens
FAEMIQPEY

SEQ ID NO: 151 - protein, 9 aa, Homo Sapiens
FIDAQFEAY

SEQ ID NO: 152 - protein, 9 aa, Homo Sapiens
FIDASRLVY

SEQ ID NO: 153 - protein, 9 aa, Homo Sapiens
FIDFLIDTY

SEQ ID NO: 154 - protein, 9 aa, Homo Sapiens
FIDLNYMVY

SEQ ID NO: 155 - protein, 9 aa, Homo Sapiens
FIDSIIAKY

SEQ ID NO: 156 - protein, 9 aa, Homo Sapiens
FIEERLLMY

SEQ ID NO: 157 - protein, 9 aa, Homo Sapiens
FIEEYVTAY

SEQ ID NO: 158 - protein, 9 aa, Homo Sapiens
FLDDFESKY

SEQ ID NO: 159 - protein, 9 aa, Homo Sapiens
FLDLVNYVY

SEQ ID NO: 160 - protein, 9 aa, Homo Sapiens
FLDTDTICY

SEQ ID NO: 161 - protein, 9 aa, Homo Sapiens
FLEETNCLY

SEQ ID NO: 162 - protein, 9 aa, Homo Sapiens
FLEPLGLAY

SEQ ID NO: 163 - protein, 9 aa, Homo Sapiens
FLEQVHQLY

SEQ ID NO: 164 - protein, 9 aa, Homo Sapiens
FLNDSYLKY

SEQ ID NO: 165 - protein, 9 aa, Homo Sapiens
FLWPEAFLY

SEQ ID NO: 166 - protein, 9 aa, Homo Sapiens
FMDDYIFTY

SEQ ID NO: 167 - protein, 9 aa, Homo Sapiens
FMDVSNPFY

SEQ ID NO: 168 - protein, 9 aa, Homo Sapiens
FSDIHDFEY

SEQ ID NO: 169 - protein, 9 aa, Homo Sapiens
FSDPNFLAH

SEQ ID NO: 170 - protein, 9 aa, Homo Sapiens
FSDTGNFGF

SEQ ID NO: 171 - protein, 9 aa, Homo Sapiens
FSDYPPLGR

SEQ ID NO: 172 - protein, 9 aa, Homo Sapiens
FSEACWEVY

SEQ ID NO: 173 - protein, 9 aa, Homo Sapiens
FSEEDFRLY

SEQ ID NO: 174 - protein, 9 aa, Homo Sapiens
FSEEQLNRY

SEQ ID NO: 175 - protein, 9 aa, Homo Sapiens
FSEFLINTY

SEQ ID NO: 176 - protein, 9 aa, Homo Sapiens
FSEIDLEKY

SEQ ID NO: 177 - protein, 9 aa, Homo Sapiens
FSELSACLY

SEQ ID NO: 178 - protein, 9 aa, Homo Sapiens
FSENTLQFY

SEQ ID NO: 179 - protein, 9 aa, Homo Sapiens
FSEPRAIFY

SEQ ID NO: 180 - protein, 9 aa, Homo Sapiens
FTAEFSSRY

SEQ ID NO: 181 - protein, 9 aa, Homo Sapiens
FTAKSPLMY

SEQ ID NO: 182 - protein, 9 aa, Homo Sapiens
FTDIDGQVY

SEQ ID NO: 183 - protein, 9 aa, Homo Sapiens
FTDTSIILF

SEQ ID NO: 184 - protein, 9 aa, Homo Sapiens
FTEEDVKFY

SEQ ID NO: 185 - protein, 9 aa, Homo Sapiens
FTEIKNLLV

SEQ ID NO: 186 - protein, 9 aa, Homo Sapiens
FTSMTRLYY

SEQ ID NO: 187 - protein, 9 aa, Homo Sapiens
FVDDQQTFF

SEQ ID NO: 188 - protein, 9 aa, Homo Sapiens
FVDDYTVRV

SEQ ID NO: 189 - protein, 9 aa, Homo Sapiens
FVDILTNWY

SEQ ID NO: 190 - protein, 9 aa, Homo Sapiens
FVDPAQITM

SEQ ID NO: 191 - protein, 9 aa, Homo Sapiens
FVDPLVTNY

SEQ ID NO: 192 - protein, 9 aa, Homo Sapiens
FVEPVGLNY

SEQ ID NO: 193 - protein, 9 aa, Homo Sapiens
FVEPYFDEY

SEQ ID NO: 194 - protein, 9 aa, Homo Sapiens
FVETESVRY

SEQ ID NO: 195 - protein, 9 aa, Homo Sapiens
FVEVGRVAY

SEQ ID NO: 196 - protein, 9 aa, Homo Sapiens
GLDDKLLHY

SEQ ID NO: 197 - protein, 9 aa, Homo Sapiens
GLDEVIFSY

SEQ ID NO: 198 - protein, 9 aa, Homo Sapiens
GSDPVFRFY

SEQ ID NO: 199 - protein, 9 aa, Homo Sapiens
GSEYLKLGY

SEQ ID NO: 200 - protein, 9 aa, Homo Sapiens
GTDELRLLY

SEQ ID NO: 201 - protein, 9 aa, Homo Sapiens
GTDLSIFKY

SEQ ID NO: 202 - protein, 9 aa, Homo Sapiens
GTEFTTILY

SEQ ID NO: 203 - protein, 9 aa, Homo Sapiens
GTELLSLVY

SEQ ID NO: 204 - protein, 9 aa, Homo Sapiens
GTLDSVLRY

SEQ ID NO: 205 - protein, 9 aa, Homo Sapiens
GTVYEDLRY

SEQ ID NO: 206 - protein, 9 aa, Homo Sapiens
HLDAELDAY

SEQ ID NO: 207 - protein, 9 aa, Homo Sapiens
HLDLGILYY

SEQ ID NO: 208 - protein, 9 aa, Homo Sapiens
HSALLALRY

SEQ ID NO: 209 - protein, 9 aa, Homo Sapiens
HSDLHILDF

SEQ ID NO: 210 - protein, 9 aa, Homo Sapiens
HSDPSILGY

SEQ ID NO: 211 - protein, 9 aa, Homo Sapiens
HSDTIQWLY

SEQ ID NO: 212 - protein, 9 aa, Homo Sapiens
HSELLEDYY

SEQ ID NO: 213 - protein, 9 aa, Homo Sapiens
HSEYHTLLY

SEQ ID NO: 214 - protein, 9 aa, Homo Sapiens
HTDILKEKY

SEQ ID NO: 215 - protein, 9 aa, Homo Sapiens
HTDQLVLIF

SEQ ID NO: 216 - protein, 9 aa, Homo Sapiens
HTDVGLLEY

SEQ ID NO: 217 - protein, 9 aa, Homo Sapiens
HTDWLLDLY

SEQ ID NO: 218 - protein, 9 aa, Homo Sapiens
IADMGHLKY

SEQ ID NO: 219 - protein, 9 aa, Homo Sapiens
IIDYLTDHY

SEQ ID NO: 220 - protein, 9 aa, Homo Sapiens
IIEAQYLRY

SEQ ID NO: 221 - protein, 9 aa, Homo Sapiens
ILDDFREAY

SEQ ID NO: 222 - protein, 9 aa, Homo Sapiens
ILDEFLQTY

SEQ ID NO: 223 - protein, 9 aa, Homo Sapiens
ILDEVIMGY

SEQ ID NO: 224 - protein, 9 aa, Homo Sapiens
ILDIPNQLY

SEQ ID NO: 225 - protein, 9 aa, Homo Sapiens
ILDVLKQGY

SEQ ID NO: 226 - protein, 9 aa, Homo Sapiens
ISDLIRDSY

SEQ ID NO: 227 - protein, 9 aa, Homo Sapiens
ISDLNELLK

SEQ ID NO: 228 - protein, 9 aa, Homo Sapiens
ISDRLIGIY

SEQ ID NO: 229 - protein, 9 aa, Homo Sapiens
ISDSYFPRY

SEQ ID NO: 230 - protein, 9 aa, Homo Sapiens
ISEELVQKY

SEQ ID NO: 231 - protein, 9 aa, Homo Sapiens
ISEVGTIRY

SEQ ID NO: 232 - protein, 9 aa, Homo Sapiens
ITDDLHFYV

SEQ ID NO: 233 - protein, 9 aa, Homo Sapiens
ITDHGSLIY

SEQ ID NO: 234 - protein, 9 aa, Homo Sapiens
ITDQGIEFY

SEQ ID NO: 235 - protein, 9 aa, Homo Sapiens
ITGDVEVVL

SEQ ID NO: 236 - protein, 9 aa, Homo Sapiens
ITQGTPLKY

SEQ ID NO: 237 - protein, 9 aa, Homo Sapiens
IVDEFAMRY

SEQ ID NO: 238 - protein, 9 aa, Homo Sapiens
IVDHIHFQY

SEQ ID NO: 239 - protein, 9 aa, Homo Sapiens
IVDNPADFY

SEQ ID NO: 240 - protein, 9 aa, Homo Sapiens
IVDSLTEMY

SEQ ID NO: 241 - protein, 9 aa, Homo Sapiens
KIDALQLEY

SEQ ID NO: 242 - protein, 9 aa, Homo Sapiens
KLDDLHTLY

SEQ ID NO: 243 - protein, 9 aa, Homo Sapiens
KLDLLEQEY

SEQ ID NO: 244 - protein, 9 aa, Homo Sapiens
KLDQLIEFY

SEQ ID NO: 245 - protein, 9 aa, Homo Sapiens
KLDSLLLFY

SEQ ID NO: 246 - protein, 9 aa, Homo Sapiens
KLDTLCDLY

SEQ ID NO: 247 - protein, 9 aa, Homo Sapiens
KMDDLNLHY

SEQ ID NO: 248 - protein, 9 aa, Homo Sapiens
KSDGSFIGY

SEQ ID NO: 249 - protein, 9 aa, Homo Sapiens
KSDLFFHDY

SEQ ID NO: 250 - protein, 9 aa, Homo Sapiens
KSDPFLVFY

SEQ ID NO: 251 - protein, 9 aa, Homo Sapiens
KSDVHLNFY

SEQ ID NO: 252 - protein, 9 aa, Homo Sapiens
KSELGLNFY

SEQ ID NO: 253 - protein, 9 aa, Homo Sapiens
KTDHFIFTY

SEQ ID NO: 254 - protein, 9 aa, Homo Sapiens
LADELITVY

SEQ ID NO: 255 - protein, 9 aa, Homo Sapiens
LADIYRELY

SEQ ID NO: 256 - protein, 9 aa, Homo Sapiens
LADLKVQLY

SEQ ID NO: 257 - protein, 9 aa, Homo Sapiens
LADLSCLVY

SEQ ID NO: 258 - protein, 9 aa, Homo Sapiens
LADQIFAYY

SEQ ID NO: 259 - protein, 9 aa, Homo Sapiens
LAEEITLHY

SEQ ID NO: 260 - protein, 9 aa, Homo Sapiens
LAELNQILY

SEQ ID NO: 261 - protein, 9 aa, Homo Sapiens
LAEWKSLEY

SEQ ID NO: 262 - protein, 9 aa, Homo Sapiens
LAEYDLDKY

SEQ ID NO: 263 - protein, 9 aa, Homo Sapiens
LDALIDTYL

SEQ ID NO: 264 - protein, 9 aa, Homo Sapiens
LIDLAIDTY

SEQ ID NO: 265 - protein, 9 aa, Homo Sapiens
LIDNSFNRY

SEQ ID NO: 266 - protein, 9 aa, Homo Sapiens
LIDPDLTQY

SEQ ID NO: 267 - protein, 9 aa, Homo Sapiens
LIDPNTLQV

SEQ ID NO: 268 - protein, 9 aa, Homo Sapiens
LIDTLLDGY

SEQ ID NO: 269 - protein, 9 aa, Homo Sapiens
LIDVGTGYY

SEQ ID NO: 270 - protein, 9 aa, Homo Sapiens
LIDYDMVHY

SEQ ID NO: 271 - protein, 9 aa, Homo Sapiens
LIEEALQKY

SEQ ID NO: 272 - protein, 9 aa, Homo Sapiens
LLDAVLIDY

SEQ ID NO: 273 - protein, 9 aa, Homo Sapiens
LLDDMNHCY

SEQ ID NO: 274 - protein, 9 aa, Homo Sapiens
LLDDSVRVY

SEQ ID NO: 275 - protein, 9 aa, Homo Sapiens
LLDDTGLAY

SEQ ID NO: 276 - protein, 9 aa, Homo Sapiens
LLDEHHISY

SEQ ID NO: 277 - protein, 9 aa, Homo Sapiens
LLDFADVTY

SEQ ID NO: 278 - protein, 9 aa, Homo Sapiens
LLDFSYEQY

SEQ ID NO: 279 - protein, 9 aa, Homo Sapiens
LLDGFLVNY

SEQ ID NO: 280 - protein, 9 aa, Homo Sapiens
LLDHLSIVY

SEQ ID NO: 281 - protein, 9 aa, Homo Sapiens
LLDIGSLDY

SEQ ID NO: 282 - protein, 9 aa, Homo Sapiens
LLDISGVLY

SEQ ID NO: 283 - protein, 9 aa, Homo Sapiens
LLDPASFEY

SEQ ID NO: 284 - protein, 9 aa, Homo Sapiens
LLDPSVFHV

SEQ ID NO: 285 - protein, 9 aa, Homo Sapiens
LLDTELDLY

SEQ ID NO: 286 - protein, 9 aa, Homo Sapiens
LLDTNRYLY

SEQ ID NO: 287 - protein, 9 aa, Homo Sapiens
LLDVTPLSL

SEQ ID NO: 288 - protein, 9 aa, Homo Sapiens
LLEELPILY

SEQ ID NO: 289 - protein, 9 aa, Homo Sapiens
LLEGLTVVY

SEQ ID NO: 290 - protein, 9 aa, Homo Sapiens
LLEKEILFY

SEQ ID NO: 291 - protein, 9 aa, Homo Sapiens
LLELLHELY

SEQ ID NO: 292 - protein, 9 aa, Homo Sapiens
LLSTYLERY

SEQ ID NO: 293 - protein, 9 aa, Homo Sapiens
LLYESPERY

SEQ ID NO: 294 - protein, 9 aa, Homo Sapiens
LMDIFGDRY

SEQ ID NO: 295 - protein, 9 aa, Homo Sapiens
LQDICPLLY

SEQ ID NO: 296 - protein, 9 aa, Homo Sapiens
LSDFGLERY

SEQ ID NO: 297 - protein, 9 aa, Homo Sapiens
LSDHSIRSF

SEQ ID NO: 298 - protein, 9 aa, Homo Sapiens
LSDIDSRYI

SEQ ID NO: 299 - protein, 9 aa, Homo Sapiens
LSDIERQIY

SEQ ID NO: 300 - protein, 9 aa, Homo Sapiens
LSDILRFIY

SEQ ID NO: 301 - protein, 9 aa, Homo Sapiens
LSDIVIEKY

SEQ ID NO: 302 - protein, 9 aa, Homo Sapiens
LSDLGKLSY

SEQ ID NO: 303 - protein, 9 aa, Homo Sapiens
LSDLGLISY

SEQ ID NO: 304 - protein, 9 aa, Homo Sapiens
LSDLGRLSY

SEQ ID NO: 305 - protein, 9 aa, Homo Sapiens
LSDLLDWKY

SEQ ID NO: 306 - protein, 9 aa, Homo Sapiens
LSDPMWPQY

SEQ ID NO: 307 - protein, 9 aa, Homo Sapiens
LSDPVHLTV

SEQ ID NO: 308 - protein, 9 aa, Homo Sapiens
LSDSFSDLY

SEQ ID NO: 309 - protein, 9 aa, Homo Sapiens
LSDSLFLEV

SEQ ID NO: 310 - protein, 9 aa, Homo Sapiens
LSEAFHEEY

SEQ ID NO: 311 - protein, 9 aa, Homo Sapiens
LSEDVRFYY

SEQ ID NO: 312 - protein, 9 aa, Homo Sapiens
LSEEGLLVY

SEQ ID NO: 313 - protein, 9 aa, Homo Sapiens
LSEERVWEY

SEQ ID NO: 314 - protein, 9 aa, Homo Sapiens
LSELAALCY

SEQ ID NO: 315 - protein, 9 aa, Homo Sapiens
LSEPSSLQY

SEQ ID NO: 316 - protein, 9 aa, Homo Sapiens
LSEQLLNNY

SEQ ID NO: 317 - protein, 9 aa, Homo Sapiens
LSEWQKELY

SEQ ID NO: 318 - protein, 9 aa, Homo Sapiens
LSGFELELY

SEQ ID NO: 319 - protein, 9 aa, Homo Sapiens
LTALGKLLY

SEQ ID NO: 320 - protein, 9 aa, Homo Sapiens
LTDDDLLRY

SEQ ID NO: 321 - protein, 9 aa, Homo Sapiens
LTDDELFQY

SEQ ID NO: 322 - protein, 9 aa, Homo Sapiens
LTDFDIRFY

SEQ ID NO: 323 - protein, 9 aa, Homo Sapiens
LTDFIREEY

SEQ ID NO: 324 - protein, 9 aa, Homo Sapiens
LTDGHPLTL

SEQ ID NO: 325 - protein, 9 aa, Homo Sapiens
LTDNRYLLL

SEQ ID NO: 326 - protein, 9 aa, Homo Sapiens
LTDNVMITV

SEQ ID NO: 327 - protein, 9 aa, Homo Sapiens
LTDPAIVKV

SEQ ID NO: 328 - protein, 9 aa, Homo Sapiens
LTDPNYLCL

SEQ ID NO: 329 - protein, 9 aa, Homo Sapiens
LTDRLASLY

SEQ ID NO: 330 - protein, 9 aa, Homo Sapiens
LTDRLQLTL

SEQ ID NO: 331 - protein, 9 aa, Homo Sapiens
LTDTFTAYY

SEQ ID NO: 332 - protein, 9 aa, Homo Sapiens
LTDTFYYRL

SEQ ID NO: 333 - protein, 9 aa, Homo Sapiens
LTDTTILQV

SEQ ID NO: 334 - protein, 9 aa, Homo Sapiens
LTDYDIRFY

SEQ ID NO: 335 - protein, 9 aa, Homo Sapiens
LTEEFRLNY

SEQ ID NO: 336 - protein, 9 aa, Homo Sapiens
LTEFKFIWY

SEQ ID NO: 337 - protein, 9 aa, Homo Sapiens
LTEGPHLYY

SEQ ID NO: 338 - protein, 9 aa, Homo Sapiens
LTEIKGSVY

SEQ ID NO: 339 - protein, 9 aa, Homo Sapiens
LTEKNWFHY

SEQ ID NO: 340 - protein, 9 aa, Homo Sapiens
LTELMFEHY

SEQ ID NO: 341 - protein, 9 aa, Homo Sapiens
LTELPDWSY

SEQ ID NO: 342 - protein, 9 aa, Homo Sapiens
LTEPTGLLY

SEQ ID NO: 343 - protein, 9 aa, Homo Sapiens
LTEQRALLY

SEQ ID NO: 344 - protein, 9 aa, Homo Sapiens
LTEQYNEQY

SEQ ID NO: 345 - protein, 9 aa, Homo Sapiens
LTEYLSTHY

SEQ ID NO: 346 - protein, 9 aa, Homo Sapiens
LTHSLVLHY

SEQ ID NO: 347 - protein, 9 aa, Homo Sapiens
LTHWEQLDY

SEQ ID NO: 348 - protein, 9 aa, Homo Sapiens
LTLSILDRY

SEQ ID NO: 349 - protein, 9 aa, Homo Sapiens
LVDEWLDSY

SEQ ID NO: 350 - protein, 9 aa, Homo Sapiens
LVDGYNVHY

SEQ ID NO: 351 - protein, 9 aa, Homo Sapiens
LVDHFMELY

SEQ ID NO: 352 - protein, 9 aa, Homo Sapiens
LVDLAPLGY

SEQ ID NO: 353 - protein, 9 aa, Homo Sapiens
LVDLYILTY

SEQ ID NO: 354 - protein, 9 aa, Homo Sapiens
LVDPSVYGY

SEQ ID NO: 355 - protein, 9 aa, Homo Sapiens
LVERLQALY

SEQ ID NO: 356 - protein, 9 aa, Homo Sapiens
MIDPSGVSY

SEQ ID NO: 357 - protein, 9 aa, Homo Sapiens
MIDVTKSYY

SEQ ID NO: 358 - protein, 9 aa, Homo Sapiens
MIEPRTLQY

SEQ ID NO: 359 - protein, 9 aa, Homo Sapiens
MLDHQPPQY

SEQ ID NO: 360 - protein, 9 aa, Homo Sapiens
MSEIADLTY

SEQ ID NO: 361 - protein, 9 aa, Homo Sapiens
MSELLFECY

SEQ ID NO: 362 - protein, 9 aa, Homo Sapiens
MSMVANLLY

SEQ ID NO: 363 - protein, 9 aa, Homo Sapiens
MTDEWFSEY

SEQ ID NO: 364 - protein, 9 aa, Homo Sapiens
MTDPIRILV

SEQ ID NO: 365 - protein, 9 aa, Homo Sapiens
MTDTYLLNL

SEQ ID NO: 366 - protein, 9 aa, Homo Sapiens
MTEKFLFLY

SEQ ID NO: 367 - protein, 9 aa, Homo Sapiens
MTHNLLLNY

SEQ ID NO: 368 - protein, 9 aa, Homo Sapiens
MVDFAMDVY

SEQ ID NO: 369 - protein, 9 aa, Homo Sapiens
MVDIIETVY

SEQ ID NO: 370 - protein, 9 aa, Homo Sapiens
MVDPFHTLF

SEQ ID NO: 371 - protein, 9 aa, Homo Sapiens
MVDPLLTKY

SEQ ID NO: 372 - protein, 9 aa, Homo Sapiens
NIDNFLSRY

SEQ ID NO: 373 - protein, 9 aa, Homo Sapiens
NLDFLDLGY

SEQ ID NO: 374 - protein, 9 aa, Homo Sapiens
NLDFQMEQY

SEQ ID NO: 375 - protein, 9 aa, Homo Sapiens
NLDIERPTY

SEQ ID NO: 376 - protein, 9 aa, Homo Sapiens
NLDIIQQEY

SEQ ID NO: 377 - protein, 9 aa, Homo Sapiens
NLDPKITEY

SEQ ID NO: 378 - protein, 9 aa, Homo Sapiens
NLDPLTETY

SEQ ID NO: 379 - protein, 9 aa, Homo Sapiens
NLEEISNYY

SEQ ID NO: 380 - protein, 9 aa, Homo Sapiens
NSDLNNLLF

SEQ ID NO: 381 - protein, 9 aa, Homo Sapiens
NSDVSLLNY

SEQ ID NO: 382 - protein, 9 aa, Homo Sapiens
NSDWHLVNY

SEQ ID NO: 383 - protein, 9 aa, Homo Sapiens
NSELSCQLY

SEQ ID NO: 384 - protein, 9 aa, Homo Sapiens
NSLFLTDLY

SEQ ID NO: 385 - protein, 9 aa, Homo Sapiens
NTDFRYFIY

SEQ ID NO: 386 - protein, 9 aa, Homo Sapiens
NTDLVFGQY

SEQ ID NO: 387 - protein, 9 aa, Homo Sapiens
NTDSPLRYV

SEQ ID NO: 388 - protein, 9 aa, Homo Sapiens
NTEEFITVY

SEQ ID NO: 389 - protein, 9 aa, Homo Sapiens
NTQPIPILY

SEQ ID NO: 390 - protein, 9 aa, Homo Sapiens
NVDAILEEY

SEQ ID NO: 391 - protein, 9 aa, Homo Sapiens
NVDESLLGY

SEQ ID NO: 392 - protein, 9 aa, Homo Sapiens
PLDQTPLFY

SEQ ID NO: 393 - protein, 9 aa, Homo Sapiens
PSDLLVNVY

SEQ ID NO: 394 - protein, 9 aa, Homo Sapiens
PSDPQVILY

SEQ ID NO: 395 - protein, 9 aa, Homo Sapiens
PTAVVPLRY

SEQ ID NO: 396 - protein, 9 aa, Homo Sapiens
PTDPKVVVY

SEQ ID NO: 397 - protein, 9 aa, Homo Sapiens
PTDVLKIVY

SEQ ID NO: 398 - protein, 9 aa, Homo Sapiens
QADIARMLY

SEQ ID NO: 399 - protein, 9 aa, Homo Sapiens
QIEEAGWSY

SEQ ID NO: 400 - protein, 9 aa, Homo Sapiens
QLDAELLRY

SEQ ID NO: 401 - protein, 9 aa, Homo Sapiens
QLDRISVYY

SEQ ID NO: 402 - protein, 9 aa, Homo Sapiens
QLEHLQSKY

SEQ ID NO: 403 - protein, 9 aa, Homo Sapiens
QMDLLQEFY

SEQ ID NO: 404 - protein, 9 aa, Homo Sapiens
QSDYFRALY

SEQ ID NO: 405 - protein, 9 aa, Homo Sapiens
QSELVGQLY

SEQ ID NO: 406 - protein, 9 aa, Homo Sapiens
QSERQLLLY

SEQ ID NO: 407 - protein, 9 aa, Homo Sapiens
QTDHLFFKY

SEQ ID NO: 408 - protein, 9 aa, Homo Sapiens
QTDINLPYL

SEQ ID NO: 409 - protein, 9 aa, Homo Sapiens
QTDKLKELY

SEQ ID NO: 410 - protein, 9 aa, Homo Sapiens
QTDNIIYVY

SEQ ID NO: 411 - protein, 9 aa, Homo Sapiens
QTDPTLLSV

SEQ ID NO: 412 - protein, 9 aa, Homo Sapiens
QTDQLVLIF

SEQ ID NO: 413 - protein, 9 aa, Homo Sapiens
QTPIVPLLY

SEQ ID NO: 414 - protein, 9 aa, Homo Sapiens
RADQELLMY

SEQ ID NO: 415 - protein, 9 aa, Homo Sapiens
RIDLIPSLY

SEQ ID NO: 416 - protein, 9 aa, Homo Sapiens
RIEKQFLLY

SEQ ID NO: 417 - protein, 9 aa, Homo Sapiens
RLDAVTLLY

SEQ ID NO: 418 - protein, 9 aa, Homo Sapiens
RLDINTNTY

SEQ ID NO: 419 - protein, 9 aa, Homo Sapiens
RLDSLTTLY

SEQ ID NO: 420 - protein, 9 aa, Homo Sapiens
RMDNIYFEY

SEQ ID NO: 421 - protein, 9 aa, Homo Sapiens
RSDFFTSFY

SEQ ID NO: 422 - protein, 9 aa, Homo Sapiens
RSDVEILGY

SEQ ID NO: 423 - protein, 9 aa, Homo Sapiens
RTDGILALY

SEQ ID NO: 424 - protein, 9 aa, Homo Sapiens
RTDPIPIVV

SEQ ID NO: 425 - protein, 9 aa, Homo Sapiens
RTEPFQDGY

SEQ ID NO: 426 - protein, 9 aa, Homo Sapiens
RTEYTITMY

SEQ ID NO: 427 - protein, 9 aa, Homo Sapiens
RVDELLEKY

SEQ ID NO: 428 - protein, 9 aa, Homo Sapiens
RVDFQGMEY

SEQ ID NO: 429 - protein, 9 aa, Homo Sapiens
RVDQSLLLY

SEQ ID NO: 430 - protein, 9 aa, Homo Sapiens
SADLVALSY

SEQ ID NO: 431 - protein, 9 aa, Homo Sapiens
SADQVALVY

SEQ ID NO: 432 - protein, 9 aa, Homo Sapiens
SADSFQSFY

SEQ ID NO: 433 - protein, 9 aa, Homo Sapiens
SLEIRALLY

SEQ ID NO: 434 - protein, 9 aa, Homo Sapiens
SMDEKVELY

SEQ ID NO: 435 - protein, 9 aa, Homo Sapiens
SSDPKVLTL

SEQ ID NO: 436 - protein, 9 aa, Homo Sapiens
SSDVLVFDY

SEQ ID NO: 437 - protein, 9 aa, Homo Sapiens
SSDYVEIHY

SEQ ID NO: 438 - protein, 9 aa, Homo Sapiens
SSEELPLYY

SEQ ID NO: 439 - protein, 9 aa, Homo Sapiens
SSELFTLTY

SEQ ID NO: 440 - protein, 9 aa, Homo Sapiens
SSEQLFLRY

SEQ ID NO: 441 - protein, 9 aa, Homo Sapiens
SSEQTFMYY

SEQ ID NO: 442 - protein, 9 aa, Homo Sapiens
STDHIPILY

SEQ ID NO: 443 - protein, 9 aa, Homo Sapiens
STDWHVVNY

SEQ ID NO: 444 - protein, 9 aa, Homo Sapiens
STELNHLGY

SEQ ID NO: 445 - protein, 9 aa, Homo Sapiens
SVDSQILYY

SEQ ID NO: 446 - protein, 9 aa, Homo Sapiens
SVEEFVERY

SEQ ID NO: 447 - protein, 9 aa, Homo Sapiens
SVEESVLLY

SEQ ID NO: 448 - protein, 9 aa, Homo Sapiens
TADHNLLLY

SEQ ID NO: 449 - protein, 9 aa, Homo Sapiens
TDDLTTWLY

SEQ ID NO: 450 - protein, 9 aa, Homo Sapiens
TEPPPLLVY

SEQ ID NO: 451 - protein, 9 aa, Homo Sapiens
TLDLIDEAY

SEQ ID NO: 452 - protein, 9 aa, Homo Sapiens
TLDTKPGLY

SEQ ID NO: 453 - protein, 9 aa, Homo Sapiens
TSDELQFGY

SEQ ID NO: 454 - protein, 9 aa, Homo Sapiens
TSEDRFIQY

SEQ ID NO: 455 - protein, 9 aa, Homo Sapiens
TSEGLKLYY

SEQ ID NO: 456 - protein, 9 aa, Homo Sapiens
TTDFIFNLY

SEQ ID NO: 457 - protein, 9 aa, Homo Sapiens
TTDFIYQLY

SEQ ID NO: 458 - protein, 9 aa, Homo Sapiens
TTDGYLLRL

SEQ ID NO: 459 - protein, 9 aa, Homo Sapiens
TTDLELIKY

SEQ ID NO: 460 - protein, 9 aa, Homo Sapiens
TTEFLYNLY

SEQ ID NO: 461 - protein, 9 aa, Homo Sapiens
TTEIETLLL

SEQ ID NO: 462 - protein, 9 aa, Homo Sapiens
TTEVHPELY

SEQ ID NO: 463 - protein, 9 aa, Homo Sapiens
TVDEHVWFY

SEQ ID NO: 464 - protein, 9 aa, Homo Sapiens
TVDRVVLLY

SEQ ID NO: 465 - protein, 9 aa, Homo Sapiens
VADKVHLMY

SEQ ID NO: 466 - protein, 9 aa, Homo Sapiens
VADLHLYLY

SEQ ID NO: 467 - protein, 9 aa, Homo Sapiens
VADVHQYFY

SEQ ID NO: 468 - protein, 9 aa, Homo Sapiens
VGDLAELLY

SEQ ID NO: 469 - protein, 9 aa, Homo Sapiens
VIDWHNYGY

SEQ ID NO: 470 - protein, 9 aa, Homo Sapiens
VLDEAFQRY

SEQ ID NO: 471 - protein, 9 aa, Homo Sapiens
VLDELKHYY

SEQ ID NO: 472 - protein, 9 aa, Homo Sapiens
VLDELSVTY

SEQ ID NO: 473 - protein, 9 aa, Homo Sapiens
VLDFGDLTY

SEQ ID NO: 474 - protein, 9 aa, Homo Sapiens
VLDILLEQY

SEQ ID NO: 475 - protein, 9 aa, Homo Sapiens
VLDIQNNLY

SEQ ID NO: 476 - protein, 9 aa, Homo Sapiens
VLDNPSPFY

SEQ ID NO: 477 - protein, 9 aa, Homo Sapiens
VLDPKVGFY

SEQ ID NO: 478 - protein, 9 aa, Homo Sapiens
VLDPYLLKY

SEQ ID NO: 479 - protein, 9 aa, Homo Sapiens
VLDRLTFDY

SEQ ID NO: 480 - protein, 9 aa, Homo Sapiens
VLDSFLQGY

SEQ ID NO: 481 - protein, 9 aa, Homo Sapiens
VLDSLLVQY

SEQ ID NO: 482 - protein, 9 aa, Homo Sapiens
VLDVVYLVY

SEQ ID NO: 483 - protein, 9 aa, Homo Sapiens
VMDTLGIPY

SEQ ID NO: 484 - protein, 9 aa, Homo Sapiens
VMDVKPVDY

SEQ ID NO: 485 - protein, 9 aa, Homo Sapiens
VSDELRQWY

SEQ ID NO: 486 - protein, 9 aa, Homo Sapiens
VSDFGLSRY

SEQ ID NO: 487 - protein, 9 aa, Homo Sapiens
VSDPVGVLY

SEQ ID NO: 488 - protein, 9 aa, Homo Sapiens
VSDRYRFLY

SEQ ID NO: 489 - protein, 9 aa, Homo Sapiens
VSDYLRQSY

SEQ ID NO: 490 - protein, 9 aa, Homo Sapiens
VSEQELLRY

SEQ ID NO: 491 - protein, 9 aa, Homo Sapiens
VTDAVALRV

SEQ ID NO: 492 - protein, 9 aa, Homo Sapiens
VTDFIAPGY

SEQ ID NO: 493 - protein, 9 aa, Homo Sapiens
VTDHLGVVY

SEQ ID NO: 494 - protein, 9 aa, Homo Sapiens
VTDIHQLSF

SEQ ID NO: 495 - protein, 9 aa, Homo Sapiens
VTDLLKELV

SEQ ID NO: 496 - protein, 9 aa, Homo Sapiens
VTEEIFLEY

SEQ ID NO: 497 - protein, 9 aa, Homo Sapiens
VTEIMSMGY

SEQ ID NO: 498 - protein, 9 aa, Homo Sapiens
VTEIRQYFY

SEQ ID NO: 499 - protein, 9 aa, Homo Sapiens
VTEKDLLLY

SEQ ID NO: 500 - protein, 9 aa, Homo Sapiens
VTELHVISY

SEQ ID NO: 501 - protein, 9 aa, Homo Sapiens
VTENVVNLY

SEQ ID NO: 502 - protein, 9 aa, Homo Sapiens
VTETNVFFY

SEQ ID NO: 503 - protein, 9 aa, Homo Sapiens
VTFPEFLRY

SEQ ID NO: 504 - protein, 9 aa, Homo Sapiens
VVDDWIESY

SEQ ID NO: 505 - protein, 9 aa, Homo Sapiens
VVDGFNVLY

SEQ ID NO: 506 - protein, 9 aa, Homo Sapiens
VVDRIYSLY

SEQ ID NO: 507 - protein, 9 aa, Homo Sapiens
VVELDLLEY

SEQ ID NO: 508 - protein, 9 aa, Homo Sapiens
WIDPFEVSY

SEQ ID NO: 509 - protein, 9 aa, Homo Sapiens
WLESVRLEY

SEQ ID NO: 510 - protein, 9 aa, Homo Sapiens
WSEITELLY

SEQ ID NO: 511 - protein, 9 aa, Homo Sapiens
WSEPQSLCY

SEQ ID NO: 512 - protein, 9 aa, Homo Sapiens
WSERLMTAY

SEQ ID NO: 513 - protein, 9 aa, Homo Sapiens
WTDINVVVY

SEQ ID NO: 514 - protein, 9 aa, Homo Sapiens
WTDNRELTY

SEQ ID NO: 515 - protein, 9 aa, Homo Sapiens
WVDPYEVSY

SEQ ID NO: 516 - protein, 9 aa, Homo Sapiens
WVDSDQLLY

SEQ ID NO: 517 - protein, 9 aa, Homo Sapiens
YAALHGEFY

SEQ ID NO: 518 - protein, 9 aa, Homo Sapiens
YADPVNAHY

SEQ ID NO: 519 - protein, 9 aa, Homo Sapiens
YIDAQFEAY

SEQ ID NO: 520 - protein, 9 aa, Homo Sapiens
YIDAQFENY

SEQ ID NO: 521 - protein, 9 aa, Homo Sapiens
YIDDVFHAL

SEQ ID NO: 522 - protein, 9 aa, Homo Sapiens
YIDEQFERY

SEQ ID NO: 523 - protein, 9 aa, Homo Sapiens
YIDPIAMEY

SEQ ID NO: 524 - protein, 9 aa, Homo Sapiens
YIDSKFEDY

SEQ ID NO: 525 - protein, 9 aa, Homo Sapiens
YIEEFLQQY

SEQ ID NO: 526 - protein, 9 aa, Homo Sapiens
YLDDPDLKY

SEQ ID NO: 527 - protein, 9 aa, Homo Sapiens
YLDGTLAIY

SEQ ID NO: 528 - protein, 9 aa, Homo Sapiens
YLDQISRYY

SEQ ID NO: 529 - protein, 9 aa, Homo Sapiens
YLDTVPEVY

SEQ ID NO: 530 - protein, 9 aa, Homo Sapiens
YLDYDDTRY

SEQ ID NO: 531 - protein, 9 aa, Homo Sapiens
YLEETSIRY

SEQ ID NO: 532 - protein, 9 aa, Homo Sapiens
YLEQLHQLY

SEQ ID NO: 533 - protein, 9 aa, Homo Sapiens
YLEQLILKY

SEQ ID NO: 534 - protein, 9 aa, Homo Sapiens
YLERGKLFY

SEQ ID NO: 535 - protein, 9 aa, Homo Sapiens
YLETVAAYY

SEQ ID NO: 536 - protein, 9 aa, Homo Sapiens
YMDDYIFTY

SEQ ID NO: 537 - protein, 9 aa, Homo Sapiens
YMELYTHVY

SEQ ID NO: 538 - protein, 9 aa, Homo Sapiens
YQDLLQLQY

SEQ ID NO: 539 - protein, 9 aa, Homo Sapiens
YSAAWAEYY

SEQ ID NO: 540 - protein, 9 aa, Homo Sapiens
YSDFFTDCY

SEQ ID NO: 541 - protein, 9 aa, Homo Sapiens
YSDKYGLGY

SEQ ID NO: 542 - protein, 9 aa, Homo Sapiens
YSDLHAFYY

SEQ ID NO: 543 - protein, 9 aa, Homo Sapiens
YSQDYQQFY

SEQ ID NO: 544 - protein, 9 aa, Homo Sapiens
YSQELSLLY

SEQ ID NO: 545 - protein, 9 aa, Homo Sapiens
YSSPYPQEY

SEQ ID NO: 546 - protein, 9 aa, Homo Sapiens
YSTDENFRY

SEQ ID NO: 547 - protein, 9 aa, Homo Sapiens
YTAVVPLVY

SEQ ID NO: 548 - protein, 9 aa, Homo Sapiens
YTDATPLRV

SEQ ID NO: 549 - protein, 9 aa, Homo Sapiens
YTDCIPQLM

SEQ ID NO: 550 - protein, 9 aa, Homo Sapiens
YTDIPKIIY

SEQ ID NO: 551 - protein, 9 aa, Homo Sapiens
YTDIVGLLL

SEQ ID NO: 552 - protein, 9 aa, Homo Sapiens
YTDKIMTYL

SEQ ID NO: 553 - protein, 9 aa, Homo Sapiens
YTDKVVIGM

SEQ ID NO: 554 - protein, 9 aa, Homo Sapiens
YTDNLVRVW

SEQ ID NO: 555 - protein, 9 aa, Homo Sapiens
YTDTGLWGL

SEQ ID NO: 556 - protein, 9 aa, Homo Sapiens
YTEIDWKAY

SEQ ID NO: 557 - protein, 9 aa, Homo Sapiens
YTELEAIMY

SEQ ID NO: 558 - protein, 9 aa, Homo Sapiens
YTELLAQVY

SEQ ID NO: 559 - protein, 9 aa, Homo Sapiens
YTFPNGAKY

SEQ ID NO: 560 - protein, 9 aa, Homo Sapiens
YTGTPDWLY

SEQ ID NO: 561 - protein, 9 aa, Homo Sapiens
YTGVQILLY

SEQ ID NO: 562 - protein, 9 aa, Homo Sapiens
YTLLDVLYY

SEQ ID NO: 563 - protein, 9 aa, Homo Sapiens
YTMKEVLFY

SEQ ID NO: 564 - protein, 9 aa, Homo Sapiens
YTSDYFISY

SEQ ID NO: 565 - protein, 9 aa, Homo Sapiens
YVDDVFLRV

SEQ ID NO: 566 - protein, 9 aa, Homo Sapiens
YVDPQFLTY

SEQ ID NO: 567 - protein, 9 aa, Homo Sapiens
YVEKFALNY

SEQ ID NO: 568 - protein, 9 aa, Homo Sapiens
YVPEHWEYY

SEQ ID NO: 569 - protein, 10 aa, Homo Sapiens
AIDHNQMFQY

SEQ ID NO: 570 - protein, 10 aa, Homo Sapiens
AIDNSRNILY

SEQ ID NO: 571 - protein, 10 aa, Homo Sapiens
ALDDFTICYF

SEQ ID NO: 572 - protein, 10 aa, Homo Sapiens
ALDENGNLWY

SEQ ID NO: 573 - protein, 10 aa, Homo Sapiens
ALDGGFQMHY

SEQ ID NO: 574 - protein, 10 aa, Homo Sapiens
ALDSHILDYY

SEQ ID NO: 575 - protein, 10 aa, Homo Sapiens
ALDTINILLY

SEQ ID NO: 576 - protein, 10 aa, Homo Sapiens
ALDYLIGGLY

SEQ ID NO: 577 - protein, 10 aa, Homo Sapiens
ASAITGYLSY

SEQ ID NO: 578 - protein, 10 aa, Homo Sapiens
ASDAAPLQYL

SEQ ID NO: 579 - protein, 10 aa, Homo Sapiens
ASDALDKIRY

SEQ ID NO: 580 - protein, 10 aa, Homo Sapiens
ASEAEMRLFY

SEQ ID NO: 581 - protein, 10 aa, Homo Sapiens
ASEFGNHYLY

SEQ ID NO: 582 - protein, 10 aa, Homo Sapiens
ASEFPGAQHY

SEQ ID NO: 583 - protein, 10 aa, Homo Sapiens
ASEMILVLEY

SEQ ID NO: 584 - protein, 10 aa, Homo Sapiens
ATDLDVANFY

SEQ ID NO: 585 - protein, 10 aa, Homo Sapiens
ATDLIRISQY

SEQ ID NO: 586 - protein, 10 aa, Homo Sapiens
ATDLVVLDRY

SEQ ID NO: 587 - protein, 10 aa, Homo Sapiens
ATEDPWKTNY

SEQ ID NO: 588 - protein, 10 aa, Homo Sapiens
ATEQVSWGHY

SEQ ID NO: 589 - protein, 10 aa, Homo Sapiens
ATESVSLYYY

SEQ ID NO: 590 - protein, 10 aa, Homo Sapiens
AVDFAERHGY

SEQ ID NO: 591 - protein, 10 aa, Homo Sapiens
AVDPTSGQLY

SEQ ID NO: 592 - protein, 10 aa, Homo Sapiens
DADYPLRVLY

SEQ ID NO: 593 - protein, 10 aa, Homo Sapiens
DDTHYLLYIY

SEQ ID NO: 594 - protein, 10 aa, Homo Sapiens
DLDYGFLSNY

SEQ ID NO: 595 - protein, 10 aa, Homo Sapiens
DLEKEAPWEY

SEQ ID NO: 596 - protein, 10 aa, Homo Sapiens
DTDFYILDKY

SEQ ID NO: 597 - protein, 10 aa, Homo Sapiens
DTEKELQALY

SEQ ID NO: 598 - protein, 10 aa, Homo Sapiens
DTEPPPLLVY

SEQ ID NO: 599 - protein, 10 aa, Homo Sapiens
DVDHGNFFTY

SEQ ID NO: 600 - protein, 10 aa, Homo Sapiens
EAEPHPLWEY

SEQ ID NO: 601 - protein, 10 aa, Homo Sapiens
EAEWQTRWFY

SEQ ID NO: 602 - protein, 10 aa, Homo Sapiens
EIDHAEYYLY

SEQ ID NO: 603 - protein, 10 aa, Homo Sapiens
EIDIPHVWLY

SEQ ID NO: 604 - protein, 10 aa, Homo Sapiens
EIDNELFQFY

SEQ ID NO: 605 - protein, 10 aa, Homo Sapiens
ELDGFGLYLY

SEQ ID NO: 606 - protein, 10 aa, Homo Sapiens
ELDQRLFENY

SEQ ID NO: 607 - protein, 10 aa, Homo Sapiens
ESEFEMKVYY

SEQ ID NO: 608 - protein, 10 aa, Homo Sapiens
ESENVVCHFY

SEQ ID NO: 609 - protein, 10 aa, Homo Sapiens
ESQLPEKVEY

SEQ ID NO: 610 - protein, 10 aa, Homo Sapiens
ETDEKDFYLY

SEQ ID NO: 611 - protein, 10 aa, Homo Sapiens
ETEEGIYWRY

SEQ ID NO: 612 - protein, 10 aa, Homo Sapiens
ETEREYFNRY

SEQ ID NO: 613 - protein, 10 aa, Homo Sapiens
FGEKNGSWLY

SEQ ID NO: 614 - protein, 10 aa, Homo Sapiens
FIDIFTSNTY

SEQ ID NO: 615 - protein, 10 aa, Homo Sapiens
FLDDGHTFNY

SEQ ID NO: 616 - protein, 10 aa, Homo Sapiens
FLDKVVGLQK

SEQ ID NO: 617 - protein, 10 aa, Homo Sapiens
FLDNPDAFYY

SEQ ID NO: 618 - protein, 10 aa, Homo Sapiens
FLDPAQRDLY

SEQ ID NO: 619 - protein, 10 aa, Homo Sapiens
FLDTNETPYF

SEQ ID NO: 620 - protein, 10 aa, Homo Sapiens
FLDTQLESTY

SEQ ID NO: 621 - protein, 10 aa, Homo Sapiens
FLEAIENNKY

SEQ ID NO: 622 - protein, 10 aa, Homo Sapiens
FLSFPTTKTY

SEQ ID NO: 623 - protein, 10 aa, Homo Sapiens
FMDPASALYR

SEQ ID NO: 624 - protein, 10 aa, Homo Sapiens
FMDPEMETRY

SEQ ID NO: 625 - protein, 10 aa, Homo Sapiens
FMDSVIFTLY

SEQ ID NO: 626 - protein, 10 aa, Homo Sapiens
FMEKETPLRY

SEQ ID NO: 627 - protein, 10 aa, Homo Sapiens
FSDNDKLYLY

SEQ ID NO: 628 - protein, 10 aa, Homo Sapiens
FSDPGQPMSF

SEQ ID NO: 629 - protein, 10 aa, Homo Sapiens
FSDVISFILY

SEQ ID NO: 630 - protein, 10 aa, Homo Sapiens
FSDYPPLGRF

SEQ ID NO: 631 - protein, 10 aa, Homo Sapiens
FSEDGEYFAY

SEQ ID NO: 632 - protein, 10 aa, Homo Sapiens
FSEFTGVWKY

SEQ ID NO: 633 - protein, 10 aa, Homo Sapiens
FTDESYLELY

SEQ ID NO: 634 - protein, 10 aa, Homo Sapiens
FTDGDAALEF

SEQ ID NO: 635 - protein, 10 aa, Homo Sapiens
FTDNFSFNTY

SEQ ID NO: 636 - protein, 10 aa, Homo Sapiens
FTDVNSILRY

SEQ ID NO: 637 - protein, 10 aa, Homo Sapiens
FTDVPSIQIY

SEQ ID NO: 638 - protein, 10 aa, Homo Sapiens
FTEHEIQEWY

SEQ ID NO: 639 - protein, 10 aa, Homo Sapiens
FTEIKVGVAY

SEQ ID NO: 640 - protein, 10 aa, Homo Sapiens
FVDPYPVNKY

SEQ ID NO: 641 - protein, 10 aa, Homo Sapiens
GIDSRYFDLY

SEQ ID NO: 642 - protein, 10 aa, Homo Sapiens
GMDEVYNLFY

SEQ ID NO: 643 - protein, 10 aa, Homo Sapiens
GSDEPAFMYY

SEQ ID NO: 644 - protein, 10 aa, Homo Sapiens
GSDPLGLIAY

SEQ ID NO: 645 - protein, 10 aa, Homo Sapiens
GTEIAASLLY

SEQ ID NO: 646 - protein, 10 aa, Homo Sapiens
GTELGNELFY

SEQ ID NO: 647 - protein, 10 aa, Homo Sapiens
GVDLTGPQLY

SEQ ID NO: 648 - protein, 10 aa, Homo Sapiens
GVDVTGPHLY

SEQ ID NO: 649 - protein, 10 aa, Homo Sapiens
HIDCGSLLGY

SEQ ID NO: 650 - protein, 10 aa, Homo Sapiens
HLDEAQRLLY

SEQ ID NO: 651 - protein, 10 aa, Homo Sapiens
HLDIAQQNLY

SEQ ID NO: 652 - protein, 10 aa, Homo Sapiens
HLDPSQRALY

SEQ ID NO: 653 - protein, 10 aa, Homo Sapiens
HTDAVWGLAY

SEQ ID NO: 654 - protein, 10 aa, Homo Sapiens
HTDDPLTWDY

SEQ ID NO: 655 - protein, 10 aa, Homo Sapiens
HTDHHMFFDY

SEQ ID NO: 656 - protein, 10 aa, Homo Sapiens
HTELDTAFMY

SEQ ID NO: 657 - protein, 10 aa, Homo Sapiens
HVEEISELFY

SEQ ID NO: 658 - protein, 10 aa, Homo Sapiens
IADSNYNWFY

SEQ ID NO: 659 - protein, 10 aa, Homo Sapiens
IIDVVRSGYY

SEQ ID NO: 660 - protein, 10 aa, Homo Sapiens
ILDIPNQLYY

SEQ ID NO: 661 - protein, 10 aa, Homo Sapiens
ILEVDLKNGY

SEQ ID NO: 662 - protein, 10 aa, Homo Sapiens
ISDGKEYLFY

SEQ ID NO: 663 - protein, 10 aa, Homo Sapiens
ISDPFYGPWY

SEQ ID NO: 664 - protein, 10 aa, Homo Sapiens
ISEAGKDLLY

SEQ ID NO: 665 - protein, 10 aa, Homo Sapiens
ISEYAADIFY

SEQ ID NO: 666 - protein, 10 aa, Homo Sapiens
ISSEELPLYY

SEQ ID NO: 667 - protein, 10 aa, Homo Sapiens
ITDIQIPLDY

SEQ ID NO: 668 - protein, 10 aa, Homo Sapiens
ITDPDPDIRY

SEQ ID NO: 669 - protein, 10 aa, Homo Sapiens
ITDSAGHILY

SEQ ID NO: 670 - protein, 10 aa, Homo Sapiens
ITDVSWRLEY

SEQ ID NO: 671 - protein, 10 aa, Homo Sapiens
IVDAEWNILY

SEQ ID NO: 672 - protein, 10 aa, Homo Sapiens
IVDDFFIGRY

SEQ ID NO: 673 - protein, 10 aa, Homo Sapiens
KLDRSVFTAY

SEQ ID NO: 674 - protein, 10 aa, Homo Sapiens
KSDSGKPYYY

SEQ ID NO: 675 - protein, 10 aa, Homo Sapiens
KTDDLTMVLY

SEQ ID NO: 676 - protein, 10 aa, Homo Sapiens
KTELQFSDYY

SEQ ID NO: 677 - protein, 10 aa, Homo Sapiens
LADVNNIGKY

SEQ ID NO: 678 - protein, 10 aa, Homo Sapiens
LIDADPYLKY

SEQ ID NO: 679 - protein, 10 aa, Homo Sapiens
LIDQDARDLY

SEQ ID NO: 680 - protein, 10 aa, Homo Sapiens
LIDSRPFVEY

SEQ ID NO: 681 - protein, 10 aa, Homo Sapiens
LIVEPGPPGP

SEQ ID NO: 682 - protein, 10 aa, Homo Sapiens
LLDDAQRLLY

SEQ ID NO: 683 - protein, 10 aa, Homo Sapiens
LLDEAQRLLY

SEQ ID NO: 684 - protein, 10 aa, Homo Sapiens
LLDELLQKGY

SEQ ID NO: 685 - protein, 10 aa, Homo Sapiens
LLDFQEFTLY

SEQ ID NO: 686 - protein, 10 aa, Homo Sapiens
LLDKPVFSFY

SEQ ID NO: 687 - protein, 10 aa, Homo Sapiens
LLDLDEELRY

SEQ ID NO: 688 - protein, 10 aa, Homo Sapiens
LLDPAQKILY

SEQ ID NO: 689 - protein, 10 aa, Homo Sapiens
LLDPAQRTLY

SEQ ID NO: 690 - protein, 10 aa, Homo Sapiens
LLDPASFEYL

SEQ ID NO: 691 - protein, 10 aa, Homo Sapiens
LLDPGQRNIY

SEQ ID NO: 692 - protein, 10 aa, Homo Sapiens
LLDPRSYHTY

SEQ ID NO: 693 - protein, 10 aa, Homo Sapiens
LLDPSQKNLY

SEQ ID NO: 694 - protein, 10 aa, Homo Sapiens
LLDQGQLNKY

SEQ ID NO: 695 - protein, 10 aa, Homo Sapiens
LLDSDEPLVY

SEQ ID NO: 696 - protein, 10 aa, Homo Sapiens
LLDSSQKNLY

SEQ ID NO: 697 - protein, 10 aa, Homo Sapiens
LLDTAQRALY

SEQ ID NO: 698 - protein, 10 aa, Homo Sapiens
LLDTNRYLYF

SEQ ID NO: 699 - protein, 10 aa, Homo Sapiens
LLDTPAQLWY

SEQ ID NO: 700 - protein, 10 aa, Homo Sapiens
LLDTPVKTQY

SEQ ID NO: 701 - protein, 10 aa, Homo Sapiens
LLDTTEKYLY

SEQ ID NO: 702 - protein, 10 aa, Homo Sapiens
LLEDKHFQSY

SEQ ID NO: 703 - protein, 10 aa, Homo Sapiens
LLEIAQTHYY

SEQ ID NO: 704 - protein, 10 aa, Homo Sapiens
LLEVDATSKY

SEQ ID NO: 705 - protein, 10 aa, Homo Sapiens
LMEEVQTLYY

SEQ ID NO: 706 - protein, 10 aa, Homo Sapiens
LSDHLINQGY

SEQ ID NO: 707 - protein, 10 aa, Homo Sapiens
LSDIASALRY

SEQ ID NO: 708 - protein, 10 aa, Homo Sapiens
LSDIGSGIRY

SEQ ID NO: 709 - protein, 10 aa, Homo Sapiens
LSDISVVSNY

SEQ ID NO: 710 - protein, 10 aa, Homo Sapiens
LSDPCPGLYL

SEQ ID NO: 711 - protein, 10 aa, Homo Sapiens
LSDVDAFIAY

SEQ ID NO: 712 - protein, 10 aa, Homo Sapiens
LSDVFPGVQY

SEQ ID NO: 713 - protein, 10 aa, Homo Sapiens
LSEEGLLRLY

SEQ ID NO: 714 - protein, 10 aa, Homo Sapiens
LSEINKPNFY

SEQ ID NO: 715 - protein, 10 aa, Homo Sapiens
LSLARGLDYY

SEQ ID NO: 716 - protein, 10 aa, Homo Sapiens
LSSLPTQMDY

SEQ ID NO: 717 - protein, 10 aa, Homo Sapiens
LTDDGNKWLY

SEQ ID NO: 718 - protein, 10 aa, Homo Sapiens
LTDDGRVFLW

SEQ ID NO: 719 - protein, 10 aa, Homo Sapiens
LTDEQIRFLY

SEQ ID NO: 720 - protein, 10 aa, Homo Sapiens
LTDGVSQIHY

SEQ ID NO: 721 - protein, 10 aa, Homo Sapiens
LTDIFQHDTY

SEQ ID NO: 722 - protein, 10 aa, Homo Sapiens
LTDILGIEDY

SEQ ID NO: 723 - protein, 10 aa, Homo Sapiens
LTDITKGVQY

SEQ ID NO: 724 - protein, 10 aa, Homo Sapiens
LTDLEIKFQY

SEQ ID NO: 725 - protein, 10 aa, Homo Sapiens
LTDLVDDNYF

SEQ ID NO: 726 - protein, 10 aa, Homo Sapiens
LTDPIQGTEY

SEQ ID NO: 727 - protein, 10 aa, Homo Sapiens
LTDPMFRGIY

SEQ ID NO: 728 - protein, 10 aa, Homo Sapiens
LTDTFTAYYR

SEQ ID NO: 729 - protein, 10 aa, Homo Sapiens
LTDYFLKDEY

SEQ ID NO: 730 - protein, 10 aa, Homo Sapiens
LTEHSSMPVE

SEQ ID NO: 731 - protein, 10 aa, Homo Sapiens
LTEITKGWLY

SEQ ID NO: 732 - protein, 10 aa, Homo Sapiens
LTELPPLDDY

SEQ ID NO: 733 - protein, 10 aa, Homo Sapiens
LTETIYKNYY

SEQ ID NO: 734 - protein, 10 aa, Homo Sapiens
LTEVDNYHFY

SEQ ID NO: 735 - protein, 10 aa, Homo Sapiens
LTEYFLNDKY

SEQ ID NO: 736 - protein, 10 aa, Homo Sapiens
LTLGRVEDFY

SEQ ID NO: 737 - protein, 10 aa, Homo Sapiens
LTWDGFPLHY

SEQ ID NO: 738 - protein, 10 aa, Homo Sapiens
LVDAFVEHRY

SEQ ID NO: 739 - protein, 10 aa, Homo Sapiens
LVDDGWILAY

SEQ ID NO: 740 - protein, 10 aa, Homo Sapiens
LVDHGDISFY

SEQ ID NO: 741 - protein, 10 aa, Homo Sapiens
LVDPWTPHLY

SEQ ID NO: 742 - protein, 10 aa, Homo Sapiens
LVDQNIFSFY

SEQ ID NO: 743 - protein, 10 aa, Homo Sapiens
LVDSKGFDEY

SEQ ID NO: 744 - protein, 10 aa, Homo Sapiens
LVEEVQLNFY

SEQ ID NO: 745 - protein, 10 aa, Homo Sapiens
LVEVEGDNRY

SEQ ID NO: 746 - protein, 10 aa, Homo Sapiens
MAELGPLNKY

SEQ ID NO: 747 - protein, 10 aa, Homo Sapiens
MLEAGILDTY

SEQ ID NO: 748 - protein, 10 aa, Homo Sapiens
MSDLLSPILY

SEQ ID NO: 749 - protein, 10 aa, Homo Sapiens
MSDSYLPSYY

SEQ ID NO: 750 - protein, 10 aa, Homo Sapiens
MSEIEAKVRY

SEQ ID NO: 751 - protein, 10 aa, Homo Sapiens
MTDLYPPELF

SEQ ID NO: 752 - protein, 10 aa, Homo Sapiens
MTDPNVALTF

SEQ ID NO: 753 - protein, 10 aa, Homo Sapiens
MTELYDYPKY

SEQ ID NO: 754 - protein, 10 aa, Homo Sapiens
NADVALVNFY

SEQ ID NO: 755 - protein, 10 aa, Homo Sapiens
NIDIPEGNWY

SEQ ID NO: 756 - protein, 10 aa, Homo Sapiens
NIDLVSKLLY

SEQ ID NO: 757 - protein, 10 aa, Homo Sapiens
NIEAAKDLLY

SEQ ID NO: 758 - protein, 10 aa, Homo Sapiens
NLDQATRVAY

SEQ ID NO: 759 - protein, 10 aa, Homo Sapiens
NMDTFSNLLY

SEQ ID NO: 760 - protein, 10 aa, Homo Sapiens
NSESGYILFY

SEQ ID NO: 761 - protein, 10 aa, Homo Sapiens
NTDFWKTLRY

SEQ ID NO: 762 - protein, 10 aa, Homo Sapiens
NTDGFLLPKY

SEQ ID NO: 763 - protein, 10 aa, Homo Sapiens
NTDHLTTVLY

SEQ ID NO: 764 - protein, 10 aa, Homo Sapiens
NTDHQTQLLY

SEQ ID NO: 765 - protein, 10 aa, Homo Sapiens
NTDLWIVMEY

SEQ ID NO: 766 - protein, 10 aa, Homo Sapiens
NTDPSIVMTY

SEQ ID NO: 767 - protein, 10 aa, Homo Sapiens
NTDPWAGYRY

SEQ ID NO: 768 - protein, 10 aa, Homo Sapiens
NTDSLDWALY

SEQ ID NO: 769 - protein, 10 aa, Homo Sapiens
NTEVLKNMGY

SEQ ID NO: 770 - protein, 10 aa, Homo Sapiens
NVDGTHWLEY

SEQ ID NO: 771 - protein, 10 aa, Homo Sapiens
NVDTESALLY

SEQ ID NO: 772 - protein, 10 aa, Homo Sapiens
PLDHLKPLEY

SEQ ID NO: 773 - protein, 10 aa, Homo Sapiens
PSDIFMVMEY

SEQ ID NO: 774 - protein, 10 aa, Homo Sapiens
PSDLTVGQFY

SEQ ID NO: 775 - protein, 10 aa, Homo Sapiens
PTEISQSLLY

SEQ ID NO: 776 - protein, 10 aa, Homo Sapiens
QAEILLSNHY

SEQ ID NO: 777 - protein, 10 aa, Homo Sapiens
QLDLAQRTLY

SEQ ID NO: 778 - protein, 10 aa, Homo Sapiens
QLDTRVSEFY

SEQ ID NO: 779 - protein, 10 aa, Homo Sapiens
QSDPWQQELY

SEQ ID NO: 780 - protein, 10 aa, Homo Sapiens
QSELQSQVRY

SEQ ID NO: 781 - protein, 10 aa, Homo Sapiens
QTEIRLRLHY

SEQ ID NO: 782 - protein, 10 aa, Homo Sapiens
QTENLGVVYY

SEQ ID NO: 783 - protein, 10 aa, Homo Sapiens
QTESQQIRYF

SEQ ID NO: 784 - protein, 10 aa, Homo Sapiens
QTVAWFPLYY

SEQ ID NO: 785 - protein, 10 aa, Homo Sapiens
QVDPLSALKY

SEQ ID NO: 786 - protein, 10 aa, Homo Sapiens
QVDPNYAYAY

SEQ ID NO: 787 - protein, 10 aa, Homo Sapiens
RLDTPLYFSY

SEQ ID NO: 788 - protein, 10 aa, Homo Sapiens
RLDVLVNNAY

SEQ ID NO: 789 - protein, 10 aa, Homo Sapiens
RLEIEPEWAY

SEQ ID NO: 790 - protein, 10 aa, Homo Sapiens
RTDAILLGHY

SEQ ID NO: 791 - protein, 10 aa, Homo Sapiens
RTELPQFVSY

SEQ ID NO: 792 - protein, 10 aa, Homo Sapiens
RVDPAKGLFY

SEQ ID NO: 793 - protein, 10 aa, Homo Sapiens
RVDPIGPLSY

SEQ ID NO: 794 - protein, 10 aa, Homo Sapiens
RVDPNGFFLY

SEQ ID NO: 795 - protein, 10 aa, Homo Sapiens
RVDVFTNLGY

SEQ ID NO: 796 - protein, 10 aa, Homo Sapiens
SADVPLVVEY

SEQ ID NO: 797 - protein, 10 aa, Homo Sapiens
SIDVAGNLDY

SEQ ID NO: 798 - protein, 10 aa, Homo Sapiens
SLDSPSYVLY

SEQ ID NO: 799 - protein, 10 aa, Homo Sapiens
SLDVGGPLRY

SEQ ID NO: 800 - protein, 10 aa, Homo Sapiens
SSDEVNFLVY

SEQ ID NO: 801 - protein, 10 aa, Homo Sapiens
SSDFLEFVNY

SEQ ID NO: 802 - protein, 10 aa, Homo Sapiens
SSDSVGGFRY

SEQ ID NO: 803 - protein, 10 aa, Homo Sapiens
SSDYSIFDNY

SEQ ID NO: 804 - protein, 10 aa, Homo Sapiens
SSEDLMKELY

SEQ ID NO: 805 - protein, 10 aa, Homo Sapiens
SSEELLSLKY

SEQ ID NO: 806 - protein, 10 aa, Homo Sapiens
SSESLNHLLY

SEQ ID NO: 807 - protein, 10 aa, Homo Sapiens
STDDPMQFHY

SEQ ID NO: 808 - protein, 10 aa, Homo Sapiens
STDKAEYTFY

SEQ ID NO: 809 - protein, 10 aa, Homo Sapiens
STDKFKTDFY

SEQ ID NO: 810 - protein, 10 aa, Homo Sapiens
STDLQDYTYY

SEQ ID NO: 811 - protein, 10 aa, Homo Sapiens
STDPREALQY

SEQ ID NO: 812 - protein, 10 aa, Homo Sapiens
STDPSVLGKY

SEQ ID NO: 813 - protein, 10 aa, Homo Sapiens
STDTSLKIFY

SEQ ID NO: 814 - protein, 10 aa, Homo Sapiens
STEEARFLTY

SEQ ID NO: 815 - protein, 10 aa, Homo Sapiens
STESMDFLKY

SEQ ID NO: 816 - protein, 10 aa, Homo Sapiens
SVDPHGFISY

SEQ ID NO: 817 - protein, 10 aa, Homo Sapiens
SVDSNLLSDY

SEQ ID NO: 818 - protein, 10 aa, Homo Sapiens
TADHNLLLYE

SEQ ID NO: 819 - protein, 10 aa, Homo Sapiens
TADTLMGLRY

SEQ ID NO: 820 - protein, 10 aa, Homo Sapiens
TIDDFRNQVY

SEQ ID NO: 821 - protein, 10 aa, Homo Sapiens
TLAVAAGLYY

SEQ ID NO: 822 - protein, 10 aa, Homo Sapiens
TLDAGKFQIY

SEQ ID NO: 823 - protein, 10 aa, Homo Sapiens
TLDAVKFSQY

SEQ ID NO: 824 - protein, 10 aa, Homo Sapiens
TLDLPHFDEY

SEQ ID NO: 825 - protein, 10 aa, Homo Sapiens
TLDPNFLDAY

SEQ ID NO: 826 - protein, 10 aa, Homo Sapiens
TLDPQTGLFY

SEQ ID NO: 827 - protein, 10 aa, Homo Sapiens
TMDIPGCLLY

SEQ ID NO: 828 - protein, 10 aa, Homo Sapiens
TSDDPWLTAY

SEQ ID NO: 829 - protein, 10 aa, Homo Sapiens
TSDELEDLRY

SEQ ID NO: 830 - protein, 10 aa, Homo Sapiens
TSDQATLLLY

SEQ ID NO: 831 - protein, 10 aa, Homo Sapiens
TSDTQWGWFY

SEQ ID NO: 832 - protein, 10 aa, Homo Sapiens
TSDVPGKLIY

SEQ ID NO: 833 - protein, 10 aa, Homo Sapiens
TSEPKPFLYY

SEQ ID NO: 834 - protein, 10 aa, Homo Sapiens
TTDCLQILAY

SEQ ID NO: 835 - protein, 10 aa, Homo Sapiens
TTDCSFIFLY

SEQ ID NO: 836 - protein, 10 aa, Homo Sapiens
TTDDWKDFLY

SEQ ID NO: 837 - protein, 10 aa, Homo Sapiens
TTDLSFLDKY

SEQ ID NO: 838 - protein, 10 aa, Homo Sapiens
TTEESLRNYY

SEQ ID NO: 839 - protein, 10 aa, Homo Sapiens
TTEETLTMLY

SEQ ID NO: 840 - protein, 10 aa, Homo Sapiens
TTEILRSMLY

SEQ ID NO: 841 - protein, 10 aa, Homo Sapiens
TTSHLMGMFY

SEQ ID NO: 842 - protein, 10 aa, Homo Sapiens
TVDNVQPLLY

SEQ ID NO: 843 - protein, 10 aa, Homo Sapiens
TVDPASLWEY

SEQ ID NO: 844 - protein, 10 aa, Homo Sapiens
TVEDPVTVEY

SEQ ID NO: 845 - protein, 10 aa, Homo Sapiens
VIDSAELQAY

SEQ ID NO: 846 - protein, 10 aa, Homo Sapiens
VIDVNKVVEY

SEQ ID NO: 847 - protein, 10 aa, Homo Sapiens
VLDPYLLKYF

SEQ ID NO: 848 - protein, 10 aa, Homo Sapiens
VLEHVPLLLY

SEQ ID NO: 849 - protein, 10 aa, Homo Sapiens
VSDGIIAPGY

SEQ ID NO: 850 - protein, 10 aa, Homo Sapiens
VSDSKQFTYY

SEQ ID NO: 851 - protein, 10 aa, Homo Sapiens
VSDYYSQLIY

SEQ ID NO: 852 - protein, 10 aa, Homo Sapiens
VSERDVYLTY

SEQ ID NO: 853 - protein, 10 aa, Homo Sapiens
VTDDLVCLVY

SEQ ID NO: 854 - protein, 10 aa, Homo Sapiens
VTDHLGVVYY

SEQ ID NO: 855 - protein, 10 aa, Homo Sapiens
VTDQNKIVTY

SEQ ID NO: 856 - protein, 10 aa, Homo Sapiens
VTDTGALYLY

SEQ ID NO: 857 - protein, 10 aa, Homo Sapiens
VTEEPQRLFY

SEQ ID NO: 858 - protein, 10 aa, Homo Sapiens
VTENLRLSLY

SEQ ID NO: 859 - protein, 10 aa, Homo Sapiens
VVDVPEFLVY

SEQ ID NO: 860 - protein, 10 aa, Homo Sapiens
VVEQLKDWLY

SEQ ID NO: 861 - protein, 10 aa, Homo Sapiens
WLDRLGESKY

SEQ ID NO: 862 - protein, 10 aa, Homo Sapiens
WLEEGIHWQY

SEQ ID NO: 863 - protein, 10 aa, Homo Sapiens
WSDYSDNLKY

SEQ ID NO: 864 - protein, 10 aa, Homo Sapiens
WSEPFYQETY

SEQ ID NO: 865 - protein, 10 aa, Homo Sapiens
WTDILSHGRY

SEQ ID NO: 866 - protein, 10 aa, Homo Sapiens
WVDDQRPENY

SEQ ID NO: 867 - protein, 10 aa, Homo Sapiens
WVDVAHLVLY

SEQ ID NO: 868 - protein, 10 aa, Homo Sapiens
YADGESFLGY

SEQ ID NO: 869 - protein, 10 aa, Homo Sapiens
YADNQVMHFY

SEQ ID NO: 870 - protein, 10 aa, Homo Sapiens
YADPYRQLQY

SEQ ID NO: 871 - protein, 10 aa, Homo Sapiens
YADTFGDINY

SEQ ID NO: 872 - protein, 10 aa, Homo Sapiens
YIDPIAMEYY

SEQ ID NO: 873 - protein, 10 aa, Homo Sapiens
YLAQDFFDRY

SEQ ID NO: 874 - protein, 10 aa, Homo Sapiens
YLDKEDTFFY

SEQ ID NO: 875 - protein, 10 aa, Homo Sapiens
YLDLLLGNCY

SEQ ID NO: 876 - protein, 10 aa, Homo Sapiens
YLDNVIGHSY

SEQ ID NO: 877 - protein, 10 aa, Homo Sapiens
YLDPVQRDLY

SEQ ID NO: 878 - protein, 10 aa, Homo Sapiens
YLDSIPPGQY

SEQ ID NO: 879 - protein, 10 aa, Homo Sapiens
YLENLEKLMY

SEQ ID NO: 880 - protein, 10 aa, Homo Sapiens
YLEREDFFFY

SEQ ID NO: 881 - protein, 10 aa, Homo Sapiens
YSDAFLNDSY

SEQ ID NO: 882 - protein, 10 aa, Homo Sapiens
YSDEFGNLDF

SEQ ID NO: 883 - protein, 10 aa, Homo Sapiens
YSDFPFHEDY

SEQ ID NO: 884 - protein, 10 aa, Homo Sapiens
YSDKYFDEHY

SEQ ID NO: 885 - protein, 10 aa, Homo Sapiens
YSDSGLFGIY

SEQ ID NO: 886 - protein, 10 aa, Homo Sapiens
YSDSLVQKGY

SEQ ID NO: 887 - protein, 10 aa, Homo Sapiens
YSEDHIIGAY

SEQ ID NO: 888 - protein, 10 aa, Homo Sapiens
YSEIKDFLSY

SEQ ID NO: 889 - protein, 10 aa, Homo Sapiens
YSESSQLLYL

SEQ ID NO: 890 - protein, 10 aa, Homo Sapiens
YSETLLSYFY

SEQ ID NO: 891 - protein, 10 aa, Homo Sapiens
YSEVYPGQQY

SEQ ID NO: 892 - protein, 10 aa, Homo Sapiens
YSFLDKMSFY

SEQ ID NO: 893 - protein, 10 aa, Homo Sapiens
YTDFDGTRVY

SEQ ID NO: 894 - protein, 10 aa, Homo Sapiens
YTDIINIFLY

SEQ ID NO: 895 - protein, 10 aa, Homo Sapiens
YTDLLRLFEY

SEQ ID NO: 896 - protein, 10 aa, Homo Sapiens
YTDTGLWGLY

SEQ ID NO: 897 - protein, 10 aa, Homo Sapiens
YTEDSPGLKV

SEQ ID NO: 898 - protein, 10 aa, Homo Sapiens
YTEEFDFKEY

SEQ ID NO: 899 - protein, 10 aa, Homo Sapiens
YTEPNYWIRY

SEQ ID NO: 900 - protein, 10 aa, Homo Sapiens
YTESWRWSAY

SEQ ID NO: 901 - protein, 10 aa, Homo Sapiens
YTFGTKEPLY

SEQ ID NO: 902 - protein, 10 aa, Homo Sapiens
YTIYRPDEGY

SEQ ID NO: 903 - protein, 10 aa, Homo Sapiens
YTLYRPEEGY

SEQ ID NO: 904 - protein, 10 aa, Homo Sapiens
YTSNLAYSFY

SEQ ID NO: 905 - protein, 10 aa, Homo Sapiens
YTSYPMHDFY

SEQ ID NO: 906 - protein, 10 aa, Homo Sapiens
YVDDASWMRY

SEQ ID NO: 907 - protein, 10 aa, Homo Sapiens
YVDPQFLTYM

SEQ ID NO: 908 - protein, 10 aa, Homo Sapiens
YVDQAELEKY

SEQ ID NO: 909 - protein, 10 aa, Homo Sapiens
YVDQVLQLVY

SEQ ID NO: 910 - protein, 11 aa, Homo Sapiens
AIMELDDTLKY

SEQ ID NO: 911 - protein, 11 aa, Homo Sapiens
ALDESFLGTLY

SEQ ID NO: 912 - protein, 11 aa, Homo Sapiens
ASDKETYELRY

SEQ ID NO: 913 - protein, 11 aa, Homo Sapiens
ATDIFSYLVEY

SEQ ID NO: 914 - protein, 11 aa, Homo Sapiens
ATDIQVLALTY

SEQ ID NO: 915 - protein, 11 aa, Homo Sapiens
ATEESFFILKY

SEQ ID NO: 916 - protein, 11 aa, Homo Sapiens
ATELDAWLAKY

SEQ ID NO: 917 - protein, 11 aa, Homo Sapiens
ATESILHFAGY

SEQ ID NO: 918 - protein, 11 aa, Homo Sapiens
ATESPLDFTKY

SEQ ID NO: 919 - protein, 11 aa, Homo Sapiens
ATEVDSRWQEY

SEQ ID NO: 920 - protein, 11 aa, Homo Sapiens
ATQLAADLLKY

SEQ ID NO: 921 - protein, 11 aa, Homo Sapiens
ATVFRTVLDYY

SEQ ID NO: 922 - protein, 11 aa, Homo Sapiens
AVDVNNMLHLY

SEQ ID NO: 923 - protein, 11 aa, Homo Sapiens
CLEPQITPSYY

SEQ ID NO: 924 - protein, 11 aa, Homo Sapiens
CSDKMSLLLVY

SEQ ID NO: 925 - protein, 11 aa, Homo Sapiens
DSDHLTIYNAY

SEQ ID NO: 926 - protein, 11 aa, Homo Sapiens
DSDLLDSQVQY

SEQ ID NO: 927 - protein, 11 aa, Homo Sapiens
DTDIVDEAIYY

SEQ ID NO: 928 - protein, 11 aa, Homo Sapiens
DTELKQVAYIY

SEQ ID NO: 929 - protein, 11 aa, Homo Sapiens
EADGAAWVLLY

SEQ ID NO: 930 - protein, 11 aa, Homo Sapiens
EIDGRSISLYY

SEQ ID NO: 931 - protein, 11 aa, Homo Sapiens
ELDIGDATQVY

SEQ ID NO: 932 - protein, 11 aa, Homo Sapiens
ELDISDSKIRY

SEQ ID NO: 933 - protein, 11 aa, Homo Sapiens
ELDPAVMDQFY

SEQ ID NO: 934 - protein, 11 aa, Homo Sapiens
ELDPLTGEWHY

SEQ ID NO: 935 - protein, 11 aa, Homo Sapiens
ELDPMAMTQKY

SEQ ID NO: 936 - protein, 11 aa, Homo Sapiens
ESAFRKLDELY

SEQ ID NO: 937 - protein, 11 aa, Homo Sapiens
ETDEKDFYLYY

SEQ ID NO: 938 - protein, 11 aa, Homo Sapiens
ETDLLDIRSEY

SEQ ID NO: 939 - protein, 11 aa, Homo Sapiens
ETEEDKFLLLY

SEQ ID NO: 940 - protein, 11 aa, Homo Sapiens
ETELISTTANY

SEQ ID NO: 941 - protein, 11 aa, Homo Sapiens
ETERFRELLLY

SEQ ID NO: 942 - protein, 11 aa, Homo Sapiens
ETEVYEGALLY

SEQ ID NO: 943 - protein, 11 aa, Homo Sapiens
ETFLTSPEELY

SEQ ID NO: 944 - protein, 11 aa, Homo Sapiens
FADQLIAAGHY

SEQ ID NO: 945 - protein, 11 aa, Homo Sapiens
FIDHDITSQLY

SEQ ID NO: 946 - protein, 11 aa, Homo Sapiens
FIDSQRVWAEY

SEQ ID NO: 947 - protein, 11 aa, Homo Sapiens
FIDVDDERWHY

SEQ ID NO: 948 - protein, 11 aa, Homo Sapiens
FIEESRQLLSY

SEQ ID NO: 949 - protein, 11 aa, Homo Sapiens
FLDASGAKLDY

SEQ ID NO: 950 - protein, 11 aa, Homo Sapiens
FLDPASAGIGY

SEQ ID NO: 951 - protein, 11 aa, Homo Sapiens
FLDPITGTFRY

SEQ ID NO: 952 - protein, 11 aa, Homo Sapiens
FLEDAIAVTRY

SEQ ID NO: 953 - protein, 11 aa, Homo Sapiens
FLEIVSEKSRY

SEQ ID NO: 954 - protein, 11 aa, Homo Sapiens
FMDPGPEGKLY

SEQ ID NO: 955 - protein, 11 aa, Homo Sapiens
FSDIHAGELYF

SEQ ID NO: 956 - protein, 11 aa, Homo Sapiens
FSDLNLEAHMY

SEQ ID NO: 957 - protein, 11 aa, Homo Sapiens
FSDPFTGGGRY

SEQ ID NO: 958 - protein, 11 aa, Homo Sapiens
FSEDRPFAVGY

SEQ ID NO: 959 - protein, 11 aa, Homo Sapiens
FSEEKIQYLVY

SEQ ID NO: 960 - protein, 11 aa, Homo Sapiens
FSEPDFVAKFY

SEQ ID NO: 961 - protein, 11 aa, Homo Sapiens
FSEPFHLIVSY

SEQ ID NO: 962 - protein, 11 aa, Homo Sapiens
FSEPSFITESY

SEQ ID NO: 963 - protein, 11 aa, Homo Sapiens
FSQPENQNLLY

SEQ ID NO: 964 - protein, 11 aa, Homo Sapiens
FTDEEGYGRYL

SEQ ID NO: 965 - protein, 11 aa, Homo Sapiens
FTEIGIHLNAY

SEQ ID NO: 966 - protein, 11 aa, Homo Sapiens
FTENDKEYQEY

SEQ ID NO: 967 - protein, 11 aa, Homo Sapiens
FVAEPDNKNVY

SEQ ID NO: 968 - protein, 11 aa, Homo Sapiens
FVEENLQHWSY

SEQ ID NO: 969 - protein, 11 aa, Homo Sapiens
FVESSTSVLRY

SEQ ID NO: 970 - protein, 11 aa, Homo Sapiens
GSDITSITERY

SEQ ID NO: 971 - protein, 11 aa, Homo Sapiens
GTDRTGFTFKY

SEQ ID NO: 972 - protein, 11 aa, Homo Sapiens
HIDFGGTSVWY

SEQ ID NO: 973 - protein, 11 aa, Homo Sapiens
HLDDQMTLLQY

SEQ ID NO: 974 - protein, 11 aa, Homo Sapiens
HLDFNLDKTLY

SEQ ID NO: 975 - protein, 11 aa, Homo Sapiens
HSDELTSLLGY

SEQ ID NO: 976 - protein, 11 aa, Homo Sapiens
HSEVLIDLTEY

SEQ ID NO: 977 - protein, 11 aa, Homo Sapiens
HTDIQEYIGCY

SEQ ID NO: 978 - protein, 11 aa, Homo Sapiens
IIDLAGDTVRY

SEQ ID NO: 979 - protein, 11 aa, Homo Sapiens
ILDNADVLSQY

SEQ ID NO: 980 - protein, 11 aa, Homo Sapiens
IMDSTEAQLRY

SEQ ID NO: 981 - protein, 11 aa, Homo Sapiens
ISDAAQLPHDY

SEQ ID NO: 982 - protein, 11 aa, Homo Sapiens
ISEPWTQRSFY

SEQ ID NO: 983 - protein, 11 aa, Homo Sapiens
ISEQTGKELLY

SEQ ID NO: 984 - protein, 11 aa, Homo Sapiens
ISESIKELQFY

SEQ ID NO: 985 - protein, 11 aa, Homo Sapiens
ISETPIIGNKY

SEQ ID NO: 986 - protein, 11 aa, Homo Sapiens
ISSENLLDAVY

SEQ ID NO: 987 - protein, 11 aa, Homo Sapiens
ISYGPDWKDFY

SEQ ID NO: 988 - protein, 11 aa, Homo Sapiens
ITDDQFDFHTY

SEQ ID NO: 989 - protein, 11 aa, Homo Sapiens
ITDFINILHRY

SEQ ID NO: 990 - protein, 11 aa, Homo Sapiens
ITDLPDHLLSY

SEQ ID NO: 991 - protein, 11 aa, Homo Sapiens
ITELLYKDGRY

SEQ ID NO: 992 - protein, 11 aa, Homo Sapiens
KSDVEAIFSKY

SEQ ID NO: 993 - protein, 11 aa, Homo Sapiens
KSDVETIFSKY

SEQ ID NO: 994 - protein, 11 aa, Homo Sapiens
KTDMVEKALLY

SEQ ID NO: 995 - protein, 11 aa, Homo Sapiens
KTEDPDLPAFY

SEQ ID NO: 996 - protein, 11 aa, Homo Sapiens
KTELERAFGYY

SEQ ID NO: 997 - protein, 11 aa, Homo Sapiens
KTETEPVFWYY

SEQ ID NO: 998 - protein, 11 aa, Homo Sapiens
LIEEGGLQHLY

SEQ ID NO: 999 - protein, 11 aa, Homo Sapiens
LIEPHYQPWSY

SEQ ID NO: 1000 - protein, 11 aa, Homo Sapiens
LINYIEMHGLY

SEQ ID NO: 1001 - protein, 11 aa, Homo Sapiens
LLDIEQDTYRY

SEQ ID NO: 1002 - protein, 11 aa, Homo Sapiens
LLDKGVYGLLY

SEQ ID NO: 1003 - protein, 11 aa, Homo Sapiens
LLDPKYGMFRY

SEQ ID NO: 1004 - protein, 11 aa, Homo Sapiens
LLDPSITLGQY

SEQ ID NO: 1005 - protein, 11 aa, Homo Sapiens
LLDPSVFHVKY

SEQ ID NO: 1006 - protein, 11 aa, Homo Sapiens
LLEDFLEHEGY

SEQ ID NO: 1007 - protein, 11 aa, Homo Sapiens
LLEGDIHGQYY

SEQ ID NO: 1008 - protein, 11 aa, Homo Sapiens
LLENDVSTLGY

SEQ ID NO: 1009 - protein, 11 aa, Homo Sapiens
LQERNPENWAY

SEQ ID NO: 1010 - protein, 11 aa, Homo Sapiens
LSDEHVQFLVY

SEQ ID NO: 1011 - protein, 11 aa, Homo Sapiens
LSDIASALRYL

SEQ ID NO: 1012 - protein, 11 aa, Homo Sapiens
LSDIASLKALY

SEQ ID NO: 1013 - protein, 11 aa, Homo Sapiens
LSDIGSGIRYL

SEQ ID NO: 1014 - protein, 11 aa, Homo Sapiens
LSDTKYLEMIY

SEQ ID NO: 1015 - protein, 11 aa, Homo Sapiens
LSELAPSLPSY

SEQ ID NO: 1016 - protein, 11 aa, Homo Sapiens
LSELFHSRNYY

SEQ ID NO: 1017 - protein, 11 aa, Homo Sapiens
LSEPEEAAALY

SEQ ID NO: 1018 - protein, 11 aa, Homo Sapiens
LTDDHVQFLIY

SEQ ID NO: 1019 - protein, 11 aa, Homo Sapiens
LTDHTVTFLQY

SEQ ID NO: 1020 - protein, 11 aa, Homo Sapiens
LTDIHGNVLQY

SEQ ID NO: 1021 - protein, 11 aa, Homo Sapiens
LTDLVDDNYFY

SEQ ID NO: 1022 - protein, 11 aa, Homo Sapiens
LTDRLWFKSTY

SEQ ID NO: 1023 - protein, 11 aa, Homo Sapiens
LTDYDIRFYMY

SEQ ID NO: 1024 - protein, 11 aa, Homo Sapiens
LTEINRSFKEY

SEQ ID NO: 1025 - protein, 11 aa, Homo Sapiens
LTELLERAAFY

SEQ ID NO: 1026 - protein, 11 aa, Homo Sapiens
LTFVPSAEDFY

SEQ ID NO: 1027 - protein, 11 aa, Homo Sapiens
LVDNSIRELQY

SEQ ID NO: 1028 - protein, 11 aa, Homo Sapiens
MIEIAGVKLLY

SEQ ID NO: 1029 - protein, 11 aa, Homo Sapiens
MTDEIFHDVAY

SEQ ID NO: 1030 - protein, 11 aa, Homo Sapiens
NSDTNIRWNNY

SEQ ID NO: 1031 - protein, 11 aa, Homo Sapiens
NSDYLALLQAY

SEQ ID NO: 1032 - protein, 11 aa, Homo Sapiens
NSYWVGEDSTY

SEQ ID NO: 1033 - protein, 11 aa, Homo Sapiens
NTEVLLSHLSY

SEQ ID NO: 1034 - protein, 11 aa, Homo Sapiens
NTSPLLGDARF

SEQ ID NO: 1035 - protein, 11 aa, Homo Sapiens
PSDPRYHEVHY

SEQ ID NO: 1036 - protein, 11 aa, Homo Sapiens
PTDATLNRLLY

SEQ ID NO: 1037 - protein, 11 aa, Homo Sapiens
PTDYADIMMGY

SEQ ID NO: 1038 - protein, 11 aa, Homo Sapiens
QADPTKLELLY

SEQ ID NO: 1039 - protein, 11 aa, Homo Sapiens
QLDVAGRVMQY

SEQ ID NO: 1040 - protein, 11 aa, Homo Sapiens
QLEDGRTLSDY

SEQ ID NO: 1041 - protein, 11 aa, Homo Sapiens
QLEWDDSTLSY

SEQ ID NO: 1042 - protein, 11 aa, Homo Sapiens
QSDIVSTMEHY

SEQ ID NO: 1043 - protein, 11 aa, Homo Sapiens
QSEEARRLLGY

SEQ ID NO: 1044 - protein, 11 aa, Homo Sapiens
QTDIQGALSAY

SEQ ID NO: 1045 - protein, 11 aa, Homo Sapiens
QTETGTPYMLY

SEQ ID NO: 1046 - protein, 11 aa, Homo Sapiens
RADPEAGLLLY

SEQ ID NO: 1047 - protein, 11 aa, Homo Sapiens
RIDTRNELESY

SEQ ID NO: 1048 - protein, 11 aa, Homo Sapiens
RIEEGTYGVVY

SEQ ID NO: 1049 - protein, 11 aa, Homo Sapiens
RLETELDGLRY

SEQ ID NO: 1050 - protein, 11 aa, Homo Sapiens
RSDSYVELSQY

SEQ ID NO: 1051 - protein, 11 aa, Homo Sapiens
RTEIIEDLAFY

SEQ ID NO: 1052 - protein, 11 aa, Homo Sapiens
RTELAIKLLEY

SEQ ID NO: 1053 - protein, 11 aa, Homo Sapiens
SIDPGADLSQY

SEQ ID NO: 1054 - protein, 11 aa, Homo Sapiens
SSDGAISLLTY

SEQ ID NO: 1055 - protein, 11 aa, Homo Sapiens
SSDQCAVQLFY

SEQ ID NO: 1056 - protein, 11 aa, Homo Sapiens
SSDTADFRDLY

SEQ ID NO: 1057 - protein, 11 aa, Homo Sapiens
SSDVIRLIMQY

SEQ ID NO: 1058 - protein, 11 aa, Homo Sapiens
SSELATEVHFY

SEQ ID NO: 1059 - protein, 11 aa, Homo Sapiens
SSEQVVDLLRY

SEQ ID NO: 1060 - protein, 11 aa, Homo Sapiens
SSEVVTVFQYY

SEQ ID NO: 1061 - protein, 11 aa, Homo Sapiens
SSEYHYVGGFY

SEQ ID NO: 1062 - protein, 11 aa, Homo Sapiens
STDVSDLLHQY

SEQ ID NO: 1063 - protein, 11 aa, Homo Sapiens
TADHNLLLYEA

SEQ ID NO: 1064 - protein, 11 aa, Homo Sapiens
TIDKATGILLY

SEQ ID NO: 1065 - protein, 11 aa, Homo Sapiens
TSDHFETIMKY

SEQ ID NO: 1066 - protein, 11 aa, Homo Sapiens
TSEQLDDILKY

SEQ ID NO: 1067 - protein, 11 aa, Homo Sapiens
TSETPDYLLKY

SEQ ID NO: 1068 - protein, 11 aa, Homo Sapiens
TTDFPGNYSGY

SEQ ID NO: 1069 - protein, 11 aa, Homo Sapiens
TTDLFGRDLSY

SEQ ID NO: 1070 - protein, 11 aa, Homo Sapiens
TVEELTDTFYY

SEQ ID NO: 1071 - protein, 11 aa, Homo Sapiens
VIDPESGNTLY

SEQ ID NO: 1072 - protein, 11 aa, Homo Sapiens
VLDINSIDNLY

SEQ ID NO: 1073 - protein, 11 aa, Homo Sapiens
VLDSEGYLLFY

SEQ ID NO: 1074 - protein, 11 aa, Homo Sapiens
VLDVISLVDKY

SEQ ID NO: 1075 - protein, 11 aa, Homo Sapiens
VLETNLTGTFY

SEQ ID NO: 1076 - protein, 11 aa, Homo Sapiens
VSENVTQYLQY

SEQ ID NO: 1077 - protein, 11 aa, Homo Sapiens
VTDGAILGKLY

SEQ ID NO: 1078 - protein, 11 aa, Homo Sapiens
VTDPRVVDLLV

SEQ ID NO: 1079 - protein, 11 aa, Homo Sapiens
VTDSGPTFNYL

SEQ ID NO: 1080 - protein, 11 aa, Homo Sapiens
VTDSGRTVILY

SEQ ID NO: 1081 - protein, 11 aa, Homo Sapiens
VTEFEDIKSGY

SEQ ID NO: 1082 - protein, 11 aa, Homo Sapiens
VTEGGEPYRLY

SEQ ID NO: 1083 - protein, 11 aa, Homo Sapiens
VTEGLTDVILY

SEQ ID NO: 1084 - protein, 11 aa, Homo Sapiens
VTEGLVDVILY

SEQ ID NO: 1085 - protein, 11 aa, Homo Sapiens
VTEITDDLHFY

SEQ ID NO: 1086 - protein, 11 aa, Homo Sapiens
VTEQLDAGVRY

SEQ ID NO: 1087 - protein, 11 aa, Homo Sapiens
VTESPAKFALY

SEQ ID NO: 1088 - protein, 11 aa, Homo Sapiens
VVDIQGVGDLY

SEQ ID NO: 1089 - protein, 11 aa, Homo Sapiens
VVDPFSKKDWY

SEQ ID NO: 1090 - protein, 11 aa, Homo Sapiens
VVEQGPSFAFY

SEQ ID NO: 1091 - protein, 11 aa, Homo Sapiens
YADQLKEYLFY

SEQ ID NO: 1092 - protein, 11 aa, Homo Sapiens
YIDQGRNPQLY

SEQ ID NO: 1093 - protein, 11 aa, Homo Sapiens
YIEDRPLHMLY

SEQ ID NO: 1094 - protein, 11 aa, Homo Sapiens
YIEFHSQSGFY

SEQ ID NO: 1095 - protein, 11 aa, Homo Sapiens
YLDLKSDEWEY

SEQ ID NO: 1096 - protein, 11 aa, Homo Sapiens
YLDPSLNSLVY

SEQ ID NO: 1097 - protein, 11 aa, Homo Sapiens
YLDSIPPGQYM

SEQ ID NO: 1098 - protein, 11 aa, Homo Sapiens
YLDWAYRSGGY

SEQ ID NO: 1099 - protein, 11 aa, Homo Sapiens
YLEDKVYLTGY

SEQ ID NO: 1100 - protein, 11 aa, Homo Sapiens
YLFEPHSGEEY

SEQ ID NO: 1101 - protein, 11 aa, Homo Sapiens
YLQNWSHVLSY

SEQ ID NO: 1102 - protein, 11 aa, Homo Sapiens
YLWSAIEIFRY

SEQ ID NO: 1103 - protein, 11 aa, Homo Sapiens
YQDPDATSLKY

SEQ ID NO: 1104 - protein, 11 aa, Homo Sapiens
YSAEPLPELCY

SEQ ID NO: 1105 - protein, 11 aa, Homo Sapiens
YSDVAKGILQY

SEQ ID NO: 1106 - protein, 11 aa, Homo Sapiens
YSDVSGLLANY

SEQ ID NO: 1107 - protein, 11 aa, Homo Sapiens
YSEDRIGLADY

SEQ ID NO: 1108 - protein, 11 aa, Homo Sapiens
YSEYPPFSHRY

SEQ ID NO: 1109 - protein, 11 aa, Homo Sapiens
YSGLLLPDAQY

SEQ ID NO: 1110 - protein, 11 aa, Homo Sapiens
YSGYIFDYDYY

SEQ ID NO: 1111 - protein, 11 aa, Homo Sapiens
YSVYRTVIEYY

SEQ ID NO: 1112 - protein, 11 aa, Homo Sapiens
YTADGKEVLEY

SEQ ID NO: 1113 - protein, 11 aa, Homo Sapiens
YTDHLQSYVIY

SEQ ID NO: 1114 - protein, 11 aa, Homo Sapiens
YTDTGLWGLYM

SEQ ID NO: 1115 - protein, 11 aa, Homo Sapiens
YTEAEEFFVKY

SEQ ID NO: 1116 - protein, 11 aa, Homo Sapiens
YTEDEIYELSY

SEQ ID NO: 1117 - protein, 11 aa, Homo Sapiens
YTEFVPQIPGY

SEQ ID NO: 1118 - protein, 11 aa, Homo Sapiens
YTELTTAIRTY

SEQ ID NO: 1119 - protein, 11 aa, Homo Sapiens
YTEQLLRGLSY

SEQ ID NO: 1120 - protein, 11 aa, Homo Sapiens
YTFSSIEREEY

SEQ ID NO: 1121 - protein, 8 aa, Homo Sapiens
AIRNDEEL

SEQ ID NO: 1122 - protein, 8 aa, Homo Sapiens
ALFKAWAL

SEQ ID NO: 1123 - protein, 8 aa, Homo Sapiens
ALGFVYKL

SEQ ID NO: 1124 - protein, 8 aa, Homo Sapiens
ALGSVVAV

SEQ ID NO: 1125 - protein, 8 aa, Homo Sapiens
FIMVMHIK

SEQ ID NO: 1126 - protein, 8 aa, Homo Sapiens
FLFRITQV

SEQ ID NO: 1127 - protein, 8 aa, Homo Sapiens
FLGKIYQI

SEQ ID NO: 1128 - protein, 8 aa, Homo Sapiens
FLYKVVQV

SEQ ID NO: 1129 - protein, 8 aa, Homo Sapiens
FSDIPNPI

SEQ ID NO: 1130 - protein, 8 aa, Homo Sapiens
GLGPTFKL

SEQ ID NO: 1131 - protein, 8 aa, Homo Sapiens
GLGRVWAV

SEQ ID NO: 1132 - protein, 8 aa, Homo Sapiens
IFVEAVLR

SEQ ID NO: 1133 - protein, 8 aa, Homo Sapiens
ILGPTFTL

SEQ ID NO: 1134 - protein, 8 aa, Homo Sapiens
LLGQVFQV

SEQ ID NO: 1135 - protein, 8 aa, Homo Sapiens
LLPAIVHI

SEQ ID NO: 1136 - protein, 8 aa, Homo Sapiens
LMEHIHKL

SEQ ID NO: 1137 - protein, 8 aa, Homo Sapiens
PINGNGKQ

SEQ ID NO: 1138 - protein, 8 aa, Homo Sapiens
PLGYEIQL

SEQ ID NO: 1139 - protein, 8 aa, Homo Sapiens
QEPVLGPV

SEQ ID NO: 1140 - protein, 8 aa, Homo Sapiens
SLFKIWLV

SEQ ID NO: 1141 - protein, 8 aa, Homo Sapiens
SLGKVFGV

SEQ ID NO: 1142 - protein, 8 aa, Homo Sapiens
SLLEHHKI

SEQ ID NO: 1143 - protein, 8 aa, Homo Sapiens
VLGTVIGV

SEQ ID NO: 1144 - protein, 8 aa, Homo Sapiens
VPPFLQPE

SEQ ID NO: 1145 - protein, 8 aa, Homo Sapiens
VREIAQDF

SEQ ID NO: 1146 - protein, 8 aa, Homo Sapiens
VYPFPGPI

SEQ ID NO: 1147 - protein, 8 aa, Homo Sapiens
WPQLFLLL

SEQ ID NO: 1148 - protein, 8 aa, Homo Sapiens
YLFHVQEV

SEQ ID NO: 1149 - protein, 8 aa, Homo Sapiens
YLFKVVLI

SEQ ID NO: 1150 - protein, 8 aa, Homo Sapiens
YLGQVTTI

SEQ ID NO: 1151 - protein, 9 aa, Homo Sapiens
AAAPVVPAV

SEQ ID NO: 1152 - protein, 9 aa, Homo Sapiens
AALPNVYEV

SEQ ID NO: 1153 - protein, 9 aa, Homo Sapiens
AIAPIIAAV

SEQ ID NO: 1154 - protein, 9 aa, Homo Sapiens
AIFSAIIFL

SEQ ID NO: 1155 - protein, 9 aa, Homo Sapiens
AIIEYMPLL

SEQ ID NO: 1156 - protein, 9 aa, Homo Sapiens
AIISELVSI

SEQ ID NO: 1157 - protein, 9 aa, Homo Sapiens
AILHLLVSL

SEQ ID NO: 1158 - protein, 9 aa, Homo Sapiens
AILKYIETL

SEQ ID NO: 1159 - protein, 9 aa, Homo Sapiens
AILPTSIFL

SEQ ID NO: 1160 - protein, 9 aa, Homo Sapiens
AILTTLIHL

SEQ ID NO: 1161 - protein, 9 aa, Homo Sapiens
AILTVVPKI

SEQ ID NO: 1162 - protein, 9 aa, Homo Sapiens
AIMDIVIKV

SEQ ID NO: 1163 - protein, 9 aa, Homo Sapiens
AIMDLLLRL

SEQ ID NO: 1164 - protein, 9 aa, Homo Sapiens
AIQDKLFQV

SEQ ID NO: 1165 - protein, 9 aa, Homo Sapiens
AIVDKVPSV

SEQ ID NO: 1166 - protein, 9 aa, Homo Sapiens
AIVRSLPSV

SEQ ID NO: 1167 - protein, 9 aa, Homo Sapiens
AIWDGLILL

SEQ ID NO: 1168 - protein, 9 aa, Homo Sapiens
ALAAALAHI

SEQ ID NO: 1169 - protein, 9 aa, Homo Sapiens
ALAALHVTL

SEQ ID NO: 1170 - protein, 9 aa, Homo Sapiens
ALAATVFCV

SEQ ID NO: 1171 - protein, 9 aa, Homo Sapiens
ALADFAELI

SEQ ID NO: 1172 - protein, 9 aa, Homo Sapiens
ALADFLPVM

SEQ ID NO: 1173 - protein, 9 aa, Homo Sapiens
ALADLLLAL

SEQ ID NO: 1174 - protein, 9 aa, Homo Sapiens
ALADTLVLL

SEQ ID NO: 1175 - protein, 9 aa, Homo Sapiens
ALAEALKEV

SEQ ID NO: 1176 - protein, 9 aa, Homo Sapiens
ALAEEVEQV

SEQ ID NO: 1177 - protein, 9 aa, Homo Sapiens
ALAEGQLRL

SEQ ID NO: 1178 - protein, 9 aa, Homo Sapiens
ALAERLDIV

SEQ ID NO: 1179 - protein, 9 aa, Homo Sapiens
ALAGVSFEI

SEQ ID NO: 1180 - protein, 9 aa, Homo Sapiens
ALAKEIDSV

SEQ ID NO: 1181 - protein, 9 aa, Homo Sapiens
ALAKIEIKL

SEQ ID NO: 1182 - protein, 9 aa, Homo Sapiens
ALAKLVEAI

SEQ ID NO: 1183 - protein, 9 aa, Homo Sapiens
ALANHLIKV

SEQ ID NO: 1184 - protein, 9 aa, Homo Sapiens
ALANKLFGA

SEQ ID NO: 1185 - protein, 9 aa, Homo Sapiens
ALANLFVIV

SEQ ID NO: 1186 - protein, 9 aa, Homo Sapiens
ALANQIPTV

SEQ ID NO: 1187 - protein, 9 aa, Homo Sapiens
ALAPAPPQV

SEQ ID NO: 1188 - protein, 9 aa, Homo Sapiens
ALAPGLPTA

SEQ ID NO: 1189 - protein, 9 aa, Homo Sapiens
ALAPGVRAV

SEQ ID NO: 1190 - protein, 9 aa, Homo Sapiens
ALAQRLLEV

SEQ ID NO: 1191 - protein, 9 aa, Homo Sapiens
ALARLVLRL

SEQ ID NO: 1192 - protein, 9 aa, Homo Sapiens
ALASVIKEL

SEQ ID NO: 1193 - protein, 9 aa, Homo Sapiens
ALASVIMGL

SEQ ID NO: 1194 - protein, 9 aa, Homo Sapiens
ALATLIHQV

SEQ ID NO: 1195 - protein, 9 aa, Homo Sapiens
ALAWLDVTL

SEQ ID NO: 1196 - protein, 9 aa, Homo Sapiens
ALDDFSISV

SEQ ID NO: 1197 - protein, 9 aa, Homo Sapiens
ALDDMISTL

SEQ ID NO: 1198 - protein, 9 aa, Homo Sapiens
ALDEQLVQV

SEQ ID NO: 1199 - protein, 9 aa, Homo Sapiens
ALDEVFTKV

SEQ ID NO: 1200 - protein, 9 aa, Homo Sapiens
ALDEVIFSL

SEQ ID NO: 1201 - protein, 9 aa, Homo Sapiens
ALDFFVPAL

SEQ ID NO: 1202 - protein, 9 aa, Homo Sapiens
ALDGFLFVV

SEQ ID NO: 1203 - protein, 9 aa, Homo Sapiens
ALDILITNV

SEQ ID NO: 1204 - protein, 9 aa, Homo Sapiens
ALDIMIPMV

SEQ ID NO: 1205 - protein, 9 aa, Homo Sapiens
ALDKATVLL

SEQ ID NO: 1206 - protein, 9 aa, Homo Sapiens
ALDNGLFTL

SEQ ID NO: 1207 - protein, 9 aa, Homo Sapiens
ALDPNIATL

SEQ ID NO: 1208 - protein, 9 aa, Homo Sapiens
ALDQEIIEV

SEQ ID NO: 1209 - protein, 9 aa, Homo Sapiens
ALDSQVPKV

SEQ ID NO: 1210 - protein, 9 aa, Homo Sapiens
ALEPIDITV

SEQ ID NO: 1211 - protein, 9 aa, Homo Sapiens
ALFDAQAQV

SEQ ID NO: 1212 - protein, 9 aa, Homo Sapiens
ALFEEVPEL

SEQ ID NO: 1213 - protein, 9 aa, Homo Sapiens
ALFEGKVQL

SEQ ID NO: 1214 - protein, 9 aa, Homo Sapiens
ALFGIPMAL

SEQ ID NO: 1215 - protein, 9 aa, Homo Sapiens
ALFGTILEL

SEQ ID NO: 1216 - protein, 9 aa, Homo Sapiens
ALFPERITV

SEQ ID NO: 1217 - protein, 9 aa, Homo Sapiens
ALFPGVALL

SEQ ID NO: 1218 - protein, 9 aa, Homo Sapiens
ALFQHITAL

SEQ ID NO: 1219 - protein, 9 aa, Homo Sapiens
ALFQRPPLI

SEQ ID NO: 1220 - protein, 9 aa, Homo Sapiens
ALFSFLYHL

SEQ ID NO: 1221 - protein, 9 aa, Homo Sapiens
ALHDILTEI

SEQ ID NO: 1222 - protein, 9 aa, Homo Sapiens
ALHDQLFYL

SEQ ID NO: 1223 - protein, 9 aa, Homo Sapiens
ALHHAVIFL

SEQ ID NO: 1224 - protein, 9 aa, Homo Sapiens
ALIDRMVNL

SEQ ID NO: 1225 - protein, 9 aa, Homo Sapiens
ALIEKLVEL

SEQ ID NO: 1226 - protein, 9 aa, Homo Sapiens
ALIFRRIYL

SEQ ID NO: 1227 - protein, 9 aa, Homo Sapiens
ALINNIVEI

SEQ ID NO: 1228 - protein, 9 aa, Homo Sapiens
ALITRIFGV

SEQ ID NO: 1229 - protein, 9 aa, Homo Sapiens
ALKDFVASI

SEQ ID NO: 1230 - protein, 9 aa, Homo Sapiens
ALKDLINEA

SEQ ID NO: 1231 - protein, 9 aa, Homo Sapiens
ALLADEFAL

SEQ ID NO: 1232 - protein, 9 aa, Homo Sapiens
ALLAELEKI

SEQ ID NO: 1233 - protein, 9 aa, Homo Sapiens
ALLAGSEYL

SEQ ID NO: 1234 - protein, 9 aa, Homo Sapiens
ALLAKILQI

SEQ ID NO: 1235 - protein, 9 aa, Homo Sapiens
ALLALLPEL

SEQ ID NO: 1236 - protein, 9 aa, Homo Sapiens
ALLAYTLGV

SEQ ID NO: 1237 - protein, 9 aa, Homo Sapiens
ALLDFLWDL

SEQ ID NO: 1238 - protein, 9 aa, Homo Sapiens
ALLDGRVQL

SEQ ID NO: 1239 - protein, 9 aa, Homo Sapiens
ALLDIIRSL

SEQ ID NO: 1240 - protein, 9 aa, Homo Sapiens
ALLDKLYAL

SEQ ID NO: 1241 - protein, 9 aa, Homo Sapiens
ALLDNNIGL

SEQ ID NO: 1242 - protein, 9 aa, Homo Sapiens
ALLDQLHTL

SEQ ID NO: 1243 - protein, 9 aa, Homo Sapiens
ALLDRIVSV

SEQ ID NO: 1244 - protein, 9 aa, Homo Sapiens
ALLDSAHLL

SEQ ID NO: 1245 - protein, 9 aa, Homo Sapiens
ALLDSFITI

SEQ ID NO: 1246 - protein, 9 aa, Homo Sapiens
ALLDWVTSV

SEQ ID NO: 1247 - protein, 9 aa, Homo Sapiens
ALLEEVKAL

SEQ ID NO: 1248 - protein, 9 aa, Homo Sapiens
ALLEGLTVV

SEQ ID NO: 1249 - protein, 9 aa, Homo Sapiens
ALLEGVKNV

SEQ ID NO: 1250 - protein, 9 aa, Homo Sapiens
ALLEKLTEL

SEQ ID NO: 1251 - protein, 9 aa, Homo Sapiens
ALLELLHEL

SEQ ID NO: 1252 - protein, 9 aa, Homo Sapiens
ALLEMDARL

SEQ ID NO: 1253 - protein, 9 aa, Homo Sapiens
ALLEQVNAL

SEQ ID NO: 1254 - protein, 9 aa, Homo Sapiens
ALLERGYSL

SEQ ID NO: 1255 - protein, 9 aa, Homo Sapiens
ALLETNPYL

SEQ ID NO: 1256 - protein, 9 aa, Homo Sapiens
ALLETVNRL

SEQ ID NO: 1257 - protein, 9 aa, Homo Sapiens
ALLGDLTKA

SEQ ID NO: 1258 - protein, 9 aa, Homo Sapiens
ALLGILQHV

SEQ ID NO: 1259 - protein, 9 aa, Homo Sapiens
ALLGKIEKV

SEQ ID NO: 1260 - protein, 9 aa, Homo Sapiens
ALLGKLDAI

SEQ ID NO: 1261 - protein, 9 aa, Homo Sapiens
ALLGYLQEV

SEQ ID NO: 1262 - protein, 9 aa, Homo Sapiens
ALLICLPEV

SEQ ID NO: 1263 - protein, 9 aa, Homo Sapiens
ALLKGLAAV

SEQ ID NO: 1264 - protein, 9 aa, Homo Sapiens
ALLKQIQEA

SEQ ID NO: 1265 - protein, 9 aa, Homo Sapiens
ALLNGEYLL

SEQ ID NO: 1266 - protein, 9 aa, Homo Sapiens
ALLNTINYL

SEQ ID NO: 1267 - protein, 9 aa, Homo Sapiens
ALLNVELEL

SEQ ID NO: 1268 - protein, 9 aa, Homo Sapiens
ALLPDLPAL

SEQ ID NO: 1269 - protein, 9 aa, Homo Sapiens
ALLPGNFTV

SEQ ID NO: 1270 - protein, 9 aa, Homo Sapiens
ALLPLLERV

SEQ ID NO: 1271 - protein, 9 aa, Homo Sapiens
ALLPQNHKL

SEQ ID NO: 1272 - protein, 9 aa, Homo Sapiens
ALLPSSPTL

SEQ ID NO: 1273 - protein, 9 aa, Homo Sapiens
ALLPVDIFL

SEQ ID NO: 1274 - protein, 9 aa, Homo Sapiens
ALLQEIVNI

SEQ ID NO: 1275 - protein, 9 aa, Homo Sapiens
ALLQQPLFL

SEQ ID NO: 1276 - protein, 9 aa, Homo Sapiens
ALLQQVHSA

SEQ ID NO: 1277 - protein, 9 aa, Homo Sapiens
ALLQRLEAL

SEQ ID NO: 1278 - protein, 9 aa, Homo Sapiens
ALLRFYVRV

SEQ ID NO: 1279 - protein, 9 aa, Homo Sapiens
ALLRLLPGL

SEQ ID NO: 1280 - protein, 9 aa, Homo Sapiens
ALLRVTPFI

SEQ ID NO: 1281 - protein, 9 aa, Homo Sapiens
ALLSAVTRL

SEQ ID NO: 1282 - protein, 9 aa, Homo Sapiens
ALLSGIVSI

SEQ ID NO: 1283 - protein, 9 aa, Homo Sapiens
ALLSGLREA

SEQ ID NO: 1284 - protein, 9 aa, Homo Sapiens
ALLSIIATV

SEQ ID NO: 1285 - protein, 9 aa, Homo Sapiens
ALLSRLEQI

SEQ ID NO: 1286 - protein, 9 aa, Homo Sapiens
ALLTVVSQV

SEQ ID NO: 1287 - protein, 9 aa, Homo Sapiens
ALLTYLEQV

SEQ ID NO: 1288 - protein, 9 aa, Homo Sapiens
ALLVRLQEV

SEQ ID NO: 1289 - protein, 9 aa, Homo Sapiens
ALMADMVYV

SEQ ID NO: 1290 - protein, 9 aa, Homo Sapiens
ALMDEVVKA

SEQ ID NO: 1291 - protein, 9 aa, Homo Sapiens
ALMDFAYTA

SEQ ID NO: 1292 - protein, 9 aa, Homo Sapiens
ALMEALVLI

SEQ ID NO: 1293 - protein, 9 aa, Homo Sapiens
ALMEEILKL

SEQ ID NO: 1294 - protein, 9 aa, Homo Sapiens
ALMELFPKL

SEQ ID NO: 1295 - protein, 9 aa, Homo Sapiens
ALMNIPVLV

SEQ ID NO: 1296 - protein, 9 aa, Homo Sapiens
ALMPQLVQL

SEQ ID NO: 1297 - protein, 9 aa, Homo Sapiens
ALMPVLNQV

SEQ ID NO: 1298 - protein, 9 aa, Homo Sapiens
ALNDCIYSV

SEQ ID NO: 1299 - protein, 9 aa, Homo Sapiens
ALNEKLVNL

SEQ ID NO: 1300 - protein, 9 aa, Homo Sapiens
ALNELLQHV

SEQ ID NO: 1301 - protein, 9 aa, Homo Sapiens
ALNENINQV

SEQ ID NO: 1302 - protein, 9 aa, Homo Sapiens
ALNEQIARL

SEQ ID NO: 1303 - protein, 9 aa, Homo Sapiens
ALNGKLYIV

SEQ ID NO: 1304 - protein, 9 aa, Homo Sapiens
ALNNLLHSL

SEQ ID NO: 1305 - protein, 9 aa, Homo Sapiens
ALNSKILSV

SEQ ID NO: 1306 - protein, 9 aa, Homo Sapiens
ALPEDLVEV

SEQ ID NO: 1307 - protein, 9 aa, Homo Sapiens
ALPPVLTTV

SEQ ID NO: 1308 - protein, 9 aa, Homo Sapiens
ALQALVVTL

SEQ ID NO: 1309 - protein, 9 aa, Homo Sapiens
ALQDFLLSV

SEQ ID NO: 1310 - protein, 9 aa, Homo Sapiens
ALQEKLWNV

SEQ ID NO: 1311 - protein, 9 aa, Homo Sapiens
ALQEMVHQV

SEQ ID NO: 1312 - protein, 9 aa, Homo Sapiens
ALQERLDGL

SEQ ID NO: 1313 - protein, 9 aa, Homo Sapiens
ALQESIPDI

SEQ ID NO: 1314 - protein, 9 aa, Homo Sapiens
ALQESLVQI

SEQ ID NO: 1315 - protein, 9 aa, Homo Sapiens
ALQSLLHLL

SEQ ID NO: 1316 - protein, 9 aa, Homo Sapiens
ALQTIQLFL

SEQ ID NO: 1317 - protein, 9 aa, Homo Sapiens
ALQTKLETL

SEQ ID NO: 1318 - protein, 9 aa, Homo Sapiens
ALRDVSEEL

SEQ ID NO: 1319 - protein, 9 aa, Homo Sapiens
ALRVFVESV

SEQ ID NO: 1320 - protein, 9 aa, Homo Sapiens
ALSASLITV

SEQ ID NO: 1321 - protein, 9 aa, Homo Sapiens
ALSDIFQAV

SEQ ID NO: 1322 - protein, 9 aa, Homo Sapiens
ALSDLEITL

SEQ ID NO: 1323 - protein, 9 aa, Homo Sapiens
ALSDSIHTV

SEQ ID NO: 1324 - protein, 9 aa, Homo Sapiens
ALSDYDLVL

SEQ ID NO: 1325 - protein, 9 aa, Homo Sapiens
ALSEELVQL

SEQ ID NO: 1326 - protein, 9 aa, Homo Sapiens
ALSEKIVSV

SEQ ID NO: 1327 - protein, 9 aa, Homo Sapiens
ALSELIILT

SEQ ID NO: 1328 - protein, 9 aa, Homo Sapiens
ALSEMVEYI

SEQ ID NO: 1329 - protein, 9 aa, Homo Sapiens
ALSGHLETV

SEQ ID NO: 1330 - protein, 9 aa, Homo Sapiens
ALSGLAVRL

SEQ ID NO: 1331 - protein, 9 aa, Homo Sapiens
ALSNLEVKL

SEQ ID NO: 1332 - protein, 9 aa, Homo Sapiens
ALSPHNILL

SEQ ID NO: 1333 - protein, 9 aa, Homo Sapiens
ALSQDIPEI

SEQ ID NO: 1334 - protein, 9 aa, Homo Sapiens
ALSQINTKL

SEQ ID NO: 1335 - protein, 9 aa, Homo Sapiens
ALSQLVPCV

SEQ ID NO: 1336 - protein, 9 aa, Homo Sapiens
ALSRLLPGL

SEQ ID NO: 1337 - protein, 9 aa, Homo Sapiens
ALSSLAVVV

SEQ ID NO: 1338 - protein, 9 aa, Homo Sapiens
ALSSLIHAL

SEQ ID NO: 1339 - protein, 9 aa, Homo Sapiens
ALSSLLVFL

SEQ ID NO: 1340 - protein, 9 aa, Homo Sapiens
ALSSVIKEL

SEQ ID NO: 1341 - protein, 9 aa, Homo Sapiens
ALTDFVRSV

SEQ ID NO: 1342 - protein, 9 aa, Homo Sapiens
ALTDVILCV

SEQ ID NO: 1343 - protein, 9 aa, Homo Sapiens
ALTELLAKI

SEQ ID NO: 1344 - protein, 9 aa, Homo Sapiens
ALTERLALI

SEQ ID NO: 1345 - protein, 9 aa, Homo Sapiens
ALTEYTLYL

SEQ ID NO: 1346 - protein, 9 aa, Homo Sapiens
ALTGYLHTI

SEQ ID NO: 1347 - protein, 9 aa, Homo Sapiens
ALTLNLTEV

SEQ ID NO: 1348 - protein, 9 aa, Homo Sapiens
ALTPVVVTL

SEQ ID NO: 1349 - protein, 9 aa, Homo Sapiens
ALTSLLKTV

SEQ ID NO: 1350 - protein, 9 aa, Homo Sapiens
ALTSVVVTL

SEQ ID NO: 1351 - protein, 9 aa, Homo Sapiens
ALTWLIPTL

SEQ ID NO: 1352 - protein, 9 aa, Homo Sapiens
ALVDCSVAL

SEQ ID NO: 1353 - protein, 9 aa, Homo Sapiens
ALVDHVAEL

SEQ ID NO: 1354 - protein, 9 aa, Homo Sapiens
ALVDQLWKL

SEQ ID NO: 1355 - protein, 9 aa, Homo Sapiens
ALVEKLESL

SEQ ID NO: 1356 - protein, 9 aa, Homo Sapiens
ALVESLEYV

SEQ ID NO: 1357 - protein, 9 aa, Homo Sapiens
ALVESLITV

SEQ ID NO: 1358 - protein, 9 aa, Homo Sapiens
ALVFELHYV

SEQ ID NO: 1359 - protein, 9 aa, Homo Sapiens
ALVNVQIPL

SEQ ID NO: 1360 - protein, 9 aa, Homo Sapiens
ALVSSLHLL

SEQ ID NO: 1361 - protein, 9 aa, Homo Sapiens
ALVSTIIMV

SEQ ID NO: 1362 - protein, 9 aa, Homo Sapiens
ALVSYLIRL

SEQ ID NO: 1363 - protein, 9 aa, Homo Sapiens
ALWAGLLTL

SEQ ID NO: 1364 - protein, 9 aa, Homo Sapiens
ALWAKSPGV

SEQ ID NO: 1365 - protein, 9 aa, Homo Sapiens
ALWDKLFNL

SEQ ID NO: 1366 - protein, 9 aa, Homo Sapiens
ALWGEDAEL

SEQ ID NO: 1367 - protein, 9 aa, Homo Sapiens
ALWGFFPVL

SEQ ID NO: 1368 - protein, 9 aa, Homo Sapiens
ALWLVSPLL

SEQ ID NO: 1369 - protein, 9 aa, Homo Sapiens
ALWNEEALL

SEQ ID NO: 1370 - protein, 9 aa, Homo Sapiens
ALWSLPLYL

SEQ ID NO: 1371 - protein, 9 aa, Homo Sapiens
ALYASRLYL

SEQ ID NO: 1372 - protein, 9 aa, Homo Sapiens
ALYAVIEKA

SEQ ID NO: 1373 - protein, 9 aa, Homo Sapiens
ALYDNVEKL

SEQ ID NO: 1374 - protein, 9 aa, Homo Sapiens
ALYGKLLKL

SEQ ID NO: 1375 - protein, 9 aa, Homo Sapiens
ALYGQPLLL

SEQ ID NO: 1376 - protein, 9 aa, Homo Sapiens
ALYHLAIKL

SEQ ID NO: 1377 - protein, 9 aa, Homo Sapiens
ALYNWLIQV

SEQ ID NO: 1378 - protein, 9 aa, Homo Sapiens
ALYPNVVQV

SEQ ID NO: 1379 - protein, 9 aa, Homo Sapiens
ALYSELLAV

SEQ ID NO: 1380 - protein, 9 aa, Homo Sapiens
ALYSKGILL

SEQ ID NO: 1381 - protein, 9 aa, Homo Sapiens
ALYTVIETV

SEQ ID NO: 1382 - protein, 9 aa, Homo Sapiens
ALYVAVVNV

SEQ ID NO: 1383 - protein, 9 aa, Homo Sapiens
AMFENFVSV

SEQ ID NO: 1384 - protein, 9 aa, Homo Sapiens
AMFGKLMTI

SEQ ID NO: 1385 - protein, 9 aa, Homo Sapiens
AMIDQVLEL

SEQ ID NO: 1386 - protein, 9 aa, Homo Sapiens
AMIELVERL

SEQ ID NO: 1387 - protein, 9 aa, Homo Sapiens
AMIERITFI

SEQ ID NO: 1388 - protein, 9 aa, Homo Sapiens
AMLAVLHTV

SEQ ID NO: 1389 - protein, 9 aa, Homo Sapiens
AMLPSITNV

SEQ ID NO: 1390 - protein, 9 aa, Homo Sapiens
AMLRLIPSL

SEQ ID NO: 1391 - protein, 9 aa, Homo Sapiens
AMLTVLHEI

SEQ ID NO: 1392 - protein, 9 aa, Homo Sapiens
AMNSQILEV

SEQ ID NO: 1393 - protein, 9 aa, Homo Sapiens
AMQEYIAVV

SEQ ID NO: 1394 - protein, 9 aa, Homo Sapiens
AMTLVNKTL

SEQ ID NO: 1395 - protein, 9 aa, Homo Sapiens
AMWEHPITA

SEQ ID NO: 1396 - protein, 9 aa, Homo Sapiens
AMYVYPPNV

SEQ ID NO: 1397 - protein, 9 aa, Homo Sapiens
AQFGYYFRV

SEQ ID NO: 1398 - protein, 9 aa, Homo Sapiens
AQILELPYA

SEQ ID NO: 1399 - protein, 9 aa, Homo Sapiens
AQMDYQLRL

SEQ ID NO: 1400 - protein, 9 aa, Homo Sapiens
ATIGELAQV

SEQ ID NO: 1401 - protein, 9 aa, Homo Sapiens
ATMPVVPSV

SEQ ID NO: 1402 - protein, 9 aa, Homo Sapiens
AVANIVNSV

SEQ ID NO: 1403 - protein, 9 aa, Homo Sapiens
AVLGFSFRL

SEQ ID NO: 1404 - protein, 9 aa, Homo Sapiens
AVLPFSPAL

SEQ ID NO: 1405 - protein, 9 aa, Homo Sapiens
AVMDTLVSV

SEQ ID NO: 1406 - protein, 9 aa, Homo Sapiens
AVMEQIPEI

SEQ ID NO: 1407 - protein, 9 aa, Homo Sapiens
AVMLHSFTL

SEQ ID NO: 1408 - protein, 9 aa, Homo Sapiens
CILPNIEAV

SEQ ID NO: 1409 - protein, 9 aa, Homo Sapiens
CLADAVVKI

SEQ ID NO: 1410 - protein, 9 aa, Homo Sapiens
CLYEIYPEL

SEQ ID NO: 1411 - protein, 9 aa, Homo Sapiens
CVIFSLEEL

SEQ ID NO: 1412 - protein, 9 aa, Homo Sapiens
DIETGQQTV

SEQ ID NO: 1413 - protein, 9 aa, Homo Sapiens
EIQYLKDLI

SEQ ID NO: 1414 - protein, 9 aa, Homo Sapiens
ELFSSPPAV

SEQ ID NO: 1415 - protein, 9 aa, Homo Sapiens
ELKPFIEEL

SEQ ID NO: 1416 - protein, 9 aa, Homo Sapiens
ELSDVLIYL

SEQ ID NO: 1417 - protein, 9 aa, Homo Sapiens
EMVELRILL

SEQ ID NO: 1418 - protein, 9 aa, Homo Sapiens
ETLDPGPPL

SEQ ID NO: 1419 - protein, 9 aa, Homo Sapiens
EVISKLYAV

SEQ ID NO: 1420 - protein, 9 aa, Homo Sapiens
FAIPMIHAV

SEQ ID NO: 1421 - protein, 9 aa, Homo Sapiens
FAMEIDPSL

SEQ ID NO: 1422 - protein, 9 aa, Homo Sapiens
FASHVSPEV

SEQ ID NO: 1423 - protein, 9 aa, Homo Sapiens
FFMERSWSV

SEQ ID NO: 1424 - protein, 9 aa, Homo Sapiens
FGLARAFGV

SEQ ID NO: 1425 - protein, 9 aa, Homo Sapiens
FIADLVVGL

SEQ ID NO: 1426 - protein, 9 aa, Homo Sapiens
FIDDANYSV

SEQ ID NO: 1427 - protein, 9 aa, Homo Sapiens
FIDEYVETV

SEQ ID NO: 1428 - protein, 9 aa, Homo Sapiens
FIFDGLHKA

SEQ ID NO: 1429 - protein, 9 aa, Homo Sapiens
FIFSDTHEL

SEQ ID NO: 1430 - protein, 9 aa, Homo Sapiens
FIINGIEKV

SEQ ID NO: 1431 - protein, 9 aa, Homo Sapiens
FIIQGLRSV

SEQ ID NO: 1432 - protein, 9 aa, Homo Sapiens
FILAAIYHL

SEQ ID NO: 1433 - protein, 9 aa, Homo Sapiens
FILEKIEYL

SEQ ID NO: 1434 - protein, 9 aa, Homo Sapiens
FILPHISTA

SEQ ID NO: 1435 - protein, 9 aa, Homo Sapiens
FILPKEIAV

SEQ ID NO: 1436 - protein, 9 aa, Homo Sapiens
FILPYIHKA

SEQ ID NO: 1437 - protein, 9 aa, Homo Sapiens
FINIVVHSV

SEQ ID NO: 1438 - protein, 9 aa, Homo Sapiens
FIQEIEHAL

SEQ ID NO: 1439 - protein, 9 aa, Homo Sapiens
FISEFEHRV

SEQ ID NO: 1440 - protein, 9 aa, Homo Sapiens
FIWENIHTL

SEQ ID NO: 1441 - protein, 9 aa, Homo Sapiens
FIWPMLIHI

SEQ ID NO: 1442 - protein, 9 aa, Homo Sapiens
FLADIVQKL

SEQ ID NO: 1443 - protein, 9 aa, Homo Sapiens
FLADPSAFV

SEQ ID NO: 1444 - protein, 9 aa, Homo Sapiens
FLAGAVTSV

SEQ ID NO: 1445 - protein, 9 aa, Homo Sapiens
FLAKLIAQA

SEQ ID NO: 1446 - protein, 9 aa, Homo Sapiens
FLANIGTSV

SEQ ID NO: 1447 - protein, 9 aa, Homo Sapiens
FLANVSTVL

SEQ ID NO: 1448 - protein, 9 aa, Homo Sapiens
FLAPRLLSL

SEQ ID NO: 1449 - protein, 9 aa, Homo Sapiens
FLAQRAVEL

SEQ ID NO: 1450 - protein, 9 aa, Homo Sapiens
FLASILEEL

SEQ ID NO: 1451 - protein, 9 aa, Homo Sapiens
FLASLDRAK

SEQ ID NO: 1452 - protein, 9 aa, Homo Sapiens
FLAVKPDGV

SEQ ID NO: 1453 - protein, 9 aa, Homo Sapiens
FLDATLTSV

SEQ ID NO: 1454 - protein, 9 aa, Homo Sapiens
FLDDVVHSL

SEQ ID NO: 1455 - protein, 9 aa, Homo Sapiens
FLDENVHFA

SEQ ID NO: 1456 - protein, 9 aa, Homo Sapiens
FLDENVHFF

SEQ ID NO: 1457 - protein, 9 aa, Homo Sapiens
FLDEPTNHL

SEQ ID NO: 1458 - protein, 9 aa, Homo Sapiens
FLDERTPRL

SEQ ID NO: 1459 - protein, 9 aa, Homo Sapiens
FLDGNELTL

SEQ ID NO: 1460 - protein, 9 aa, Homo Sapiens
FLDGNEMTL

SEQ ID NO: 1461 - protein, 9 aa, Homo Sapiens
FLDGYVSQL

SEQ ID NO: 1462 - protein, 9 aa, Homo Sapiens
FLDHIIASV

SEQ ID NO: 1463 - protein, 9 aa, Homo Sapiens
FLDHVMYTI

SEQ ID NO: 1464 - protein, 9 aa, Homo Sapiens
FLDIVELLL

SEQ ID NO: 1465 - protein, 9 aa, Homo Sapiens
FLDKQGFYV

SEQ ID NO: 1466 - protein, 9 aa, Homo Sapiens
FLDLGPPGI

SEQ ID NO: 1467 - protein, 9 aa, Homo Sapiens
FLDMTNWNL

SEQ ID NO: 1468 - protein, 9 aa, Homo Sapiens
FLDNGPKTI

SEQ ID NO: 1469 - protein, 9 aa, Homo Sapiens
FLDNLHINL

SEQ ID NO: 1470 - protein, 9 aa, Homo Sapiens
FLDNSLDTV

SEQ ID NO: 1471 - protein, 9 aa, Homo Sapiens
FLDPRPLTV

SEQ ID NO: 1472 - protein, 9 aa, Homo Sapiens
FLDSAYFRL

SEQ ID NO: 1473 - protein, 9 aa, Homo Sapiens
FLDSLIYGA

SEQ ID NO: 1474 - protein, 9 aa, Homo Sapiens
FLDSTSPLL

SEQ ID NO: 1475 - protein, 9 aa, Homo Sapiens
FLEEEVYPL

SEQ ID NO: 1476 - protein, 9 aa, Homo Sapiens
FLEKLLPPV

SEQ ID NO: 1477 - protein, 9 aa, Homo Sapiens
FLEPVNPRL

SEQ ID NO: 1478 - protein, 9 aa, Homo Sapiens
FLETNVPLL

SEQ ID NO: 1479 - protein, 9 aa, Homo Sapiens
FLFDHLLTL

SEQ ID NO: 1480 - protein, 9 aa, Homo Sapiens
FLFDRPMHV

SEQ ID NO: 1481 - protein, 9 aa, Homo Sapiens
FLFDTQHFI

SEQ ID NO: 1482 - protein, 9 aa, Homo Sapiens
FLFELPSRL

SEQ ID NO: 1483 - protein, 9 aa, Homo Sapiens
FLFEPVVKA

SEQ ID NO: 1484 - protein, 9 aa, Homo Sapiens
FLFGEVHKA

SEQ ID NO: 1485 - protein, 9 aa, Homo Sapiens
FLFGYPKRL

SEQ ID NO: 1486 - protein, 9 aa, Homo Sapiens
FLFLDRTYV

SEQ ID NO: 1487 - protein, 9 aa, Homo Sapiens
FLFNKVVNL

SEQ ID NO: 1488 - protein, 9 aa, Homo Sapiens
FLFNLPLNI

SEQ ID NO: 1489 - protein, 9 aa, Homo Sapiens
FLFNYDYTL

SEQ ID NO: 1490 - protein, 9 aa, Homo Sapiens
FLFPHSVLV

SEQ ID NO: 1491 - protein, 9 aa, Homo Sapiens
FLFPVYPLI

SEQ ID NO: 1492 - protein, 9 aa, Homo Sapiens
FLFQEPRSI

SEQ ID NO: 1493 - protein, 9 aa, Homo Sapiens
FLFQEVLVI

SEQ ID NO: 1494 - protein, 9 aa, Homo Sapiens
FLFQFIPYM

SEQ ID NO: 1495 - protein, 9 aa, Homo Sapiens
FLFRDILEL

SEQ ID NO: 1496 - protein, 9 aa, Homo Sapiens
FLFSKFIEL

SEQ ID NO: 1497 - protein, 9 aa, Homo Sapiens
FLFVDPELV

SEQ ID NO: 1498 - protein, 9 aa, Homo Sapiens
FLGEKIASV

SEQ ID NO: 1499 - protein, 9 aa, Homo Sapiens
FLGIHVFLV

SEQ ID NO: 1500 - protein, 9 aa, Homo Sapiens
FLGIYLLTI

SEQ ID NO: 1501 - protein, 9 aa, Homo Sapiens
FLGNLDITV

SEQ ID NO: 1502 - protein, 9 aa, Homo Sapiens
FLGSFIDHV

SEQ ID NO: 1503 - protein, 9 aa, Homo Sapiens
FLHAADVVL

SEQ ID NO: 1504 - protein, 9 aa, Homo Sapiens
FLHAVDVVL

SEQ ID NO: 1505 - protein, 9 aa, Homo Sapiens
FLHDNMVEI

SEQ ID NO: 1506 - protein, 9 aa, Homo Sapiens
FLHEATVRL

SEQ ID NO: 1507 - protein, 9 aa, Homo Sapiens
FLHESLILL

SEQ ID NO: 1508 - protein, 9 aa, Homo Sapiens
FLHEVLWEL

SEQ ID NO: 1509 - protein, 9 aa, Homo Sapiens
FLIAALDVL

SEQ ID NO: 1510 - protein, 9 aa, Homo Sapiens
FLIEEQKIV

SEQ ID NO: 1511 - protein, 9 aa, Homo Sapiens
FLINFIHTL

SEQ ID NO: 1512 - protein, 9 aa, Homo Sapiens
FLIPAVELI

SEQ ID NO: 1513 - protein, 9 aa, Homo Sapiens
FLIPFVITV

SEQ ID NO: 1514 - protein, 9 aa, Homo Sapiens
FLIPIYHQV

SEQ ID NO: 1515 - protein, 9 aa, Homo Sapiens
FLIPKFFEL

SEQ ID NO: 1516 - protein, 9 aa, Homo Sapiens
FLIPYFIFL

SEQ ID NO: 1517 - protein, 9 aa, Homo Sapiens
FLIRESETL

SEQ ID NO: 1518 - protein, 9 aa, Homo Sapiens
FLIRNIPVI

SEQ ID NO: 1519 - protein, 9 aa, Homo Sapiens
FLISRLIKL

SEQ ID NO: 1520 - protein, 9 aa, Homo Sapiens
FLITILDHL

SEQ ID NO: 1521 - protein, 9 aa, Homo Sapiens
FLKDLVASV

SEQ ID NO: 1522 - protein, 9 aa, Homo Sapiens
FLKNELDNV

SEQ ID NO: 1523 - protein, 9 aa, Homo Sapiens
FLLALEPEL

SEQ ID NO: 1524 - protein, 9 aa, Homo Sapiens
FLLALGHFL

SEQ ID NO: 1525 - protein, 9 aa, Homo Sapiens
FLLDHGASL

SEQ ID NO: 1526 - protein, 9 aa, Homo Sapiens
FLLDKALLI

SEQ ID NO: 1527 - protein, 9 aa, Homo Sapiens
FLLDKKIGV

SEQ ID NO: 1528 - protein, 9 aa, Homo Sapiens
FLLEGIRSL

SEQ ID NO: 1529 - protein, 9 aa, Homo Sapiens
FLLEIRQTL

SEQ ID NO: 1530 - protein, 9 aa, Homo Sapiens
FLLEKGYEV

SEQ ID NO: 1531 - protein, 9 aa, Homo Sapiens
FLLEKPFSV

SEQ ID NO: 1532 - protein, 9 aa, Homo Sapiens
FLLENSSKV

SEQ ID NO: 1533 - protein, 9 aa, Homo Sapiens
FLLEREQLL

SEQ ID NO: 1534 - protein, 9 aa, Homo Sapiens
FLLFINHRL

SEQ ID NO: 1535 - protein, 9 aa, Homo Sapiens
FLLGEHLLL

SEQ ID NO: 1536 - protein, 9 aa, Homo Sapiens
FLLGKEVSL

SEQ ID NO: 1537 - protein, 9 aa, Homo Sapiens
FLLHIQQQV

SEQ ID NO: 1538 - protein, 9 aa, Homo Sapiens
FLLPDVIRI

SEQ ID NO: 1539 - protein, 9 aa, Homo Sapiens
FLLPFAALL

SEQ ID NO: 1540 - protein, 9 aa, Homo Sapiens
FLLPGHTRL

SEQ ID NO: 1541 - protein, 9 aa, Homo Sapiens
FLLPILSQI

SEQ ID NO: 1542 - protein, 9 aa, Homo Sapiens
FLLPKVQSI

SEQ ID NO: 1543 - protein, 9 aa, Homo Sapiens
FLLPLRIAL

SEQ ID NO: 1544 - protein, 9 aa, Homo Sapiens
FLLPMFERL

SEQ ID NO: 1545 - protein, 9 aa, Homo Sapiens
FLLPTGVYL

SEQ ID NO: 1546 - protein, 9 aa, Homo Sapiens
FLLPVAVKL

SEQ ID NO: 1547 - protein, 9 aa, Homo Sapiens
FLLPVINEM

SEQ ID NO: 1548 - protein, 9 aa, Homo Sapiens
FLLQHQTFL

SEQ ID NO: 1549 - protein, 9 aa, Homo Sapiens
FLLQLHWRL

SEQ ID NO: 1550 - protein, 9 aa, Homo Sapiens
FLLQLQEEL

SEQ ID NO: 1551 - protein, 9 aa, Homo Sapiens
FLMDFIHQV

SEQ ID NO: 1552 - protein, 9 aa, Homo Sapiens
FLMEEVHMI

SEQ ID NO: 1553 - protein, 9 aa, Homo Sapiens
FLMWFIETA

SEQ ID NO: 1554 - protein, 9 aa, Homo Sapiens
FLNDEVWNL

SEQ ID NO: 1555 - protein, 9 aa, Homo Sapiens
FLNDIFERI

SEQ ID NO: 1556 - protein, 9 aa, Homo Sapiens
FLNGEVIRL

SEQ ID NO: 1557 - protein, 9 aa, Homo Sapiens
FLNGLEILL

SEQ ID NO: 1558 - protein, 9 aa, Homo Sapiens
FLNKLVILV

SEQ ID NO: 1559 - protein, 9 aa, Homo Sapiens
FLNNQEYVL

SEQ ID NO: 1560 - protein, 9 aa, Homo Sapiens
FLPAGIVAV

SEQ ID NO: 1561 - protein, 9 aa, Homo Sapiens
FLPARFYQA

SEQ ID NO: 1562 - protein, 9 aa, Homo Sapiens
FLPEAFDFI

SEQ ID NO: 1563 - protein, 9 aa, Homo Sapiens
FLPEAPAEL

SEQ ID NO: 1564 - protein, 9 aa, Homo Sapiens
FLPEPMGTA

SEQ ID NO: 1565 - protein, 9 aa, Homo Sapiens
FLPESVAVV

SEQ ID NO: 1566 - protein, 9 aa, Homo Sapiens
FLPLIVNTV

SEQ ID NO: 1567 - protein, 9 aa, Homo Sapiens
FLPPAQVTV

SEQ ID NO: 1568 - protein, 9 aa, Homo Sapiens
FLPPLPTSV

SEQ ID NO: 1569 - protein, 9 aa, Homo Sapiens
FLPPPFPPP

SEQ ID NO: 1570 - protein, 9 aa, Homo Sapiens
FLPPSFPIV

SEQ ID NO: 1571 - protein, 9 aa, Homo Sapiens
FLPPYTFQI

SEQ ID NO: 1572 - protein, 9 aa, Homo Sapiens
FLPQKIIYL

SEQ ID NO: 1573 - protein, 9 aa, Homo Sapiens
FLPQVVVTV

SEQ ID NO: 1574 - protein, 9 aa, Homo Sapiens
FLPRKFPSL

SEQ ID NO: 1575 - protein, 9 aa, Homo Sapiens
FLPSYIIDV

SEQ ID NO: 1576 - protein, 9 aa, Homo Sapiens
FLQEHNTTL

SEQ ID NO: 1577 - protein, 9 aa, Homo Sapiens
FLQEKSPAV

SEQ ID NO: 1578 - protein, 9 aa, Homo Sapiens
FLQEYGLSV

SEQ ID NO: 1579 - protein, 9 aa, Homo Sapiens
FLQEYVANL

SEQ ID NO: 1580 - protein, 9 aa, Homo Sapiens
FLQLAVDKV

SEQ ID NO: 1581 - protein, 9 aa, Homo Sapiens
FLQNVQILL

SEQ ID NO: 1582 - protein, 9 aa, Homo Sapiens
FLQPELVKL

SEQ ID NO: 1583 - protein, 9 aa, Homo Sapiens
FLQPGGYHV

SEQ ID NO: 1584 - protein, 9 aa, Homo Sapiens
FLREYFERL

SEQ ID NO: 1585 - protein, 9 aa, Homo Sapiens
FLRNINEYL

SEQ ID NO: 1586 - protein, 9 aa, Homo Sapiens
FLSDIPETV

SEQ ID NO: 1587 - protein, 9 aa, Homo Sapiens
FLSEKLERI

SEQ ID NO: 1588 - protein, 9 aa, Homo Sapiens
FLSELQYYL

SEQ ID NO: 1589 - protein, 9 aa, Homo Sapiens
FLSELTQQL

SEQ ID NO: 1590 - protein, 9 aa, Homo Sapiens
FLSEVFAQL

SEQ ID NO: 1591 - protein, 9 aa, Homo Sapiens
FLSEVFHQA

SEQ ID NO: 1592 - protein, 9 aa, Homo Sapiens
FLSGAKIWL

SEQ ID NO: 1593 - protein, 9 aa, Homo Sapiens
FLSGYYVTL

SEQ ID NO: 1594 - protein, 9 aa, Homo Sapiens
FLSHIPITL

SEQ ID NO: 1595 - protein, 9 aa, Homo Sapiens
FLSLINVGL

SEQ ID NO: 1596 - protein, 9 aa, Homo Sapiens
FLSNDTVQL

SEQ ID NO: 1597 - protein, 9 aa, Homo Sapiens
FLSNIFQAL

SEQ ID NO: 1598 - protein, 9 aa, Homo Sapiens
FLSPFNMIL

SEQ ID NO: 1599 - protein, 9 aa, Homo Sapiens
FLSPWPPAV

SEQ ID NO: 1600 - protein, 9 aa, Homo Sapiens
FLSSVIQNL

SEQ ID NO: 1601 - protein, 9 aa, Homo Sapiens
FLSTINVGL

SEQ ID NO: 1602 - protein, 9 aa, Homo Sapiens
FLSTLEHHL

SEQ ID NO: 1603 - protein, 9 aa, Homo Sapiens
FLSTSIAQL

SEQ ID NO: 1604 - protein, 9 aa, Homo Sapiens
FLSVTIINL

SEQ ID NO: 1605 - protein, 9 aa, Homo Sapiens
FLTAAIILL

SEQ ID NO: 1606 - protein, 9 aa, Homo Sapiens
FLTDREVRL

SEQ ID NO: 1607 - protein, 9 aa, Homo Sapiens
FLTEFINYI

SEQ ID NO: 1608 - protein, 9 aa, Homo Sapiens
FLTELVISL

SEQ ID NO: 1609 - protein, 9 aa, Homo Sapiens
FLTGVTTEL

SEQ ID NO: 1610 - protein, 9 aa, Homo Sapiens
FLTKQEILL

SEQ ID NO: 1611 - protein, 9 aa, Homo Sapiens
FLVDIMEHL

SEQ ID NO: 1612 - protein, 9 aa, Homo Sapiens
FLVDSQFMV

SEQ ID NO: 1613 - protein, 9 aa, Homo Sapiens
FLVEHNLVL

SEQ ID NO: 1614 - protein, 9 aa, Homo Sapiens
FLVGERVTL

SEQ ID NO: 1615 - protein, 9 aa, Homo Sapiens
FLVLDVVYL

SEQ ID NO: 1616 - protein, 9 aa, Homo Sapiens
FLVNSDLTL

SEQ ID NO: 1617 - protein, 9 aa, Homo Sapiens
FLVQNIHTL

SEQ ID NO: 1618 - protein, 9 aa, Homo Sapiens
FLVTVIHTL

SEQ ID NO: 1619 - protein, 9 aa, Homo Sapiens
FLWERPTLL

SEQ ID NO: 1620 - protein, 9 aa, Homo Sapiens
FLWPKEVEL

SEQ ID NO: 1621 - protein, 9 aa, Homo Sapiens
FLYAGHIFL

SEQ ID NO: 1622 - protein, 9 aa, Homo Sapiens
FLYDDNQRV

SEQ ID NO: 1623 - protein, 9 aa, Homo Sapiens
FLYDTHQNL

SEQ ID NO: 1624 - protein, 9 aa, Homo Sapiens
FLYFEDHGL

SEQ ID NO: 1625 - protein, 9 aa, Homo Sapiens
FLYIRQLAI

SEQ ID NO: 1626 - protein, 9 aa, Homo Sapiens
FLYPFLHTV

SEQ ID NO: 1627 - protein, 9 aa, Homo Sapiens
FLYPFPLAL

SEQ ID NO: 1628 - protein, 9 aa, Homo Sapiens
FLYQYSTRL

SEQ ID NO: 1629 - protein, 9 aa, Homo Sapiens
FLYSDEVQI

SEQ ID NO: 1630 - protein, 9 aa, Homo Sapiens
FLYSLLMKL

SEQ ID NO: 1631 - protein, 9 aa, Homo Sapiens
FLYWHLEDL

SEQ ID NO: 1632 - protein, 9 aa, Homo Sapiens
FMATIAEGL

SEQ ID NO: 1633 - protein, 9 aa, Homo Sapiens
FMFGQKLNV

SEQ ID NO: 1634 - protein, 9 aa, Homo Sapiens
FMFQEALKL

SEQ ID NO: 1635 - protein, 9 aa, Homo Sapiens
FMLGNYINL

SEQ ID NO: 1636 - protein, 9 aa, Homo Sapiens
FMLKDMLYL

SEQ ID NO: 1637 - protein, 9 aa, Homo Sapiens
FMLPDPQNI

SEQ ID NO: 1638 - protein, 9 aa, Homo Sapiens
FMSEYLIEL

SEQ ID NO: 1639 - protein, 9 aa, Homo Sapiens
FMTTNVPNV

SEQ ID NO: 1640 - protein, 9 aa, Homo Sapiens
FMVEKGPTL

SEQ ID NO: 1641 - protein, 9 aa, Homo Sapiens
FQDENYLYL

SEQ ID NO: 1642 - protein, 9 aa, Homo Sapiens
FQDPVPLTV

SEQ ID NO: 1643 - protein, 9 aa, Homo Sapiens
FQIGPVAGV

SEQ ID NO: 1644 - protein, 9 aa, Homo Sapiens
FQLPIRFNL

SEQ ID NO: 1645 - protein, 9 aa, Homo Sapiens
FQMEQIVYC

SEQ ID NO: 1646 - protein, 9 aa, Homo Sapiens
FQTDLIYNL

SEQ ID NO: 1647 - protein, 9 aa, Homo Sapiens
FTAEFLEKV

SEQ ID NO: 1648 - protein, 9 aa, Homo Sapiens
FTWEGLYNV

SEQ ID NO: 1649 - protein, 9 aa, Homo Sapiens
FVARMIPKV

SEQ ID NO: 1650 - protein, 9 aa, Homo Sapiens
FVDDYTVRV

SEQ ID NO: 1651 - protein, 9 aa, Homo Sapiens
FVDEFLTYL

SEQ ID NO: 1652 - protein, 9 aa, Homo Sapiens
FVDGLTFKV

SEQ ID NO: 1653 - protein, 9 aa, Homo Sapiens
FVFPGELLL

SEQ ID NO: 1654 - protein, 9 aa, Homo Sapiens
FVFSFPVSV

SEQ ID NO: 1655 - protein, 9 aa, Homo Sapiens
FVHDLVLYL

SEQ ID NO: 1656 - protein, 9 aa, Homo Sapiens
FVIAELVNV

SEQ ID NO: 1657 - protein, 9 aa, Homo Sapiens
FVIDLQTRL

SEQ ID NO: 1658 - protein, 9 aa, Homo Sapiens
FVIPVVQAL

SEQ ID NO: 1659 - protein, 9 aa, Homo Sapiens
FVIRNIVEA

SEQ ID NO: 1660 - protein, 9 aa, Homo Sapiens
FVLPELPSV

SEQ ID NO: 1661 - protein, 9 aa, Homo Sapiens
FVLPVATQI

SEQ ID NO: 1662 - protein, 9 aa, Homo Sapiens
FVMETFVHL

SEQ ID NO: 1663 - protein, 9 aa, Homo Sapiens
FVPDTPVGV

SEQ ID NO: 1664 - protein, 9 aa, Homo Sapiens
GELYLIPFA

SEQ ID NO: 1665 - protein, 9 aa, Homo Sapiens
GIAELVPGV

SEQ ID NO: 1666 - protein, 9 aa, Homo Sapiens
GIMKKAYEL

SEQ ID NO: 1667 - protein, 9 aa, Homo Sapiens
GIWGFIKGV

SEQ ID NO: 1668 - protein, 9 aa, Homo Sapiens
GLAAFRAFL

SEQ ID NO: 1669 - protein, 9 aa, Homo Sapiens
GLAATLYSL

SEQ ID NO: 1670 - protein, 9 aa, Homo Sapiens
GLAEFQENV

SEQ ID NO: 1671 - protein, 9 aa, Homo Sapiens
GLAEILVLV

SEQ ID NO: 1672 - protein, 9 aa, Homo Sapiens
GLAHFVNEI

SEQ ID NO: 1673 - protein, 9 aa, Homo Sapiens
GLAKLIADV

SEQ ID NO: 1674 - protein, 9 aa, Homo Sapiens
GLAKRVWSL

SEQ ID NO: 1675 - protein, 9 aa, Homo Sapiens
GLAPHLEQI

SEQ ID NO: 1676 - protein, 9 aa, Homo Sapiens
GLAPKPVQV

SEQ ID NO: 1677 - protein, 9 aa, Homo Sapiens
GLAPLHIQL

SEQ ID NO: 1678 - protein, 9 aa, Homo Sapiens
GLATDVQTV

SEQ ID NO: 1679 - protein, 9 aa, Homo Sapiens
GLDDLLLFL

SEQ ID NO: 1680 - protein, 9 aa, Homo Sapiens
GLDELFVQV

SEQ ID NO: 1681 - protein, 9 aa, Homo Sapiens
GLDIPTVQV

SEQ ID NO: 1682 - protein, 9 aa, Homo Sapiens
GLDNINVFL

SEQ ID NO: 1683 - protein, 9 aa, Homo Sapiens
GLDSYLPEL

SEQ ID NO: 1684 - protein, 9 aa, Homo Sapiens
GLFARIIMI

SEQ ID NO: 1685 - protein, 9 aa, Homo Sapiens
GLFDQHFRL

SEQ ID NO: 1686 - protein, 9 aa, Homo Sapiens
GLFDQQLAL

SEQ ID NO: 1687 - protein, 9 aa, Homo Sapiens
GLFDTAISL

SEQ ID NO: 1688 - protein, 9 aa, Homo Sapiens
GLFGVPLCL

SEQ ID NO: 1689 - protein, 9 aa, Homo Sapiens
GLFGYLVFL

SEQ ID NO: 1690 - protein, 9 aa, Homo Sapiens
GLFHFPTPL

SEQ ID NO: 1691 - protein, 9 aa, Homo Sapiens
GLFMGLVLV

SEQ ID NO: 1692 - protein, 9 aa, Homo Sapiens
GLFPTSHSV

SEQ ID NO: 1693 - protein, 9 aa, Homo Sapiens
GLFPWTPKL

SEQ ID NO: 1694 - protein, 9 aa, Homo Sapiens
GLFQGKTPL

SEQ ID NO: 1695 - protein, 9 aa, Homo Sapiens
GLFSAKLFL

SEQ ID NO: 1696 - protein, 9 aa, Homo Sapiens
GLGPNLVGV

SEQ ID NO: 1697 - protein, 9 aa, Homo Sapiens
GLHGWAFTL

SEQ ID NO: 1698 - protein, 9 aa, Homo Sapiens
GLHNVVYGI

SEQ ID NO: 1699 - protein, 9 aa, Homo Sapiens
GLHSYFITV

SEQ ID NO: 1700 - protein, 9 aa, Homo Sapiens
GLIDEIYGI

SEQ ID NO: 1701 - protein, 9 aa, Homo Sapiens
GLIDENPGL

SEQ ID NO: 1702 - protein, 9 aa, Homo Sapiens
GLIDFAIQL

SEQ ID NO: 1703 - protein, 9 aa, Homo Sapiens
GLIDHQTYL

SEQ ID NO: 1704 - protein, 9 aa, Homo Sapiens
GLIDKVNEL

SEQ ID NO: 1705 - protein, 9 aa, Homo Sapiens
GLIDRQVTV

SEQ ID NO: 1706 - protein, 9 aa, Homo Sapiens
GLIDVHVHL

SEQ ID NO: 1707 - protein, 9 aa, Homo Sapiens
GLIEILKKV

SEQ ID NO: 1708 - protein, 9 aa, Homo Sapiens
GLIEKNIEL

SEQ ID NO: 1709 - protein, 9 aa, Homo Sapiens
GLIENPALL

SEQ ID NO: 1710 - protein, 9 aa, Homo Sapiens
GLIGQLDEV

SEQ ID NO: 1711 - protein, 9 aa, Homo Sapiens
GLKEGIPAL

SEQ ID NO: 1712 - protein, 9 aa, Homo Sapiens
GLKHDIARV

SEQ ID NO: 1713 - protein, 9 aa, Homo Sapiens
GLLAKIFEL

SEQ ID NO: 1714 - protein, 9 aa, Homo Sapiens
GLLDAVTYL

SEQ ID NO: 1715 - protein, 9 aa, Homo Sapiens
GLLDLPFRV

SEQ ID NO: 1716 - protein, 9 aa, Homo Sapiens
GLLDRIMQL

SEQ ID NO: 1717 - protein, 9 aa, Homo Sapiens
GLLEEAYTL

SEQ ID NO: 1718 - protein, 9 aa, Homo Sapiens
GLLEGLVEV

SEQ ID NO: 1719 - protein, 9 aa, Homo Sapiens
GLLEIVTSV

SEQ ID NO: 1720 - protein, 9 aa, Homo Sapiens
GLLENIPRV

SEQ ID NO: 1721 - protein, 9 aa, Homo Sapiens
GLLENIRQL

SEQ ID NO: 1722 - protein, 9 aa, Homo Sapiens
GLLERVKEL

SEQ ID NO: 1723 - protein, 9 aa, Homo Sapiens
GLLGNVAEV

SEQ ID NO: 1724 - protein, 9 aa, Homo Sapiens
GLLGNVVNI

SEQ ID NO: 1725 - protein, 9 aa, Homo Sapiens
GLLGYLHFV

SEQ ID NO: 1726 - protein, 9 aa, Homo Sapiens
GLLHLTLLL

SEQ ID NO: 1727 - protein, 9 aa, Homo Sapiens
GLLNNIAEV

SEQ ID NO: 1728 - protein, 9 aa, Homo Sapiens
GLLPDVPSL

SEQ ID NO: 1729 - protein, 9 aa, Homo Sapiens
GLLRIIPYL

SEQ ID NO: 1730 - protein, 9 aa, Homo Sapiens
GLLRLAIRL

SEQ ID NO: 1731 - protein, 9 aa, Homo Sapiens
GLLSIFTKV

SEQ ID NO: 1732 - protein, 9 aa, Homo Sapiens
GLLTEIRAV

SEQ ID NO: 1733 - protein, 9 aa, Homo Sapiens
GLMDTVKKV

SEQ ID NO: 1734 - protein, 9 aa, Homo Sapiens
GLMEDLLKL

SEQ ID NO: 1735 - protein, 9 aa, Homo Sapiens
GLMGISSTL

SEQ ID NO: 1736 - protein, 9 aa, Homo Sapiens
GLMRKVPRV

SEQ ID NO: 1737 - protein, 9 aa, Homo Sapiens
GLMTTVHAI

SEQ ID NO: 1738 - protein, 9 aa, Homo Sapiens
GLNEEIARV

SEQ ID NO: 1739 - protein, 9 aa, Homo Sapiens
GLNEFVVKF

SEQ ID NO: 1740 - protein, 9 aa, Homo Sapiens
GLPELVIQL

SEQ ID NO: 1741 - protein, 9 aa, Homo Sapiens
GLQEYVEAV

SEQ ID NO: 1742 - protein, 9 aa, Homo Sapiens
GLSDLRLEL

SEQ ID NO: 1743 - protein, 9 aa, Homo Sapiens
GLSETILAV

SEQ ID NO: 1744 - protein, 9 aa, Homo Sapiens
GLSGIIPTL

SEQ ID NO: 1745 - protein, 9 aa, Homo Sapiens
GLSQVAVTV

SEQ ID NO: 1746 - protein, 9 aa, Homo Sapiens
GLSSLSIHL

SEQ ID NO: 1747 - protein, 9 aa, Homo Sapiens
GLSVIIPHV

SEQ ID NO: 1748 - protein, 9 aa, Homo Sapiens
GLTEALHFV

SEQ ID NO: 1749 - protein, 9 aa, Homo Sapiens
GLTPHLTMV

SEQ ID NO: 1750 - protein, 9 aa, Homo Sapiens
GLTSAIQAV

SEQ ID NO: 1751 - protein, 9 aa, Homo Sapiens
GLVDQLVKA

SEQ ID NO: 1752 - protein, 9 aa, Homo Sapiens
GLVGSLQEV

SEQ ID NO: 1753 - protein, 9 aa, Homo Sapiens
GLVNYQISV

SEQ ID NO: 1754 - protein, 9 aa, Homo Sapiens
GLVPFLVSV

SEQ ID NO: 1755 - protein, 9 aa, Homo Sapiens
GLWGHALLL

SEQ ID NO: 1756 - protein, 9 aa, Homo Sapiens
GLWGPVHEL

SEQ ID NO: 1757 - protein, 9 aa, Homo Sapiens
GLYELVWRV

SEQ ID NO: 1758 - protein, 9 aa, Homo Sapiens
GLYGAIFRL

SEQ ID NO: 1759 - protein, 9 aa, Homo Sapiens
GLYGLIVAL

SEQ ID NO: 1760 - protein, 9 aa, Homo Sapiens
GLYPNLIQV

SEQ ID NO: 1761 - protein, 9 aa, Homo Sapiens
GLYQGQVLV

SEQ ID NO: 1762 - protein, 9 aa, Homo Sapiens
GLYSGVTTV

SEQ ID NO: 1763 - protein, 9 aa, Homo Sapiens
GMAERIPEL

SEQ ID NO: 1764 - protein, 9 aa, Homo Sapiens
GMDRYLIYV

SEQ ID NO: 1765 - protein, 9 aa, Homo Sapiens
GMMSVDPRL

SEQ ID NO: 1766 - protein, 9 aa, Homo Sapiens
GMYIFLHTV

SEQ ID NO: 1767 - protein, 9 aa, Homo Sapiens
GQIEVVPEV

SEQ ID NO: 1768 - protein, 9 aa, Homo Sapiens
GTIGLIHAV

SEQ ID NO: 1769 - protein, 9 aa, Homo Sapiens
GVKQLIVGV

SEQ ID NO: 1770 - protein, 9 aa, Homo Sapiens
GVLPNIQAV

SEQ ID NO: 1771 - protein, 9 aa, Homo Sapiens
GVQDFVPFV

SEQ ID NO: 1772 - protein, 9 aa, Homo Sapiens
HIFKDKVVL

SEQ ID NO: 1773 - protein, 9 aa, Homo Sapiens
HIIENIVAV

SEQ ID NO: 1774 - protein, 9 aa, Homo Sapiens
HILDFSPSL

SEQ ID NO: 1775 - protein, 9 aa, Homo Sapiens
HILECEFYL

SEQ ID NO: 1776 - protein, 9 aa, Homo Sapiens
HILQLLTTV

SEQ ID NO: 1777 - protein, 9 aa, Homo Sapiens
HLAELIAEL

SEQ ID NO: 1778 - protein, 9 aa, Homo Sapiens
HLAIKLEQV

SEQ ID NO: 1779 - protein, 9 aa, Homo Sapiens
HLANIVERV

SEQ ID NO: 1780 - protein, 9 aa, Homo Sapiens
HLDATKLLL

SEQ ID NO: 1781 - protein, 9 aa, Homo Sapiens
HLFDAFVSV

SEQ ID NO: 1782 - protein, 9 aa, Homo Sapiens
HLFGALVLL

SEQ ID NO: 1783 - protein, 9 aa, Homo Sapiens
HLFTATINL

SEQ ID NO: 1784 - protein, 9 aa, Homo Sapiens
HLGDFLVFL

SEQ ID NO: 1785 - protein, 9 aa, Homo Sapiens
HLIEPLANA

SEQ ID NO: 1786 - protein, 9 aa, Homo Sapiens
HLIHEVTKV

SEQ ID NO: 1787 - protein, 9 aa, Homo Sapiens
HLINYIIFL

SEQ ID NO: 1788 - protein, 9 aa, Homo Sapiens
HLISTINTV

SEQ ID NO: 1789 - protein, 9 aa, Homo Sapiens
HLLDIYIQL

SEQ ID NO: 1790 - protein, 9 aa, Homo Sapiens
HLLEEPIYL

SEQ ID NO: 1791 - protein, 9 aa, Homo Sapiens
HLLGDQISL

SEQ ID NO: 1792 - protein, 9 aa, Homo Sapiens
HLLGDVVFL

SEQ ID NO: 1793 - protein, 9 aa, Homo Sapiens
HLLHTVPAL

SEQ ID NO: 1794 - protein, 9 aa, Homo Sapiens
HLLNESPML

SEQ ID NO: 1795 - protein, 9 aa, Homo Sapiens
HLSDAIVEV

SEQ ID NO: 1796 - protein, 9 aa, Homo Sapiens
HLSIINEYL

SEQ ID NO: 1797 - protein, 9 aa, Homo Sapiens
HLSNIPPSV

SEQ ID NO: 1798 - protein, 9 aa, Homo Sapiens
HLSVVSVTV

SEQ ID NO: 1799 - protein, 9 aa, Homo Sapiens
HLTDITLKV

SEQ ID NO: 1800 - protein, 9 aa, Homo Sapiens
HLTYLNVYL

SEQ ID NO: 1801 - protein, 9 aa, Homo Sapiens
HLVPEVPTV

SEQ ID NO: 1802 - protein, 9 aa, Homo Sapiens
HLWAELVFL

SEQ ID NO: 1803 - protein, 9 aa, Homo Sapiens
HLWRGIVSI

SEQ ID NO: 1804 - protein, 9 aa, Homo Sapiens
HLWSYLITL

SEQ ID NO: 1805 - protein, 9 aa, Homo Sapiens
HLYDIHVTV

SEQ ID NO: 1806 - protein, 9 aa, Homo Sapiens
HVLDVIHEV

SEQ ID NO: 1807 - protein, 9 aa, Homo Sapiens
IAEMRIPAL

SEQ ID NO: 1808 - protein, 9 aa, Homo Sapiens
IAPPVPLKA

SEQ ID NO: 1809 - protein, 9 aa, Homo Sapiens
IAQEILKVV

SEQ ID NO: 1810 - protein, 9 aa, Homo Sapiens
IIADNIIFL

SEQ ID NO: 1811 - protein, 9 aa, Homo Sapiens
IIDGKIFCV

SEQ ID NO: 1812 - protein, 9 aa, Homo Sapiens
IIFVPVPQL

SEQ ID NO: 1813 - protein, 9 aa, Homo Sapiens
IIIDSVPEV

SEQ ID NO: 1814 - protein, 9 aa, Homo Sapiens
IIIPEIQKV

SEQ ID NO: 1815 - protein, 9 aa, Homo Sapiens
ILAAHVPTL

SEQ ID NO: 1816 - protein, 9 aa, Homo Sapiens
ILAAVETRL

SEQ ID NO: 1817 - protein, 9 aa, Homo Sapiens
ILADIVISA

SEQ ID NO: 1818 - protein, 9 aa, Homo Sapiens
ILAEGITIV

SEQ ID NO: 1819 - protein, 9 aa, Homo Sapiens
ILAELLLRV

SEQ ID NO: 1820 - protein, 9 aa, Homo Sapiens
ILAKEVEIV

SEQ ID NO: 1821 - protein, 9 aa, Homo Sapiens
ILAPVVKEI

SEQ ID NO: 1822 - protein, 9 aa, Homo Sapiens
ILAQIMPFL

SEQ ID NO: 1823 - protein, 9 aa, Homo Sapiens
ILAQQPLSV

SEQ ID NO: 1824 - protein, 9 aa, Homo Sapiens
ILASIFETV

SEQ ID NO: 1825 - protein, 9 aa, Homo Sapiens
ILDCIYNEV

SEQ ID NO: 1826 - protein, 9 aa, Homo Sapiens
ILDDIGHGV

SEQ ID NO: 1827 - protein, 9 aa, Homo Sapiens
ILDDSHLLV

SEQ ID NO: 1828 - protein, 9 aa, Homo Sapiens
ILDEPTNHL

SEQ ID NO: 1829 - protein, 9 aa, Homo Sapiens
ILDEPTNNL

SEQ ID NO: 1830 - protein, 9 aa, Homo Sapiens
ILDEVIFKL

SEQ ID NO: 1831 - protein, 9 aa, Homo Sapiens
ILDGNQLHI

SEQ ID NO: 1832 - protein, 9 aa, Homo Sapiens
ILDHEVPSL

SEQ ID NO: 1833 - protein, 9 aa, Homo Sapiens
ILDKKVEKV

SEQ ID NO: 1834 - protein, 9 aa, Homo Sapiens
ILDPCIYRV

SEQ ID NO: 1835 - protein, 9 aa, Homo Sapiens
ILDQKINEV

SEQ ID NO: 1836 - protein, 9 aa, Homo Sapiens
ILDSRLIAA

SEQ ID NO: 1837 - protein, 9 aa, Homo Sapiens
ILDVTVVYL

SEQ ID NO: 1838 - protein, 9 aa, Homo Sapiens
ILEENIPVL

SEQ ID NO: 1839 - protein, 9 aa, Homo Sapiens
ILEPSLYTV

SEQ ID NO: 1840 - protein, 9 aa, Homo Sapiens
ILFGHENRV

SEQ ID NO: 1841 - protein, 9 aa, Homo Sapiens
ILFNRVLGV

SEQ ID NO: 1842 - protein, 9 aa, Homo Sapiens
ILFPLRFTL

SEQ ID NO: 1843 - protein, 9 aa, Homo Sapiens
ILGDFLVAV

SEQ ID NO: 1844 - protein, 9 aa, Homo Sapiens
ILGIQPPSV

SEQ ID NO: 1845 - protein, 9 aa, Homo Sapiens
ILGPKPQGV

SEQ ID NO: 1846 - protein, 9 aa, Homo Sapiens
ILGTHNITV

SEQ ID NO: 1847 - protein, 9 aa, Homo Sapiens
ILHDAVVFL

SEQ ID NO: 1848 - protein, 9 aa, Homo Sapiens
ILHDDEVTV

SEQ ID NO: 1849 - protein, 9 aa, Homo Sapiens
ILHGLVAAV

SEQ ID NO: 1850 - protein, 9 aa, Homo Sapiens
ILHSVTTNL

SEQ ID NO: 1851 - protein, 9 aa, Homo Sapiens
ILIDWLVQV

SEQ ID NO: 1852 - protein, 9 aa, Homo Sapiens
ILIETKLVL

SEQ ID NO: 1853 - protein, 9 aa, Homo Sapiens
ILIGRIKNV

SEQ ID NO: 1854 - protein, 9 aa, Homo Sapiens
ILIRPLVSV

SEQ ID NO: 1855 - protein, 9 aa, Homo Sapiens
ILISKLLGA

SEQ ID NO: 1856 - protein, 9 aa, Homo Sapiens
ILITNVVCV

SEQ ID NO: 1857 - protein, 9 aa, Homo Sapiens
ILLAEVDKV

SEQ ID NO: 1858 - protein, 9 aa, Homo Sapiens
ILLAEVPTM

SEQ ID NO: 1859 - protein, 9 aa, Homo Sapiens
ILLDIHIFM

SEQ ID NO: 1860 - protein, 9 aa, Homo Sapiens
ILLDQTVRV

SEQ ID NO: 1861 - protein, 9 aa, Homo Sapiens
ILLDRLLYL

SEQ ID NO: 1862 - protein, 9 aa, Homo Sapiens
ILLEGTMNL

SEQ ID NO: 1863 - protein, 9 aa, Homo Sapiens
ILLEHNYAL

SEQ ID NO: 1864 - protein, 9 aa, Homo Sapiens
ILLKDILSV

SEQ ID NO: 1865 - protein, 9 aa, Homo Sapiens
ILLLPLHTG

SEQ ID NO: 1866 - protein, 9 aa, Homo Sapiens
ILLPYVSKV

SEQ ID NO: 1867 - protein, 9 aa, Homo Sapiens
ILLQGRLYL

SEQ ID NO: 1868 - protein, 9 aa, Homo Sapiens
ILLSVPLLV

SEQ ID NO: 1869 - protein, 9 aa, Homo Sapiens
ILMEHIHKL

SEQ ID NO: 1870 - protein, 9 aa, Homo Sapiens
ILMGVLKEV

SEQ ID NO: 1871 - protein, 9 aa, Homo Sapiens
ILMTLTVKV

SEQ ID NO: 1872 - protein, 9 aa, Homo Sapiens
ILNEIVNFV

SEQ ID NO: 1873 - protein, 9 aa, Homo Sapiens
ILNEVDISV

SEQ ID NO: 1874 - protein, 9 aa, Homo Sapiens
ILNKQEFFV

SEQ ID NO: 1875 - protein, 9 aa, Homo Sapiens
ILNNKIPEA

SEQ ID NO: 1876 - protein, 9 aa, Homo Sapiens
ILNPEVVTV

SEQ ID NO: 1877 - protein, 9 aa, Homo Sapiens
ILNPVTTKL

SEQ ID NO: 1878 - protein, 9 aa, Homo Sapiens
ILNPYNLFL

SEQ ID NO: 1879 - protein, 9 aa, Homo Sapiens
ILNSTTIEI

SEQ ID NO: 1880 - protein, 9 aa, Homo Sapiens
ILNTLNITV

SEQ ID NO: 1881 - protein, 9 aa, Homo Sapiens
ILNYVLVRV

SEQ ID NO: 1882 - protein, 9 aa, Homo Sapiens
ILPERFLAV

SEQ ID NO: 1883 - protein, 9 aa, Homo Sapiens
ILQDRLNQV

SEQ ID NO: 1884 - protein, 9 aa, Homo Sapiens
ILQEREYRL

SEQ ID NO: 1885 - protein, 9 aa, Homo Sapiens
ILQNKIDLV

SEQ ID NO: 1886 - protein, 9 aa, Homo Sapiens
ILQQHIATV

SEQ ID NO: 1887 - protein, 9 aa, Homo Sapiens
ILSEFSSKL

SEQ ID NO: 1888 - protein, 9 aa, Homo Sapiens
ILSEIKEAV

SEQ ID NO: 1889 - protein, 9 aa, Homo Sapiens
ILSELAPSL

SEQ ID NO: 1890 - protein, 9 aa, Homo Sapiens
ILSESLHSL

SEQ ID NO: 1891 - protein, 9 aa, Homo Sapiens
ILSEVQQAV

SEQ ID NO: 1892 - protein, 9 aa, Homo Sapiens
ILSGVIRSV

SEQ ID NO: 1893 - protein, 9 aa, Homo Sapiens
ILSPTVVSI

SEQ ID NO: 1894 - protein, 9 aa, Homo Sapiens
ILSQYITFV

SEQ ID NO: 1895 - protein, 9 aa, Homo Sapiens
ILSVFIPSL

SEQ ID NO: 1896 - protein, 9 aa, Homo Sapiens
ILTDITKGV

SEQ ID NO: 1897 - protein, 9 aa, Homo Sapiens
ILTEAIKAA

SEQ ID NO: 1898 - protein, 9 aa, Homo Sapiens
ILTESEIKL

SEQ ID NO: 1899 - protein, 9 aa, Homo Sapiens
ILTKILYLI

SEQ ID NO: 1900 - protein, 9 aa, Homo Sapiens
ILTNVVPKM

SEQ ID NO: 1901 - protein, 9 aa, Homo Sapiens
ILTSDVPQI

SEQ ID NO: 1902 - protein, 9 aa, Homo Sapiens
ILVDTVWAL

SEQ ID NO: 1903 - protein, 9 aa, Homo Sapiens
ILVDWLVQV

SEQ ID NO: 1904 - protein, 9 aa, Homo Sapiens
ILVGLLHMV

SEQ ID NO: 1905 - protein, 9 aa, Homo Sapiens
ILWDTLLRL

SEQ ID NO: 1906 - protein, 9 aa, Homo Sapiens
ILWEHLEIL

SEQ ID NO: 1907 - protein, 9 aa, Homo Sapiens
ILWETVPSM

SEQ ID NO: 1908 - protein, 9 aa, Homo Sapiens
ILWSEAIFL

SEQ ID NO: 1909 - protein, 9 aa, Homo Sapiens
ILWSHLELL

SEQ ID NO: 1910 - protein, 9 aa, Homo Sapiens
ILYDKLEKI

SEQ ID NO: 1911 - protein, 9 aa, Homo Sapiens
ILYGKIIHL

SEQ ID NO: 1912 - protein, 9 aa, Homo Sapiens
IMDATNILV

SEQ ID NO: 1913 - protein, 9 aa, Homo Sapiens
IMEDIILTL

SEQ ID NO: 1914 - protein, 9 aa, Homo Sapiens
IMFRGEVRL

SEQ ID NO: 1915 - protein, 9 aa, Homo Sapiens
IMLEALERV

SEQ ID NO: 1916 - protein, 9 aa, Homo Sapiens
IQHDLIFSL

SEQ ID NO: 1917 - protein, 9 aa, Homo Sapiens
IQIMKVEEI

SEQ ID NO: 1918 - protein, 9 aa, Homo Sapiens
IQVTKVTQV

SEQ ID NO: 1919 - protein, 9 aa, Homo Sapiens
IRKLPFQRL

SEQ ID NO: 1920 - protein, 9 aa, Homo Sapiens
ISLLVTIKI

SEQ ID NO: 1921 - protein, 9 aa, Homo Sapiens
ISTEVNPKL

SEQ ID NO: 1922 - protein, 9 aa, Homo Sapiens
ITTDVLYTI

SEQ ID NO: 1923 - protein, 9 aa, Homo Sapiens
IVIGVLHQL

SEQ ID NO: 1924 - protein, 9 aa, Homo Sapiens
IVMEHVVFL

SEQ ID NO: 1925 - protein, 9 aa, Homo Sapiens
IVMETVPVL

SEQ ID NO: 1926 - protein, 9 aa, Homo Sapiens
IVVDNVPQV

SEQ ID NO: 1927 - protein, 9 aa, Homo Sapiens
IVWNGPVGV

SEQ ID NO: 1928 - protein, 9 aa, Homo Sapiens
KIADFGWSV

SEQ ID NO: 1929 - protein, 9 aa, Homo Sapiens
KIAELLENV

SEQ ID NO: 1930 - protein, 9 aa, Homo Sapiens
KIAENVLHL

SEQ ID NO: 1931 - protein, 9 aa, Homo Sapiens
KIAPNTPQL

SEQ ID NO: 1932 - protein, 9 aa, Homo Sapiens
KILDYEVTL

SEQ ID NO: 1933 - protein, 9 aa, Homo Sapiens
KILEDVVGV

SEQ ID NO: 1934 - protein, 9 aa, Homo Sapiens
KILPDLNTV

SEQ ID NO: 1935 - protein, 9 aa, Homo Sapiens
KILPTLEAV

SEQ ID NO: 1936 - protein, 9 aa, Homo Sapiens
KILPVMVTL

SEQ ID NO: 1937 - protein, 9 aa, Homo Sapiens
KILQELPSV

SEQ ID NO: 1938 - protein, 9 aa, Homo Sapiens
KILSELFTV

SEQ ID NO: 1939 - protein, 9 aa, Homo Sapiens
KIMDYSLLL

SEQ ID NO: 1940 - protein, 9 aa, Homo Sapiens
KISEVVELL

SEQ ID NO: 1941 - protein, 9 aa, Homo Sapiens
KISTITPQI

SEQ ID NO: 1942 - protein, 9 aa, Homo Sapiens
KISVIVETV

SEQ ID NO: 1943 - protein, 9 aa, Homo Sapiens
KIVDFSYSV

SEQ ID NO: 1944 - protein, 9 aa, Homo Sapiens
KIYEGQVEV

SEQ ID NO: 1945 - protein, 9 aa, Homo Sapiens
KLAAVVNNL

SEQ ID NO: 1946 - protein, 9 aa, Homo Sapiens
KLAEALPSL

SEQ ID NO: 1947 - protein, 9 aa, Homo Sapiens
KLAEFIDFL

SEQ ID NO: 1948 - protein, 9 aa, Homo Sapiens
KLAEGVLDV

SEQ ID NO: 1949 - protein, 9 aa, Homo Sapiens
KLDAFVEGV

SEQ ID NO: 1950 - protein, 9 aa, Homo Sapiens
KLDDYVYYV

SEQ ID NO: 1951 - protein, 9 aa, Homo Sapiens
KLDHVVTII

SEQ ID NO: 1952 - protein, 9 aa, Homo Sapiens
KLDWHRFNL

SEQ ID NO: 1953 - protein, 9 aa, Homo Sapiens
KLEEIIHQI

SEQ ID NO: 1954 - protein, 9 aa, Homo Sapiens
KLFDAPLSI

SEQ ID NO: 1955 - protein, 9 aa, Homo Sapiens
KLFDRPQEL

SEQ ID NO: 1956 - protein, 9 aa, Homo Sapiens
KLFGETTLV

SEQ ID NO: 1957 - protein, 9 aa, Homo Sapiens
KLFGMIITI

SEQ ID NO: 1958 - protein, 9 aa, Homo Sapiens
KLFIGGLNV

SEQ ID NO: 1959 - protein, 9 aa, Homo Sapiens
KLFNEFIQL

SEQ ID NO: 1960 - protein, 9 aa, Homo Sapiens
KLFPFYFHI

SEQ ID NO: 1961 - protein, 9 aa, Homo Sapiens
KLFQGQLVL

SEQ ID NO: 1962 - protein, 9 aa, Homo Sapiens
KLFSELPLA

SEQ ID NO: 1963 - protein, 9 aa, Homo Sapiens
KLFSILSTV

SEQ ID NO: 1964 - protein, 9 aa, Homo Sapiens
KLGEIVTTI

SEQ ID NO: 1965 - protein, 9 aa, Homo Sapiens
KLGLKPLEV

SEQ ID NO: 1966 - protein, 9 aa, Homo Sapiens
KLHDINAQL

SEQ ID NO: 1967 - protein, 9 aa, Homo Sapiens
KLHGVNINV

SEQ ID NO: 1968 - protein, 9 aa, Homo Sapiens
KLIDYIYTA

SEQ ID NO: 1969 - protein, 9 aa, Homo Sapiens
KLIEELETL

SEQ ID NO: 1970 - protein, 9 aa, Homo Sapiens
KLIFSVEAV

SEQ ID NO: 1971 - protein, 9 aa, Homo Sapiens
KLILLITQV

SEQ ID NO: 1972 - protein, 9 aa, Homo Sapiens
KLIPLLLQL

SEQ ID NO: 1973 - protein, 9 aa, Homo Sapiens
KLIPQLPTL

SEQ ID NO: 1974 - protein, 9 aa, Homo Sapiens
KLIQESPTV

SEQ ID NO: 1975 - protein, 9 aa, Homo Sapiens
KLIQNVFEI

SEQ ID NO: 1976 - protein, 9 aa, Homo Sapiens
KLISELQKL

SEQ ID NO: 1977 - protein, 9 aa, Homo Sapiens
KLLAVIHEL

SEQ ID NO: 1978 - protein, 9 aa, Homo Sapiens
KLLDIRSYL

SEQ ID NO: 1979 - protein, 9 aa, Homo Sapiens
KLLDLQVRV

SEQ ID NO: 1980 - protein, 9 aa, Homo Sapiens
KLLDQMPSL

SEQ ID NO: 1981 - protein, 9 aa, Homo Sapiens
KLLDVVHPA

SEQ ID NO: 1982 - protein, 9 aa, Homo Sapiens
KLLEAEQSL

SEQ ID NO: 1983 - protein, 9 aa, Homo Sapiens
KLLEPVLLL

SEQ ID NO: 1984 - protein, 9 aa, Homo Sapiens
KLLEYIEEI

SEQ ID NO: 1985 - protein, 9 aa, Homo Sapiens
KLLFWVTEV

SEQ ID NO: 1986 - protein, 9 aa, Homo Sapiens
KLLGELHTL

SEQ ID NO: 1987 - protein, 9 aa, Homo Sapiens
KLLPETVTI

SEQ ID NO: 1988 - protein, 9 aa, Homo Sapiens
KLLPQLTYL

SEQ ID NO: 1989 - protein, 9 aa, Homo Sapiens
KLLPSVTEL

SEQ ID NO: 1990 - protein, 9 aa, Homo Sapiens
KLLQFYPSL

SEQ ID NO: 1991 - protein, 9 aa, Homo Sapiens
KLLSKFYEL

SEQ ID NO: 1992 - protein, 9 aa, Homo Sapiens
KLLTEVHAA

SEQ ID NO: 1993 - protein, 9 aa, Homo Sapiens
KLMAPDISL

SEQ ID NO: 1994 - protein, 9 aa, Homo Sapiens
KLMDEVAGI

SEQ ID NO: 1995 - protein, 9 aa, Homo Sapiens
KLMDQLEAL

SEQ ID NO: 1996 - protein, 9 aa, Homo Sapiens
KLMELLEEI

SEQ ID NO: 1997 - protein, 9 aa, Homo Sapiens
KLMELYERL

SEQ ID NO: 1998 - protein, 9 aa, Homo Sapiens
KLMTALVNV

SEQ ID NO: 1999 - protein, 9 aa, Homo Sapiens
KLNATNIEL

SEQ ID NO: 2000 - protein, 9 aa, Homo Sapiens
KLNPGIAYV

SEQ ID NO: 2001 - protein, 9 aa, Homo Sapiens
KLNPQQFEV

SEQ ID NO: 2002 - protein, 9 aa, Homo Sapiens
KLPEKWESV

SEQ ID NO: 2003 - protein, 9 aa, Homo Sapiens
KLQDGLLHI

SEQ ID NO: 2004 - protein, 9 aa, Homo Sapiens
KLQDQIFNL

SEQ ID NO: 2005 - protein, 9 aa, Homo Sapiens
KLQEFLQTL

SEQ ID NO: 2006 - protein, 9 aa, Homo Sapiens
KLQELNYNL

SEQ ID NO: 2007 - protein, 9 aa, Homo Sapiens
KLQEQIFHL

SEQ ID NO: 2008 - protein, 9 aa, Homo Sapiens
KLSDLQTQL

SEQ ID NO: 2009 - protein, 9 aa, Homo Sapiens
KLSEIPLTL

SEQ ID NO: 2010 - protein, 9 aa, Homo Sapiens
KLSFIIRTV

SEQ ID NO: 2011 - protein, 9 aa, Homo Sapiens
KLTDNLVAL

SEQ ID NO: 2012 - protein, 9 aa, Homo Sapiens
KLTENLVAL

SEQ ID NO: 2013 - protein, 9 aa, Homo Sapiens
KLTVVLEAV

SEQ ID NO: 2014 - protein, 9 aa, Homo Sapiens
KLVDCIIEV

SEQ ID NO: 2015 - protein, 9 aa, Homo Sapiens
KLVELPYTV

SEQ ID NO: 2016 - protein, 9 aa, Homo Sapiens
KLVKEVIAV

SEQ ID NO: 2017 - protein, 9 aa, Homo Sapiens
KLVNILVQL

SEQ ID NO: 2018 - protein, 9 aa, Homo Sapiens
KLWADRISL

SEQ ID NO: 2019 - protein, 9 aa, Homo Sapiens
KLWDLLYKL

SEQ ID NO: 2020 - protein, 9 aa, Homo Sapiens
KLWQTPLHV

SEQ ID NO: 2021 - protein, 9 aa, Homo Sapiens
KLWSETFDV

SEQ ID NO: 2022 - protein, 9 aa, Homo Sapiens
KLWSFFIYL

SEQ ID NO: 2023 - protein, 9 aa, Homo Sapiens
KLWSRSLKL

SEQ ID NO: 2024 - protein, 9 aa, Homo Sapiens
KLYDGFQYL

SEQ ID NO: 2025 - protein, 9 aa, Homo Sapiens
KLYELYLQL

SEQ ID NO: 2026 - protein, 9 aa, Homo Sapiens
KLYGKPIRV

SEQ ID NO: 2027 - protein, 9 aa, Homo Sapiens
KMADIEYRL

SEQ ID NO: 2028 - protein, 9 aa, Homo Sapiens
KMAEMLVEL

SEQ ID NO: 2029 - protein, 9 aa, Homo Sapiens
KMAPALRKV

SEQ ID NO: 2030 - protein, 9 aa, Homo Sapiens
KMDEVLYSI

SEQ ID NO: 2031 - protein, 9 aa, Homo Sapiens
KMDPIISRV

SEQ ID NO: 2032 - protein, 9 aa, Homo Sapiens
KMLEKLPEL

SEQ ID NO: 2033 - protein, 9 aa, Homo Sapiens
KMLGLTVSL

SEQ ID NO: 2034 - protein, 9 aa, Homo Sapiens
KMMDVTVTI

SEQ ID NO: 2035 - protein, 9 aa, Homo Sapiens
KMMELFIRL

SEQ ID NO: 2036 - protein, 9 aa, Homo Sapiens
KMVSIQITL

SEQ ID NO: 2037 - protein, 9 aa, Homo Sapiens
KMWEEAISL

SEQ ID NO: 2038 - protein, 9 aa, Homo Sapiens
KQVSDLISV

SEQ ID NO: 2039 - protein, 9 aa, Homo Sapiens
KTFNLIPAV

SEQ ID NO: 2040 - protein, 9 aa, Homo Sapiens
KTLEGEFSV

SEQ ID NO: 2041 - protein, 9 aa, Homo Sapiens
KVADLVLML

SEQ ID NO: 2042 - protein, 9 aa, Homo Sapiens
KVADYIPQL

SEQ ID NO: 2043 - protein, 9 aa, Homo Sapiens
KVAPAPAVV

SEQ ID NO: 2044 - protein, 9 aa, Homo Sapiens
KVIDEIYRV

SEQ ID NO: 2045 - protein, 9 aa, Homo Sapiens
KVIDYVPGI

SEQ ID NO: 2046 - protein, 9 aa, Homo Sapiens
KVIEINPYL

SEQ ID NO: 2047 - protein, 9 aa, Homo Sapiens
KVLDFEHFL

SEQ ID NO: 2048 - protein, 9 aa, Homo Sapiens
KVLDLKINL

SEQ ID NO: 2049 - protein, 9 aa, Homo Sapiens
KVLDLRINL

SEQ ID NO: 2050 - protein, 9 aa, Homo Sapiens
KVLERVNAV

SEQ ID NO: 2051 - protein, 9 aa, Homo Sapiens
KVLETLVTV

SEQ ID NO: 2052 - protein, 9 aa, Homo Sapiens
KVLGIVVGV

SEQ ID NO: 2053 - protein, 9 aa, Homo Sapiens
KVLNKVITV

SEQ ID NO: 2054 - protein, 9 aa, Homo Sapiens
KVLSKEFHL

SEQ ID NO: 2055 - protein, 9 aa, Homo Sapiens
KVMELLVHL

SEQ ID NO: 2056 - protein, 9 aa, Homo Sapiens
KVWGNVVTV

SEQ ID NO: 2057 - protein, 9 aa, Homo Sapiens
LASVIIPTI

SEQ ID NO: 2058 - protein, 9 aa, Homo Sapiens
LDTNADKQL

SEQ ID NO: 2059 - protein, 9 aa, Homo Sapiens
LGPPPPLRV

SEQ ID NO: 2060 - protein, 9 aa, Homo Sapiens
LIAGTAVVG

SEQ ID NO: 2061 - protein, 9 aa, Homo Sapiens
LIDEQILCV

SEQ ID NO: 2062 - protein, 9 aa, Homo Sapiens
LIDPNTLQV

SEQ ID NO: 2063 - protein, 9 aa, Homo Sapiens
LIFFYIIYL

SEQ ID NO: 2064 - protein, 9 aa, Homo Sapiens
LIGEFLEKV

SEQ ID NO: 2065 - protein, 9 aa, Homo Sapiens
LIGSLIPTI

SEQ ID NO: 2066 - protein, 9 aa, Homo Sapiens
LILGKLHYV

SEQ ID NO: 2067 - protein, 9 aa, Homo Sapiens
LIQLGVLPA

SEQ ID NO: 2068 - protein, 9 aa, Homo Sapiens
LISESFLTV

SEQ ID NO: 2069 - protein, 9 aa, Homo Sapiens
LISQIVSSI

SEQ ID NO: 2070 - protein, 9 aa, Homo Sapiens
LIWPLLSTV

SEQ ID NO: 2071 - protein, 9 aa, Homo Sapiens
LIYSGKLLL

SEQ ID NO: 2072 - protein, 9 aa, Homo Sapiens
LLADELITV

SEQ ID NO: 2073 - protein, 9 aa, Homo Sapiens
LLADLLHNV

SEQ ID NO: 2074 - protein, 9 aa, Homo Sapiens
LLADVETFV

SEQ ID NO: 2075 - protein, 9 aa, Homo Sapiens
LLAEAKYYL

SEQ ID NO: 2076 - protein, 9 aa, Homo Sapiens
LLAEKIYKI

SEQ ID NO: 2077 - protein, 9 aa, Homo Sapiens
LLAEKVEEI

SEQ ID NO: 2078 - protein, 9 aa, Homo Sapiens
LLAEKVEQL

SEQ ID NO: 2079 - protein, 9 aa, Homo Sapiens
LLAELLTHL

SEQ ID NO: 2080 - protein, 9 aa, Homo Sapiens
LLAELPASV

SEQ ID NO: 2081 - protein, 9 aa, Homo Sapiens
LLAEPVPGI

SEQ ID NO: 2082 - protein, 9 aa, Homo Sapiens
LLAEQGYEV

SEQ ID NO: 2083 - protein, 9 aa, Homo Sapiens
LLAESVTEV

SEQ ID NO: 2084 - protein, 9 aa, Homo Sapiens
LLAETHYQL

SEQ ID NO: 2085 - protein, 9 aa, Homo Sapiens
LLAEVIENL

SEQ ID NO: 2086 - protein, 9 aa, Homo Sapiens
LLAGLHVLL

SEQ ID NO: 2087 - protein, 9 aa, Homo Sapiens
LLAHVTLEL

SEQ ID NO: 2088 - protein, 9 aa, Homo Sapiens
LLANKVPAA

SEQ ID NO: 2089 - protein, 9 aa, Homo Sapiens
LLAPIRVLL

SEQ ID NO: 2090 - protein, 9 aa, Homo Sapiens
LLAPIVFVL

SEQ ID NO: 2091 - protein, 9 aa, Homo Sapiens
LLAPKLNEA

SEQ ID NO: 2092 - protein, 9 aa, Homo Sapiens
LLASEVPQL

SEQ ID NO: 2093 - protein, 9 aa, Homo Sapiens
LLATEVVTV

SEQ ID NO: 2094 - protein, 9 aa, Homo Sapiens
LLATVLQAV

SEQ ID NO: 2095 - protein, 9 aa, Homo Sapiens
LLDATQHTL

SEQ ID NO: 2096 - protein, 9 aa, Homo Sapiens
LLDDSLVSI

SEQ ID NO: 2097 - protein, 9 aa, Homo Sapiens
LLDDTTVTL

SEQ ID NO: 2098 - protein, 9 aa, Homo Sapiens
LLDGCRIYL

SEQ ID NO: 2099 - protein, 9 aa, Homo Sapiens
LLDHAPPEI

SEQ ID NO: 2100 - protein, 9 aa, Homo Sapiens
LLDHVLLTL

SEQ ID NO: 2101 - protein, 9 aa, Homo Sapiens
LLDIIKSTV

SEQ ID NO: 2102 - protein, 9 aa, Homo Sapiens
LLDLHSYLL

SEQ ID NO: 2103 - protein, 9 aa, Homo Sapiens
LLDNTDIHL

SEQ ID NO: 2104 - protein, 9 aa, Homo Sapiens
LLDPSVFHV

SEQ ID NO: 2105 - protein, 9 aa, Homo Sapiens
LLDRFLATV

SEQ ID NO: 2106 - protein, 9 aa, Homo Sapiens
LLDSAPLNV

SEQ ID NO: 2107 - protein, 9 aa, Homo Sapiens
LLDSAVYYL

SEQ ID NO: 2108 - protein, 9 aa, Homo Sapiens
LLDTVLVNL

SEQ ID NO: 2109 - protein, 9 aa, Homo Sapiens
LLDTVTMQV

SEQ ID NO: 2110 - protein, 9 aa, Homo Sapiens
LLDVPTAAV

SEQ ID NO: 2111 - protein, 9 aa, Homo Sapiens
LLDVTPLSL

SEQ ID NO: 2112 - protein, 9 aa, Homo Sapiens
LLDVVHPAA

SEQ ID NO: 2113 - protein, 9 aa, Homo Sapiens
LLEGSEIYL

SEQ ID NO: 2114 - protein, 9 aa, Homo Sapiens
LLEPFVHQV

SEQ ID NO: 2115 - protein, 9 aa, Homo Sapiens
LLFDEYHKL

SEQ ID NO: 2116 - protein, 9 aa, Homo Sapiens
LLFDQAYQM

SEQ ID NO: 2117 - protein, 9 aa, Homo Sapiens
LLFDRPMHV

SEQ ID NO: 2118 - protein, 9 aa, Homo Sapiens
LLFDSVIHL

SEQ ID NO: 2119 - protein, 9 aa, Homo Sapiens
LLFEGIARI

SEQ ID NO: 2120 - protein, 9 aa, Homo Sapiens
LLFPGKVTV

SEQ ID NO: 2121 - protein, 9 aa, Homo Sapiens
LLFTWEELI

SEQ ID NO: 2122 - protein, 9 aa, Homo Sapiens
LLGGDVVSV

SEQ ID NO: 2123 - protein, 9 aa, Homo Sapiens
LLGPKPFPL

SEQ ID NO: 2124 - protein, 9 aa, Homo Sapiens
LLGPPPVGV

SEQ ID NO: 2125 - protein, 9 aa, Homo Sapiens
LLGPRLVLA

SEQ ID NO: 2126 - protein, 9 aa, Homo Sapiens
LLHDGIPVV

SEQ ID NO: 2127 - protein, 9 aa, Homo Sapiens
LLHSFVDSV

SEQ ID NO: 2128 - protein, 9 aa, Homo Sapiens
LLIDHRFLL

SEQ ID NO: 2129 - protein, 9 aa, Homo Sapiens
LLIERILLL

SEQ ID NO: 2130 - protein, 9 aa, Homo Sapiens
LLIGATMQV

SEQ ID NO: 2131 - protein, 9 aa, Homo Sapiens
LLIGHLERV

SEQ ID NO: 2132 - protein, 9 aa, Homo Sapiens
LLIGLLKSL

SEQ ID NO: 2133 - protein, 9 aa, Homo Sapiens
LLIGTDVSL

SEQ ID NO: 2134 - protein, 9 aa, Homo Sapiens
LLIKQVVEV

SEQ ID NO: 2135 - protein, 9 aa, Homo Sapiens
LLIPFTIFM

SEQ ID NO: 2136 - protein, 9 aa, Homo Sapiens
LLIPGLATA

SEQ ID NO: 2137 - protein, 9 aa, Homo Sapiens
LLIPIHLEV

SEQ ID NO: 2138 - protein, 9 aa, Homo Sapiens
LLITGTLHQ

SEQ ID NO: 2139 - protein, 9 aa, Homo Sapiens
LLLAAPAQA

SEQ ID NO: 2140 - protein, 9 aa, Homo Sapiens
LLLAATPGL

SEQ ID NO: 2141 - protein, 9 aa, Homo Sapiens
LLLAHIIAL

SEQ ID NO: 2142 - protein, 9 aa, Homo Sapiens
LLLDAKLLV

SEQ ID NO: 2143 - protein, 9 aa, Homo Sapiens
LLLDIMPGL

SEQ ID NO: 2144 - protein, 9 aa, Homo Sapiens
LLLDKPETV

SEQ ID NO: 2145 - protein, 9 aa, Homo Sapiens
LLLDMQNRL

SEQ ID NO: 2146 - protein, 9 aa, Homo Sapiens
LLLDRIASV

SEQ ID NO: 2147 - protein, 9 aa, Homo Sapiens
LLLDVPTAA

SEQ ID NO: 2148 - protein, 9 aa, Homo Sapiens
LLLEAVWHL

SEQ ID NO: 2149 - protein, 9 aa, Homo Sapiens
LLLEILHEI

SEQ ID NO: 2150 - protein, 9 aa, Homo Sapiens
LLLGERVAL

SEQ ID NO: 2151 - protein, 9 aa, Homo Sapiens
LLLGQLVEV

SEQ ID NO: 2152 - protein, 9 aa, Homo Sapiens
LLLKGVEAV

SEQ ID NO: 2153 - protein, 9 aa, Homo Sapiens
LLLNAVLTV

SEQ ID NO: 2154 - protein, 9 aa, Homo Sapiens
LLLNELPSV

SEQ ID NO: 2155 - protein, 9 aa, Homo Sapiens
LLLPGLETV

SEQ ID NO: 2156 - protein, 9 aa, Homo Sapiens
LLLPGSHYL

SEQ ID NO: 2157 - protein, 9 aa, Homo Sapiens
LLLPILVTV

SEQ ID NO: 2158 - protein, 9 aa, Homo Sapiens
LLLSLLPAL

SEQ ID NO: 2159 - protein, 9 aa, Homo Sapiens
LLLSVLPQL

SEQ ID NO: 2160 - protein, 9 aa, Homo Sapiens
LLMATILHL

SEQ ID NO: 2161 - protein, 9 aa, Homo Sapiens
LLMDRVDEM

SEQ ID NO: 2162 - protein, 9 aa, Homo Sapiens
LLMEEFAFL

SEQ ID NO: 2163 - protein, 9 aa, Homo Sapiens
LLMEHIFKL

SEQ ID NO: 2164 - protein, 9 aa, Homo Sapiens
LLMEHIQEI

SEQ ID NO: 2165 - protein, 9 aa, Homo Sapiens
LLMVLSPRL

SEQ ID NO: 2166 - protein, 9 aa, Homo Sapiens
LLNEQELQL

SEQ ID NO: 2167 - protein, 9 aa, Homo Sapiens
LLNKSIIRV

SEQ ID NO: 2168 - protein, 9 aa, Homo Sapiens
LLNPVVEFV

SEQ ID NO: 2169 - protein, 9 aa, Homo Sapiens
LLPDEIADV

SEQ ID NO: 2170 - protein, 9 aa, Homo Sapiens
LLPDHTYSV

SEQ ID NO: 2171 - protein, 9 aa, Homo Sapiens
LLPDIVTCV

SEQ ID NO: 2172 - protein, 9 aa, Homo Sapiens
LLPEGPPAI

SEQ ID NO: 2173 - protein, 9 aa, Homo Sapiens
LLPIKTVGV

SEQ ID NO: 2174 - protein, 9 aa, Homo Sapiens
LLPNAVYKV

SEQ ID NO: 2175 - protein, 9 aa, Homo Sapiens
LLPPAPPHA

SEQ ID NO: 2176 - protein, 9 aa, Homo Sapiens
LLPPPPCPA

SEQ ID NO: 2177 - protein, 9 aa, Homo Sapiens
LLPPVTLAA

SEQ ID NO: 2178 - protein, 9 aa, Homo Sapiens
LLPTGVFQV

SEQ ID NO: 2179 - protein, 9 aa, Homo Sapiens
LLQDHPWLL

SEQ ID NO: 2180 - protein, 9 aa, Homo Sapiens
LLQDIILQV

SEQ ID NO: 2181 - protein, 9 aa, Homo Sapiens
LLQDKQFEL

SEQ ID NO: 2182 - protein, 9 aa, Homo Sapiens
LLQDRLVSV

SEQ ID NO: 2183 - protein, 9 aa, Homo Sapiens
LLQESLAQA

SEQ ID NO: 2184 - protein, 9 aa, Homo Sapiens
LLQEVEHQL

SEQ ID NO: 2185 - protein, 9 aa, Homo Sapiens
LLQNNLPAV

SEQ ID NO: 2186 - protein, 9 aa, Homo Sapiens
LLQQELTEA

SEQ ID NO: 2187 - protein, 9 aa, Homo Sapiens
LLREKVEFL

SEQ ID NO: 2188 - protein, 9 aa, Homo Sapiens
LLSAEPVPA

SEQ ID NO: 2189 - protein, 9 aa, Homo Sapiens
LLSDTKLEL

SEQ ID NO: 2190 - protein, 9 aa, Homo Sapiens
LLSEDFVSV

SEQ ID NO: 2191 - protein, 9 aa, Homo Sapiens
LLSEHVIAI

SEQ ID NO: 2192 - protein, 9 aa, Homo Sapiens
LLSGFVPLL

SEQ ID NO: 2193 - protein, 9 aa, Homo Sapiens
LLSGQLPTI

SEQ ID NO: 2194 - protein, 9 aa, Homo Sapiens
LLSHVIVAL

SEQ ID NO: 2195 - protein, 9 aa, Homo Sapiens
LLSKVLIYL

SEQ ID NO: 2196 - protein, 9 aa, Homo Sapiens
LLSPVVPQI

SEQ ID NO: 2197 - protein, 9 aa, Homo Sapiens
LLSSIVEEL

SEQ ID NO: 2198 - protein, 9 aa, Homo Sapiens
LLSSVSIAL

SEQ ID NO: 2199 - protein, 9 aa, Homo Sapiens
LLSSVTAEL

SEQ ID NO: 2200 - protein, 9 aa, Homo Sapiens
LLTDIKVKL

SEQ ID NO: 2201 - protein, 9 aa, Homo Sapiens
LLTDILVFL

SEQ ID NO: 2202 - protein, 9 aa, Homo Sapiens
LLTEIRAVV

SEQ ID NO: 2203 - protein, 9 aa, Homo Sapiens
LLTLVPPLV

SEQ ID NO: 2204 - protein, 9 aa, Homo Sapiens
LLVDVEPKV

SEQ ID NO: 2205 - protein, 9 aa, Homo Sapiens
LLVGFVHYL

SEQ ID NO: 2206 - protein, 9 aa, Homo Sapiens
LLWDKIHKL

SEQ ID NO: 2207 - protein, 9 aa, Homo Sapiens
LLWERVEKL

SEQ ID NO: 2208 - protein, 9 aa, Homo Sapiens
LLWGDLIWL

SEQ ID NO: 2209 - protein, 9 aa, Homo Sapiens
LLWPGAALL

SEQ ID NO: 2210 - protein, 9 aa, Homo Sapiens
LLWWLQPRL

SEQ ID NO: 2211 - protein, 9 aa, Homo Sapiens
LLYDNVPGA

SEQ ID NO: 2212 - protein, 9 aa, Homo Sapiens
LLYDQPLQV

SEQ ID NO: 2213 - protein, 9 aa, Homo Sapiens
LLYEKGISL

SEQ ID NO: 2214 - protein, 9 aa, Homo Sapiens
LLYGHTVTV

SEQ ID NO: 2215 - protein, 9 aa, Homo Sapiens
LLYGKYVSV

SEQ ID NO: 2216 - protein, 9 aa, Homo Sapiens
LLYGSIPKA

SEQ ID NO: 2217 - protein, 9 aa, Homo Sapiens
LLYHYWIAV

SEQ ID NO: 2218 - protein, 9 aa, Homo Sapiens
LLYVNVIGL

SEQ ID NO: 2219 - protein, 9 aa, Homo Sapiens
LLYYGVVTL

SEQ ID NO: 2220 - protein, 9 aa, Homo Sapiens
LLYYQTNYL

SEQ ID NO: 2221 - protein, 9 aa, Homo Sapiens
LMAAEIPNI

SEQ ID NO: 2222 - protein, 9 aa, Homo Sapiens
LMNAVVQTV

SEQ ID NO: 2223 - protein, 9 aa, Homo Sapiens
LMTDVLVFL

SEQ ID NO: 2224 - protein, 9 aa, Homo Sapiens
LMVDHVTEV

SEQ ID NO: 2225 - protein, 9 aa, Homo Sapiens
LMYPYIFHV

SEQ ID NO: 2226 - protein, 9 aa, Homo Sapiens
LPINGNGKQ

SEQ ID NO: 2227 - protein, 9 aa, Homo Sapiens
LPLVVVLTI

SEQ ID NO: 2228 - protein, 9 aa, Homo Sapiens
LQFDGIHVV

SEQ ID NO: 2229 - protein, 9 aa, Homo Sapiens
LQLDKEFQL

SEQ ID NO: 2230 - protein, 9 aa, Homo Sapiens
LQWDKVLRL

SEQ ID NO: 2231 - protein, 9 aa, Homo Sapiens
LSEVLELVL

SEQ ID NO: 2232 - protein, 9 aa, Homo Sapiens
LSLDALLTV

SEQ ID NO: 2233 - protein, 9 aa, Homo Sapiens
LSLENLEKI

SEQ ID NO: 2234 - protein, 9 aa, Homo Sapiens
LTFPVRDGV

SEQ ID NO: 2235 - protein, 9 aa, Homo Sapiens
LTRQLVHIF

SEQ ID NO: 2236 - protein, 9 aa, Homo Sapiens
LVLPVLVFL

SEQ ID NO: 2237 - protein, 9 aa, Homo Sapiens
MIRKEELEI

SEQ ID NO: 2238 - protein, 9 aa, Homo Sapiens
MITDVVPEV

SEQ ID NO: 2239 - protein, 9 aa, Homo Sapiens
MIWKGLIVL

SEQ ID NO: 2240 - protein, 9 aa, Homo Sapiens
MLADIPVTI

SEQ ID NO: 2241 - protein, 9 aa, Homo Sapiens
MLAEKLPNL

SEQ ID NO: 2242 - protein, 9 aa, Homo Sapiens
MLAGFITTL

SEQ ID NO: 2243 - protein, 9 aa, Homo Sapiens
MLANDIARL

SEQ ID NO: 2244 - protein, 9 aa, Homo Sapiens
MLATRVFSL

SEQ ID NO: 2245 - protein, 9 aa, Homo Sapiens
MLAWINESL

SEQ ID NO: 2246 - protein, 9 aa, Homo Sapiens
MLDEILLQL

SEQ ID NO: 2247 - protein, 9 aa, Homo Sapiens
MLDMSVPAV

SEQ ID NO: 2248 - protein, 9 aa, Homo Sapiens
MLDSLRIYL

SEQ ID NO: 2249 - protein, 9 aa, Homo Sapiens
MLFGHPLLV

SEQ ID NO: 2250 - protein, 9 aa, Homo Sapiens
MLFPGSIAL

SEQ ID NO: 2251 - protein, 9 aa, Homo Sapiens
MLHSVTLFL

SEQ ID NO: 2252 - protein, 9 aa, Homo Sapiens
MLIGEIFEL

SEQ ID NO: 2253 - protein, 9 aa, Homo Sapiens
MLLATLLLL

SEQ ID NO: 2254 - protein, 9 aa, Homo Sapiens
MLLDFIQHI

SEQ ID NO: 2255 - protein, 9 aa, Homo Sapiens
MLLSSLVSL

SEQ ID NO: 2256 - protein, 9 aa, Homo Sapiens
MLLSVPLLL

SEQ ID NO: 2257 - protein, 9 aa, Homo Sapiens
MLLTKLPTI

SEQ ID NO: 2258 - protein, 9 aa, Homo Sapiens
MLNEHDFEV

SEQ ID NO: 2259 - protein, 9 aa, Homo Sapiens
MLPPPPLTA

SEQ ID NO: 2260 - protein, 9 aa, Homo Sapiens
MLQDSIHVV

SEQ ID NO: 2261 - protein, 9 aa, Homo Sapiens
MLSPFISSV

SEQ ID NO: 2262 - protein, 9 aa, Homo Sapiens
MLTGISPFL

SEQ ID NO: 2263 - protein, 9 aa, Homo Sapiens
MLYDIVPVV

SEQ ID NO: 2264 - protein, 9 aa, Homo Sapiens
MLYEKLLTA

SEQ ID NO: 2265 - protein, 9 aa, Homo Sapiens
MMLDDLLQL

SEQ ID NO: 2266 - protein, 9 aa, Homo Sapiens
MMMALLVPL

SEQ ID NO: 2267 - protein, 9 aa, Homo Sapiens
MTLGQIYYL

SEQ ID NO: 2268 - protein, 9 aa, Homo Sapiens
MVDGTLLLL

SEQ ID NO: 2269 - protein, 9 aa, Homo Sapiens
MVIALILFL

SEQ ID NO: 2270 - protein, 9 aa, Homo Sapiens
MVLPLLIFV

SEQ ID NO: 2271 - protein, 9 aa, Homo Sapiens
NIFPYPVGV

SEQ ID NO: 2272 - protein, 9 aa, Homo Sapiens
NIIELVHQV

SEQ ID NO: 2273 - protein, 9 aa, Homo Sapiens
NILDFVVVV

SEQ ID NO: 2274 - protein, 9 aa, Homo Sapiens
NIMDFKLFL

SEQ ID NO: 2275 - protein, 9 aa, Homo Sapiens
NIMDIKIGL

SEQ ID NO: 2276 - protein, 9 aa, Homo Sapiens
NIPLLPMEQ

SEQ ID NO: 2277 - protein, 9 aa, Homo Sapiens
NIVEKLREV

SEQ ID NO: 2278 - protein, 9 aa, Homo Sapiens
NIWNINLQL

SEQ ID NO: 2279 - protein, 9 aa, Homo Sapiens
NLAEKLIGV

SEQ ID NO: 2280 - protein, 9 aa, Homo Sapiens
NLAENISRV

SEQ ID NO: 2281 - protein, 9 aa, Homo Sapiens
NLAEVVERV

SEQ ID NO: 2282 - protein, 9 aa, Homo Sapiens
NLANVVLLL

SEQ ID NO: 2283 - protein, 9 aa, Homo Sapiens
NLASFIEQV

SEQ ID NO: 2284 - protein, 9 aa, Homo Sapiens
NLDFNPPHV

SEQ ID NO: 2285 - protein, 9 aa, Homo Sapiens
NLDNPIQTV

SEQ ID NO: 2286 - protein, 9 aa, Homo Sapiens
NLDPAVHEV

SEQ ID NO: 2287 - protein, 9 aa, Homo Sapiens
NLFAQTYGL

SEQ ID NO: 2288 - protein, 9 aa, Homo Sapiens
NLFEWHFTV

SEQ ID NO: 2289 - protein, 9 aa, Homo Sapiens
NLFHYLTEV

SEQ ID NO: 2290 - protein, 9 aa, Homo Sapiens
NLFKLEVRL

SEQ ID NO: 2291 - protein, 9 aa, Homo Sapiens
NLFNKYPAL

SEQ ID NO: 2292 - protein, 9 aa, Homo Sapiens
NLFNRYPAL

SEQ ID NO: 2293 - protein, 9 aa, Homo Sapiens
NLFSREFRA

SEQ ID NO: 2294 - protein, 9 aa, Homo Sapiens
NLGDFLIFL

SEQ ID NO: 2295 - protein, 9 aa, Homo Sapiens
NLIANVLYL

SEQ ID NO: 2296 - protein, 9 aa, Homo Sapiens
NLIEVNEEV

SEQ ID NO: 2297 - protein, 9 aa, Homo Sapiens
NLISALEEA

SEQ ID NO: 2298 - protein, 9 aa, Homo Sapiens
NLLDLLTEV

SEQ ID NO: 2299 - protein, 9 aa, Homo Sapiens
NLLDPPPEV

SEQ ID NO: 2300 - protein, 9 aa, Homo Sapiens
NLLEALLEL

SEQ ID NO: 2301 - protein, 9 aa, Homo Sapiens
NLLEEVFHL

SEQ ID NO: 2302 - protein, 9 aa, Homo Sapiens
NLLEIAPHL

SEQ ID NO: 2303 - protein, 9 aa, Homo Sapiens
NLLELFVQL

SEQ ID NO: 2304 - protein, 9 aa, Homo Sapiens
NLLEQFILL

SEQ ID NO: 2305 - protein, 9 aa, Homo Sapiens
NLLGMIFSM

SEQ ID NO: 2306 - protein, 9 aa, Homo Sapiens
NLLKLIAEV

SEQ ID NO: 2307 - protein, 9 aa, Homo Sapiens
NLLPKLHIV

SEQ ID NO: 2308 - protein, 9 aa, Homo Sapiens
NLLRRLWVV

SEQ ID NO: 2309 - protein, 9 aa, Homo Sapiens
NLLTHIENV

SEQ ID NO: 2310 - protein, 9 aa, Homo Sapiens
NLMELLIMI

SEQ ID NO: 2311 - protein, 9 aa, Homo Sapiens
NLMEMVAQL

SEQ ID NO: 2312 - protein, 9 aa, Homo Sapiens
NLNSIVPSV

SEQ ID NO: 2313 - protein, 9 aa, Homo Sapiens
NLQVTQPTV

SEQ ID NO: 2314 - protein, 9 aa, Homo Sapiens
NLVAIPVYV

SEQ ID NO: 2315 - protein, 9 aa, Homo Sapiens
NLVEKTPAL

SEQ ID NO: 2316 - protein, 9 aa, Homo Sapiens
NLVPMIIHL

SEQ ID NO: 2317 - protein, 9 aa, Homo Sapiens
NLVRELLAV

SEQ ID NO: 2318 - protein, 9 aa, Homo Sapiens
NLWSLVAKV

SEQ ID NO: 2319 - protein, 9 aa, Homo Sapiens
NLYPFVKTV

SEQ ID NO: 2320 - protein, 9 aa, Homo Sapiens
NMLEAVHTI

SEQ ID NO: 2321 - protein, 9 aa, Homo Sapiens
NMLNLAVHL

SEQ ID NO: 2322 - protein, 9 aa, Homo Sapiens
NMLPQIFRV

SEQ ID NO: 2323 - protein, 9 aa, Homo Sapiens
NMVAKVDEV

SEQ ID NO: 2324 - protein, 9 aa, Homo Sapiens
NMVDIIHSV

SEQ ID NO: 2325 - protein, 9 aa, Homo Sapiens
NMYGKVVTV

SEQ ID NO: 2326 - protein, 9 aa, Homo Sapiens
NQFPGFKEV

SEQ ID NO: 2327 - protein, 9 aa, Homo Sapiens
NQIDFIICL

SEQ ID NO: 2328 - protein, 9 aa, Homo Sapiens
PLGPAPVSV

SEQ ID NO: 2329 - protein, 9 aa, Homo Sapiens
PLLDLHIEL

SEQ ID NO: 2330 - protein, 9 aa, Homo Sapiens
PRFIKIIEV

SEQ ID NO: 2331 - protein, 9 aa, Homo Sapiens
QEQNQEQPI

SEQ ID NO: 2332 - protein, 9 aa, Homo Sapiens
QILEAIPQV

SEQ ID NO: 2333 - protein, 9 aa, Homo Sapiens
QIMDYLLCL

SEQ ID NO: 2334 - protein, 9 aa, Homo Sapiens
QLDDLKVEL

SEQ ID NO: 2335 - protein, 9 aa, Homo Sapiens
QLDTVNFFL

SEQ ID NO: 2336 - protein, 9 aa, Homo Sapiens
QLFEDLVYL

SEQ ID NO: 2337 - protein, 9 aa, Homo Sapiens
QLFEKQLQL

SEQ ID NO: 2338 - protein, 9 aa, Homo Sapiens
QLFQGVLTL

SEQ ID NO: 2339 - protein, 9 aa, Homo Sapiens
QLFYTKIFL

SEQ ID NO: 2340 - protein, 9 aa, Homo Sapiens
QLGDFLIKV

SEQ ID NO: 2341 - protein, 9 aa, Homo Sapiens
QLIDIIHTA

SEQ ID NO: 2342 - protein, 9 aa, Homo Sapiens
QLIDKVWQL

SEQ ID NO: 2343 - protein, 9 aa, Homo Sapiens
QLIDYERQL

SEQ ID NO: 2344 - protein, 9 aa, Homo Sapiens
QLINLSILL

SEQ ID NO: 2345 - protein, 9 aa, Homo Sapiens
QLIPKLIFL

SEQ ID NO: 2346 - protein, 9 aa, Homo Sapiens
QLLAILPEA

SEQ ID NO: 2347 - protein, 9 aa, Homo Sapiens
QLLDLMHTL

SEQ ID NO: 2348 - protein, 9 aa, Homo Sapiens
QLLDQVEQI

SEQ ID NO: 2349 - protein, 9 aa, Homo Sapiens
QLLEKVIEL

SEQ ID NO: 2350 - protein, 9 aa, Homo Sapiens
QLLEKVPTL

SEQ ID NO: 2351 - protein, 9 aa, Homo Sapiens
QLLGGVRAV

SEQ ID NO: 2352 - protein, 9 aa, Homo Sapiens
QLLGLIQRV

SEQ ID NO: 2353 - protein, 9 aa, Homo Sapiens
QLLPLIVNL

SEQ ID NO: 2354 - protein, 9 aa, Homo Sapiens
QLLPNLRAV

SEQ ID NO: 2355 - protein, 9 aa, Homo Sapiens
QLLPNVTTV

SEQ ID NO: 2356 - protein, 9 aa, Homo Sapiens
QLLQHVQAV

SEQ ID NO: 2357 - protein, 9 aa, Homo Sapiens
QLLTAIVKL

SEQ ID NO: 2358 - protein, 9 aa, Homo Sapiens
QLMEQVAQL

SEQ ID NO: 2359 - protein, 9 aa, Homo Sapiens
QLMPLPVKV

SEQ ID NO: 2360 - protein, 9 aa, Homo Sapiens
QLMQQMIQL

SEQ ID NO: 2361 - protein, 9 aa, Homo Sapiens
QLNDVAHLV

SEQ ID NO: 2362 - protein, 9 aa, Homo Sapiens
QLNEKVAQL

SEQ ID NO: 2363 - protein, 9 aa, Homo Sapiens
QLPNFAFSV

SEQ ID NO: 2364 - protein, 9 aa, Homo Sapiens
QLQDFDWQV

SEQ ID NO: 2365 - protein, 9 aa, Homo Sapiens
QLSDVAEKL

SEQ ID NO: 2366 - protein, 9 aa, Homo Sapiens
QLSEVFIQL

SEQ ID NO: 2367 - protein, 9 aa, Homo Sapiens
QLSPVLLYL

SEQ ID NO: 2368 - protein, 9 aa, Homo Sapiens
QLSQIVPKV

SEQ ID NO: 2369 - protein, 9 aa, Homo Sapiens
QLSTVITQV

SEQ ID NO: 2370 - protein, 9 aa, Homo Sapiens
QLTDLNVQL

SEQ ID NO: 2371 - protein, 9 aa, Homo Sapiens
QLTEMLPSI

SEQ ID NO: 2372 - protein, 9 aa, Homo Sapiens
QLTNVILHL

SEQ ID NO: 2373 - protein, 9 aa, Homo Sapiens
QLVDFQWKL

SEQ ID NO: 2374 - protein, 9 aa, Homo Sapiens
QLVDIIEKV

SEQ ID NO: 2375 - protein, 9 aa, Homo Sapiens
QLVDTTVEL

SEQ ID NO: 2376 - protein, 9 aa, Homo Sapiens
QLVEQVEQI

SEQ ID NO: 2377 - protein, 9 aa, Homo Sapiens
QLVPALAKV

SEQ ID NO: 2378 - protein, 9 aa, Homo Sapiens
QLVQRVASV

SEQ ID NO: 2379 - protein, 9 aa, Homo Sapiens
QLVRDLLEV

SEQ ID NO: 2380 - protein, 9 aa, Homo Sapiens
QLWFREFFL

SEQ ID NO: 2381 - protein, 9 aa, Homo Sapiens
QLWHFILEL

SEQ ID NO: 2382 - protein, 9 aa, Homo Sapiens
QLWNNYFHL

SEQ ID NO: 2383 - protein, 9 aa, Homo Sapiens
QLYLKLWNL

SEQ ID NO: 2384 - protein, 9 aa, Homo Sapiens
QLYNQIIKL

SEQ ID NO: 2385 - protein, 9 aa, Homo Sapiens
QLYNSLIFL

SEQ ID NO: 2386 - protein, 9 aa, Homo Sapiens
QLYQLFHYL

SEQ ID NO: 2387 - protein, 9 aa, Homo Sapiens
QLYSVDVTL

SEQ ID NO: 2388 - protein, 9 aa, Homo Sapiens
QMFQYFITV

SEQ ID NO: 2389 - protein, 9 aa, Homo Sapiens
QMISRIEYI

SEQ ID NO: 2390 - protein, 9 aa, Homo Sapiens
QMISRIEYV

SEQ ID NO: 2391 - protein, 9 aa, Homo Sapiens
QMLELITRL

SEQ ID NO: 2392 - protein, 9 aa, Homo Sapiens
QQIGKVVQV

SEQ ID NO: 2393 - protein, 9 aa, Homo Sapiens
QVIPVLPQV

SEQ ID NO: 2394 - protein, 9 aa, Homo Sapiens
RDLLLWLLL

SEQ ID NO: 2395 - protein, 9 aa, Homo Sapiens
RIADLSYTV

SEQ ID NO: 2396 - protein, 9 aa, Homo Sapiens
RIIDTVAQV

SEQ ID NO: 2397 - protein, 9 aa, Homo Sapiens
RIIDVVYNA

SEQ ID NO: 2398 - protein, 9 aa, Homo Sapiens
RILDILEYI

SEQ ID NO: 2399 - protein, 9 aa, Homo Sapiens
RILDYVINL

SEQ ID NO: 2400 - protein, 9 aa, Homo Sapiens
RIMNLTVML

SEQ ID NO: 2401 - protein, 9 aa, Homo Sapiens
RISDVHFSV

SEQ ID NO: 2402 - protein, 9 aa, Homo Sapiens
RISTINILL

SEQ ID NO: 2403 - protein, 9 aa, Homo Sapiens
RIYKYIHKV

SEQ ID NO: 2404 - protein, 9 aa, Homo Sapiens
RLAELLVSV

SEQ ID NO: 2405 - protein, 9 aa, Homo Sapiens
RLAHYIDRV

SEQ ID NO: 2406 - protein, 9 aa, Homo Sapiens
RLAQHITYV

SEQ ID NO: 2407 - protein, 9 aa, Homo Sapiens
RLAVYIDKV

SEQ ID NO: 2408 - protein, 9 aa, Homo Sapiens
RLAVYIDRV

SEQ ID NO: 2409 - protein, 9 aa, Homo Sapiens
RLDDSLLYL

SEQ ID NO: 2410 - protein, 9 aa, Homo Sapiens
RLDETIQAI

SEQ ID NO: 2411 - protein, 9 aa, Homo Sapiens
RLFDDVPQV

SEQ ID NO: 2412 - protein, 9 aa, Homo Sapiens
RLFDEPQLA

SEQ ID NO: 2413 - protein, 9 aa, Homo Sapiens
RLFDWLVSV

SEQ ID NO: 2414 - protein, 9 aa, Homo Sapiens
RLFEGNALL

SEQ ID NO: 2415 - protein, 9 aa, Homo Sapiens
RLFENYIEL

SEQ ID NO: 2416 - protein, 9 aa, Homo Sapiens
RLFESSQYL

SEQ ID NO: 2417 - protein, 9 aa, Homo Sapiens
RLFEVPHEL

SEQ ID NO: 2418 - protein, 9 aa, Homo Sapiens
RLGDAILSV

SEQ ID NO: 2419 - protein, 9 aa, Homo Sapiens
RLGPVPPGL

SEQ ID NO: 2420 - protein, 9 aa, Homo Sapiens
RLHDVLMEL

SEQ ID NO: 2421 - protein, 9 aa, Homo Sapiens
RLIALSFGL

SEQ ID NO: 2422 - protein, 9 aa, Homo Sapiens
RLIAQRYLL

SEQ ID NO: 2423 - protein, 9 aa, Homo Sapiens
RLIEESVTV

SEQ ID NO: 2424 - protein, 9 aa, Homo Sapiens
RLIESLFTI

SEQ ID NO: 2425 - protein, 9 aa, Homo Sapiens
RLINQVLEL

SEQ ID NO: 2426 - protein, 9 aa, Homo Sapiens
RLIPTLVSI

SEQ ID NO: 2427 - protein, 9 aa, Homo Sapiens
RLLAQVPGL

SEQ ID NO: 2428 - protein, 9 aa, Homo Sapiens
RLLATIVML

SEQ ID NO: 2429 - protein, 9 aa, Homo Sapiens
RLLDGAFKL

SEQ ID NO: 2430 - protein, 9 aa, Homo Sapiens
RLLDKWVEL

SEQ ID NO: 2431 - protein, 9 aa, Homo Sapiens
RLLDRKVLL

SEQ ID NO: 2432 - protein, 9 aa, Homo Sapiens
RLLDYVATV

SEQ ID NO: 2433 - protein, 9 aa, Homo Sapiens
RLLDYVVNI

SEQ ID NO: 2434 - protein, 9 aa, Homo Sapiens
RLLEGVNQL

SEQ ID NO: 2435 - protein, 9 aa, Homo Sapiens
RLLEIDPYL

SEQ ID NO: 2436 - protein, 9 aa, Homo Sapiens
RLLELETRL

SEQ ID NO: 2437 - protein, 9 aa, Homo Sapiens
RLLENMTEV

SEQ ID NO: 2438 - protein, 9 aa, Homo Sapiens
RLLEQKVEL

SEQ ID NO: 2439 - protein, 9 aa, Homo Sapiens
RLLEQLQEI

SEQ ID NO: 2440 - protein, 9 aa, Homo Sapiens
RLLEVPVML

SEQ ID NO: 2441 - protein, 9 aa, Homo Sapiens
RLLGYVATL

SEQ ID NO: 2442 - protein, 9 aa, Homo Sapiens
RLLKSKLYL

SEQ ID NO: 2443 - protein, 9 aa, Homo Sapiens
RLLNFDTEL

SEQ ID NO: 2444 - protein, 9 aa, Homo Sapiens
RLLNFQRQL

SEQ ID NO: 2445 - protein, 9 aa, Homo Sapiens
RLLPALASV

SEQ ID NO: 2446 - protein, 9 aa, Homo Sapiens
RLLPQVDSV

SEQ ID NO: 2447 - protein, 9 aa, Homo Sapiens
RLLQAVALV

SEQ ID NO: 2448 - protein, 9 aa, Homo Sapiens
RLLQTLPQL

SEQ ID NO: 2449 - protein, 9 aa, Homo Sapiens
RLLYQLVFL

SEQ ID NO: 2450 - protein, 9 aa, Homo Sapiens
RLMEPIYLV

SEQ ID NO: 2451 - protein, 9 aa, Homo Sapiens
RLNEAAVTV

SEQ ID NO: 2452 - protein, 9 aa, Homo Sapiens
RLPDLIIFL

SEQ ID NO: 2453 - protein, 9 aa, Homo Sapiens
RLPEAIEEV

SEQ ID NO: 2454 - protein, 9 aa, Homo Sapiens
RLPEIYIQL

SEQ ID NO: 2455 - protein, 9 aa, Homo Sapiens
RLPPPFPGL

SEQ ID NO: 2456 - protein, 9 aa, Homo Sapiens
RLQDAIAKV

SEQ ID NO: 2457 - protein, 9 aa, Homo Sapiens
RLQEEINEV

SEQ ID NO: 2458 - protein, 9 aa, Homo Sapiens
RLQEFIDEV

SEQ ID NO: 2459 - protein, 9 aa, Homo Sapiens
RLSDAQIYV

SEQ ID NO: 2460 - protein, 9 aa, Homo Sapiens
RLSDVQIYV

SEQ ID NO: 2461 - protein, 9 aa, Homo Sapiens
RLSEVQASL

SEQ ID NO: 2462 - protein, 9 aa, Homo Sapiens
RLSPVSPAL

SEQ ID NO: 2463 - protein, 9 aa, Homo Sapiens
RLSSVNAEV

SEQ ID NO: 2464 - protein, 9 aa, Homo Sapiens
RLTDFLDCV

SEQ ID NO: 2465 - protein, 9 aa, Homo Sapiens
RLTDYISKV

SEQ ID NO: 2466 - protein, 9 aa, Homo Sapiens
RLTDYVAFL

SEQ ID NO: 2467 - protein, 9 aa, Homo Sapiens
RLTPKLMEV

SEQ ID NO: 2468 - protein, 9 aa, Homo Sapiens
RLVDLDWRV

SEQ ID NO: 2469 - protein, 9 aa, Homo Sapiens
RLVEIQYEL

SEQ ID NO: 2470 - protein, 9 aa, Homo Sapiens
RLVPFLVEL

SEQ ID NO: 2471 - protein, 9 aa, Homo Sapiens
RLVPFLVFV

SEQ ID NO: 2472 - protein, 9 aa, Homo Sapiens
RLWEGAISI

SEQ ID NO: 2473 - protein, 9 aa, Homo Sapiens
RLWEKLTLL

SEQ ID NO: 2474 - protein, 9 aa, Homo Sapiens
RLWEYLLEL

SEQ ID NO: 2475 - protein, 9 aa, Homo Sapiens
RLWGEPVNL

SEQ ID NO: 2476 - protein, 9 aa, Homo Sapiens
RLWNETVEL

SEQ ID NO: 2477 - protein, 9 aa, Homo Sapiens
RLYHELVGL

SEQ ID NO: 2478 - protein, 9 aa, Homo Sapiens
RLYHITDQV

SEQ ID NO: 2479 - protein, 9 aa, Homo Sapiens
RMDELFVLI

SEQ ID NO: 2480 - protein, 9 aa, Homo Sapiens
RMFDGKFVV

SEQ ID NO: 2481 - protein, 9 aa, Homo Sapiens
RMFPGEVAL

SEQ ID NO: 2482 - protein, 9 aa, Homo Sapiens
RMLPHAPGV

SEQ ID NO: 2483 - protein, 9 aa, Homo Sapiens
RMLSELPAL

SEQ ID NO: 2484 - protein, 9 aa, Homo Sapiens
RMLYMIEQV

SEQ ID NO: 2485 - protein, 9 aa, Homo Sapiens
RMVHILTSV

SEQ ID NO: 2486 - protein, 9 aa, Homo Sapiens
RQFLFHWTV

SEQ ID NO: 2487 - protein, 9 aa, Homo Sapiens
RQIEYYFSV

SEQ ID NO: 2488 - protein, 9 aa, Homo Sapiens
RTIEYLEEV

SEQ ID NO: 2489 - protein, 9 aa, Homo Sapiens
RTLDLPIYV

SEQ ID NO: 2490 - protein, 9 aa, Homo Sapiens
RVIGTLEEV

SEQ ID NO: 2491 - protein, 9 aa, Homo Sapiens
RVLDVILEV

SEQ ID NO: 2492 - protein, 9 aa, Homo Sapiens
RVLEELEGV

SEQ ID NO: 2493 - protein, 9 aa, Homo Sapiens
RVMELFFTV

SEQ ID NO: 2494 - protein, 9 aa, Homo Sapiens
SDPFTHLAP

SEQ ID NO: 2495 - protein, 9 aa, Homo Sapiens
SIAAVLPKV

SEQ ID NO: 2496 - protein, 9 aa, Homo Sapiens
SIAEVVHQL

SEQ ID NO: 2497 - protein, 9 aa, Homo Sapiens
SIHDVTFQV

SEQ ID NO: 2498 - protein, 9 aa, Homo Sapiens
SIIDWLNSV

SEQ ID NO: 2499 - protein, 9 aa, Homo Sapiens
SIIGRLLEV

SEQ ID NO: 2500 - protein, 9 aa, Homo Sapiens
SIISNLDEV

SEQ ID NO: 2501 - protein, 9 aa, Homo Sapiens
SILADRILL

SEQ ID NO: 2502 - protein, 9 aa, Homo Sapiens
SILDQVWNI

SEQ ID NO: 2503 - protein, 9 aa, Homo Sapiens
SILEDPPSI

SEQ ID NO: 2504 - protein, 9 aa, Homo Sapiens
SILEHQIQV

SEQ ID NO: 2505 - protein, 9 aa, Homo Sapiens
SILHDVVEV

SEQ ID NO: 2506 - protein, 9 aa, Homo Sapiens
SILKKVLEA

SEQ ID NO: 2507 - protein, 9 aa, Homo Sapiens
SILQTLILV

SEQ ID NO: 2508 - protein, 9 aa, Homo Sapiens
SILRHVAEV

SEQ ID NO: 2509 - protein, 9 aa, Homo Sapiens
SILSLVTKI

SEQ ID NO: 2510 - protein, 9 aa, Homo Sapiens
SIMDYVVFV

SEQ ID NO: 2511 - protein, 9 aa, Homo Sapiens
SISDVIAQV

SEQ ID NO: 2512 - protein, 9 aa, Homo Sapiens
SISPIVLYL

SEQ ID NO: 2513 - protein, 9 aa, Homo Sapiens
SIYQFLIAV

SEQ ID NO: 2514 - protein, 9 aa, Homo Sapiens
SLAADIPRL

SEQ ID NO: 2515 - protein, 9 aa, Homo Sapiens
SLAANTFTI

SEQ ID NO: 2516 - protein, 9 aa, Homo Sapiens
SLADIAQKL

SEQ ID NO: 2517 - protein, 9 aa, Homo Sapiens
SLADLYFRA

SEQ ID NO: 2518 - protein, 9 aa, Homo Sapiens
SLADVHIEV

SEQ ID NO: 2519 - protein, 9 aa, Homo Sapiens
SLADYITAA

SEQ ID NO: 2520 - protein, 9 aa, Homo Sapiens
SLAEFVQSL

SEQ ID NO: 2521 - protein, 9 aa, Homo Sapiens
SLAEGRLYL

SEQ ID NO: 2522 - protein, 9 aa, Homo Sapiens
SLAEKIQAL

SEQ ID NO: 2523 - protein, 9 aa, Homo Sapiens
SLAELIQAL

SEQ ID NO: 2524 - protein, 9 aa, Homo Sapiens
SLAELVHAV

SEQ ID NO: 2525 - protein, 9 aa, Homo Sapiens
SLAEPRVSV

SEQ ID NO: 2526 - protein, 9 aa, Homo Sapiens
SLAERVDRL

SEQ ID NO: 2527 - protein, 9 aa, Homo Sapiens
SLAEVLQQL

SEQ ID NO: 2528 - protein, 9 aa, Homo Sapiens
SLAEVNTQL

SEQ ID NO: 2529 - protein, 9 aa, Homo Sapiens
SLAGFLLSV

SEQ ID NO: 2530 - protein, 9 aa, Homo Sapiens
SLAGGIIGV

SEQ ID NO: 2531 - protein, 9 aa, Homo Sapiens
SLAPIIVHV

SEQ ID NO: 2532 - protein, 9 aa, Homo Sapiens
SLAPIIVYI

SEQ ID NO: 2533 - protein, 9 aa, Homo Sapiens
SLAPLFFKL

SEQ ID NO: 2534 - protein, 9 aa, Homo Sapiens
SLAPVLCGI

SEQ ID NO: 2535 - protein, 9 aa, Homo Sapiens
SLAQVVMKV

SEQ ID NO: 2536 - protein, 9 aa, Homo Sapiens
SLAQYLINA

SEQ ID NO: 2537 - protein, 9 aa, Homo Sapiens
SLAQYLINV

SEQ ID NO: 2538 - protein, 9 aa, Homo Sapiens
SLAQYNPKL

SEQ ID NO: 2539 - protein, 9 aa, Homo Sapiens
SLASFIPAV

SEQ ID NO: 2540 - protein, 9 aa, Homo Sapiens
SLASLLAKV

SEQ ID NO: 2541 - protein, 9 aa, Homo Sapiens
SLASLLVSV

SEQ ID NO: 2542 - protein, 9 aa, Homo Sapiens
SLASVFVRL

SEQ ID NO: 2543 - protein, 9 aa, Homo Sapiens
SLASVIFLL

SEQ ID NO: 2544 - protein, 9 aa, Homo Sapiens
SLATSLPRL

SEQ ID NO: 2545 - protein, 9 aa, Homo Sapiens
SLAVSSPRL

SEQ ID NO: 2546 - protein, 9 aa, Homo Sapiens
SLAWDVPAA

SEQ ID NO: 2547 - protein, 9 aa, Homo Sapiens
SLDAKEIYL

SEQ ID NO: 2548 - protein, 9 aa, Homo Sapiens
SLDEGIEQV

SEQ ID NO: 2549 - protein, 9 aa, Homo Sapiens
SLDGAPIGV

SEQ ID NO: 2550 - protein, 9 aa, Homo Sapiens
SLDGFTIQV

SEQ ID NO: 2551 - protein, 9 aa, Homo Sapiens
SLDPTLPSV

SEQ ID NO: 2552 - protein, 9 aa, Homo Sapiens
SLDSTLHAV

SEQ ID NO: 2553 - protein, 9 aa, Homo Sapiens
SLDWQMVFL

SEQ ID NO: 2554 - protein, 9 aa, Homo Sapiens
SLEENLPCI

SEQ ID NO: 2555 - protein, 9 aa, Homo Sapiens
SLFDARVHL

SEQ ID NO: 2556 - protein, 9 aa, Homo Sapiens
SLFDAVSSL

SEQ ID NO: 2557 - protein, 9 aa, Homo Sapiens
SLFDLNFQA

SEQ ID NO: 2558 - protein, 9 aa, Homo Sapiens
SLFEGTWYL

SEQ ID NO: 2559 - protein, 9 aa, Homo Sapiens
SLFGGSVKL

SEQ ID NO: 2560 - protein, 9 aa, Homo Sapiens
SLFGNIKGA

SEQ ID NO: 2561 - protein, 9 aa, Homo Sapiens
SLFGQEVYC

SEQ ID NO: 2562 - protein, 9 aa, Homo Sapiens
SLFKLIVKV

SEQ ID NO: 2563 - protein, 9 aa, Homo Sapiens
SLFPAELAL

SEQ ID NO: 2564 - protein, 9 aa, Homo Sapiens
SLFPGKLEV

SEQ ID NO: 2565 - protein, 9 aa, Homo Sapiens
SLFPGQVVI

SEQ ID NO: 2566 - protein, 9 aa, Homo Sapiens
SLFPHAICL

SEQ ID NO: 2567 - protein, 9 aa, Homo Sapiens
SLFRVITEV

SEQ ID NO: 2568 - protein, 9 aa, Homo Sapiens
SLFSAVHKI

SEQ ID NO: 2569 - protein, 9 aa, Homo Sapiens
SLFSGKPEV

SEQ ID NO: 2570 - protein, 9 aa, Homo Sapiens
SLFSMLHQA

SEQ ID NO: 2571 - protein, 9 aa, Homo Sapiens
SLFSSPPEI

SEQ ID NO: 2572 - protein, 9 aa, Homo Sapiens
SLFSVIVRV

SEQ ID NO: 2573 - protein, 9 aa, Homo Sapiens
SLGEFHVRL

SEQ ID NO: 2574 - protein, 9 aa, Homo Sapiens
SLGRFEITV

SEQ ID NO: 2575 - protein, 9 aa, Homo Sapiens
SLHDAIMIV

SEQ ID NO: 2576 - protein, 9 aa, Homo Sapiens
SLHFLILYV

SEQ ID NO: 2577 - protein, 9 aa, Homo Sapiens
SLHSVIIQL

SEQ ID NO: 2578 - protein, 9 aa, Homo Sapiens
SLIAGVIRV

SEQ ID NO: 2579 - protein, 9 aa, Homo Sapiens
SLIAKVATA

SEQ ID NO: 2580 - protein, 9 aa, Homo Sapiens
SLIARLERL

SEQ ID NO: 2581 - protein, 9 aa, Homo Sapiens
SLIDADPYL

SEQ ID NO: 2582 - protein, 9 aa, Homo Sapiens
SLIDFLRVV

SEQ ID NO: 2583 - protein, 9 aa, Homo Sapiens
SLIDILVAL

SEQ ID NO: 2584 - protein, 9 aa, Homo Sapiens
SLIDIVTEI

SEQ ID NO: 2585 - protein, 9 aa, Homo Sapiens
SLIDQFFGV

SEQ ID NO: 2586 - protein, 9 aa, Homo Sapiens
SLIEDLILL

SEQ ID NO: 2587 - protein, 9 aa, Homo Sapiens
SLIEHLQGL

SEQ ID NO: 2588 - protein, 9 aa, Homo Sapiens
SLIEKIPTA

SEQ ID NO: 2589 - protein, 9 aa, Homo Sapiens
SLIEKLWQT

SEQ ID NO: 2590 - protein, 9 aa, Homo Sapiens
SLIEKVTQL

SEQ ID NO: 2591 - protein, 9 aa, Homo Sapiens
SLIEKYFSV

SEQ ID NO: 2592 - protein, 9 aa, Homo Sapiens
SLIEQTTAL

SEQ ID NO: 2593 - protein, 9 aa, Homo Sapiens
SLIEVVIGL

SEQ ID NO: 2594 - protein, 9 aa, Homo Sapiens
SLIEYCIEL

SEQ ID NO: 2595 - protein, 9 aa, Homo Sapiens
SLIFKLEEL

SEQ ID NO: 2596 - protein, 9 aa, Homo Sapiens
SLIGHLQTL

SEQ ID NO: 2597 - protein, 9 aa, Homo Sapiens
SLIGNLHLA

SEQ ID NO: 2598 - protein, 9 aa, Homo Sapiens
SLIHDVINL

SEQ ID NO: 2599 - protein, 9 aa, Homo Sapiens
SLIHGLWNL

SEQ ID NO: 2600 - protein, 9 aa, Homo Sapiens
SLIKHKIML

SEQ ID NO: 2601 - protein, 9 aa, Homo Sapiens
SLIKKIKDV

SEQ ID NO: 2602 - protein, 9 aa, Homo Sapiens
SLIKQIPRI

SEQ ID NO: 2603 - protein, 9 aa, Homo Sapiens
SLIKYFLFV

SEQ ID NO: 2604 - protein, 9 aa, Homo Sapiens
SLIPIISGV

SEQ ID NO: 2605 - protein, 9 aa, Homo Sapiens
SLIPTSPQV

SEQ ID NO: 2606 - protein, 9 aa, Homo Sapiens
SLIRIVPVV

SEQ ID NO: 2607 - protein, 9 aa, Homo Sapiens
SLIRNLEQL

SEQ ID NO: 2608 - protein, 9 aa, Homo Sapiens
SLIRSVVAL

SEQ ID NO: 2609 - protein, 9 aa, Homo Sapiens
SLISINNKL

SEQ ID NO: 2610 - protein, 9 aa, Homo Sapiens
SLISVIHLI

SEQ ID NO: 2611 - protein, 9 aa, Homo Sapiens
SLITPLQAV

SEQ ID NO: 2612 - protein, 9 aa, Homo Sapiens
SLITRLLEV

SEQ ID NO: 2613 - protein, 9 aa, Homo Sapiens
SLLACEFLL

SEQ ID NO: 2614 - protein, 9 aa, Homo Sapiens
SLLASLHTL

SEQ ID NO: 2615 - protein, 9 aa, Homo Sapiens
SLLDCTFRL

SEQ ID NO: 2616 - protein, 9 aa, Homo Sapiens
SLLDDLHSA

SEQ ID NO: 2617 - protein, 9 aa, Homo Sapiens
SLLDEFYKL

SEQ ID NO: 2618 - protein, 9 aa, Homo Sapiens
SLLDELLEV

SEQ ID NO: 2619 - protein, 9 aa, Homo Sapiens
SLLDEVLNV

SEQ ID NO: 2620 - protein, 9 aa, Homo Sapiens
SLLDGHFVL

SEQ ID NO: 2621 - protein, 9 aa, Homo Sapiens
SLLDIIEKV

SEQ ID NO: 2622 - protein, 9 aa, Homo Sapiens
SLLDLEQKL

SEQ ID NO: 2623 - protein, 9 aa, Homo Sapiens
SLLDNLLTI

SEQ ID NO: 2624 - protein, 9 aa, Homo Sapiens
SLLDPVPEV

SEQ ID NO: 2625 - protein, 9 aa, Homo Sapiens
SLLDSVVGL

SEQ ID NO: 2626 - protein, 9 aa, Homo Sapiens
SLLDTLVLL

SEQ ID NO: 2627 - protein, 9 aa, Homo Sapiens
SLLEAVSFL

SEQ ID NO: 2628 - protein, 9 aa, Homo Sapiens
SLLEFNTTV

SEQ ID NO: 2629 - protein, 9 aa, Homo Sapiens
SLLEHLSHV

SEQ ID NO: 2630 - protein, 9 aa, Homo Sapiens
SLLEKLSAL

SEQ ID NO: 2631 - protein, 9 aa, Homo Sapiens
SLLEKSLGL

SEQ ID NO: 2632 - protein, 9 aa, Homo Sapiens
SLLENIAKA

SEQ ID NO: 2633 - protein, 9 aa, Homo Sapiens
SLLEPFVYL

SEQ ID NO: 2634 - protein, 9 aa, Homo Sapiens
SLLESVQKL

SEQ ID NO: 2635 - protein, 9 aa, Homo Sapiens
SLLEWCQEV

SEQ ID NO: 2636 - protein, 9 aa, Homo Sapiens
SLLGATVTV

SEQ ID NO: 2637 - protein, 9 aa, Homo Sapiens
SLLGFVATV

SEQ ID NO: 2638 - protein, 9 aa, Homo Sapiens
SLLGFVYKL

SEQ ID NO: 2639 - protein, 9 aa, Homo Sapiens
SLLGGNIRL

SEQ ID NO: 2640 - protein, 9 aa, Homo Sapiens
SLLGHLMIV

SEQ ID NO: 2641 - protein, 9 aa, Homo Sapiens
SLLGHVIRL

SEQ ID NO: 2642 - protein, 9 aa, Homo Sapiens
SLLKDLAEI

SEQ ID NO: 2643 - protein, 9 aa, Homo Sapiens
SLLLLQLLL

SEQ ID NO: 2644 - protein, 9 aa, Homo Sapiens
SLLMSIHNI

SEQ ID NO: 2645 - protein, 9 aa, Homo Sapiens
SLLNVVMDL

SEQ ID NO: 2646 - protein, 9 aa, Homo Sapiens
SLLPAIVEL

SEQ ID NO: 2647 - protein, 9 aa, Homo Sapiens
SLLPAQYNL

SEQ ID NO: 2648 - protein, 9 aa, Homo Sapiens
SLLPFLKAV

SEQ ID NO: 2649 - protein, 9 aa, Homo Sapiens
SLLPFWYTL

SEQ ID NO: 2650 - protein, 9 aa, Homo Sapiens
SLLPSVPAL

SEQ ID NO: 2651 - protein, 9 aa, Homo Sapiens
SLLPTSPRL

SEQ ID NO: 2652 - protein, 9 aa, Homo Sapiens
SLLPYLPML

SEQ ID NO: 2653 - protein, 9 aa, Homo Sapiens
SLLQALNEV

SEQ ID NO: 2654 - protein, 9 aa, Homo Sapiens
SLLQEGIYL

SEQ ID NO: 2655 - protein, 9 aa, Homo Sapiens
SLLQLWLTL

SEQ ID NO: 2656 - protein, 9 aa, Homo Sapiens
SLLQTLYKV

SEQ ID NO: 2657 - protein, 9 aa, Homo Sapiens
SLLQTQHAL

SEQ ID NO: 2658 - protein, 9 aa, Homo Sapiens
SLLQVLISI

SEQ ID NO: 2659 - protein, 9 aa, Homo Sapiens
SLLRDVPLA

SEQ ID NO: 2660 - protein, 9 aa, Homo Sapiens
SLLRSIFTV

SEQ ID NO: 2661 - protein, 9 aa, Homo Sapiens
SLLRVGWSV

SEQ ID NO: 2662 - protein, 9 aa, Homo Sapiens
SLLSDIIAL

SEQ ID NO: 2663 - protein, 9 aa, Homo Sapiens
SLLSELQHA

SEQ ID NO: 2664 - protein, 9 aa, Homo Sapiens
SLLSHVEQL

SEQ ID NO: 2665 - protein, 9 aa, Homo Sapiens
SLLSHVIVA

SEQ ID NO: 2666 - protein, 9 aa, Homo Sapiens
SLLSQQPFL

SEQ ID NO: 2667 - protein, 9 aa, Homo Sapiens
SLLSSVFKL

SEQ ID NO: 2668 - protein, 9 aa, Homo Sapiens
SLLSVFSLV

SEQ ID NO: 2669 - protein, 9 aa, Homo Sapiens
SLLSVSHAL

SEQ ID NO: 2670 - protein, 9 aa, Homo Sapiens
SLLTAISEV

SEQ ID NO: 2671 - protein, 9 aa, Homo Sapiens
SLLTSTVQV

SEQ ID NO: 2672 - protein, 9 aa, Homo Sapiens
SLLVHNVSV

SEQ ID NO: 2673 - protein, 9 aa, Homo Sapiens
SLLYNVPAV

SEQ ID NO: 2674 - protein, 9 aa, Homo Sapiens
SLMALILFL

SEQ ID NO: 2675 - protein, 9 aa, Homo Sapiens
SLMDLQERL

SEQ ID NO: 2676 - protein, 9 aa, Homo Sapiens
SLMDLTLLL

SEQ ID NO: 2677 - protein, 9 aa, Homo Sapiens
SLMEILYTL

SEQ ID NO: 2678 - protein, 9 aa, Homo Sapiens
SLMEKISKL

SEQ ID NO: 2679 - protein, 9 aa, Homo Sapiens
SLMLVTVEL

SEQ ID NO: 2680 - protein, 9 aa, Homo Sapiens
SLMMTIINL

SEQ ID NO: 2681 - protein, 9 aa, Homo Sapiens
SLMSHAIEL

SEQ ID NO: 2682 - protein, 9 aa, Homo Sapiens
SLMVPVFVV

SEQ ID NO: 2683 - protein, 9 aa, Homo Sapiens
SLNELRVLL

SEQ ID NO: 2684 - protein, 9 aa, Homo Sapiens
SLNEYQPKL

SEQ ID NO: 2685 - protein, 9 aa, Homo Sapiens
SLNGLEVHL

SEQ ID NO: 2686 - protein, 9 aa, Homo Sapiens
SLNLAPPTV

SEQ ID NO: 2687 - protein, 9 aa, Homo Sapiens
SLPDHLPSV

SEQ ID NO: 2688 - protein, 9 aa, Homo Sapiens
SLPDIKVYL

SEQ ID NO: 2689 - protein, 9 aa, Homo Sapiens
SLPELVHAV

SEQ ID NO: 2690 - protein, 9 aa, Homo Sapiens
SLQDEIQRV

SEQ ID NO: 2691 - protein, 9 aa, Homo Sapiens
SLQEEIAFL

SEQ ID NO: 2692 - protein, 9 aa, Homo Sapiens
SLQEFLAAL

SEQ ID NO: 2693 - protein, 9 aa, Homo Sapiens
SLQEKLWAI

SEQ ID NO: 2694 - protein, 9 aa, Homo Sapiens
SLQELLIQV

SEQ ID NO: 2695 - protein, 9 aa, Homo Sapiens
SLQETIQSL

SEQ ID NO: 2696 - protein, 9 aa, Homo Sapiens
SLQSLIISV

SEQ ID NO: 2697 - protein, 9 aa, Homo Sapiens
SLQSTILGV

SEQ ID NO: 2698 - protein, 9 aa, Homo Sapiens
SLSAFTPAL

SEQ ID NO: 2699 - protein, 9 aa, Homo Sapiens
SLSDTVEKL

SEQ ID NO: 2700 - protein, 9 aa, Homo Sapiens
SLSEKQYFL

SEQ ID NO: 2701 - protein, 9 aa, Homo Sapiens
SLSEKTVLL

SEQ ID NO: 2702 - protein, 9 aa, Homo Sapiens
SLSEYDQCL

SEQ ID NO: 2703 - protein, 9 aa, Homo Sapiens
SLSFLVPSL

SEQ ID NO: 2704 - protein, 9 aa, Homo Sapiens
SLSFMNPRL

SEQ ID NO: 2705 - protein, 9 aa, Homo Sapiens
SLSFVSPSL

SEQ ID NO: 2706 - protein, 9 aa, Homo Sapiens
SLSGELREV

SEQ ID NO: 2707 - protein, 9 aa, Homo Sapiens
SLSHLVPAL

SEQ ID NO: 2708 - protein, 9 aa, Homo Sapiens
SLSPIYPAA

SEQ ID NO: 2709 - protein, 9 aa, Homo Sapiens
SLSSFLHGV

SEQ ID NO: 2710 - protein, 9 aa, Homo Sapiens
SLSSLELFL

SEQ ID NO: 2711 - protein, 9 aa, Homo Sapiens
SLSSLVVQL

SEQ ID NO: 2712 - protein, 9 aa, Homo Sapiens
SLSSVLSHV

SEQ ID NO: 2713 - protein, 9 aa, Homo Sapiens
SLSTCIPAI

SEQ ID NO: 2714 - protein, 9 aa, Homo Sapiens
SLSTVFVVL

SEQ ID NO: 2715 - protein, 9 aa, Homo Sapiens
SLTRHQFYL

SEQ ID NO: 2716 - protein, 9 aa, Homo Sapiens
SLTSVVLTL

SEQ ID NO: 2717 - protein, 9 aa, Homo Sapiens
SLVAILQSV

SEQ ID NO: 2718 - protein, 9 aa, Homo Sapiens
SLVDASWEL

SEQ ID NO: 2719 - protein, 9 aa, Homo Sapiens
SLVDTVYAL

SEQ ID NO: 2720 - protein, 9 aa, Homo Sapiens
SLVEIILHV

SEQ ID NO: 2721 - protein, 9 aa, Homo Sapiens
SLVELLVQL

SEQ ID NO: 2722 - protein, 9 aa, Homo Sapiens
SLVEQLTMV

SEQ ID NO: 2723 - protein, 9 aa, Homo Sapiens
SLVGLLLYL

SEQ ID NO: 2724 - protein, 9 aa, Homo Sapiens
SLVHINIFL

SEQ ID NO: 2725 - protein, 9 aa, Homo Sapiens
SLVNQVPKI

SEQ ID NO: 2726 - protein, 9 aa, Homo Sapiens
SLVNVVPKL

SEQ ID NO: 2727 - protein, 9 aa, Homo Sapiens
SLVQRVETI

SEQ ID NO: 2728 - protein, 9 aa, Homo Sapiens
SLVYLCYTV

SEQ ID NO: 2729 - protein, 9 aa, Homo Sapiens
SLWFKPEEL

SEQ ID NO: 2730 - protein, 9 aa, Homo Sapiens
SLWGGDVVL

SEQ ID NO: 2731 - protein, 9 aa, Homo Sapiens
SLWGTHVVV

SEQ ID NO: 2732 - protein, 9 aa, Homo Sapiens
SLWHLPLLL

SEQ ID NO: 2733 - protein, 9 aa, Homo Sapiens
SLWKEVSEL

SEQ ID NO: 2734 - protein, 9 aa, Homo Sapiens
SLWKGLVGI

SEQ ID NO: 2735 - protein, 9 aa, Homo Sapiens
SLWPMTFGL

SEQ ID NO: 2736 - protein, 9 aa, Homo Sapiens
SLWSIISKV

SEQ ID NO: 2737 - protein, 9 aa, Homo Sapiens
SLYDWNVKL

SEQ ID NO: 2738 - protein, 9 aa, Homo Sapiens
SLYDYNPNL

SEQ ID NO: 2739 - protein, 9 aa, Homo Sapiens
SLYEMVSRV

SEQ ID NO: 2740 - protein, 9 aa, Homo Sapiens
SLYGGTITI

SEQ ID NO: 2741 - protein, 9 aa, Homo Sapiens
SLYGYLRGA

SEQ ID NO: 2742 - protein, 9 aa, Homo Sapiens
SLYHIYVAL

SEQ ID NO: 2743 - protein, 9 aa, Homo Sapiens
SLYHVESTV

SEQ ID NO: 2744 - protein, 9 aa, Homo Sapiens
SLYIKDIWL

SEQ ID NO: 2745 - protein, 9 aa, Homo Sapiens
SLYKGLLSV

SEQ ID NO: 2746 - protein, 9 aa, Homo Sapiens
SLYREILFL

SEQ ID NO: 2747 - protein, 9 aa, Homo Sapiens
SMAELDIKL

SEQ ID NO: 2748 - protein, 9 aa, Homo Sapiens
SMAPYVLNV

SEQ ID NO: 2749 - protein, 9 aa, Homo Sapiens
SMAVVIPEA

SEQ ID NO: 2750 - protein, 9 aa, Homo Sapiens
SMFGAGLTV

SEQ ID NO: 2751 - protein, 9 aa, Homo Sapiens
SMHQILLYL

SEQ ID NO: 2752 - protein, 9 aa, Homo Sapiens
SMLDDLRNV

SEQ ID NO: 2753 - protein, 9 aa, Homo Sapiens
SMLEPVPEL

SEQ ID NO: 2754 - protein, 9 aa, Homo Sapiens
SMLLEIIFL

SEQ ID NO: 2755 - protein, 9 aa, Homo Sapiens
SMLNRILAV

SEQ ID NO: 2756 - protein, 9 aa, Homo Sapiens
SMLPVPPAV

SEQ ID NO: 2757 - protein, 9 aa, Homo Sapiens
SMLQKTWLL

SEQ ID NO: 2758 - protein, 9 aa, Homo Sapiens
SMLTLPLSL

SEQ ID NO: 2759 - protein, 9 aa, Homo Sapiens
SMMALLVQL

SEQ ID NO: 2760 - protein, 9 aa, Homo Sapiens
SMMQTLLTV

SEQ ID NO: 2761 - protein, 9 aa, Homo Sapiens
SMSADVPLV

SEQ ID NO: 2762 - protein, 9 aa, Homo Sapiens
SMTLAIHEI

SEQ ID NO: 2763 - protein, 9 aa, Homo Sapiens
SMTLVNVLV

SEQ ID NO: 2764 - protein, 9 aa, Homo Sapiens
SMVDVVMLL

SEQ ID NO: 2765 - protein, 9 aa, Homo Sapiens
SMYDKVLML

SEQ ID NO: 2766 - protein, 9 aa, Homo Sapiens
SQTFVNPHV

SEQ ID NO: 2767 - protein, 9 aa, Homo Sapiens
STLHLVLRL

SEQ ID NO: 2768 - protein, 9 aa, Homo Sapiens
SVFAGVVGV

SEQ ID NO: 2769 - protein, 9 aa, Homo Sapiens
SVIEQIVYV

SEQ ID NO: 2770 - protein, 9 aa, Homo Sapiens
SVIEQLFFV

SEQ ID NO: 2771 - protein, 9 aa, Homo Sapiens
SVIQNLRTV

SEQ ID NO: 2772 - protein, 9 aa, Homo Sapiens
SVITQVFHV

SEQ ID NO: 2773 - protein, 9 aa, Homo Sapiens
SVLDLLVQL

SEQ ID NO: 2774 - protein, 9 aa, Homo Sapiens
SVLDLVVAL

SEQ ID NO: 2775 - protein, 9 aa, Homo Sapiens
SVLDQKILL

SEQ ID NO: 2776 - protein, 9 aa, Homo Sapiens
SVLGAITSV

SEQ ID NO: 2777 - protein, 9 aa, Homo Sapiens
SVLGKIWKL

SEQ ID NO: 2778 - protein, 9 aa, Homo Sapiens
SVLKSIQEV

SEQ ID NO: 2779 - protein, 9 aa, Homo Sapiens
SVLVSPPAV

SEQ ID NO: 2780 - protein, 9 aa, Homo Sapiens
SVMELLQGV

SEQ ID NO: 2781 - protein, 9 aa, Homo Sapiens
SVMSILPKI

SEQ ID NO: 2782 - protein, 9 aa, Homo Sapiens
TIDDIVLTI

SEQ ID NO: 2783 - protein, 9 aa, Homo Sapiens
TILKRLFRV

SEQ ID NO: 2784 - protein, 9 aa, Homo Sapiens
TILPKVMQV

SEQ ID NO: 2785 - protein, 9 aa, Homo Sapiens
TIMELLIMV

SEQ ID NO: 2786 - protein, 9 aa, Homo Sapiens
TIMPKDIQL

SEQ ID NO: 2787 - protein, 9 aa, Homo Sapiens
TLAAIAVHL

SEQ ID NO: 2788 - protein, 9 aa, Homo Sapiens
TLADLVHHV

SEQ ID NO: 2789 - protein, 9 aa, Homo Sapiens
TLADVLYHV

SEQ ID NO: 2790 - protein, 9 aa, Homo Sapiens
TLADYLHLL

SEQ ID NO: 2791 - protein, 9 aa, Homo Sapiens
TLAEKIQTI

SEQ ID NO: 2792 - protein, 9 aa, Homo Sapiens
TLAELHISL

SEQ ID NO: 2793 - protein, 9 aa, Homo Sapiens
TLAELLVLL

SEQ ID NO: 2794 - protein, 9 aa, Homo Sapiens
TLAETLVNL

SEQ ID NO: 2795 - protein, 9 aa, Homo Sapiens
TLAFVSPSL

SEQ ID NO: 2796 - protein, 9 aa, Homo Sapiens
TLAGDVHIV

SEQ ID NO: 2797 - protein, 9 aa, Homo Sapiens
TLCDLYETL

SEQ ID NO: 2798 - protein, 9 aa, Homo Sapiens
TLDAGNIKL

SEQ ID NO: 2799 - protein, 9 aa, Homo Sapiens
TLDDLIAAV

SEQ ID NO: 2800 - protein, 9 aa, Homo Sapiens
TLDEKIEKV

SEQ ID NO: 2801 - protein, 9 aa, Homo Sapiens
TLDGSLHAV

SEQ ID NO: 2802 - protein, 9 aa, Homo Sapiens
TLENIIATV

SEQ ID NO: 2803 - protein, 9 aa, Homo Sapiens
TLFDYEVRL

SEQ ID NO: 2804 - protein, 9 aa, Homo Sapiens
TLFGLTPTL

SEQ ID NO: 2805 - protein, 9 aa, Homo Sapiens
TLFPSKIGV

SEQ ID NO: 2806 - protein, 9 aa, Homo Sapiens
TLFPVRLLV

SEQ ID NO: 2807 - protein, 9 aa, Homo Sapiens
TLFTKELVL

SEQ ID NO: 2808 - protein, 9 aa, Homo Sapiens
TLGDAHIYL

SEQ ID NO: 2809 - protein, 9 aa, Homo Sapiens
TLGNVLVTV

SEQ ID NO: 2810 - protein, 9 aa, Homo Sapiens
TLGVIPESV

SEQ ID NO: 2811 - protein, 9 aa, Homo Sapiens
TLHSIIISL

SEQ ID NO: 2812 - protein, 9 aa, Homo Sapiens
TLIAAILYL

SEQ ID NO: 2813 - protein, 9 aa, Homo Sapiens
TLIEDILGV

SEQ ID NO: 2814 - protein, 9 aa, Homo Sapiens
TLIGLSIKV

SEQ ID NO: 2815 - protein, 9 aa, Homo Sapiens
TLIGYFVGL

SEQ ID NO: 2816 - protein, 9 aa, Homo Sapiens
TLINLLLKV

SEQ ID NO: 2817 - protein, 9 aa, Homo Sapiens
TLISELVQA

SEQ ID NO: 2818 - protein, 9 aa, Homo Sapiens
TLISRLPAV

SEQ ID NO: 2819 - protein, 9 aa, Homo Sapiens
TLKDTITSV

SEQ ID NO: 2820 - protein, 9 aa, Homo Sapiens
TLLDFINAV

SEQ ID NO: 2821 - protein, 9 aa, Homo Sapiens
TLLDRMVHL

SEQ ID NO: 2822 - protein, 9 aa, Homo Sapiens
TLLESIRQA

SEQ ID NO: 2823 - protein, 9 aa, Homo Sapiens
TLLGHEFVL

SEQ ID NO: 2824 - protein, 9 aa, Homo Sapiens
TLLGHLDYI

SEQ ID NO: 2825 - protein, 9 aa, Homo Sapiens
TLLGKEIKI

SEQ ID NO: 2826 - protein, 9 aa, Homo Sapiens
TLLGKVVAL

SEQ ID NO: 2827 - protein, 9 aa, Homo Sapiens
TLLGNIHAV

SEQ ID NO: 2828 - protein, 9 aa, Homo Sapiens
TLLGSYIEL

SEQ ID NO: 2829 - protein, 9 aa, Homo Sapiens
TLLGVTVTV

SEQ ID NO: 2830 - protein, 9 aa, Homo Sapiens
TLLHFLVEI

SEQ ID NO: 2831 - protein, 9 aa, Homo Sapiens
TLLHLAVSL

SEQ ID NO: 2832 - protein, 9 aa, Homo Sapiens
TLLIQVPRI

SEQ ID NO: 2833 - protein, 9 aa, Homo Sapiens
TLLKQLKEA

SEQ ID NO: 2834 - protein, 9 aa, Homo Sapiens
TLLKSIPLV

SEQ ID NO: 2835 - protein, 9 aa, Homo Sapiens
TLLNVIKSV

SEQ ID NO: 2836 - protein, 9 aa, Homo Sapiens
TLLPTLYEI

SEQ ID NO: 2837 - protein, 9 aa, Homo Sapiens
TLLRLLYEA

SEQ ID NO: 2838 - protein, 9 aa, Homo Sapiens
TLLSNIQGV

SEQ ID NO: 2839 - protein, 9 aa, Homo Sapiens
TLLTAIVKL

SEQ ID NO: 2840 - protein, 9 aa, Homo Sapiens
TLLTKPVEI

SEQ ID NO: 2841 - protein, 9 aa, Homo Sapiens
TLLVVVPKL

SEQ ID NO: 2842 - protein, 9 aa, Homo Sapiens
TLMAEMHVV

SEQ ID NO: 2843 - protein, 9 aa, Homo Sapiens
TLMEEVLLL

SEQ ID NO: 2844 - protein, 9 aa, Homo Sapiens
TLNDREYQL

SEQ ID NO: 2845 - protein, 9 aa, Homo Sapiens
TLNEKLFLL

SEQ ID NO: 2846 - protein, 9 aa, Homo Sapiens
TLNEKLTAL

SEQ ID NO: 2847 - protein, 9 aa, Homo Sapiens
TLNNLEIFL

SEQ ID NO: 2848 - protein, 9 aa, Homo Sapiens
TLNNWLATV

SEQ ID NO: 2849 - protein, 9 aa, Homo Sapiens
TLPDTILTV

SEQ ID NO: 2850 - protein, 9 aa, Homo Sapiens
TLPNIYVTL

SEQ ID NO: 2851 - protein, 9 aa, Homo Sapiens
TLQDIVYKL

SEQ ID NO: 2852 - protein, 9 aa, Homo Sapiens
TLQEFLERI

SEQ ID NO: 2853 - protein, 9 aa, Homo Sapiens
TLQEVVTGV

SEQ ID NO: 2854 - protein, 9 aa, Homo Sapiens
TLQPTLVAV

SEQ ID NO: 2855 - protein, 9 aa, Homo Sapiens
TLSDIMVSL

SEQ ID NO: 2856 - protein, 9 aa, Homo Sapiens
TLSDIVVTL

SEQ ID NO: 2857 - protein, 9 aa, Homo Sapiens
TLSDLRVYL

SEQ ID NO: 2858 - protein, 9 aa, Homo Sapiens
TLSDVLDRV

SEQ ID NO: 2859 - protein, 9 aa, Homo Sapiens
TLSDVVVGL

SEQ ID NO: 2860 - protein, 9 aa, Homo Sapiens
TLSEVTNQL

SEQ ID NO: 2861 - protein, 9 aa, Homo Sapiens
TLSKIVPHI

SEQ ID NO: 2862 - protein, 9 aa, Homo Sapiens
TLSNLWIFL

SEQ ID NO: 2863 - protein, 9 aa, Homo Sapiens
TLSPLLLFL

SEQ ID NO: 2864 - protein, 9 aa, Homo Sapiens
TLSPRPPLI

SEQ ID NO: 2865 - protein, 9 aa, Homo Sapiens
TLSQVIPMV

SEQ ID NO: 2866 - protein, 9 aa, Homo Sapiens
TLSTVISKV

SEQ ID NO: 2867 - protein, 9 aa, Homo Sapiens
TLTGKTITL

SEQ ID NO: 2868 - protein, 9 aa, Homo Sapiens
TLTNIIHNL

SEQ ID NO: 2869 - protein, 9 aa, Homo Sapiens
TLTNVIHNL

SEQ ID NO: 2870 - protein, 9 aa, Homo Sapiens
TLTSKLYSL

SEQ ID NO: 2871 - protein, 9 aa, Homo Sapiens
TLTSNIPEI

SEQ ID NO: 2872 - protein, 9 aa, Homo Sapiens
TLVDEVFRI

SEQ ID NO: 2873 - protein, 9 aa, Homo Sapiens
TLVDFPLHL

SEQ ID NO: 2874 - protein, 9 aa, Homo Sapiens
TLVEAIKQV

SEQ ID NO: 2875 - protein, 9 aa, Homo Sapiens
TLVTWLQCV

SEQ ID NO: 2876 - protein, 9 aa, Homo Sapiens
TLVYHVVGV

SEQ ID NO: 2877 - protein, 9 aa, Homo Sapiens
TLWGFVPFV

SEQ ID NO: 2878 - protein, 9 aa, Homo Sapiens
TLWGGLLRL

SEQ ID NO: 2879 - protein, 9 aa, Homo Sapiens
TLWNEIERL

SEQ ID NO: 2880 - protein, 9 aa, Homo Sapiens
TLWNQELYI

SEQ ID NO: 2881 - protein, 9 aa, Homo Sapiens
TLWQIVINI

SEQ ID NO: 2882 - protein, 9 aa, Homo Sapiens
TLWRGPVVV

SEQ ID NO: 2883 - protein, 9 aa, Homo Sapiens
TLWVDPCEV

SEQ ID NO: 2884 - protein, 9 aa, Homo Sapiens
TLWVDPYEV

SEQ ID NO: 2885 - protein, 9 aa, Homo Sapiens
TLWYKIFTT

SEQ ID NO: 2886 - protein, 9 aa, Homo Sapiens
TLWYRAPEV

SEQ ID NO: 2887 - protein, 9 aa, Homo Sapiens
TLWYRSPEV

SEQ ID NO: 2888 - protein, 9 aa, Homo Sapiens
TLWYVPLSL

SEQ ID NO: 2889 - protein, 9 aa, Homo Sapiens
TLYGSQIKL

SEQ ID NO: 2890 - protein, 9 aa, Homo Sapiens
TLYHLRLLV

SEQ ID NO: 2891 - protein, 9 aa, Homo Sapiens
TLYSGLDEV

SEQ ID NO: 2892 - protein, 9 aa, Homo Sapiens
TMADQIVTV

SEQ ID NO: 2893 - protein, 9 aa, Homo Sapiens
TMFEFAFHL

SEQ ID NO: 2894 - protein, 9 aa, Homo Sapiens
TMGFEVPGV

SEQ ID NO: 2895 - protein, 9 aa, Homo Sapiens
TMINAIPVA

SEQ ID NO: 2896 - protein, 9 aa, Homo Sapiens
TMLELLLRL

SEQ ID NO: 2897 - protein, 9 aa, Homo Sapiens
TMLGVSHVV

SEQ ID NO: 2898 - protein, 9 aa, Homo Sapiens
TMLSLEFHL

SEQ ID NO: 2899 - protein, 9 aa, Homo Sapiens
TMVDRIEEV

SEQ ID NO: 2900 - protein, 9 aa, Homo Sapiens
TQILSVPKV

SEQ ID NO: 2901 - protein, 9 aa, Homo Sapiens
TTFPRPVTV

SEQ ID NO: 2902 - protein, 9 aa, Homo Sapiens
TVAPFNPTV

SEQ ID NO: 2903 - protein, 9 aa, Homo Sapiens
TVFEGRIYV

SEQ ID NO: 2904 - protein, 9 aa, Homo Sapiens
TVFEHTFHV

SEQ ID NO: 2905 - protein, 9 aa, Homo Sapiens
TVIRDPPSI

SEQ ID NO: 2906 - protein, 9 aa, Homo Sapiens
TVLDAIYEV

SEQ ID NO: 2907 - protein, 9 aa, Homo Sapiens
TVLEKVYEL

SEQ ID NO: 2908 - protein, 9 aa, Homo Sapiens
TVLGKIWKL

SEQ ID NO: 2909 - protein, 9 aa, Homo Sapiens
TVLPFVSTV

SEQ ID NO: 2910 - protein, 9 aa, Homo Sapiens
TVMDEIHTV

SEQ ID NO: 2911 - protein, 9 aa, Homo Sapiens
TVMGKIFAV

SEQ ID NO: 2912 - protein, 9 aa, Homo Sapiens
TVPPVFVSV

SEQ ID NO: 2913 - protein, 9 aa, Homo Sapiens
TVTTVILEV

SEQ ID NO: 2914 - protein, 9 aa, Homo Sapiens
VAPFPEVFG

SEQ ID NO: 2915 - protein, 9 aa, Homo Sapiens
VIDGHIYAV

SEQ ID NO: 2916 - protein, 9 aa, Homo Sapiens
VIFDLPTTV

SEQ ID NO: 2917 - protein, 9 aa, Homo Sapiens
VIIPLLHTV

SEQ ID NO: 2918 - protein, 9 aa, Homo Sapiens
VILDPVHSV

SEQ ID NO: 2919 - protein, 9 aa, Homo Sapiens
VILPTVHEV

SEQ ID NO: 2920 - protein, 9 aa, Homo Sapiens
VITETVVEV

SEQ ID NO: 2921 - protein, 9 aa, Homo Sapiens
VKNLLPKSI

SEQ ID NO: 2922 - protein, 9 aa, Homo Sapiens
VLADALKSI

SEQ ID NO: 2923 - protein, 9 aa, Homo Sapiens
VLADFEAGL

SEQ ID NO: 2924 - protein, 9 aa, Homo Sapiens
VLADLKVQL

SEQ ID NO: 2925 - protein, 9 aa, Homo Sapiens
VLADQEVRL

SEQ ID NO: 2926 - protein, 9 aa, Homo Sapiens
VLADQVWTL

SEQ ID NO: 2927 - protein, 9 aa, Homo Sapiens
VLAETLTQV

SEQ ID NO: 2928 - protein, 9 aa, Homo Sapiens
VLAFLVHEL

SEQ ID NO: 2929 - protein, 9 aa, Homo Sapiens
VLAHTILGV

SEQ ID NO: 2930 - protein, 9 aa, Homo Sapiens
VLASLIIRL

SEQ ID NO: 2931 - protein, 9 aa, Homo Sapiens
VLAWGLLNV

SEQ ID NO: 2932 - protein, 9 aa, Homo Sapiens
VLAYFLPEA

SEQ ID NO: 2933 - protein, 9 aa, Homo Sapiens
VLDDKLVFV

SEQ ID NO: 2934 - protein, 9 aa, Homo Sapiens
VLDDKLYVV

SEQ ID NO: 2935 - protein, 9 aa, Homo Sapiens
VLDELPPLI

SEQ ID NO: 2936 - protein, 9 aa, Homo Sapiens
VLDSVDVRL

SEQ ID NO: 2937 - protein, 9 aa, Homo Sapiens
VLEDLEVTV

SEQ ID NO: 2938 - protein, 9 aa, Homo Sapiens
VLFELKLLL

SEQ ID NO: 2939 - protein, 9 aa, Homo Sapiens
VLFESQFSV

SEQ ID NO: 2940 - protein, 9 aa, Homo Sapiens
VLFEVAWEV

SEQ ID NO: 2941 - protein, 9 aa, Homo Sapiens
VLFGFVPET

SEQ ID NO: 2942 - protein, 9 aa, Homo Sapiens
VLFGKPMVV

SEQ ID NO: 2943 - protein, 9 aa, Homo Sapiens
VLFGLLREV

SEQ ID NO: 2944 - protein, 9 aa, Homo Sapiens
VLFHNLPSL

SEQ ID NO: 2945 - protein, 9 aa, Homo Sapiens
VLFTGVKEV

SEQ ID NO: 2946 - protein, 9 aa, Homo Sapiens
VLFTITKTV

SEQ ID NO: 2947 - protein, 9 aa, Homo Sapiens
VLGPKIEAV

SEQ ID NO: 2948 - protein, 9 aa, Homo Sapiens
VLHEGTNFV

SEQ ID NO: 2949 - protein, 9 aa, Homo Sapiens
VLIANLEKL

SEQ ID NO: 2950 - protein, 9 aa, Homo Sapiens
VLIDYQRNV

SEQ ID NO: 2951 - protein, 9 aa, Homo Sapiens
VLIETLVTL

SEQ ID NO: 2952 - protein, 9 aa, Homo Sapiens
VLIGHSYGV

SEQ ID NO: 2953 - protein, 9 aa, Homo Sapiens
VLIGSNHSL

SEQ ID NO: 2954 - protein, 9 aa, Homo Sapiens
VLIKWFPEV

SEQ ID NO: 2955 - protein, 9 aa, Homo Sapiens
VLIPKLPQL

SEQ ID NO: 2956 - protein, 9 aa, Homo Sapiens
VLITTLITA

SEQ ID NO: 2957 - protein, 9 aa, Homo Sapiens
VLKEIVERV

SEQ ID NO: 2958 - protein, 9 aa, Homo Sapiens
VLKVFLENV

SEQ ID NO: 2959 - protein, 9 aa, Homo Sapiens
VLLDHLSLA

SEQ ID NO: 2960 - protein, 9 aa, Homo Sapiens
VLLDSVEKL

SEQ ID NO: 2961 - protein, 9 aa, Homo Sapiens
VLLESKILL

SEQ ID NO: 2962 - protein, 9 aa, Homo Sapiens
VLLFIEHSV

SEQ ID NO: 2963 - protein, 9 aa, Homo Sapiens
VLLGHIFYV

SEQ ID NO: 2964 - protein, 9 aa, Homo Sapiens
VLLGKVYVV

SEQ ID NO: 2965 - protein, 9 aa, Homo Sapiens
VLLHVSVLL

SEQ ID NO: 2966 - protein, 9 aa, Homo Sapiens
VLLKIVEQI

SEQ ID NO: 2967 - protein, 9 aa, Homo Sapiens
VLLRVLILL

SEQ ID NO: 2968 - protein, 9 aa, Homo Sapiens
VLLSEILHL

SEQ ID NO: 2969 - protein, 9 aa, Homo Sapiens
VLLSHLSYL

SEQ ID NO: 2970 - protein, 9 aa, Homo Sapiens
VLLSTIHEL

SEQ ID NO: 2971 - protein, 9 aa, Homo Sapiens
VLLTGLHAV

SEQ ID NO: 2972 - protein, 9 aa, Homo Sapiens
VLLTMIARV

SEQ ID NO: 2973 - protein, 9 aa, Homo Sapiens
VLLTRLENV

SEQ ID NO: 2974 - protein, 9 aa, Homo Sapiens
VLMDGSVKL

SEQ ID NO: 2975 - protein, 9 aa, Homo Sapiens
VLMDLKALL

SEQ ID NO: 2976 - protein, 9 aa, Homo Sapiens
VLMDRLPSL

SEQ ID NO: 2977 - protein, 9 aa, Homo Sapiens
VLMEIIAKV

SEQ ID NO: 2978 - protein, 9 aa, Homo Sapiens
VLMEKPDVV

SEQ ID NO: 2979 - protein, 9 aa, Homo Sapiens
VLMEMSYRL

SEQ ID NO: 2980 - protein, 9 aa, Homo Sapiens
VLMENIVYL

SEQ ID NO: 2981 - protein, 9 aa, Homo Sapiens
VLMGQLYVV

SEQ ID NO: 2982 - protein, 9 aa, Homo Sapiens
VLMPWIHEL

SEQ ID NO: 2983 - protein, 9 aa, Homo Sapiens
VLMTEDIKL

SEQ ID NO: 2984 - protein, 9 aa, Homo Sapiens
VLMWEIYSL

SEQ ID NO: 2985 - protein, 9 aa, Homo Sapiens
VLNEYFHNV

SEQ ID NO: 2986 - protein, 9 aa, Homo Sapiens
VLNNVVIHL

SEQ ID NO: 2987 - protein, 9 aa, Homo Sapiens
VLQDIQVML

SEQ ID NO: 2988 - protein, 9 aa, Homo Sapiens
VLQDTVEQL

SEQ ID NO: 2989 - protein, 9 aa, Homo Sapiens
VLQEKIEVV

SEQ ID NO: 2990 - protein, 9 aa, Homo Sapiens
VLQEKVPEI

SEQ ID NO: 2991 - protein, 9 aa, Homo Sapiens
VLQNVAFSV

SEQ ID NO: 2992 - protein, 9 aa, Homo Sapiens
VLQQHLETL

SEQ ID NO: 2993 - protein, 9 aa, Homo Sapiens
VLQRSLVTV

SEQ ID NO: 2994 - protein, 9 aa, Homo Sapiens
VLQYVVPEV

SEQ ID NO: 2995 - protein, 9 aa, Homo Sapiens
VLSDIIQNL

SEQ ID NO: 2996 - protein, 9 aa, Homo Sapiens
VLSDVIPSI

SEQ ID NO: 2997 - protein, 9 aa, Homo Sapiens
VLSELAARL

SEQ ID NO: 2998 - protein, 9 aa, Homo Sapiens
VLSELLWQV

SEQ ID NO: 2999 - protein, 9 aa, Homo Sapiens
VLSNVEVTL

SEQ ID NO: 3000 - protein, 9 aa, Homo Sapiens
VLSTGVPTV

SEQ ID NO: 3001 - protein, 9 aa, Homo Sapiens
VLTESPPSL

SEQ ID NO: 3002 - protein, 9 aa, Homo Sapiens
VLTGILEQV

SEQ ID NO: 3003 - protein, 9 aa, Homo Sapiens
VLTNKLLTV

SEQ ID NO: 3004 - protein, 9 aa, Homo Sapiens
VLTSVTEAL

SEQ ID NO: 3005 - protein, 9 aa, Homo Sapiens
VLVAELVGV

SEQ ID NO: 3006 - protein, 9 aa, Homo Sapiens
VLVDRTIYI

SEQ ID NO: 3007 - protein, 9 aa, Homo Sapiens
VLVQVSPSL

SEQ ID NO: 3008 - protein, 9 aa, Homo Sapiens
VLVSFAYKV

SEQ ID NO: 3009 - protein, 9 aa, Homo Sapiens
VLWDRTFSL

SEQ ID NO: 3010 - protein, 9 aa, Homo Sapiens
VLWFKPVEL

SEQ ID NO: 3011 - protein, 9 aa, Homo Sapiens
VLWGETVHL

SEQ ID NO: 3012 - protein, 9 aa, Homo Sapiens
VLWKEILFL

SEQ ID NO: 3013 - protein, 9 aa, Homo Sapiens
VLWNKTVTA

SEQ ID NO: 3014 - protein, 9 aa, Homo Sapiens
VLWPESISV

SEQ ID NO: 3015 - protein, 9 aa, Homo Sapiens
VLYDRPLKI

SEQ ID NO: 3016 - protein, 9 aa, Homo Sapiens
VLYENALKL

SEQ ID NO: 3017 - protein, 9 aa, Homo Sapiens
VLYENKVAV

SEQ ID NO: 3018 - protein, 9 aa, Homo Sapiens
VLYPHPPLA

SEQ ID NO: 3019 - protein, 9 aa, Homo Sapiens
VLYSIAEKV

SEQ ID NO: 3020 - protein, 9 aa, Homo Sapiens
VLYTGDFRL

SEQ ID NO: 3021 - protein, 9 aa, Homo Sapiens
VLYTGVVRV

SEQ ID NO: 3022 - protein, 9 aa, Homo Sapiens
VMAPRTLVL

SEQ ID NO: 3023 - protein, 9 aa, Homo Sapiens
VMDAALLLI

SEQ ID NO: 3024 - protein, 9 aa, Homo Sapiens
VMDSKIVQV

SEQ ID NO: 3025 - protein, 9 aa, Homo Sapiens
VMFKTPVSI

SEQ ID NO: 3026 - protein, 9 aa, Homo Sapiens
VMLDVPIRL

SEQ ID NO: 3027 - protein, 9 aa, Homo Sapiens
VMLQINPKL

SEQ ID NO: 3028 - protein, 9 aa, Homo Sapiens
VMTLVSTYL

SEQ ID NO: 3029 - protein, 9 aa, Homo Sapiens
VMYGKVYRI

SEQ ID NO: 3030 - protein, 9 aa, Homo Sapiens
VPQLEIVPN

SEQ ID NO: 3031 - protein, 9 aa, Homo Sapiens
VQIGDIVTV

SEQ ID NO: 3032 - protein, 9 aa, Homo Sapiens
VTEGVIVPE

SEQ ID NO: 3033 - protein, 9 aa, Homo Sapiens
VTESFLLAV

SEQ ID NO: 3034 - protein, 9 aa, Homo Sapiens
VTLDGIPEV

SEQ ID NO: 3035 - protein, 9 aa, Homo Sapiens
VTRDLVSEV

SEQ ID NO: 3036 - protein, 9 aa, Homo Sapiens
VTTDIQVKV

SEQ ID NO: 3037 - protein, 9 aa, Homo Sapiens
VVAEFVPLI

SEQ ID NO: 3038 - protein, 9 aa, Homo Sapiens
VVLNATWLV

SEQ ID NO: 3039 - protein, 9 aa, Homo Sapiens
VVLPAPPAV

SEQ ID NO: 3040 - protein, 9 aa, Homo Sapiens
VVPPFLQPE

SEQ ID NO: 3041 - protein, 9 aa, Homo Sapiens
VVVGDLVEV

SEQ ID NO: 3042 - protein, 9 aa, Homo Sapiens
VVWGTVIRV

SEQ ID NO: 3043 - protein, 9 aa, Homo Sapiens
VVWLVAVIV

SEQ ID NO: 3044 - protein, 9 aa, Homo Sapiens
WLLQKNPQL

SEQ ID NO: 3045 - protein, 9 aa, Homo Sapiens
WLMPVIPAL

SEQ ID NO: 3046 - protein, 9 aa, Homo Sapiens
WLPEVMILV

SEQ ID NO: 3047 - protein, 9 aa, Homo Sapiens
WLSTSIPEA

SEQ ID NO: 3048 - protein, 9 aa, Homo Sapiens
WLTPVIPAL

SEQ ID NO: 3049 - protein, 9 aa, Homo Sapiens
WLVDHVYAI

SEQ ID NO: 3050 - protein, 9 aa, Homo Sapiens
WMLEQLRQV

SEQ ID NO: 3051 - protein, 9 aa, Homo Sapiens
YAFNMKATV

SEQ ID NO: 3052 - protein, 9 aa, Homo Sapiens
YAFPKSITV

SEQ ID NO: 3053 - protein, 9 aa, Homo Sapiens
YALNHTLSV

SEQ ID NO: 3054 - protein, 9 aa, Homo Sapiens
YGLPVVVKL

SEQ ID NO: 3055 - protein, 9 aa, Homo Sapiens
YIAGFFLTV

SEQ ID NO: 3056 - protein, 9 aa, Homo Sapiens
YIALKLVAV

SEQ ID NO: 3057 - protein, 9 aa, Homo Sapiens
YIFEEPFTI

SEQ ID NO: 3058 - protein, 9 aa, Homo Sapiens
YIFTTPKSV

SEQ ID NO: 3059 - protein, 9 aa, Homo Sapiens
YIGEVLVSV

SEQ ID NO: 3060 - protein, 9 aa, Homo Sapiens
YIIEREPLI

SEQ ID NO: 3061 - protein, 9 aa, Homo Sapiens
YILDLQVVL

SEQ ID NO: 3062 - protein, 9 aa, Homo Sapiens
YILGDNFTV

SEQ ID NO: 3063 - protein, 9 aa, Homo Sapiens
YILKIVPTV

SEQ ID NO: 3064 - protein, 9 aa, Homo Sapiens
YIWDRHYNI

SEQ ID NO: 3065 - protein, 9 aa, Homo Sapiens
YIYKDTIQV

SEQ ID NO: 3066 - protein, 9 aa, Homo Sapiens
YLADIFTKL

SEQ ID NO: 3067 - protein, 9 aa, Homo Sapiens
YLADLYHFV

SEQ ID NO: 3068 - protein, 9 aa, Homo Sapiens
YLADVTNAL

SEQ ID NO: 3069 - protein, 9 aa, Homo Sapiens
YLAHFIEGL

SEQ ID NO: 3070 - protein, 9 aa, Homo Sapiens
YLAHLAHHL

SEQ ID NO: 3071 - protein, 9 aa, Homo Sapiens
YLAIVWPVV

SEQ ID NO: 3072 - protein, 9 aa, Homo Sapiens
YLAKVKSLL

SEQ ID NO: 3073 - protein, 9 aa, Homo Sapiens
YLAPFLRNV

SEQ ID NO: 3074 - protein, 9 aa, Homo Sapiens
YLAPHVRTL

SEQ ID NO: 3075 - protein, 9 aa, Homo Sapiens
YLASLIRSV

SEQ ID NO: 3076 - protein, 9 aa, Homo Sapiens
YLATFALKV

SEQ ID NO: 3077 - protein, 9 aa, Homo Sapiens
YLDASLITV

SEQ ID NO: 3078 - protein, 9 aa, Homo Sapiens
YLDEYIARM

SEQ ID NO: 3079 - protein, 9 aa, Homo Sapiens
YLDFTNPKV

SEQ ID NO: 3080 - protein, 9 aa, Homo Sapiens
YLDIINLFL

SEQ ID NO: 3081 - protein, 9 aa, Homo Sapiens
YLDKTFYNL

SEQ ID NO: 3082 - protein, 9 aa, Homo Sapiens
YLDNGVVFV

SEQ ID NO: 3083 - protein, 9 aa, Homo Sapiens
YLDPAQRGV

SEQ ID NO: 3084 - protein, 9 aa, Homo Sapiens
YLDPRITVA

SEQ ID NO: 3085 - protein, 9 aa, Homo Sapiens
YLDQRELLL

SEQ ID NO: 3086 - protein, 9 aa, Homo Sapiens
YLDRFLAGV

SEQ ID NO: 3087 - protein, 9 aa, Homo Sapiens
YLDRLIPQA

SEQ ID NO: 3088 - protein, 9 aa, Homo Sapiens
YLEEILVRV

SEQ ID NO: 3089 - protein, 9 aa, Homo Sapiens
YLEPKLTQV

SEQ ID NO: 3090 - protein, 9 aa, Homo Sapiens
YLEPYLKEV

SEQ ID NO: 3091 - protein, 9 aa, Homo Sapiens
YLFAVNIKL

SEQ ID NO: 3092 - protein, 9 aa, Homo Sapiens
YLFERIKEL

SEQ ID NO: 3093 - protein, 9 aa, Homo Sapiens
YLFERTFNL

SEQ ID NO: 3094 - protein, 9 aa, Homo Sapiens
YLFGRNPDL

SEQ ID NO: 3095 - protein, 9 aa, Homo Sapiens
YLFPGIPEL

SEQ ID NO: 3096 - protein, 9 aa, Homo Sapiens
YLFQLLQGL

SEQ ID NO: 3097 - protein, 9 aa, Homo Sapiens
YLFTIINSL

SEQ ID NO: 3098 - protein, 9 aa, Homo Sapiens
YLGDFADTL

SEQ ID NO: 3099 - protein, 9 aa, Homo Sapiens
YLGIVELLV

SEQ ID NO: 3100 - protein, 9 aa, Homo Sapiens
YLGNINPQM

SEQ ID NO: 3101 - protein, 9 aa, Homo Sapiens
YLGPHIASV

SEQ ID NO: 3102 - protein, 9 aa, Homo Sapiens
YLGPVSPSL

SEQ ID NO: 3103 - protein, 9 aa, Homo Sapiens
YLHDFLKYL

SEQ ID NO: 3104 - protein, 9 aa, Homo Sapiens
YLHEDIPGL

SEQ ID NO: 3105 - protein, 9 aa, Homo Sapiens
YLHNQGIGV

SEQ ID NO: 3106 - protein, 9 aa, Homo Sapiens
YLHSGQVAL

SEQ ID NO: 3107 - protein, 9 aa, Homo Sapiens
YLHSQVVSV

SEQ ID NO: 3108 - protein, 9 aa, Homo Sapiens
YLHSYLTYI

SEQ ID NO: 3109 - protein, 9 aa, Homo Sapiens
YLHTNVALV

SEQ ID NO: 3110 - protein, 9 aa, Homo Sapiens
YLIARVMLL

SEQ ID NO: 3111 - protein, 9 aa, Homo Sapiens
YLIASIDHL

SEQ ID NO: 3112 - protein, 9 aa, Homo Sapiens
YLIEPDVEL

SEQ ID NO: 3113 - protein, 9 aa, Homo Sapiens
YLIKYIAIV

SEQ ID NO: 3114 - protein, 9 aa, Homo Sapiens
YLINEIDRI

SEQ ID NO: 3115 - protein, 9 aa, Homo Sapiens
YLISELEAA

SEQ ID NO: 3116 - protein, 9 aa, Homo Sapiens
YLITLLEHL

SEQ ID NO: 3117 - protein, 9 aa, Homo Sapiens
YLITSVELL

SEQ ID NO: 3118 - protein, 9 aa, Homo Sapiens
YLKDLIEEV

SEQ ID NO: 3119 - protein, 9 aa, Homo Sapiens
YLLDLHSYL

SEQ ID NO: 3120 - protein, 9 aa, Homo Sapiens
YLLDLLRLP

SEQ ID NO: 3121 - protein, 9 aa, Homo Sapiens
YLLDQHILI

SEQ ID NO: 3122 - protein, 9 aa, Homo Sapiens
YLLEKFVAV

SEQ ID NO: 3123 - protein, 9 aa, Homo Sapiens
YLLEKSRIV

SEQ ID NO: 3124 - protein, 9 aa, Homo Sapiens
YLLESVNKL

SEQ ID NO: 3125 - protein, 9 aa, Homo Sapiens
YLLGHDIRI

SEQ ID NO: 3126 - protein, 9 aa, Homo Sapiens
YLLLKTHQL

SEQ ID NO: 3127 - protein, 9 aa, Homo Sapiens
YLLPAGYSL

SEQ ID NO: 3128 - protein, 9 aa, Homo Sapiens
YLLPAIVHI

SEQ ID NO: 3129 - protein, 9 aa, Homo Sapiens
YLLPESVDL

SEQ ID NO: 3130 - protein, 9 aa, Homo Sapiens
YLLPYENLL

SEQ ID NO: 3131 - protein, 9 aa, Homo Sapiens
YLLQRAVEV

SEQ ID NO: 3132 - protein, 9 aa, Homo Sapiens
YLLREWVNL

SEQ ID NO: 3133 - protein, 9 aa, Homo Sapiens
YLLRSLDYV

SEQ ID NO: 3134 - protein, 9 aa, Homo Sapiens
YLLTESSKL

SEQ ID NO: 3135 - protein, 9 aa, Homo Sapiens
YLLYSLIFV

SEQ ID NO: 3136 - protein, 9 aa, Homo Sapiens
YLMEVTHDL

SEQ ID NO: 3137 - protein, 9 aa, Homo Sapiens
YLMVENIRL

SEQ ID NO: 3138 - protein, 9 aa, Homo Sapiens
YLNALVHLI

SEQ ID NO: 3139 - protein, 9 aa, Homo Sapiens
YLNDGLWHM

SEQ ID NO: 3140 - protein, 9 aa, Homo Sapiens
YLNDLHEVL

SEQ ID NO: 3141 - protein, 9 aa, Homo Sapiens
YLNDRVDEL

SEQ ID NO: 3142 - protein, 9 aa, Homo Sapiens
YLNHLEPPV

SEQ ID NO: 3143 - protein, 9 aa, Homo Sapiens
YLNLIELFL

SEQ ID NO: 3144 - protein, 9 aa, Homo Sapiens
YLNSVVQVL

SEQ ID NO: 3145 - protein, 9 aa, Homo Sapiens
YLPEDFIRV

SEQ ID NO: 3146 - protein, 9 aa, Homo Sapiens
YLPHAPPFA

SEQ ID NO: 3147 - protein, 9 aa, Homo Sapiens
YLPHYIPGV

SEQ ID NO: 3148 - protein, 9 aa, Homo Sapiens
YLPPATQVV

SEQ ID NO: 3149 - protein, 9 aa, Homo Sapiens
YLPPGFLSA

SEQ ID NO: 3150 - protein, 9 aa, Homo Sapiens
YLPVKIEQV

SEQ ID NO: 3151 - protein, 9 aa, Homo Sapiens
YLPYPIHQV

SEQ ID NO: 3152 - protein, 9 aa, Homo Sapiens
YLQDYTDRV

SEQ ID NO: 3153 - protein, 9 aa, Homo Sapiens
YLQNWSHVL

SEQ ID NO: 3154 - protein, 9 aa, Homo Sapiens
YLQPKLLGI

SEQ ID NO: 3155 - protein, 9 aa, Homo Sapiens
YLQQVNHKL

SEQ ID NO: 3156 - protein, 9 aa, Homo Sapiens
YLSAKVEAL

SEQ ID NO: 3157 - protein, 9 aa, Homo Sapiens
YLSDNVHLV

SEQ ID NO: 3158 - protein, 9 aa, Homo Sapiens
YLSEAGAYL

SEQ ID NO: 3159 - protein, 9 aa, Homo Sapiens
YLSEKVLAA

SEQ ID NO: 3160 - protein, 9 aa, Homo Sapiens
YLSGIAHFL

SEQ ID NO: 3161 - protein, 9 aa, Homo Sapiens
YLSKIIPAL

SEQ ID NO: 3162 - protein, 9 aa, Homo Sapiens
YLSLLNQQL

SEQ ID NO: 3163 - protein, 9 aa, Homo Sapiens
YLSNVDVYL

SEQ ID NO: 3164 - protein, 9 aa, Homo Sapiens
YLSPDLSKV

SEQ ID NO: 3165 - protein, 9 aa, Homo Sapiens
YLSPKLWAL

SEQ ID NO: 3166 - protein, 9 aa, Homo Sapiens
YLSSVITTI

SEQ ID NO: 3167 - protein, 9 aa, Homo Sapiens
YLSTCIDQV

SEQ ID NO: 3168 - protein, 9 aa, Homo Sapiens
YLSVKIWDL

SEQ ID NO: 3169 - protein, 9 aa, Homo Sapiens
YLSVKVWDL

SEQ ID NO: 3170 - protein, 9 aa, Homo Sapiens
YLTAEILEL

SEQ ID NO: 3171 - protein, 9 aa, Homo Sapiens
YLTAEVLEL

SEQ ID NO: 3172 - protein, 9 aa, Homo Sapiens
YLTDLQVSL

SEQ ID NO: 3173 - protein, 9 aa, Homo Sapiens
YLTDRVMTV

SEQ ID NO: 3174 - protein, 9 aa, Homo Sapiens
YLTGYNFTL

SEQ ID NO: 3175 - protein, 9 aa, Homo Sapiens
YLTHDSPSV

SEQ ID NO: 3176 - protein, 9 aa, Homo Sapiens
YLTPLILTL

SEQ ID NO: 3177 - protein, 9 aa, Homo Sapiens
YLTSQLPPL

SEQ ID NO: 3178 - protein, 9 aa, Homo Sapiens
YLTYILLHL

SEQ ID NO: 3179 - protein, 9 aa, Homo Sapiens
YLVAEKVTV

SEQ ID NO: 3180 - protein, 9 aa, Homo Sapiens
YLVDFTQKI

SEQ ID NO: 3181 - protein, 9 aa, Homo Sapiens
YLVEDIQHI

SEQ ID NO: 3182 - protein, 9 aa, Homo Sapiens
YLVELSSLL

SEQ ID NO: 3183 - protein, 9 aa, Homo Sapiens
YLVNDIYEL

SEQ ID NO: 3184 - protein, 9 aa, Homo Sapiens
YLVPELDGV

SEQ ID NO: 3185 - protein, 9 aa, Homo Sapiens
YLVSNVIEL

SEQ ID NO: 3186 - protein, 9 aa, Homo Sapiens
YLVTKVVAV

SEQ ID NO: 3187 - protein, 9 aa, Homo Sapiens
YLVTSIAKA

SEQ ID NO: 3188 - protein, 9 aa, Homo Sapiens
YLVVKIEKV

SEQ ID NO: 3189 - protein, 9 aa, Homo Sapiens
YLVYILNEL

SEQ ID NO: 3190 - protein, 9 aa, Homo Sapiens
YLWLKLNQV

SEQ ID NO: 3191 - protein, 9 aa, Homo Sapiens
YLWNLQVKL

SEQ ID NO: 3192 - protein, 9 aa, Homo Sapiens
YLWQGVRVA

SEQ ID NO: 3193 - protein, 9 aa, Homo Sapiens
YLYCGQEGL

SEQ ID NO: 3194 - protein, 9 aa, Homo Sapiens
YLYDLNHTL

SEQ ID NO: 3195 - protein, 9 aa, Homo Sapiens
YLYDRLLRI

SEQ ID NO: 3196 - protein, 9 aa, Homo Sapiens
YLYEHNFAF

SEQ ID NO: 3197 - protein, 9 aa, Homo Sapiens
YLYKYLWRL

SEQ ID NO: 3198 - protein, 9 aa, Homo Sapiens
YLYNEGLSV

SEQ ID NO: 3199 - protein, 9 aa, Homo Sapiens
YLYPDITRL

SEQ ID NO: 3200 - protein, 9 aa, Homo Sapiens
YLYSLEVQL

SEQ ID NO: 3201 - protein, 9 aa, Homo Sapiens
YLYTKEQLL

SEQ ID NO: 3202 - protein, 9 aa, Homo Sapiens
YMAELIERL

SEQ ID NO: 3203 - protein, 9 aa, Homo Sapiens
YMAPEVVEA

SEQ ID NO: 3204 - protein, 9 aa, Homo Sapiens
YMDQWVPVI

SEQ ID NO: 3205 - protein, 9 aa, Homo Sapiens
YMDTLNIFM

SEQ ID NO: 3206 - protein, 9 aa, Homo Sapiens
YMFEAREFL

SEQ ID NO: 3207 - protein, 9 aa, Homo Sapiens
YMFEEVPIV

SEQ ID NO: 3208 - protein, 9 aa, Homo Sapiens
YMIAHITGL

SEQ ID NO: 3209 - protein, 9 aa, Homo Sapiens
YMLDLQKQL

SEQ ID NO: 3210 - protein, 9 aa, Homo Sapiens
YMLEHVITL

SEQ ID NO: 3211 - protein, 9 aa, Homo Sapiens
YMVHIQVTL

SEQ ID NO: 3212 - protein, 9 aa, Homo Sapiens
YPFPGPIPN

SEQ ID NO: 3213 - protein, 9 aa, Homo Sapiens
YQEPVLGPV

SEQ ID NO: 3214 - protein, 9 aa, Homo Sapiens
YQLEEIQRV

SEQ ID NO: 3215 - protein, 9 aa, Homo Sapiens
YQSELELRV

SEQ ID NO: 3216 - protein, 9 aa, Homo Sapiens
YQSGVVVLV

SEQ ID NO: 3217 - protein, 9 aa, Homo Sapiens
YQVGQLYSV

SEQ ID NO: 3218 - protein, 9 aa, Homo Sapiens
YQYPVIIHL

SEQ ID NO: 3219 - protein, 9 aa, Homo Sapiens
YTLDSILFL

SEQ ID NO: 3220 - protein, 9 aa, Homo Sapiens
YTSPVNPAV

SEQ ID NO: 3221 - protein, 9 aa, Homo Sapiens
YTWEEVFRV

SEQ ID NO: 3222 - protein, 9 aa, Homo Sapiens
YVINDLTAV

SEQ ID NO: 3223 - protein, 9 aa, Homo Sapiens
YVLDLAAKV

SEQ ID NO: 3224 - protein, 9 aa, Homo Sapiens
YVLEGLKSV

SEQ ID NO: 3225 - protein, 9 aa, Homo Sapiens
YVLKYLFEV

SEQ ID NO: 3226 - protein, 9 aa, Homo Sapiens
YVLPLIIIL

SEQ ID NO: 3227 - protein, 9 aa, Homo Sapiens
YVLPVVSYI

SEQ ID NO: 3228 - protein, 9 aa, Homo Sapiens
YVVPFVAKV

SEQ ID NO: 3229 - protein, 9 aa, Homo Sapiens
YVYEYLLHV

SEQ ID NO: 3230 - protein, 10 aa, Homo Sapiens
AIIDGKIFCV

SEQ ID NO: 3231 - protein, 10 aa, Homo Sapiens
AIMGFIGFFV

SEQ ID NO: 3232 - protein, 10 aa, Homo Sapiens
ALAEIAKAEL

SEQ ID NO: 3233 - protein, 10 aa, Homo Sapiens
ALAKPPVVSV

SEQ ID NO: 3234 - protein, 10 aa, Homo Sapiens
ALALIYNEAL

SEQ ID NO: 3235 - protein, 10 aa, Homo Sapiens
ALDAGAVYTL

SEQ ID NO: 3236 - protein, 10 aa, Homo Sapiens
ALDPAAQAFL

SEQ ID NO: 3237 - protein, 10 aa, Homo Sapiens
ALDVQGIYRV

SEQ ID NO: 3238 - protein, 10 aa, Homo Sapiens
ALFNTRIPRV

SEQ ID NO: 3239 - protein, 10 aa, Homo Sapiens
ALFPAPLAQI

SEQ ID NO: 3240 - protein, 10 aa, Homo Sapiens
ALFTFSPLTV

SEQ ID NO: 3241 - protein, 10 aa, Homo Sapiens
ALFTKVLENV

SEQ ID NO: 3242 - protein, 10 aa, Homo Sapiens
ALGDKFLLRV

SEQ ID NO: 3243 - protein, 10 aa, Homo Sapiens
ALIDEQILCV

SEQ ID NO: 3244 - protein, 10 aa, Homo Sapiens
ALIENLTHQI

SEQ ID NO: 3245 - protein, 10 aa, Homo Sapiens
ALIPIPLAVI

SEQ ID NO: 3246 - protein, 10 aa, Homo Sapiens
ALLAGPLRPA

SEQ ID NO: 3247 - protein, 10 aa, Homo Sapiens
ALLDGRLQVV

SEQ ID NO: 3248 - protein, 10 aa, Homo Sapiens
ALLDQALSNA

SEQ ID NO: 3249 - protein, 10 aa, Homo Sapiens
ALLDVTPKAV

SEQ ID NO: 3250 - protein, 10 aa, Homo Sapiens
ALLEDSCHYL

SEQ ID NO: 3251 - protein, 10 aa, Homo Sapiens
ALLELVPWRA

SEQ ID NO: 3252 - protein, 10 aa, Homo Sapiens
ALLESVLRHV

SEQ ID NO: 3253 - protein, 10 aa, Homo Sapiens
ALLETNPYLL

SEQ ID NO: 3254 - protein, 10 aa, Homo Sapiens
ALLGYEMVQV

SEQ ID NO: 3255 - protein, 10 aa, Homo Sapiens
ALLNAILHSA

SEQ ID NO: 3256 - protein, 10 aa, Homo Sapiens
ALLNFLLPTI

SEQ ID NO: 3257 - protein, 10 aa, Homo Sapiens
ALLSLDPAAV

SEQ ID NO: 3258 - protein, 10 aa, Homo Sapiens
ALLSLHFLFV

SEQ ID NO: 3259 - protein, 10 aa, Homo Sapiens
ALLTGIISKA

SEQ ID NO: 3260 - protein, 10 aa, Homo Sapiens
ALMDNPTLYL

SEQ ID NO: 3261 - protein, 10 aa, Homo Sapiens
ALQDVPLSSV

SEQ ID NO: 3262 - protein, 10 aa, Homo Sapiens
ALQPGTLQLI

SEQ ID NO: 3263 - protein, 10 aa, Homo Sapiens
ALSKEGIVAL

SEQ ID NO: 3264 - protein, 10 aa, Homo Sapiens
ALTGIPLPLI

SEQ ID NO: 3265 - protein, 10 aa, Homo Sapiens
ALVDHLNVGV

SEQ ID NO: 3266 - protein, 10 aa, Homo Sapiens
ALVDQRELYL

SEQ ID NO: 3267 - protein, 10 aa, Homo Sapiens
ALVLGPLKSV

SEQ ID NO: 3268 - protein, 10 aa, Homo Sapiens
ALVQITLPTV

SEQ ID NO: 3269 - protein, 10 aa, Homo Sapiens
ALWEDEGVRA

SEQ ID NO: 3270 - protein, 10 aa, Homo Sapiens
ALWGFFPVLL

SEQ ID NO: 3271 - protein, 10 aa, Homo Sapiens
ALWKGRPLSV

SEQ ID NO: 3272 - protein, 10 aa, Homo Sapiens
ALWVSQPPEI

SEQ ID NO: 3273 - protein, 10 aa, Homo Sapiens
ALYDVRTILL

SEQ ID NO: 3274 - protein, 10 aa, Homo Sapiens
ALYELEGTTV

SEQ ID NO: 3275 - protein, 10 aa, Homo Sapiens
ALYEYQPLQI

SEQ ID NO: 3276 - protein, 10 aa, Homo Sapiens
ALYPGQLVQL

SEQ ID NO: 3277 - protein, 10 aa, Homo Sapiens
ALYTGFSILV

SEQ ID NO: 3278 - protein, 10 aa, Homo Sapiens
AMADAGILRL

SEQ ID NO: 3279 - protein, 10 aa, Homo Sapiens
AMAHVAGFTV

SEQ ID NO: 3280 - protein, 10 aa, Homo Sapiens
AMFDHIPVGV

SEQ ID NO: 3281 - protein, 10 aa, Homo Sapiens
AMPPPPPQGV

SEQ ID NO: 3282 - protein, 10 aa, Homo Sapiens
AVFTGIFDSV

SEQ ID NO: 3283 - protein, 10 aa, Homo Sapiens
AVIDVGINRV

SEQ ID NO: 3284 - protein, 10 aa, Homo Sapiens
AVLQGKLAEV

SEQ ID NO: 3285 - protein, 10 aa, Homo Sapiens
CLMGKGMKRV

SEQ ID NO: 3286 - protein, 10 aa, Homo Sapiens
DTNADKQLSF

SEQ ID NO: 3287 - protein, 10 aa, Homo Sapiens
ELFPHSLLSV

SEQ ID NO: 3288 - protein, 10 aa, Homo Sapiens
FIDKFTPPVV

SEQ ID NO: 3289 - protein, 10 aa, Homo Sapiens
FIFDVHVHEV

SEQ ID NO: 3290 - protein, 10 aa, Homo Sapiens
FIFEKKLAQA

SEQ ID NO: 3291 - protein, 10 aa, Homo Sapiens
FIFPASNVYL

SEQ ID NO: 3292 - protein, 10 aa, Homo Sapiens
FIFSEKPVFV

SEQ ID NO: 3293 - protein, 10 aa, Homo Sapiens
FIIEKQPPQV

SEQ ID NO: 3294 - protein, 10 aa, Homo Sapiens
FIMEGPLTRI

SEQ ID NO: 3295 - protein, 10 aa, Homo Sapiens
FIMEGTLTRV

SEQ ID NO: 3296 - protein, 10 aa, Homo Sapiens
FIYHGEVPQA

SEQ ID NO: 3297 - protein, 10 aa, Homo Sapiens
FIYQGKIPIA

SEQ ID NO: 3298 - protein, 10 aa, Homo Sapiens
FLADVDKLKL

SEQ ID NO: 3299 - protein, 10 aa, Homo Sapiens
FLAEDALNTV

SEQ ID NO: 3300 - protein, 10 aa, Homo Sapiens
FLAEDPKVTL

SEQ ID NO: 3301 - protein, 10 aa, Homo Sapiens
FLAEEGFYKF

SEQ ID NO: 3302 - protein, 10 aa, Homo Sapiens
FLAEHPNVTL

SEQ ID NO: 3303 - protein, 10 aa, Homo Sapiens
FLAERLYAEV

SEQ ID NO: 3304 - protein, 10 aa, Homo Sapiens
FLDPNNIPKA

SEQ ID NO: 3305 - protein, 10 aa, Homo Sapiens
FLEGQIHPEL

SEQ ID NO: 3306 - protein, 10 aa, Homo Sapiens
FLFASTILHL

SEQ ID NO: 3307 - protein, 10 aa, Homo Sapiens
FLFDGSPTYV

SEQ ID NO: 3308 - protein, 10 aa, Homo Sapiens
FLFDNDFPAL

SEQ ID NO: 3309 - protein, 10 aa, Homo Sapiens
FLFGEEPSKL

SEQ ID NO: 3310 - protein, 10 aa, Homo Sapiens
FLGEKYIRRV

SEQ ID NO: 3311 - protein, 10 aa, Homo Sapiens
FLGENISNFL

SEQ ID NO: 3312 - protein, 10 aa, Homo Sapiens
FLHDHVDLQV

SEQ ID NO: 3313 - protein, 10 aa, Homo Sapiens
FLIEEQKIVV

SEQ ID NO: 3314 - protein, 10 aa, Homo Sapiens
FLIGILLREV

SEQ ID NO: 3315 - protein, 10 aa, Homo Sapiens
FLIGPKLYEA

SEQ ID NO: 3316 - protein, 10 aa, Homo Sapiens
FLIPFETRQL

SEQ ID NO: 3317 - protein, 10 aa, Homo Sapiens
FLLDGFPRTV

SEQ ID NO: 3318 - protein, 10 aa, Homo Sapiens
FLLDGKVLSL

SEQ ID NO: 3319 - protein, 10 aa, Homo Sapiens
FLLEDDIHVS

SEQ ID NO: 3320 - protein, 10 aa, Homo Sapiens
FLLEPGNLEV

SEQ ID NO: 3321 - protein, 10 aa, Homo Sapiens
FLLGPRLVLA

SEQ ID NO: 3322 - protein, 10 aa, Homo Sapiens
FLLPDGLVRL

SEQ ID NO: 3323 - protein, 10 aa, Homo Sapiens
FLLPHPGLKV

SEQ ID NO: 3324 - protein, 10 aa, Homo Sapiens
FLLPHPGLQV

SEQ ID NO: 3325 - protein, 10 aa, Homo Sapiens
FLLPIKTVGV

SEQ ID NO: 3326 - protein, 10 aa, Homo Sapiens
FLLPLLIEKV

SEQ ID NO: 3327 - protein, 10 aa, Homo Sapiens
FLLPSEVPAL

SEQ ID NO: 3328 - protein, 10 aa, Homo Sapiens
FLLPTGLSSL

SEQ ID NO: 3329 - protein, 10 aa, Homo Sapiens
FLLQINDILL

SEQ ID NO: 3330 - protein, 10 aa, Homo Sapiens
FLLQQHLISA

SEQ ID NO: 3331 - protein, 10 aa, Homo Sapiens
FLLSLRGAGA

SEQ ID NO: 3332 - protein, 10 aa, Homo Sapiens
FLMQYPGRSL

SEQ ID NO: 3333 - protein, 10 aa, Homo Sapiens
FLNEDLEVKI

SEQ ID NO: 3334 - protein, 10 aa, Homo Sapiens
FLPSHSLDTV

SEQ ID NO: 3335 - protein, 10 aa, Homo Sapiens
FLQEEPGQLL

SEQ ID NO: 3336 - protein, 10 aa, Homo Sapiens
FLQEGDLISA

SEQ ID NO: 3337 - protein, 10 aa, Homo Sapiens
FLQENTHVRL

SEQ ID NO: 3338 - protein, 10 aa, Homo Sapiens
FLRDMPDPLL

SEQ ID NO: 3339 - protein, 10 aa, Homo Sapiens
FLSDGTIISV

SEQ ID NO: 3340 - protein, 10 aa, Homo Sapiens
FLSEHPNVTL

SEQ ID NO: 3341 - protein, 10 aa, Homo Sapiens
FLSTLHEVYL

SEQ ID NO: 3342 - protein, 10 aa, Homo Sapiens
FLTDMPDILL

SEQ ID NO: 3343 - protein, 10 aa, Homo Sapiens
FLTEIENLFL

SEQ ID NO: 3344 - protein, 10 aa, Homo Sapiens
FLVDGPRVQL

SEQ ID NO: 3345 - protein, 10 aa, Homo Sapiens
FLVEEEDLFL

SEQ ID NO: 3346 - protein, 10 aa, Homo Sapiens
FLVEKQPPQV

SEQ ID NO: 3347 - protein, 10 aa, Homo Sapiens
FLVSSDLTYV

SEQ ID NO: 3348 - protein, 10 aa, Homo Sapiens
FLWDEGFHQL

SEQ ID NO: 3349 - protein, 10 aa, Homo Sapiens
FLWERPTLLV

SEQ ID NO: 3350 - protein, 10 aa, Homo Sapiens
FLWEYGDLHL

SEQ ID NO: 3351 - protein, 10 aa, Homo Sapiens
FLWPGLNVPL

SEQ ID NO: 3352 - protein, 10 aa, Homo Sapiens
FLWTEKFPSL

SEQ ID NO: 3353 - protein, 10 aa, Homo Sapiens
FLWVGATPHL

SEQ ID NO: 3354 - protein, 10 aa, Homo Sapiens
FLYAAQPELL

SEQ ID NO: 3355 - protein, 10 aa, Homo Sapiens
FLYIGDIVSL

SEQ ID NO: 3356 - protein, 10 aa, Homo Sapiens
FLYKEKLVSV

SEQ ID NO: 3357 - protein, 10 aa, Homo Sapiens
FLYPFPLALF

SEQ ID NO: 3358 - protein, 10 aa, Homo Sapiens
FLYQRLVVGA

SEQ ID NO: 3359 - protein, 10 aa, Homo Sapiens
FMDPQKMPYL

SEQ ID NO: 3360 - protein, 10 aa, Homo Sapiens
FMFDEKLVTV

SEQ ID NO: 3361 - protein, 10 aa, Homo Sapiens
FMQDPMEIFV

SEQ ID NO: 3362 - protein, 10 aa, Homo Sapiens
FMQDPMEVFV

SEQ ID NO: 3363 - protein, 10 aa, Homo Sapiens
FMYNFQLVTL

SEQ ID NO: 3364 - protein, 10 aa, Homo Sapiens
FQWDSDNIYL

SEQ ID NO: 3365 - protein, 10 aa, Homo Sapiens
FVADEGICYL

SEQ ID NO: 3366 - protein, 10 aa, Homo Sapiens
FVDKTVLPFV

SEQ ID NO: 3367 - protein, 10 aa, Homo Sapiens
FVDPNGKISL

SEQ ID NO: 3368 - protein, 10 aa, Homo Sapiens
FVFDRPLPVS

SEQ ID NO: 3369 - protein, 10 aa, Homo Sapiens
FVMEGEPPKL

SEQ ID NO: 3370 - protein, 10 aa, Homo Sapiens
GIFGGHIRSV

SEQ ID NO: 3371 - protein, 10 aa, Homo Sapiens
GIIDGVIQMV

SEQ ID NO: 3372 - protein, 10 aa, Homo Sapiens
GILGIQPPSV

SEQ ID NO: 3373 - protein, 10 aa, Homo Sapiens
GLAAGGIVAV

SEQ ID NO: 3374 - protein, 10 aa, Homo Sapiens
GLAPFLLNAV

SEQ ID NO: 3375 - protein, 10 aa, Homo Sapiens
GLAPGGLAVV

SEQ ID NO: 3376 - protein, 10 aa, Homo Sapiens
GLDDIKDLKV

SEQ ID NO: 3377 - protein, 10 aa, Homo Sapiens
GLIDVKPLGV

SEQ ID NO: 3378 - protein, 10 aa, Homo Sapiens
GLIEWLENTV

SEQ ID NO: 3379 - protein, 10 aa, Homo Sapiens
GLIGVGLINV

SEQ ID NO: 3380 - protein, 10 aa, Homo Sapiens
GLLGDIAIHL

SEQ ID NO: 3381 - protein, 10 aa, Homo Sapiens
GLLNRPNPLL

SEQ ID NO: 3382 - protein, 10 aa, Homo Sapiens
GLLPGCVYHV

SEQ ID NO: 3383 - protein, 10 aa, Homo Sapiens
GLMGAGIAQV

SEQ ID NO: 3384 - protein, 10 aa, Homo Sapiens
GLPRFGIEMV

SEQ ID NO: 3385 - protein, 10 aa, Homo Sapiens
GLSPLRPPSV

SEQ ID NO: 3386 - protein, 10 aa, Homo Sapiens
GLSTEGIYRV

SEQ ID NO: 3387 - protein, 10 aa, Homo Sapiens
GLTGQRLLGV

SEQ ID NO: 3388 - protein, 10 aa, Homo Sapiens
GLVKEGLVMV

SEQ ID NO: 3389 - protein, 10 aa, Homo Sapiens
GLWGQSVPTA

SEQ ID NO: 3390 - protein, 10 aa, Homo Sapiens
GLWHGMFANV

SEQ ID NO: 3391 - protein, 10 aa, Homo Sapiens
GLYDGPVCEV

SEQ ID NO: 3392 - protein, 10 aa, Homo Sapiens
GLYEFPLNKV

SEQ ID NO: 3393 - protein, 10 aa, Homo Sapiens
GLYEGLDWLA

SEQ ID NO: 3394 - protein, 10 aa, Homo Sapiens
GMASLNLPAV

SEQ ID NO: 3395 - protein, 10 aa, Homo Sapiens
GMFKNLLKEV

SEQ ID NO: 3396 - protein, 10 aa, Homo Sapiens
GQFPSYLETV

SEQ ID NO: 3397 - protein, 10 aa, Homo Sapiens
GVIDGHIYAV

SEQ ID NO: 3398 - protein, 10 aa, Homo Sapiens
HLLDFPNIVI

SEQ ID NO: 3399 - protein, 10 aa, Homo Sapiens
HLLPGDELYL

SEQ ID NO: 3400 - protein, 10 aa, Homo Sapiens
HLLPTAPTTV

SEQ ID NO: 3401 - protein, 10 aa, Homo Sapiens
HLLSGQLPTI

SEQ ID NO: 3402 - protein, 10 aa, Homo Sapiens
ILAPCKLETV

SEQ ID NO: 3403 - protein, 10 aa, Homo Sapiens
ILEEGKEILV

SEQ ID NO: 3404 - protein, 10 aa, Homo Sapiens
ILFDHMVPLV

SEQ ID NO: 3405 - protein, 10 aa, Homo Sapiens
ILFPDIIARA

SEQ ID NO: 3406 - protein, 10 aa, Homo Sapiens
ILIDLRRGCA

SEQ ID NO: 3407 - protein, 10 aa, Homo Sapiens
ILLDISFPGL

SEQ ID NO: 3408 - protein, 10 aa, Homo Sapiens
ILLDKLLIRL

SEQ ID NO: 3409 - protein, 10 aa, Homo Sapiens
ILLDNDHYAM

SEQ ID NO: 3410 - protein, 10 aa, Homo Sapiens
ILLSGASPFL

SEQ ID NO: 3411 - protein, 10 aa, Homo Sapiens
ILMSYDHVEL

SEQ ID NO: 3412 - protein, 10 aa, Homo Sapiens
ILNEFPGHGL

SEQ ID NO: 3413 - protein, 10 aa, Homo Sapiens
ILQDLQPFLV

SEQ ID NO: 3414 - protein, 10 aa, Homo Sapiens
ILSGIGVSQV

SEQ ID NO: 3415 - protein, 10 aa, Homo Sapiens
ILSHINTVFV

SEQ ID NO: 3416 - protein, 10 aa, Homo Sapiens
ILWSERPTKV

SEQ ID NO: 3417 - protein, 10 aa, Homo Sapiens
ILYDIPDIRL

SEQ ID NO: 3418 - protein, 10 aa, Homo Sapiens
IMLKGDNITL

SEQ ID NO: 3419 - protein, 10 aa, Homo Sapiens
KIFDEILVNA

SEQ ID NO: 3420 - protein, 10 aa, Homo Sapiens
KIFQELVEGV

SEQ ID NO: 3421 - protein, 10 aa, Homo Sapiens
KIFSGVFVKV

SEQ ID NO: 3422 - protein, 10 aa, Homo Sapiens
KIFTEDLPEV

SEQ ID NO: 3423 - protein, 10 aa, Homo Sapiens
KIGDFGLATV

SEQ ID NO: 3424 - protein, 10 aa, Homo Sapiens
KILEDIGLYL

SEQ ID NO: 3425 - protein, 10 aa, Homo Sapiens
KIMDATNILV

SEQ ID NO: 3426 - protein, 10 aa, Homo Sapiens
KIVSEIRGKV

SEQ ID NO: 3427 - protein, 10 aa, Homo Sapiens
KIWDVSVNSV

SEQ ID NO: 3428 - protein, 10 aa, Homo Sapiens
KLADIQIEQL

SEQ ID NO: 3429 - protein, 10 aa, Homo Sapiens
KLADISINYV

SEQ ID NO: 3430 - protein, 10 aa, Homo Sapiens
KLAELKQECL

SEQ ID NO: 3431 - protein, 10 aa, Homo Sapiens
KLAENIDAQL

SEQ ID NO: 3432 - protein, 10 aa, Homo Sapiens
KLFEGLKFFL

SEQ ID NO: 3433 - protein, 10 aa, Homo Sapiens
KLFPQETLFL

SEQ ID NO: 3434 - protein, 10 aa, Homo Sapiens
KLFTNDCIFL

SEQ ID NO: 3435 - protein, 10 aa, Homo Sapiens
KLHDVELHQV

SEQ ID NO: 3436 - protein, 10 aa, Homo Sapiens
KLIDGQVIQL

SEQ ID NO: 3437 - protein, 10 aa, Homo Sapiens
KLIEKLDIKL

SEQ ID NO: 3438 - protein, 10 aa, Homo Sapiens
KLIQLPVVYV

SEQ ID NO: 3439 - protein, 10 aa, Homo Sapiens
KLKPGDLVGV

SEQ ID NO: 3440 - protein, 10 aa, Homo Sapiens
KLLDEAIQAV

SEQ ID NO: 3441 - protein, 10 aa, Homo Sapiens
KLLDFQEFTL

SEQ ID NO: 3442 - protein, 10 aa, Homo Sapiens
KLLDIPGLEV

SEQ ID NO: 3443 - protein, 10 aa, Homo Sapiens
KLLDPEDISV

SEQ ID NO: 3444 - protein, 10 aa, Homo Sapiens
KLLEEQGIFL

SEQ ID NO: 3445 - protein, 10 aa, Homo Sapiens
KLLEGQVIQL

SEQ ID NO: 3446 - protein, 10 aa, Homo Sapiens
KLLEPVPVSV

SEQ ID NO: 3447 - protein, 10 aa, Homo Sapiens
KLLEVNGVAL

SEQ ID NO: 3448 - protein, 10 aa, Homo Sapiens
KLLEVQILEV

SEQ ID NO: 3449 - protein, 10 aa, Homo Sapiens
KLLEVVQPCL

SEQ ID NO: 3450 - protein, 10 aa, Homo Sapiens
KLMDLDVEQL

SEQ ID NO: 3451 - protein, 10 aa, Homo Sapiens
KLQEFELPYV

SEQ ID NO: 3452 - protein, 10 aa, Homo Sapiens
KLTDQTLIYL

SEQ ID NO: 3453 - protein, 10 aa, Homo Sapiens
KLTDVGIATL

SEQ ID NO: 3454 - protein, 10 aa, Homo Sapiens
KLVEFDFLGA

SEQ ID NO: 3455 - protein, 10 aa, Homo Sapiens
KLWDIINVNI

SEQ ID NO: 3456 - protein, 10 aa, Homo Sapiens
KLWDISEVMV

SEQ ID NO: 3457 - protein, 10 aa, Homo Sapiens
KLWDNELQYV

SEQ ID NO: 3458 - protein, 10 aa, Homo Sapiens
KLWEFFQVDV

SEQ ID NO: 3459 - protein, 10 aa, Homo Sapiens
KLWEMDNMLI

SEQ ID NO: 3460 - protein, 10 aa, Homo Sapiens
KLYDIDVAKV

SEQ ID NO: 3461 - protein, 10 aa, Homo Sapiens
KLYESLLPFA

SEQ ID NO: 3462 - protein, 10 aa, Homo Sapiens
KLYHQWLSTV

SEQ ID NO: 3463 - protein, 10 aa, Homo Sapiens
KLYNPENIYL

SEQ ID NO: 3464 - protein, 10 aa, Homo Sapiens
KLYPQLPAEI

SEQ ID NO: 3465 - protein, 10 aa, Homo Sapiens
KMFESFIESV

SEQ ID NO: 3466 - protein, 10 aa, Homo Sapiens
KMLDEILLQL

SEQ ID NO: 3467 - protein, 10 aa, Homo Sapiens
KMLEIDPQKV

SEQ ID NO: 3468 - protein, 10 aa, Homo Sapiens
KMYEEFLSKV

SEQ ID NO: 3469 - protein, 10 aa, Homo Sapiens
KQLDDLKVEL

SEQ ID NO: 3470 - protein, 10 aa, Homo Sapiens
KQMEQISQFL

SEQ ID NO: 3471 - protein, 10 aa, Homo Sapiens
KQVDFLNWEV

SEQ ID NO: 3472 - protein, 10 aa, Homo Sapiens
KVFDPVPVGV

SEQ ID NO: 3473 - protein, 10 aa, Homo Sapiens
KVGNFKFIYV

SEQ ID NO: 3474 - protein, 10 aa, Homo Sapiens
KVGSFKFIYV

SEQ ID NO: 3475 - protein, 10 aa, Homo Sapiens
KVLDSFCEGL

SEQ ID NO: 3476 - protein, 10 aa, Homo Sapiens
KVPQLEIVPN

SEQ ID NO: 3477 - protein, 10 aa, Homo Sapiens
LDTNADKQLS

SEQ ID NO: 3478 - protein, 10 aa, Homo Sapiens
LFLAILRLSL

SEQ ID NO: 3479 - protein, 10 aa, Homo Sapiens
LGAPGILGLP

SEQ ID NO: 3480 - protein, 10 aa, Homo Sapiens
LGPVRGPFPI

SEQ ID NO: 3481 - protein, 10 aa, Homo Sapiens
LIKEVDIYTV

SEQ ID NO: 3482 - protein, 10 aa, Homo Sapiens
LILEKQPAYV

SEQ ID NO: 3483 - protein, 10 aa, Homo Sapiens
LILPHVDIQL

SEQ ID NO: 3484 - protein, 10 aa, Homo Sapiens
LLAEIGAVTL

SEQ ID NO: 3485 - protein, 10 aa, Homo Sapiens
LLAELREYNL

SEQ ID NO: 3486 - protein, 10 aa, Homo Sapiens
LLDEHGHVRI

SEQ ID NO: 3487 - protein, 10 aa, Homo Sapiens
LLFEADTITL

SEQ ID NO: 3488 - protein, 10 aa, Homo Sapiens
LLFEGEKITI

SEQ ID NO: 3489 - protein, 10 aa, Homo Sapiens
LLFERELHSV

SEQ ID NO: 3490 - protein, 10 aa, Homo Sapiens
LLFGKIGYYL

SEQ ID NO: 3491 - protein, 10 aa, Homo Sapiens
LLFPHPVNQV

SEQ ID NO: 3492 - protein, 10 aa, Homo Sapiens
LLLDTEGFVK

SEQ ID NO: 3493 - protein, 10 aa, Homo Sapiens
LLLDVPTAAV

SEQ ID NO: 3494 - protein, 10 aa, Homo Sapiens
LLLDVTPLSL

SEQ ID NO: 3495 - protein, 10 aa, Homo Sapiens
LLLPPPPCPA

SEQ ID NO: 3496 - protein, 10 aa, Homo Sapiens
LLLSAEPVPA

SEQ ID NO: 3497 - protein, 10 aa, Homo Sapiens
LLPDYYLVTV

SEQ ID NO: 3498 - protein, 10 aa, Homo Sapiens
LLSAAEPVPA

SEQ ID NO: 3499 - protein, 10 aa, Homo Sapiens
LLSHSLLVTL

SEQ ID NO: 3500 - protein, 10 aa, Homo Sapiens
LLWDVPAPSL

SEQ ID NO: 3501 - protein, 10 aa, Homo Sapiens
LLWPGAALLV

SEQ ID NO: 3502 - protein, 10 aa, Homo Sapiens
LLYDDKGVGL

SEQ ID NO: 3503 - protein, 10 aa, Homo Sapiens
LLYDFQLINV

SEQ ID NO: 3504 - protein, 10 aa, Homo Sapiens
LLYEDALYTV

SEQ ID NO: 3505 - protein, 10 aa, Homo Sapiens
LLYEDIPDKV

SEQ ID NO: 3506 - protein, 10 aa, Homo Sapiens
LLYQGPHNTL

SEQ ID NO: 3507 - protein, 10 aa, Homo Sapiens
LMVELLKVFV

SEQ ID NO: 3508 - protein, 10 aa, Homo Sapiens
LTIEDGIFEV

SEQ ID NO: 3509 - protein, 10 aa, Homo Sapiens
MLLEIPYMAA

SEQ ID NO: 3510 - protein, 10 aa, Homo Sapiens
NLLSKVLIYL

SEQ ID NO: 3511 - protein, 10 aa, Homo Sapiens
QLDENANVQL

SEQ ID NO: 3512 - protein, 10 aa, Homo Sapiens
QLEEEGITFV

SEQ ID NO: 3513 - protein, 10 aa, Homo Sapiens
QLHAGSLVSV

SEQ ID NO: 3514 - protein, 10 aa, Homo Sapiens
QLIDYKILGL

SEQ ID NO: 3515 - protein, 10 aa, Homo Sapiens
QVFPGLLERV

SEQ ID NO: 3516 - protein, 10 aa, Homo Sapiens
RIADGLPVAV

SEQ ID NO: 3517 - protein, 10 aa, Homo Sapiens
RIINGIIISV

SEQ ID NO: 3518 - protein, 10 aa, Homo Sapiens
RLADLEALKV

SEQ ID NO: 3519 - protein, 10 aa, Homo Sapiens
RLAQEGIYTL

SEQ ID NO: 3520 - protein, 10 aa, Homo Sapiens
RLDELGGVYL

SEQ ID NO: 3521 - protein, 10 aa, Homo Sapiens
RLFADILNDV

SEQ ID NO: 3522 - protein, 10 aa, Homo Sapiens
RLFNDPVAMV

SEQ ID NO: 3523 - protein, 10 aa, Homo Sapiens
RLFPGAPPTA

SEQ ID NO: 3524 - protein, 10 aa, Homo Sapiens
RLIDDMVAQV

SEQ ID NO: 3525 - protein, 10 aa, Homo Sapiens
RLLAETHYQL

SEQ ID NO: 3526 - protein, 10 aa, Homo Sapiens
RLLDEEISRV

SEQ ID NO: 3527 - protein, 10 aa, Homo Sapiens
RLLDLENIQI

SEQ ID NO: 3528 - protein, 10 aa, Homo Sapiens
RLLEEEGVSL

SEQ ID NO: 3529 - protein, 10 aa, Homo Sapiens
RLLEGYEIYV

SEQ ID NO: 3530 - protein, 10 aa, Homo Sapiens
RLLENMTEVV

SEQ ID NO: 3531 - protein, 10 aa, Homo Sapiens
RLLGNVLVVV

SEQ ID NO: 3532 - protein, 10 aa, Homo Sapiens
RLLILENILL

SEQ ID NO: 3533 - protein, 10 aa, Homo Sapiens
RLMNLPLHSV

SEQ ID NO: 3534 - protein, 10 aa, Homo Sapiens
RLMQGDEICL

SEQ ID NO: 3535 - protein, 10 aa, Homo Sapiens
RLPDIPLRQV

SEQ ID NO: 3536 - protein, 10 aa, Homo Sapiens
RLQEDPPAGV

SEQ ID NO: 3537 - protein, 10 aa, Homo Sapiens
RLQEDPPVGV

SEQ ID NO: 3538 - protein, 10 aa, Homo Sapiens
RLSEFIPAVF

SEQ ID NO: 3539 - protein, 10 aa, Homo Sapiens
RLYPWGVVEV

SEQ ID NO: 3540 - protein, 10 aa, Homo Sapiens
RLYQSNLVLV

SEQ ID NO: 3541 - protein, 10 aa, Homo Sapiens
RMFDGKFVVA

SEQ ID NO: 3542 - protein, 10 aa, Homo Sapiens
RMIKEKLCYV

SEQ ID NO: 3543 - protein, 10 aa, Homo Sapiens
RQYPWGVVQV

SEQ ID NO: 3544 - protein, 10 aa, Homo Sapiens
RVAPEEHPVL

SEQ ID NO: 3545 - protein, 10 aa, Homo Sapiens
RVLDFDPMAV

SEQ ID NO: 3546 - protein, 10 aa, Homo Sapiens
SIMEMQAMEV

SEQ ID NO: 3547 - protein, 10 aa, Homo Sapiens
SIYGGFLLGV

SEQ ID NO: 3548 - protein, 10 aa, Homo Sapiens
SLADLQNDEV

SEQ ID NO: 3549 - protein, 10 aa, Homo Sapiens
SLAELKGFEV

SEQ ID NO: 3550 - protein, 10 aa, Homo Sapiens
SLAETDKITL

SEQ ID NO: 3551 - protein, 10 aa, Homo Sapiens
SLAEVAGLQV

SEQ ID NO: 3552 - protein, 10 aa, Homo Sapiens
SLAPDTRLFV

SEQ ID NO: 3553 - protein, 10 aa, Homo Sapiens
SLEGIPLAQV

SEQ ID NO: 3554 - protein, 10 aa, Homo Sapiens
SLFAGGMLRV

SEQ ID NO: 3555 - protein, 10 aa, Homo Sapiens
SLFAGQPLTI

SEQ ID NO: 3556 - protein, 10 aa, Homo Sapiens
SLFAQRLKTL

SEQ ID NO: 3557 - protein, 10 aa, Homo Sapiens
SLFEKGLKNV

SEQ ID NO: 3558 - protein, 10 aa, Homo Sapiens
SLFGSPPTSV

SEQ ID NO: 3559 - protein, 10 aa, Homo Sapiens
SLFPGKLEVV

SEQ ID NO: 3560 - protein, 10 aa, Homo Sapiens
SLFPHNPQFI

SEQ ID NO: 3561 - protein, 10 aa, Homo Sapiens
SLFSHSLISI

SEQ ID NO: 3562 - protein, 10 aa, Homo Sapiens
SLIEDLILLL

SEQ ID NO: 3563 - protein, 10 aa, Homo Sapiens
SLINVGLISV

SEQ ID NO: 3564 - protein, 10 aa, Homo Sapiens
SLIPEGPPQV

SEQ ID NO: 3565 - protein, 10 aa, Homo Sapiens
SLISIKRLTL

SEQ ID NO: 3566 - protein, 10 aa, Homo Sapiens
SLLDRFLATV

SEQ ID NO: 3567 - protein, 10 aa, Homo Sapiens
SLLDTSSVLV

SEQ ID NO: 3568 - protein, 10 aa, Homo Sapiens
SLLEKELESV

SEQ ID NO: 3569 - protein, 10 aa, Homo Sapiens
SLLEKQQIYL

SEQ ID NO: 3570 - protein, 10 aa, Homo Sapiens
SLLEQGLVEA

SEQ ID NO: 3571 - protein, 10 aa, Homo Sapiens
SLLGGDVVSV

SEQ ID NO: 3572 - protein, 10 aa, Homo Sapiens
SLLGPPPVGV

SEQ ID NO: 3573 - protein, 10 aa, Homo Sapiens
SLLGPSIDSV

SEQ ID NO: 3574 - protein, 10 aa, Homo Sapiens
SLLPEGPPAI

SEQ ID NO: 3575 - protein, 10 aa, Homo Sapiens
SLLPVKPVEI

SEQ ID NO: 3576 - protein, 10 aa, Homo Sapiens
SLLSGRISTL

SEQ ID NO: 3577 - protein, 10 aa, Homo Sapiens
SLLSLLPLFL

SEQ ID NO: 3578 - protein, 10 aa, Homo Sapiens
SLMDHTIPEV

SEQ ID NO: 3579 - protein, 10 aa, Homo Sapiens
SLMEDQVLQL

SEQ ID NO: 3580 - protein, 10 aa, Homo Sapiens
SLMQYETPGF

SEQ ID NO: 3581 - protein, 10 aa, Homo Sapiens
SLPDFGISYV

SEQ ID NO: 3582 - protein, 10 aa, Homo Sapiens
SLQEEKLIYV

SEQ ID NO: 3583 - protein, 10 aa, Homo Sapiens
SLTIDGIYYV

SEQ ID NO: 3584 - protein, 10 aa, Homo Sapiens
SLVQGELVTA

SEQ ID NO: 3585 - protein, 10 aa, Homo Sapiens
SLVYPFPGPI

SEQ ID NO: 3586 - protein, 10 aa, Homo Sapiens
SLYEGIDFYT

SEQ ID NO: 3587 - protein, 10 aa, Homo Sapiens
SLYGHKLPVI

SEQ ID NO: 3588 - protein, 10 aa, Homo Sapiens
SQFQQEFPSL

SEQ ID NO: 3589 - protein, 10 aa, Homo Sapiens
SQYDYILPQV

SEQ ID NO: 3590 - protein, 10 aa, Homo Sapiens
SVAPFALPTV

SEQ ID NO: 3591 - protein, 10 aa, Homo Sapiens
TIPDFIFANV

SEQ ID NO: 3592 - protein, 10 aa, Homo Sapiens
TLAEIAKAEL

SEQ ID NO: 3593 - protein, 10 aa, Homo Sapiens
TLAEIAKVEL

SEQ ID NO: 3594 - protein, 10 aa, Homo Sapiens
TLATDILMGV

SEQ ID NO: 3595 - protein, 10 aa, Homo Sapiens
TLFPGKVHSL

SEQ ID NO: 3596 - protein, 10 aa, Homo Sapiens
TLHGLQQYYV

SEQ ID NO: 3597 - protein, 10 aa, Homo Sapiens
TLIEDEIATI

SEQ ID NO: 3598 - protein, 10 aa, Homo Sapiens
TLIHSDLTSV

SEQ ID NO: 3599 - protein, 10 aa, Homo Sapiens
TLLDGKLVLL

SEQ ID NO: 3600 - protein, 10 aa, Homo Sapiens
TLLEDGTFKV

SEQ ID NO: 3601 - protein, 10 aa, Homo Sapiens
TLLPGEGPFL

SEQ ID NO: 3602 - protein, 10 aa, Homo Sapiens
TLMEQPLTTL

SEQ ID NO: 3603 - protein, 10 aa, Homo Sapiens
TLMNLGGLAV

SEQ ID NO: 3604 - protein, 10 aa, Homo Sapiens
TLNDGVVVQV

SEQ ID NO: 3605 - protein, 10 aa, Homo Sapiens
TLSDGVVVQV

SEQ ID NO: 3606 - protein, 10 aa, Homo Sapiens
TLTEEGVIKV

SEQ ID NO: 3607 - protein, 10 aa, Homo Sapiens
TLYERGFENI

SEQ ID NO: 3608 - protein, 10 aa, Homo Sapiens
TLYPLHILFV

SEQ ID NO: 3609 - protein, 10 aa, Homo Sapiens
TMLHLTDIQL

SEQ ID NO: 3610 - protein, 10 aa, Homo Sapiens
TMQELIGLYV

SEQ ID NO: 3611 - protein, 10 aa, Homo Sapiens
TVYGGYLCSV

SEQ ID NO: 3612 - protein, 10 aa, Homo Sapiens
VLADRGVCLI

SEQ ID NO: 3613 - protein, 10 aa, Homo Sapiens
VLDELKNMKC

SEQ ID NO: 3614 - protein, 10 aa, Homo Sapiens
VLFDDELLMV

SEQ ID NO: 3615 - protein, 10 aa, Homo Sapiens
VLFDVSIMAV

SEQ ID NO: 3616 - protein, 10 aa, Homo Sapiens
VLFEGRTVQL

SEQ ID NO: 3617 - protein, 10 aa, Homo Sapiens
VLFEKEVNEV

SEQ ID NO: 3618 - protein, 10 aa, Homo Sapiens
VLFGAVITGA

SEQ ID NO: 3619 - protein, 10 aa, Homo Sapiens
VLFQEALWHV

SEQ ID NO: 3620 - protein, 10 aa, Homo Sapiens
VLIEGSINSV

SEQ ID NO: 3621 - protein, 10 aa, Homo Sapiens
VLIGEFLEKV

SEQ ID NO: 3622 - protein, 10 aa, Homo Sapiens
VLIKNLLVSV

SEQ ID NO: 3623 - protein, 10 aa, Homo Sapiens
VLINGQMVKL

SEQ ID NO: 3624 - protein, 10 aa, Homo Sapiens
VLIRDLNFEV

SEQ ID NO: 3625 - protein, 10 aa, Homo Sapiens
VLLDYHLNYL

SEQ ID NO: 3626 - protein, 10 aa, Homo Sapiens
VLLEPFVHQV

SEQ ID NO: 3627 - protein, 10 aa, Homo Sapiens
VLLEQPTWQL

SEQ ID NO: 3628 - protein, 10 aa, Homo Sapiens
VLLEYHIAYL

SEQ ID NO: 3629 - protein, 10 aa, Homo Sapiens
VLLHFKHIYL

SEQ ID NO: 3630 - protein, 10 aa, Homo Sapiens
VLLKARLVPA

SEQ ID NO: 3631 - protein, 10 aa, Homo Sapiens
VLLNEILEQV

SEQ ID NO: 3632 - protein, 10 aa, Homo Sapiens
VLLTDILVFL

SEQ ID NO: 3633 - protein, 10 aa, Homo Sapiens
VLMDLKALLL

SEQ ID NO: 3634 - protein, 10 aa, Homo Sapiens
VLMEKPDVVV

SEQ ID NO: 3635 - protein, 10 aa, Homo Sapiens
VLMQDSRLYL

SEQ ID NO: 3636 - protein, 10 aa, Homo Sapiens
VLPNFLPYNV

SEQ ID NO: 3637 - protein, 10 aa, Homo Sapiens
VLVPYEPPQV

SEQ ID NO: 3638 - protein, 10 aa, Homo Sapiens
VLWDRTFSLF

SEQ ID NO: 3639 - protein, 10 aa, Homo Sapiens
VLYEKDIQLF

SEQ ID NO: 3640 - protein, 10 aa, Homo Sapiens
VLYPASPHGV

SEQ ID NO: 3641 - protein, 10 aa, Homo Sapiens
VLYPHEPTAV

SEQ ID NO: 3642 - protein, 10 aa, Homo Sapiens
VMFGGKQVVV

SEQ ID NO: 3643 - protein, 10 aa, Homo Sapiens
VMFRTPLASV

SEQ ID NO: 3644 - protein, 10 aa, Homo Sapiens
VMIAGKVAVV

SEQ ID NO: 3645 - protein, 10 aa, Homo Sapiens
VVPPFLQPEV

SEQ ID NO: 3646 - protein, 10 aa, Homo Sapiens
VYPFPGPIPN

SEQ ID NO: 3647 - protein, 10 aa, Homo Sapiens
WLLPYNGVTV

SEQ ID NO: 3648 - protein, 10 aa, Homo Sapiens
WNVSLFSILL

SEQ ID NO: 3649 - protein, 10 aa, Homo Sapiens
YAYDGKDYIA

SEQ ID NO: 3650 - protein, 10 aa, Homo Sapiens
YIMDNKLAQI

SEQ ID NO: 3651 - protein, 10 aa, Homo Sapiens
YIYDKDMEII

SEQ ID NO: 3652 - protein, 10 aa, Homo Sapiens
YLAEKYEWDV

SEQ ID NO: 3653 - protein, 10 aa, Homo Sapiens
YLAELVTPIL

SEQ ID NO: 3654 - protein, 10 aa, Homo Sapiens
YLARIQGFQV

SEQ ID NO: 3655 - protein, 10 aa, Homo Sapiens
YLATVTGIAV

SEQ ID NO: 3656 - protein, 10 aa, Homo Sapiens
YLDGHLITTV

SEQ ID NO: 3657 - protein, 10 aa, Homo Sapiens
YLDHTADVQL

SEQ ID NO: 3658 - protein, 10 aa, Homo Sapiens
YLDIKGLLDV

SEQ ID NO: 3659 - protein, 10 aa, Homo Sapiens
YLDLFGDPSV

SEQ ID NO: 3660 - protein, 10 aa, Homo Sapiens
YLDPRLAFTV

SEQ ID NO: 3661 - protein, 10 aa, Homo Sapiens
YLDQGTQIFL

SEQ ID NO: 3662 - protein, 10 aa, Homo Sapiens
YLFDIQLPNI

SEQ ID NO: 3663 - protein, 10 aa, Homo Sapiens
YLFDRNGVCL

SEQ ID NO: 3664 - protein, 10 aa, Homo Sapiens
YLFEIRDWRL

SEQ ID NO: 3665 - protein, 10 aa, Homo Sapiens
YLFGERLLEC

SEQ ID NO: 3666 - protein, 10 aa, Homo Sapiens
YLFGKEMYQV

SEQ ID NO: 3667 - protein, 10 aa, Homo Sapiens
YLFPGIPELL

SEQ ID NO: 3668 - protein, 10 aa, Homo Sapiens
YLGLLENVRV

SEQ ID NO: 3669 - protein, 10 aa, Homo Sapiens
YLIDIKTIAI

SEQ ID NO: 3670 - protein, 10 aa, Homo Sapiens
YLIDRDPTYF

SEQ ID NO: 3671 - protein, 10 aa, Homo Sapiens
YLILHLISTV

SEQ ID NO: 3672 - protein, 10 aa, Homo Sapiens
YLINFEIRSL

SEQ ID NO: 3673 - protein, 10 aa, Homo Sapiens
YLIPDIDLKL

SEQ ID NO: 3674 - protein, 10 aa, Homo Sapiens
YLIQSVPAEL

SEQ ID NO: 3675 - protein, 10 aa, Homo Sapiens
YLITGNLEKL

SEQ ID NO: 3676 - protein, 10 aa, Homo Sapiens
YLLDHLHLEL

SEQ ID NO: 3677 - protein, 10 aa, Homo Sapiens
YLLDKETLRL

SEQ ID NO: 3678 - protein, 10 aa, Homo Sapiens
YLLDLHSYLL

SEQ ID NO: 3679 - protein, 10 aa, Homo Sapiens
YLLDMPLWYL

SEQ ID NO: 3680 - protein, 10 aa, Homo Sapiens
YLLDYPNNLL

SEQ ID NO: 3681 - protein, 10 aa, Homo Sapiens
YLLEEILDKV

SEQ ID NO: 3682 - protein, 10 aa, Homo Sapiens
YLLEEKIASL

SEQ ID NO: 3683 - protein, 10 aa, Homo Sapiens
YLLEQDFPGM

SEQ ID NO: 3684 - protein, 10 aa, Homo Sapiens
YLLQEPPRTV

SEQ ID NO: 3685 - protein, 10 aa, Homo Sapiens
YLLTHPPPIM

SEQ ID NO: 3686 - protein, 10 aa, Homo Sapiens
YLMEGSYNKV

SEQ ID NO: 3687 - protein, 10 aa, Homo Sapiens
YLMEQNVTKL

SEQ ID NO: 3688 - protein, 10 aa, Homo Sapiens
YLMNLNIMTV

SEQ ID NO: 3689 - protein, 10 aa, Homo Sapiens
YLMQNWEHVL

SEQ ID NO: 3690 - protein, 10 aa, Homo Sapiens
YLNDLHEVLL

SEQ ID NO: 3691 - protein, 10 aa, Homo Sapiens
YLQEVPILTL

SEQ ID NO: 3692 - protein, 10 aa, Homo Sapiens
YLSDIPLHDA

SEQ ID NO: 3693 - protein, 10 aa, Homo Sapiens
YLSHNGIEVI

SEQ ID NO: 3694 - protein, 10 aa, Homo Sapiens
YLTNEGIQYL

SEQ ID NO: 3695 - protein, 10 aa, Homo Sapiens
YLTTLRALYL

SEQ ID NO: 3696 - protein, 10 aa, Homo Sapiens
YLVEINKILL

SEQ ID NO: 3697 - protein, 10 aa, Homo Sapiens
YLVGDELWVV

SEQ ID NO: 3698 - protein, 10 aa, Homo Sapiens
YLWDLDHGFA

SEQ ID NO: 3699 - protein, 10 aa, Homo Sapiens
YLWEHIFEGL

SEQ ID NO: 3700 - protein, 10 aa, Homo Sapiens
YLWHIPLSYV

SEQ ID NO: 3701 - protein, 10 aa, Homo Sapiens
YLYGQTTTYL

SEQ ID NO: 3702 - protein, 10 aa, Homo Sapiens
YLYPIKNLEM

SEQ ID NO: 3703 - protein, 10 aa, Homo Sapiens
YLYSNKLQSL

SEQ ID NO: 3704 - protein, 10 aa, Homo Sapiens
YMFEEVPIVI

SEQ ID NO: 3705 - protein, 10 aa, Homo Sapiens
YMFPDTMLQA

SEQ ID NO: 3706 - protein, 10 aa, Homo Sapiens
YMIDNVILLI

SEQ ID NO: 3707 - protein, 10 aa, Homo Sapiens
YMLPDGTYCL

SEQ ID NO: 3708 - protein, 10 aa, Homo Sapiens
YVFENTVATV

SEQ ID NO: 3709 - protein, 10 aa, Homo Sapiens
YVLEDLEVTV

SEQ ID NO: 3710 - protein, 10 aa, Homo Sapiens
YVMEYRELFL

SEQ ID NO: 3711 - protein, 10 aa, Homo Sapiens
YVYDKDIEQI

SEQ ID NO: 3712 - protein, 11 aa, Homo Sapiens
AALEEADKMFL

SEQ ID NO: 3713 - protein, 11 aa, Homo Sapiens
AIAPCEVTVPA

SEQ ID NO: 3714 - protein, 11 aa, Homo Sapiens
AILGITESFQV

SEQ ID NO: 3715 - protein, 11 aa, Homo Sapiens
ALAAPDIVPAL

SEQ ID NO: 3716 - protein, 11 aa, Homo Sapiens
ALADKELLPSV

SEQ ID NO: 3717 - protein, 11 aa, Homo Sapiens
ALADLQEAVKL

SEQ ID NO: 3718 - protein, 11 aa, Homo Sapiens
ALDPLADKILI

SEQ ID NO: 3719 - protein, 11 aa, Homo Sapiens
ALDRQTATQLL

SEQ ID NO: 3720 - protein, 11 aa, Homo Sapiens
ALDTLEDDMTI

SEQ ID NO: 3721 - protein, 11 aa, Homo Sapiens
ALFARPDLLLL

SEQ ID NO: 3722 - protein, 11 aa, Homo Sapiens
ALFASGLIHRV

SEQ ID NO: 3723 - protein, 11 aa, Homo Sapiens
ALFEESGLIRI

SEQ ID NO: 3724 - protein, 11 aa, Homo Sapiens
ALFEQKGPVYV

SEQ ID NO: 3725 - protein, 11 aa, Homo Sapiens
ALFGSDDCLSV

SEQ ID NO: 3726 - protein, 11 aa, Homo Sapiens
ALFPHLLQPVL

SEQ ID NO: 3727 - protein, 11 aa, Homo Sapiens
ALFPVAEDISL

SEQ ID NO: 3728 - protein, 11 aa, Homo Sapiens
ALGEEALLRYV

SEQ ID NO: 3729 - protein, 11 aa, Homo Sapiens
ALGFYPAEITL

SEQ ID NO: 3730 - protein, 11 aa, Homo Sapiens
ALIEAEKVAQV

SEQ ID NO: 3731 - protein, 11 aa, Homo Sapiens
ALIEVPDGFTA

SEQ ID NO: 3732 - protein, 11 aa, Homo Sapiens
ALILEPSLYTV

SEQ ID NO: 3733 - protein, 11 aa, Homo Sapiens
ALINNIVEIRV

SEQ ID NO: 3734 - protein, 11 aa, Homo Sapiens
ALKRQGRTLYG

SEQ ID NO: 3735 - protein, 11 aa, Homo Sapiens
ALLAGSEYLKL

SEQ ID NO: 3736 - protein, 11 aa, Homo Sapiens
ALLDVSNNYGI

SEQ ID NO: 3737 - protein, 11 aa, Homo Sapiens
ALLEADVNIKL

SEQ ID NO: 3738 - protein, 11 aa, Homo Sapiens
ALLEENSTPQL

SEQ ID NO: 3739 - protein, 11 aa, Homo Sapiens
ALLEKPGELSL

SEQ ID NO: 3740 - protein, 11 aa, Homo Sapiens
ALLENMEGLFL

SEQ ID NO: 3741 - protein, 11 aa, Homo Sapiens
ALLEPEFILKA

SEQ ID NO: 3742 - protein, 11 aa, Homo Sapiens
ALLGAGCDPEL

SEQ ID NO: 3743 - protein, 11 aa, Homo Sapiens
ALLGGNVRMML

SEQ ID NO: 3744 - protein, 11 aa, Homo Sapiens
ALLGKLDAINV

SEQ ID NO: 3745 - protein, 11 aa, Homo Sapiens
ALLKNPKILLL

SEQ ID NO: 3746 - protein, 11 aa, Homo Sapiens
ALLNGEYLLAA

SEQ ID NO: 3747 - protein, 11 aa, Homo Sapiens
ALMEQVAHQTI

SEQ ID NO: 3748 - protein, 11 aa, Homo Sapiens
ALNEEAGRLLL

SEQ ID NO: 3749 - protein, 11 aa, Homo Sapiens
ALPEVLAVIQV

SEQ ID NO: 3750 - protein, 11 aa, Homo Sapiens
ALQEAIDAIFL

SEQ ID NO: 3751 - protein, 11 aa, Homo Sapiens
ALSEAMGLFCL

SEQ ID NO: 3752 - protein, 11 aa, Homo Sapiens
ALSEEGLLVYL

SEQ ID NO: 3753 - protein, 11 aa, Homo Sapiens
ALSNSDVIRQV

SEQ ID NO: 3754 - protein, 11 aa, Homo Sapiens
ALWDIETGQQT

SEQ ID NO: 3755 - protein, 11 aa, Homo Sapiens
ALWENPESGEL

SEQ ID NO: 3756 - protein, 11 aa, Homo Sapiens
ALYLGAKAIQL

SEQ ID NO: 3757 - protein, 11 aa, Homo Sapiens
ALYNDISHMKI

SEQ ID NO: 3758 - protein, 11 aa, Homo Sapiens
AMASLGALALL

SEQ ID NO: 3759 - protein, 11 aa, Homo Sapiens
AMFESSQNVLL

SEQ ID NO: 3760 - protein, 11 aa, Homo Sapiens
AMLENASDIKL

SEQ ID NO: 3761 - protein, 11 aa, Homo Sapiens
AMSNLVPPVEL

SEQ ID NO: 3762 - protein, 11 aa, Homo Sapiens
AQAEVYKELRL

SEQ ID NO: 3763 - protein, 11 aa, Homo Sapiens
AVLDGADCIML

SEQ ID NO: 3764 - protein, 11 aa, Homo Sapiens
AVMAPRTLVLL

SEQ ID NO: 3765 - protein, 11 aa, Homo Sapiens
CLIKEVDIYTV

SEQ ID NO: 3766 - protein, 11 aa, Homo Sapiens
CLYELPENIRV

SEQ ID NO: 3767 - protein, 11 aa, Homo Sapiens
CLYPHIDKQYL

SEQ ID NO: 3768 - protein, 11 aa, Homo Sapiens
DAAHGAWILII

SEQ ID NO: 3769 - protein, 11 aa, Homo Sapiens
FIDVGLAGGAV

SEQ ID NO: 3770 - protein, 11 aa, Homo Sapiens
FIWKSGGDLTL

SEQ ID NO: 3771 - protein, 11 aa, Homo Sapiens
FLADPSAFVAA

SEQ ID NO: 3772 - protein, 11 aa, Homo Sapiens
FLAEGLRNENL

SEQ ID NO: 3773 - protein, 11 aa, Homo Sapiens
FLAELPGSLSL

SEQ ID NO: 3774 - protein, 11 aa, Homo Sapiens
FLAHDQAVRTL

SEQ ID NO: 3775 - protein, 11 aa, Homo Sapiens
FLAPDNSLLLA

SEQ ID NO: 3776 - protein, 11 aa, Homo Sapiens
FLASESLIKQI

SEQ ID NO: 3777 - protein, 11 aa, Homo Sapiens
FLDPGGPMMKL

SEQ ID NO: 3778 - protein, 11 aa, Homo Sapiens
FLDPHTTQTFV

SEQ ID NO: 3779 - protein, 11 aa, Homo Sapiens
FLFDCPGQVEL

SEQ ID NO: 3780 - protein, 11 aa, Homo Sapiens
FLFDGSPTYVL

SEQ ID NO: 3781 - protein, 11 aa, Homo Sapiens
FLFDIPKILDL

SEQ ID NO: 3782 - protein, 11 aa, Homo Sapiens
FLFEPVVKAFL

SEQ ID NO: 3783 - protein, 11 aa, Homo Sapiens
FLFNTENKLLL

SEQ ID NO: 3784 - protein, 11 aa, Homo Sapiens
FLFVDPELVSA

SEQ ID NO: 3785 - protein, 11 aa, Homo Sapiens
FLGCIGAVNEV

SEQ ID NO: 3786 - protein, 11 aa, Homo Sapiens
FLHDDNMNFRV

SEQ ID NO: 3787 - protein, 11 aa, Homo Sapiens
FLHEESILERV

SEQ ID NO: 3788 - protein, 11 aa, Homo Sapiens
FLIEPEHVNTV

SEQ ID NO: 3789 - protein, 11 aa, Homo Sapiens
FLIILPKELQA

SEQ ID NO: 3790 - protein, 11 aa, Homo Sapiens
FLINSSGDIFL

SEQ ID NO: 3791 - protein, 11 aa, Homo Sapiens
FLLDKPQDLSI

SEQ ID NO: 3792 - protein, 11 aa, Homo Sapiens
FLLDPVKGERL

SEQ ID NO: 3793 - protein, 11 aa, Homo Sapiens
FLLDPYKYMTL

SEQ ID NO: 3794 - protein, 11 aa, Homo Sapiens
FLLEQEKTQAL

SEQ ID NO: 3795 - protein, 11 aa, Homo Sapiens
FLLFEGEKITI

SEQ ID NO: 3796 - protein, 11 aa, Homo Sapiens
FLLGPEGQHLL

SEQ ID NO: 3797 - protein, 11 aa, Homo Sapiens
FLLLPDAEAQL

SEQ ID NO: 3798 - protein, 11 aa, Homo Sapiens
FLLPHPGLKVA

SEQ ID NO: 3799 - protein, 11 aa, Homo Sapiens
FLLPKVQSIQL

SEQ ID NO: 3800 - protein, 11 aa, Homo Sapiens
FLLRVGADPAL

SEQ ID NO: 3801 - protein, 11 aa, Homo Sapiens
FLMENGSITSI

SEQ ID NO: 3802 - protein, 11 aa, Homo Sapiens
FLMKNSDLYGA

SEQ ID NO: 3803 - protein, 11 aa, Homo Sapiens
FLMRVMDIPYL

SEQ ID NO: 3804 - protein, 11 aa, Homo Sapiens
FLPDPSALQNL

SEQ ID NO: 3805 - protein, 11 aa, Homo Sapiens
FLPETRIMTSV

SEQ ID NO: 3806 - protein, 11 aa, Homo Sapiens
FLPPEHTIVYI

SEQ ID NO: 3807 - protein, 11 aa, Homo Sapiens
FLSDAEIIQLV

SEQ ID NO: 3808 - protein, 11 aa, Homo Sapiens
FLSEEGGHVAV

SEQ ID NO: 3809 - protein, 11 aa, Homo Sapiens
FLSEVWNTHTL

SEQ ID NO: 3810 - protein, 11 aa, Homo Sapiens
FLTDSNNIKEV

SEQ ID NO: 3811 - protein, 11 aa, Homo Sapiens
FLVEPQEDTRL

SEQ ID NO: 3812 - protein, 11 aa, Homo Sapiens
FLVPIESIERA

SEQ ID NO: 3813 - protein, 11 aa, Homo Sapiens
FLWDPAKRTSV

SEQ ID NO: 3814 - protein, 11 aa, Homo Sapiens
FLWDVPSNWTL

SEQ ID NO: 3815 - protein, 11 aa, Homo Sapiens
FLWEYGDLHLF

SEQ ID NO: 3816 - protein, 11 aa, Homo Sapiens
FLWQEGHSAFA

SEQ ID NO: 3817 - protein, 11 aa, Homo Sapiens
FLYDHIQPVRA

SEQ ID NO: 3818 - protein, 11 aa, Homo Sapiens
FMIDASVHPTL

SEQ ID NO: 3819 - protein, 11 aa, Homo Sapiens
FMLETVDSVKL

SEQ ID NO: 3820 - protein, 11 aa, Homo Sapiens
FMLPDPQNISL

SEQ ID NO: 3821 - protein, 11 aa, Homo Sapiens
FQFVGIENIHV

SEQ ID NO: 3822 - protein, 11 aa, Homo Sapiens
FQHEENLLQQV

SEQ ID NO: 3823 - protein, 11 aa, Homo Sapiens
FVQEVVQSQQV

SEQ ID NO: 3824 - protein, 11 aa, Homo Sapiens
FVQPFGPQYEV

SEQ ID NO: 3825 - protein, 11 aa, Homo Sapiens
FVYDPLVDWTA

SEQ ID NO: 3826 - protein, 11 aa, Homo Sapiens
GILTKELLHSV

SEQ ID NO: 3827 - protein, 11 aa, Homo Sapiens
GLADASLLKKV

SEQ ID NO: 3828 - protein, 11 aa, Homo Sapiens
GLADNTVIAKV

SEQ ID NO: 3829 - protein, 11 aa, Homo Sapiens
GLAPPQHLIRV

SEQ ID NO: 3830 - protein, 11 aa, Homo Sapiens
GLDNAVSLFQV

SEQ ID NO: 3831 - protein, 11 aa, Homo Sapiens
GLDPLGYEIQL

SEQ ID NO: 3832 - protein, 11 aa, Homo Sapiens
GLDPQGDRSFL

SEQ ID NO: 3833 - protein, 11 aa, Homo Sapiens
GLDSNLKYILV

SEQ ID NO: 3834 - protein, 11 aa, Homo Sapiens
GLFERDKLIFL

SEQ ID NO: 3835 - protein, 11 aa, Homo Sapiens
GLFHLGEFVNV

SEQ ID NO: 3836 - protein, 11 aa, Homo Sapiens
GLFTLSHITQL

SEQ ID NO: 3837 - protein, 11 aa, Homo Sapiens
GLGEGFQTVRV

SEQ ID NO: 3838 - protein, 11 aa, Homo Sapiens
GLIDIENPNRV

SEQ ID NO: 3839 - protein, 11 aa, Homo Sapiens
GLIDTKELEPL

SEQ ID NO: 3840 - protein, 11 aa, Homo Sapiens
GLIEDHFDVTV

SEQ ID NO: 3841 - protein, 11 aa, Homo Sapiens
GLIPIHADPRL

SEQ ID NO: 3842 - protein, 11 aa, Homo Sapiens
GLISFSDYIFL

SEQ ID NO: 3843 - protein, 11 aa, Homo Sapiens
GLLAGDRLVEV

SEQ ID NO: 3844 - protein, 11 aa, Homo Sapiens
GLLDGGVDILL

SEQ ID NO: 3845 - protein, 11 aa, Homo Sapiens
GLLDLPFRVGV

SEQ ID NO: 3846 - protein, 11 aa, Homo Sapiens
GLLESRLDPYL

SEQ ID NO: 3847 - protein, 11 aa, Homo Sapiens
GLLGPFSFLLL

SEQ ID NO: 3848 - protein, 11 aa, Homo Sapiens
GLLPEHFLFLA

SEQ ID NO: 3849 - protein, 11 aa, Homo Sapiens
GLLPEPNILQL

SEQ ID NO: 3850 - protein, 11 aa, Homo Sapiens
GLLPSKIRINL

SEQ ID NO: 3851 - protein, 11 aa, Homo Sapiens
GLLQINDKIAL

SEQ ID NO: 3852 - protein, 11 aa, Homo Sapiens
GLLQQPSALML

SEQ ID NO: 3853 - protein, 11 aa, Homo Sapiens
GLLYPTEDYKV

SEQ ID NO: 3854 - protein, 11 aa, Homo Sapiens
GLMDEKLLHNV

SEQ ID NO: 3855 - protein, 11 aa, Homo Sapiens
GLTSTDLLFHL

SEQ ID NO: 3856 - protein, 11 aa, Homo Sapiens
GLWEDGRSTLL

SEQ ID NO: 3857 - protein, 11 aa, Homo Sapiens
GLWEIENNPTV

SEQ ID NO: 3858 - protein, 11 aa, Homo Sapiens
GLWGPEEEPHL

SEQ ID NO: 3859 - protein, 11 aa, Homo Sapiens
GLYDSQNPPTV

SEQ ID NO: 3860 - protein, 11 aa, Homo Sapiens
GMWNPNAPVFL

SEQ ID NO: 3861 - protein, 11 aa, Homo Sapiens
GMYGKIAVMEL

SEQ ID NO: 3862 - protein, 11 aa, Homo Sapiens
GQSELASRLTL

SEQ ID NO: 3863 - protein, 11 aa, Homo Sapiens
GVAESIHLWEV

SEQ ID NO: 3864 - protein, 11 aa, Homo Sapiens
GVAPSRAIYFA

SEQ ID NO: 3865 - protein, 11 aa, Homo Sapiens
GVLEMERLHYI

SEQ ID NO: 3866 - protein, 11 aa, Homo Sapiens
HAVYRDDLKKL

SEQ ID NO: 3867 - protein, 11 aa, Homo Sapiens
HEQLSVAEITN

SEQ ID NO: 3868 - protein, 11 aa, Homo Sapiens
HLFEDAYLLTL

SEQ ID NO: 3869 - protein, 11 aa, Homo Sapiens
HLLGEGAFAQV

SEQ ID NO: 3870 - protein, 11 aa, Homo Sapiens
HLMEENMIVYV

SEQ ID NO: 3871 - protein, 11 aa, Homo Sapiens
HLYSSIEHLTT

SEQ ID NO: 3872 - protein, 11 aa, Homo Sapiens
HVYDGKFLARV

SEQ ID NO: 3873 - protein, 11 aa, Homo Sapiens
IDVNMGEVLLV

SEQ ID NO: 3874 - protein, 11 aa, Homo Sapiens
IILEEGKEILV

SEQ ID NO: 3875 - protein, 11 aa, Homo Sapiens
ILDDTAKNLRV

SEQ ID NO: 3876 - protein, 11 aa, Homo Sapiens
ILDEMSHKLRL

SEQ ID NO: 3877 - protein, 11 aa, Homo Sapiens
ILENPPEEMKL

SEQ ID NO: 3878 - protein, 11 aa, Homo Sapiens
ILFDCPGQIEL

SEQ ID NO: 3879 - protein, 11 aa, Homo Sapiens
ILGPPPPSFHL

SEQ ID NO: 3880 - protein, 11 aa, Homo Sapiens
ILIEKEYLERV

SEQ ID NO: 3881 - protein, 11 aa, Homo Sapiens
ILINDAGEVRL

SEQ ID NO: 3882 - protein, 11 aa, Homo Sapiens
ILISVDGKVYL

SEQ ID NO: 3883 - protein, 11 aa, Homo Sapiens
ILLAEGRLVNL

SEQ ID NO: 3884 - protein, 11 aa, Homo Sapiens
ILLDDHGHIRI

SEQ ID NO: 3885 - protein, 11 aa, Homo Sapiens
ILLDDNMQIRL

SEQ ID NO: 3886 - protein, 11 aa, Homo Sapiens
ILLDDQFQPKL

SEQ ID NO: 3887 - protein, 11 aa, Homo Sapiens
ILLDDTGLAYI

SEQ ID NO: 3888 - protein, 11 aa, Homo Sapiens
ILLDEEGHIKI

SEQ ID NO: 3889 - protein, 11 aa, Homo Sapiens
ILLDERGQIKL

SEQ ID NO: 3890 - protein, 11 aa, Homo Sapiens
ILLDHEKEWKL

SEQ ID NO: 3891 - protein, 11 aa, Homo Sapiens
ILLNIEHRIML

SEQ ID NO: 3892 - protein, 11 aa, Homo Sapiens
ILLNNSGQIKL

SEQ ID NO: 3893 - protein, 11 aa, Homo Sapiens
ILLNPAYDVYL

SEQ ID NO: 3894 - protein, 11 aa, Homo Sapiens
ILLPEPSIRSV

SEQ ID NO: 3895 - protein, 11 aa, Homo Sapiens
ILLQENGHIYV

SEQ ID NO: 3896 - protein, 11 aa, Homo Sapiens
ILLSEEDLQML

SEQ ID NO: 3897 - protein, 11 aa, Homo Sapiens
ILLSEPGLVKL

SEQ ID NO: 3898 - protein, 11 aa, Homo Sapiens
ILLTEPGQVKL

SEQ ID NO: 3899 - protein, 11 aa, Homo Sapiens
ILLTSTELFQL

SEQ ID NO: 3900 - protein, 11 aa, Homo Sapiens
ILMEHIHKLKA

SEQ ID NO: 3901 - protein, 11 aa, Homo Sapiens
ILMSPNSYIKL

SEQ ID NO: 3902 - protein, 11 aa, Homo Sapiens
ILYSKTEHLGL

SEQ ID NO: 3903 - protein, 11 aa, Homo Sapiens
IMLSEKHLISV

SEQ ID NO: 3904 - protein, 11 aa, Homo Sapiens
IQDELGGKITV

SEQ ID NO: 3905 - protein, 11 aa, Homo Sapiens
ISERYGPVFTI

SEQ ID NO: 3906 - protein, 11 aa, Homo Sapiens
ISLPGEMVTLG

SEQ ID NO: 3907 - protein, 11 aa, Homo Sapiens
ISYAIMFLYIS

SEQ ID NO: 3908 - protein, 11 aa, Homo Sapiens
IVLPAGALHQV

SEQ ID NO: 3909 - protein, 11 aa, Homo Sapiens
KIGDFGLVTSL

SEQ ID NO: 3910 - protein, 11 aa, Homo Sapiens
KIMDYSLLVGI

SEQ ID NO: 3911 - protein, 11 aa, Homo Sapiens
KIMTEKELLAV

SEQ ID NO: 3912 - protein, 11 aa, Homo Sapiens
KIWDLKERTNV

SEQ ID NO: 3913 - protein, 11 aa, Homo Sapiens
KIWDVSVNSVV

SEQ ID NO: 3914 - protein, 11 aa, Homo Sapiens
KIWEELSVLEV

SEQ ID NO: 3915 - protein, 11 aa, Homo Sapiens
KLADDVDLEQV

SEQ ID NO: 3916 - protein, 11 aa, Homo Sapiens
KLADFGDAVQL

SEQ ID NO: 3917 - protein, 11 aa, Homo Sapiens
KLAPITYPQGL

SEQ ID NO: 3918 - protein, 11 aa, Homo Sapiens
KLDDLTQDLTV

SEQ ID NO: 3919 - protein, 11 aa, Homo Sapiens
KLDTVSSKIEL

SEQ ID NO: 3920 - protein, 11 aa, Homo Sapiens
KLFADAGLVCI

SEQ ID NO: 3921 - protein, 11 aa, Homo Sapiens
KLFDLDEKLML

SEQ ID NO: 3922 - protein, 11 aa, Homo Sapiens
KLFDRPQELKL

SEQ ID NO: 3923 - protein, 11 aa, Homo Sapiens
KLFNESHGIFL

SEQ ID NO: 3924 - protein, 11 aa, Homo Sapiens
KLFPGFEIETV

SEQ ID NO: 3925 - protein, 11 aa, Homo Sapiens
KLFTQIFGVGV

SEQ ID NO: 3926 - protein, 11 aa, Homo Sapiens
KLGDFGLLVEL

SEQ ID NO: 3927 - protein, 11 aa, Homo Sapiens
KLGEFAKVLEL

SEQ ID NO: 3928 - protein, 11 aa, Homo Sapiens
KLGHTDILVGV

SEQ ID NO: 3929 - protein, 11 aa, Homo Sapiens
KLIDETQDMLL

SEQ ID NO: 3930 - protein, 11 aa, Homo Sapiens
KLIDFGSGALL

SEQ ID NO: 3931 - protein, 11 aa, Homo Sapiens
KLIDLSQVMYL

SEQ ID NO: 3932 - protein, 11 aa, Homo Sapiens
KLIGDPNLEFV

SEQ ID NO: 3933 - protein, 11 aa, Homo Sapiens
KLLDELPIAKV

SEQ ID NO: 3934 - protein, 11 aa, Homo Sapiens
KLLDFGSLSNL

SEQ ID NO: 3935 - protein, 11 aa, Homo Sapiens
KLLDISELDMV

SEQ ID NO: 3936 - protein, 11 aa, Homo Sapiens
KLLDLSDSTSV

SEQ ID NO: 3937 - protein, 11 aa, Homo Sapiens
KLLDMVGKVQI

SEQ ID NO: 3938 - protein, 11 aa, Homo Sapiens
KLLDTMVDTFL

SEQ ID NO: 3939 - protein, 11 aa, Homo Sapiens
KLLETELLQEI

SEQ ID NO: 3940 - protein, 11 aa, Homo Sapiens
KLLEVSDDPQV

SEQ ID NO: 3941 - protein, 11 aa, Homo Sapiens
KLLSHSLLVTL

SEQ ID NO: 3942 - protein, 11 aa, Homo Sapiens
KLMDEVAGIVA

SEQ ID NO: 3943 - protein, 11 aa, Homo Sapiens
KLMNDDTLVNV

SEQ ID NO: 3944 - protein, 11 aa, Homo Sapiens
KLSLVAAMLLL

SEQ ID NO: 3945 - protein, 11 aa, Homo Sapiens
KLWDPRTPCNA

SEQ ID NO: 3946 - protein, 11 aa, Homo Sapiens
KLWNVAAPLYL

SEQ ID NO: 3947 - protein, 11 aa, Homo Sapiens
KLWTGGLDNTV

SEQ ID NO: 3948 - protein, 11 aa, Homo Sapiens
KLYQEVEIASV

SEQ ID NO: 3949 - protein, 11 aa, Homo Sapiens
KMDASLGNLFA

SEQ ID NO: 3950 - protein, 11 aa, Homo Sapiens
KMDDPDYWRTV

SEQ ID NO: 3951 - protein, 11 aa, Homo Sapiens
KMDDPTVNWSI

SEQ ID NO: 3952 - protein, 11 aa, Homo Sapiens
KMFDLNGDGEV

SEQ ID NO: 3953 - protein, 11 aa, Homo Sapiens
KMYEKIDLTLL

SEQ ID NO: 3954 - protein, 11 aa, Homo Sapiens
KMYGYVDTLLT

SEQ ID NO: 3955 - protein, 11 aa, Homo Sapiens
KVLEPSETLVV

SEQ ID NO: 3956 - protein, 11 aa, Homo Sapiens
KVLEVTEEFGV

SEQ ID NO: 3957 - protein, 11 aa, Homo Sapiens
KVLRESGLKYV

SEQ ID NO: 3958 - protein, 11 aa, Homo Sapiens
KVPQLEIVPNS

SEQ ID NO: 3959 - protein, 11 aa, Homo Sapiens
LILNVDGLIGV

SEQ ID NO: 3960 - protein, 11 aa, Homo Sapiens
LLAGFAFLTGV

SEQ ID NO: 3961 - protein, 11 aa, Homo Sapiens
LLAILPEAARA

SEQ ID NO: 3962 - protein, 11 aa, Homo Sapiens
LLDEIENIKQV

SEQ ID NO: 3963 - protein, 11 aa, Homo Sapiens
LLDEPTNHLDL

SEQ ID NO: 3964 - protein, 11 aa, Homo Sapiens
LLDPNVKSIFV

SEQ ID NO: 3965 - protein, 11 aa, Homo Sapiens
LLFDHLEPIEL

SEQ ID NO: 3966 - protein, 11 aa, Homo Sapiens
LLFEGEKKITI

SEQ ID NO: 3967 - protein, 11 aa, Homo Sapiens
LLFEHSDIVVI

SEQ ID NO: 3968 - protein, 11 aa, Homo Sapiens
LLFGKIGYYLV

SEQ ID NO: 3969 - protein, 11 aa, Homo Sapiens
LLFHHPNILEL

SEQ ID NO: 3970 - protein, 11 aa, Homo Sapiens
LLFPQIEGIKI

SEQ ID NO: 3971 - protein, 11 aa, Homo Sapiens
LLGELPRLLLL

SEQ ID NO: 3972 - protein, 11 aa, Homo Sapiens
LLIDDKGTIKL

SEQ ID NO: 3973 - protein, 11 aa, Homo Sapiens
LLIGHLERVTV

SEQ ID NO: 3974 - protein, 11 aa, Homo Sapiens
LLLAAARLAAA

SEQ ID NO: 3975 - protein, 11 aa, Homo Sapiens
LLLDENGVLKL

SEQ ID NO: 3976 - protein, 11 aa, Homo Sapiens
LLLDERQDVHL

SEQ ID NO: 3977 - protein, 11 aa, Homo Sapiens
LLLEEGGLVQV

SEQ ID NO: 3978 - protein, 11 aa, Homo Sapiens
LLLEPGSLYIL

SEQ ID NO: 3979 - protein, 11 aa, Homo Sapiens
LLLLDTVTMQV

SEQ ID NO: 3980 - protein, 11 aa, Homo Sapiens
LLLNEEALAQI

SEQ ID NO: 3981 - protein, 11 aa, Homo Sapiens
LLLPDYYLVTV

SEQ ID NO: 3982 - protein, 11 aa, Homo Sapiens
LLLPEHVLVKI

SEQ ID NO: 3983 - protein, 11 aa, Homo Sapiens
LLLTDQHLYKL

SEQ ID NO: 3984 - protein, 11 aa, Homo Sapiens
LLLYEEGLRVV

SEQ ID NO: 3985 - protein, 11 aa, Homo Sapiens
LLMPSSEDLLL

SEQ ID NO: 3986 - protein, 11 aa, Homo Sapiens
LLPDVGAIVTC

SEQ ID NO: 3987 - protein, 11 aa, Homo Sapiens
LLPGVDVLLEV

SEQ ID NO: 3988 - protein, 11 aa, Homo Sapiens
LLVPTSGIYFV

SEQ ID NO: 3989 - protein, 11 aa, Homo Sapiens
LLYDLADQLHA

SEQ ID NO: 3990 - protein, 11 aa, Homo Sapiens
LLYEDIGTSRV

SEQ ID NO: 3991 - protein, 11 aa, Homo Sapiens
LLYQEGAKMAV

SEQ ID NO: 3992 - protein, 11 aa, Homo Sapiens
LMWELEKKSAV

SEQ ID NO: 3993 - protein, 11 aa, Homo Sapiens
LSLSSETKPKL

SEQ ID NO: 3994 - protein, 11 aa, Homo Sapiens
LVDQPHSLLSI

SEQ ID NO: 3995 - protein, 11 aa, Homo Sapiens
LVVDEGSLVSV

SEQ ID NO: 3996 - protein, 11 aa, Homo Sapiens
MHQPHQPLPPT

SEQ ID NO: 3997 - protein, 11 aa, Homo Sapiens
MLFENMGAYTV

SEQ ID NO: 3998 - protein, 11 aa, Homo Sapiens
MLFGHPLLVSV

SEQ ID NO: 3999 - protein, 11 aa, Homo Sapiens
MTLPVDAVISV

SEQ ID NO: 4000 - protein, 11 aa, Homo Sapiens
NIASIGSTIFL

SEQ ID NO: 4001 - protein, 11 aa, Homo Sapiens
NIFPNPEATFV

SEQ ID NO: 4002 - protein, 11 aa, Homo Sapiens
NIIEAINELLV

SEQ ID NO: 4003 - protein, 11 aa, Homo Sapiens
NIMDIKIGLLV

SEQ ID NO: 4004 - protein, 11 aa, Homo Sapiens
NLAGENILNPL

SEQ ID NO: 4005 - protein, 11 aa, Homo Sapiens
NLASFIEQVAV

SEQ ID NO: 4006 - protein, 11 aa, Homo Sapiens
NLFEIITADEV

SEQ ID NO: 4007 - protein, 11 aa, Homo Sapiens
NLFEWAKNSPL

SEQ ID NO: 4008 - protein, 11 aa, Homo Sapiens
NLLDLNQKLQL

SEQ ID NO: 4009 - protein, 11 aa, Homo Sapiens
NLMNNPQIQQL

SEQ ID NO: 4010 - protein, 11 aa, Homo Sapiens
NLMPQMKTLYL

SEQ ID NO: 4011 - protein, 11 aa, Homo Sapiens
NLPAPHIMPGV

SEQ ID NO: 4012 - protein, 11 aa, Homo Sapiens
NMLDVNGLFTL

SEQ ID NO: 4013 - protein, 11 aa, Homo Sapiens
NMYEGVGRMFI

SEQ ID NO: 4014 - protein, 11 aa, Homo Sapiens
QLLPQGIVPAL

SEQ ID NO: 4015 - protein, 11 aa, Homo Sapiens
QLQPTDALLCV

SEQ ID NO: 4016 - protein, 11 aa, Homo Sapiens
QMLEAIKALEV

SEQ ID NO: 4017 - protein, 11 aa, Homo Sapiens
QMLPLNTNIRL

SEQ ID NO: 4018 - protein, 11 aa, Homo Sapiens
QMMQNPQILAA

SEQ ID NO: 4019 - protein, 11 aa, Homo Sapiens
QMWELSAVARV

SEQ ID NO: 4020 - protein, 11 aa, Homo Sapiens
QQLDSKFLEQV

SEQ ID NO: 4021 - protein, 11 aa, Homo Sapiens
RIAGIRGIQGV

SEQ ID NO: 4022 - protein, 11 aa, Homo Sapiens
RILDIDIPMSV

SEQ ID NO: 4023 - protein, 11 aa, Homo Sapiens
RLAEALPKQSV

SEQ ID NO: 4024 - protein, 11 aa, Homo Sapiens
RLAETLAQIYL

SEQ ID NO: 4025 - protein, 11 aa, Homo Sapiens
RLAEVGQYEQV

SEQ ID NO: 4026 - protein, 11 aa, Homo Sapiens
RLFDDSTVTTV

SEQ ID NO: 4027 - protein, 11 aa, Homo Sapiens
RLFDEPQLASL

SEQ ID NO: 4028 - protein, 11 aa, Homo Sapiens
RLFEVPHELVA

SEQ ID NO: 4029 - protein, 11 aa, Homo Sapiens
RLFHDSAVTSV

SEQ ID NO: 4030 - protein, 11 aa, Homo Sapiens
RLFLGIHVFLV

SEQ ID NO: 4031 - protein, 11 aa, Homo Sapiens
RLFNDPVAMVL

SEQ ID NO: 4032 - protein, 11 aa, Homo Sapiens
RLGEAEGLMKV

SEQ ID NO: 4033 - protein, 11 aa, Homo Sapiens
RLIDDEVRILI

SEQ ID NO: 4034 - protein, 11 aa, Homo Sapiens
RLIQGDQILSV

SEQ ID NO: 4035 - protein, 11 aa, Homo Sapiens
RLLEEGVLRQI

SEQ ID NO: 4036 - protein, 11 aa, Homo Sapiens
RLLEIPAVSHV

SEQ ID NO: 4037 - protein, 11 aa, Homo Sapiens
RLLEPAQVQQL

SEQ ID NO: 4038 - protein, 11 aa, Homo Sapiens
RLLEVNQQSLL

SEQ ID NO: 4039 - protein, 11 aa, Homo Sapiens
RLLEVTNTIRV

SEQ ID NO: 4040 - protein, 11 aa, Homo Sapiens
RLLPGDIILKV

SEQ ID NO: 4041 - protein, 11 aa, Homo Sapiens
RLLPPGAVVAV

SEQ ID NO: 4042 - protein, 11 aa, Homo Sapiens
RLLQETMYMTV

SEQ ID NO: 4043 - protein, 11 aa, Homo Sapiens
RLMEPIYLVEI

SEQ ID NO: 4044 - protein, 11 aa, Homo Sapiens
RLMNDMTAVAL

SEQ ID NO: 4045 - protein, 11 aa, Homo Sapiens
RLMNETTAVAL

SEQ ID NO: 4046 - protein, 11 aa, Homo Sapiens
RLPNRALLVNV

SEQ ID NO: 4047 - protein, 11 aa, Homo Sapiens
RLQETEGMVAV

SEQ ID NO: 4048 - protein, 11 aa, Homo Sapiens
RLWDHATMTEV

SEQ ID NO: 4049 - protein, 11 aa, Homo Sapiens
RLWDLTTGTTT

SEQ ID NO: 4050 - protein, 11 aa, Homo Sapiens
RLYSGISGLEL

SEQ ID NO: 4051 - protein, 11 aa, Homo Sapiens
RMANRDLLSSV

SEQ ID NO: 4052 - protein, 11 aa, Homo Sapiens
RMFDMGFEYQV

SEQ ID NO: 4053 - protein, 11 aa, Homo Sapiens
RMGGFGSIIQL

SEQ ID NO: 4054 - protein, 11 aa, Homo Sapiens
RMLDMGFEPQI

SEQ ID NO: 4055 - protein, 11 aa, Homo Sapiens
RMLEDRDLFVM

SEQ ID NO: 4056 - protein, 11 aa, Homo Sapiens
RQISIRGIVGV

SEQ ID NO: 4057 - protein, 11 aa, Homo Sapiens
RQLEEEGITFV

SEQ ID NO: 4058 - protein, 11 aa, Homo Sapiens
RVDPNGSRYLL

SEQ ID NO: 4059 - protein, 11 aa, Homo Sapiens
RVIDDSLVVGV

SEQ ID NO: 4060 - protein, 11 aa, Homo Sapiens
RVLPPSALQSV

SEQ ID NO: 4061 - protein, 11 aa, Homo Sapiens
RVMEEIRNLTV

SEQ ID NO: 4062 - protein, 11 aa, Homo Sapiens
RVMEELPLMLL

SEQ ID NO: 4063 - protein, 11 aa, Homo Sapiens
SIGKPSLFISV

SEQ ID NO: 4064 - protein, 11 aa, Homo Sapiens
SIQQSIERLLV

SEQ ID NO: 4065 - protein, 11 aa, Homo Sapiens
SLADIAQKLQL

SEQ ID NO: 4066 - protein, 11 aa, Homo Sapiens
SLAELDEKISA

SEQ ID NO: 4067 - protein, 11 aa, Homo Sapiens
SLAERVDRLQV

SEQ ID NO: 4068 - protein, 11 aa, Homo Sapiens
SLAGDVALQQL

SEQ ID NO: 4069 - protein, 11 aa, Homo Sapiens
SLAVLGGKLYV

SEQ ID NO: 4070 - protein, 11 aa, Homo Sapiens
SLDAAAGMLYL

SEQ ID NO: 4071 - protein, 11 aa, Homo Sapiens
SLFGGSVKLAL

SEQ ID NO: 4072 - protein, 11 aa, Homo Sapiens
SLFQGVEFHYV

SEQ ID NO: 4073 - protein, 11 aa, Homo Sapiens
SLFSEETPVVL

SEQ ID NO: 4074 - protein, 11 aa, Homo Sapiens
SLIDDNNEINL

SEQ ID NO: 4075 - protein, 11 aa, Homo Sapiens
SLIDMRGIETV

SEQ ID NO: 4076 - protein, 11 aa, Homo Sapiens
SLINLPANSTI

SEQ ID NO: 4077 - protein, 11 aa, Homo Sapiens
SLINVNDLSFV

SEQ ID NO: 4078 - protein, 11 aa, Homo Sapiens
SLLDIIEKVMA

SEQ ID NO: 4079 - protein, 11 aa, Homo Sapiens
SLLEDKGLAEV

SEQ ID NO: 4080 - protein, 11 aa, Homo Sapiens
SLLESNKDLLL

SEQ ID NO: 4081 - protein, 11 aa, Homo Sapiens
SLLESSRSQEL

SEQ ID NO: 4082 - protein, 11 aa, Homo Sapiens
SLLEVNEESTV

SEQ ID NO: 4083 - protein, 11 aa, Homo Sapiens
SLLGDDALVQV

SEQ ID NO: 4084 - protein, 11 aa, Homo Sapiens
SLLGGNIRLLL

SEQ ID NO: 4085 - protein, 11 aa, Homo Sapiens
SLLHLGALYGI

SEQ ID NO: 4086 - protein, 11 aa, Homo Sapiens
SLLKEPQKVQL

SEQ ID NO: 4087 - protein, 11 aa, Homo Sapiens
SLLPADCQIHL

SEQ ID NO: 4088 - protein, 11 aa, Homo Sapiens
SLLPEYVVPYM

SEQ ID NO: 4089 - protein, 11 aa, Homo Sapiens
SLLPGNLVEKV

SEQ ID NO: 4090 - protein, 11 aa, Homo Sapiens
SLLPPDALVGL

SEQ ID NO: 4091 - protein, 11 aa, Homo Sapiens
SLLPPTALVGL

SEQ ID NO: 4092 - protein, 11 aa, Homo Sapiens
SLLPVDIRQYL

SEQ ID NO: 4093 - protein, 11 aa, Homo Sapiens
SLLRRVSVTAV

SEQ ID NO: 4094 - protein, 11 aa, Homo Sapiens
SLLSNDLKLNL

SEQ ID NO: 4095 - protein, 11 aa, Homo Sapiens
SLMDPNKFLLL

SEQ ID NO: 4096 - protein, 11 aa, Homo Sapiens
SLMEESGICKV

SEQ ID NO: 4097 - protein, 11 aa, Homo Sapiens
SLMEKVRNMAL

SEQ ID NO: 4098 - protein, 11 aa, Homo Sapiens
SLMHDVYGMLL

SEQ ID NO: 4099 - protein, 11 aa, Homo Sapiens
SLMPHFKSMYL

SEQ ID NO: 4100 - protein, 11 aa, Homo Sapiens
SLQEFVKAFYL

SEQ ID NO: 4101 - protein, 11 aa, Homo Sapiens
SLVENIERLKV

SEQ ID NO: 4102 - protein, 11 aa, Homo Sapiens
SLVSPASFENV

SEQ ID NO: 4103 - protein, 11 aa, Homo Sapiens
SLWSLTHLTAL

SEQ ID NO: 4104 - protein, 11 aa, Homo Sapiens
SLYDQAEKLVS

SEQ ID NO: 4105 - protein, 11 aa, Homo Sapiens
SMADIPLGFGV

SEQ ID NO: 4106 - protein, 11 aa, Homo Sapiens
SMAPGLVIQAV

SEQ ID NO: 4107 - protein, 11 aa, Homo Sapiens
SQLDISDPYKV

SEQ ID NO: 4108 - protein, 11 aa, Homo Sapiens
SQLDISEPYKV

SEQ ID NO: 4109 - protein, 11 aa, Homo Sapiens
STFDHPELVKL

SEQ ID NO: 4110 - protein, 11 aa, Homo Sapiens
SVIDHIHLISV

SEQ ID NO: 4111 - protein, 11 aa, Homo Sapiens
TEDELQDKIHP

SEQ ID NO: 4112 - protein, 11 aa, Homo Sapiens
TIAEGLTLAQV

SEQ ID NO: 4113 - protein, 11 aa, Homo Sapiens
TIIDLPGITRV

SEQ ID NO: 4114 - protein, 11 aa, Homo Sapiens
TLADLRVLFGI

SEQ ID NO: 4115 - protein, 11 aa, Homo Sapiens
TLFHDPWKLLI

SEQ ID NO: 4116 - protein, 11 aa, Homo Sapiens
TLIDLPGITKV

SEQ ID NO: 4117 - protein, 11 aa, Homo Sapiens
TLIGLSIKVKL

SEQ ID NO: 4118 - protein, 11 aa, Homo Sapiens
TLLAAEFLKQV

SEQ ID NO: 4119 - protein, 11 aa, Homo Sapiens
TLLADQGEIRV

SEQ ID NO: 4120 - protein, 11 aa, Homo Sapiens
TLLDASEKLKL

SEQ ID NO: 4121 - protein, 11 aa, Homo Sapiens
TLLDNTDTISI

SEQ ID NO: 4122 - protein, 11 aa, Homo Sapiens
TLLDPNEKYLL

SEQ ID NO: 4123 - protein, 11 aa, Homo Sapiens
TLLDSVLVTLV

SEQ ID NO: 4124 - protein, 11 aa, Homo Sapiens
TLLEEIRDLAL

SEQ ID NO: 4125 - protein, 11 aa, Homo Sapiens
TLLHAGGLARA

SEQ ID NO: 4126 - protein, 11 aa, Homo Sapiens
TLMEEVLLLGL

SEQ ID NO: 4127 - protein, 11 aa, Homo Sapiens
TLMEQTLPVTV

SEQ ID NO: 4128 - protein, 11 aa, Homo Sapiens
TLVDNISTMAL

SEQ ID NO: 4129 - protein, 11 aa, Homo Sapiens
TLWYRAPEVLL

SEQ ID NO: 4130 - protein, 11 aa, Homo Sapiens
TLYDIAHTPGV

SEQ ID NO: 4131 - protein, 11 aa, Homo Sapiens
TLYKDVRDLLA

SEQ ID NO: 4132 - protein, 11 aa, Homo Sapiens
TLYNPERTITV

SEQ ID NO: 4133 - protein, 11 aa, Homo Sapiens
TMAKESSIIGV

SEQ ID NO: 4134 - protein, 11 aa, Homo Sapiens
VILDIPLLFET

SEQ ID NO: 4135 - protein, 11 aa, Homo Sapiens
VLFDVTGQVRL

SEQ ID NO: 4136 - protein, 11 aa, Homo Sapiens
VLFENTDSVHL

SEQ ID NO: 4137 - protein, 11 aa, Homo Sapiens
VLFGWPSLVFV

SEQ ID NO: 4138 - protein, 11 aa, Homo Sapiens
VLFPSAEVALL

SEQ ID NO: 4139 - protein, 11 aa, Homo Sapiens
VLFSSPPVILL

SEQ ID NO: 4140 - protein, 11 aa, Homo Sapiens
VLFSVADRLRL

SEQ ID NO: 4141 - protein, 11 aa, Homo Sapiens
VLGGKAFLEHL

SEQ ID NO: 4142 - protein, 11 aa, Homo Sapiens
VLIDTPGQIEV

SEQ ID NO: 4143 - protein, 11 aa, Homo Sapiens
VLIDVGTGYYV

SEQ ID NO: 4144 - protein, 11 aa, Homo Sapiens
VLLDVNGHIRL

SEQ ID NO: 4145 - protein, 11 aa, Homo Sapiens
VLLEEGEAQRL

SEQ ID NO: 4146 - protein, 11 aa, Homo Sapiens
VLLFEADTITL

SEQ ID NO: 4147 - protein, 11 aa, Homo Sapiens
VLLFERELHSV

SEQ ID NO: 4148 - protein, 11 aa, Homo Sapiens
VLLPAAGLLQL

SEQ ID NO: 4149 - protein, 11 aa, Homo Sapiens
VLLPDERTISL

SEQ ID NO: 4150 - protein, 11 aa, Homo Sapiens
VLLPEGGITAI

SEQ ID NO: 4151 - protein, 11 aa, Homo Sapiens
VLLSEQGDVKL

SEQ ID NO: 4152 - protein, 11 aa, Homo Sapiens
VLLSHPDPLHL

SEQ ID NO: 4153 - protein, 11 aa, Homo Sapiens
VLLVEHALSKV

SEQ ID NO: 4154 - protein, 11 aa, Homo Sapiens
VLMEDRLTNRL

SEQ ID NO: 4155 - protein, 11 aa, Homo Sapiens
VLMNQPPQIAP

SEQ ID NO: 4156 - protein, 11 aa, Homo Sapiens
VLVDDDGIKVV

SEQ ID NO: 4157 - protein, 11 aa, Homo Sapiens
VLWDLVDRIGI

SEQ ID NO: 4158 - protein, 11 aa, Homo Sapiens
VLYNEIEYAQA

SEQ ID NO: 4159 - protein, 11 aa, Homo Sapiens
VMFEDGVLMRL

SEQ ID NO: 4160 - protein, 11 aa, Homo Sapiens
VMFKKIKSFEV

SEQ ID NO: 4161 - protein, 11 aa, Homo Sapiens
VMQDPEFLQSV

SEQ ID NO: 4162 - protein, 11 aa, Homo Sapiens
VVLEGASLETV

SEQ ID NO: 4163 - protein, 11 aa, Homo Sapiens
WLIEDGKVVTV

SEQ ID NO: 4164 - protein, 11 aa, Homo Sapiens
YAYDGKDYIAL

SEQ ID NO: 4165 - protein, 11 aa, Homo Sapiens
YIFPLDDKAAV

SEQ ID NO: 4166 - protein, 11 aa, Homo Sapiens
YIMEPSIFNTL

SEQ ID NO: 4167 - protein, 11 aa, Homo Sapiens
YKVPQLEIVPN

SEQ ID NO: 4168 - protein, 11 aa, Homo Sapiens
YLADPAKFPEA

SEQ ID NO: 4169 - protein, 11 aa, Homo Sapiens
YLAGLHANIAV

SEQ ID NO: 4170 - protein, 11 aa, Homo Sapiens
YLDVSVGKIVA

SEQ ID NO: 4171 - protein, 11 aa, Homo Sapiens
YLFDVQRNNIA

SEQ ID NO: 4172 - protein, 11 aa, Homo Sapiens
YLHDQNPDAAL

SEQ ID NO: 4173 - protein, 11 aa, Homo Sapiens
YLIGQHVTAAL

SEQ ID NO: 4174 - protein, 11 aa, Homo Sapiens
YLINNPNQISL

SEQ ID NO: 4175 - protein, 11 aa, Homo Sapiens
YLIPFTGIVGL

SEQ ID NO: 4176 - protein, 11 aa, Homo Sapiens
YLIPLLERLDL

SEQ ID NO: 4177 - protein, 11 aa, Homo Sapiens
YLISQVEGHQV

SEQ ID NO: 4178 - protein, 11 aa, Homo Sapiens
YLLDIGCGTGL

SEQ ID NO: 4179 - protein, 11 aa, Homo Sapiens
YLLEQTPEQQA

SEQ ID NO: 4180 - protein, 11 aa, Homo Sapiens
YLLNDASLISV

SEQ ID NO: 4181 - protein, 11 aa, Homo Sapiens
YLLPKDQGITL

SEQ ID NO: 4182 - protein, 11 aa, Homo Sapiens
YLLPSGGSVTL

SEQ ID NO: 4183 - protein, 11 aa, Homo Sapiens
YLLSEKDLILA

SEQ ID NO: 4184 - protein, 11 aa, Homo Sapiens
YLMDINGKMWL

SEQ ID NO: 4185 - protein, 11 aa, Homo Sapiens
YLNETFSELRL

SEQ ID NO: 4186 - protein, 11 aa, Homo Sapiens
YLPDIIKDQKA

SEQ ID NO: 4187 - protein, 11 aa, Homo Sapiens
YLQDQHLLLTV

SEQ ID NO: 4188 - protein, 11 aa, Homo Sapiens
YLQEHAQEVVL

SEQ ID NO: 4189 - protein, 11 aa, Homo Sapiens
YLSDPCPGLYL

SEQ ID NO: 4190 - protein, 11 aa, Homo Sapiens
YLSEDVFQHAV

SEQ ID NO: 4191 - protein, 11 aa, Homo Sapiens
YLSELSEHVKL

SEQ ID NO: 4192 - protein, 11 aa, Homo Sapiens
YLYESGETEKL

SEQ ID NO: 4193 - protein, 11 aa, Homo Sapiens
YMGEEKLIASV

SEQ ID NO: 4194 - protein, 11 aa, Homo Sapiens
YMIGSEVGNYL

SEQ ID NO: 4195 - protein, 11 aa, Homo Sapiens
YQDPLDPTRSV

SEQ ID NO: 4196 - protein, 11 aa, Homo Sapiens
YQFDKVGILTL

SEQ ID NO: 4197 - protein, 11 aa, Homo Sapiens
YQFDSALLPAV

SEQ ID NO: 4198 - protein, 11 aa, Homo Sapiens
YQFGEIRTITV

SEQ ID NO: 4199 - protein, 11 aa, Homo Sapiens
YQLEIPENFTT

SEQ ID NO: 4200 - protein, 11 aa, Homo Sapiens
YTLPIASSIRL

SEQ ID NO: 4201 - protein, 11 aa, Homo Sapiens
YVIAYIRDLAL

SEQ ID NO: 4202 - protein, 11 aa, Homo Sapiens
YVIDPIKGLKL

SEQ ID NO: 4203 - protein, 8 aa, Homo Sapiens
ALFKAWAL

SEQ ID NO: 4204 - protein, 8 aa, Homo Sapiens
ALKDLLCH

SEQ ID NO: 4205 - protein, 8 aa, Homo Sapiens
ALNRNEIL

SEQ ID NO: 4206 - protein, 8 aa, Homo Sapiens
ASGLIHRV

SEQ ID NO: 4207 - protein, 8 aa, Homo Sapiens
EEQLQQIR

SEQ ID NO: 4208 - protein, 8 aa, Homo Sapiens
EESNYELE

SEQ ID NO: 4209 - protein, 8 aa, Homo Sapiens
EKSPLQTI

SEQ ID NO: 4210 - protein, 8 aa, Homo Sapiens
FGEEPSKL

SEQ ID NO: 4211 - protein, 8 aa, Homo Sapiens
FGGHIRSV

SEQ ID NO: 4212 - protein, 8 aa, Homo Sapiens
FNEKSKEL

SEQ ID NO: 4213 - protein, 8 aa, Homo Sapiens
GKDAVEDL

SEQ ID NO: 4214 - protein, 8 aa, Homo Sapiens
GLFKTDRV

SEQ ID NO: 4215 - protein, 8 aa, Homo Sapiens
GLGPVEYL

SEQ ID NO: 4216 - protein, 8 aa, Homo Sapiens
HLLQWLLL

SEQ ID NO: 4217 - protein, 8 aa, Homo Sapiens
ILGPTFTL

SEQ ID NO: 4218 - protein, 8 aa, Homo Sapiens
ILTDHQYL

SEQ ID NO: 4219 - protein, 8 aa, Homo Sapiens
IRLENEIQ

SEQ ID NO: 4220 - protein, 8 aa, Homo Sapiens
ISDLEHRL

SEQ ID NO: 4221 - protein, 8 aa, Homo Sapiens
ISSEKVVP

SEQ ID NO: 4222 - protein, 8 aa, Homo Sapiens
KLGPAIKL

SEQ ID NO: 4223 - protein, 8 aa, Homo Sapiens
LAETEGRY

SEQ ID NO: 4224 - protein, 8 aa, Homo Sapiens
LAGHDNRV

SEQ ID NO: 4225 - protein, 8 aa, Homo Sapiens
LAPHVRTL

SEQ ID NO: 4226 - protein, 8 aa, Homo Sapiens
LFGEVHKA

SEQ ID NO: 4227 - protein, 8 aa, Homo Sapiens
LFGHENRV

SEQ ID NO: 4228 - protein, 8 aa, Homo Sapiens
LKDKIEKA

SEQ ID NO: 4229 - protein, 8 aa, Homo Sapiens
LKGDVEKL

SEQ ID NO: 4230 - protein, 8 aa, Homo Sapiens
LKKEQENL

SEQ ID NO: 4231 - protein, 8 aa, Homo Sapiens
LKPEVDKL

SEQ ID NO: 4232 - protein, 8 aa, Homo Sapiens
LLAGSEYL

SEQ ID NO: 4233 - protein, 8 aa, Homo Sapiens
LLGPEHPL

SEQ ID NO: 4234 - protein, 8 aa, Homo Sapiens
LLYSYERA

SEQ ID NO: 4235 - protein, 8 aa, Homo Sapiens
LMEHIHKL

SEQ ID NO: 4236 - protein, 8 aa, Homo Sapiens
LNEKINHL

SEQ ID NO: 4237 - protein, 8 aa, Homo Sapiens
LNPHLRQL

SEQ ID NO: 4238 - protein, 8 aa, Homo Sapiens
LQEREYRL

SEQ ID NO: 4239 - protein, 8 aa, Homo Sapiens
LQQAKDEI

SEQ ID NO: 4240 - protein, 8 aa, Homo Sapiens
LQQAKEDL

SEQ ID NO: 4241 - protein, 8 aa, Homo Sapiens
LSSHVRGV

SEQ ID NO: 4242 - protein, 8 aa, Homo Sapiens
LYSKTEHL

SEQ ID NO: 4243 - protein, 8 aa, Homo Sapiens
NNRSLDLD

SEQ ID NO: 4244 - protein, 8 aa, Homo Sapiens
SFSKAFGQ

SEQ ID NO: 4245 - protein, 8 aa, Homo Sapiens
SKEEAEAL

SEQ ID NO: 4246 - protein, 8 aa, Homo Sapiens
STGDVNVE

SEQ ID NO: 4247 - protein, 8 aa, Homo Sapiens
TEELAYLK

SEQ ID NO: 4248 - protein, 8 aa, Homo Sapiens
VSLTACKV

SEQ ID NO: 4249 - protein, 8 aa, Homo Sapiens
VSQINHKL

SEQ ID NO: 4250 - protein, 8 aa, Homo Sapiens
YDKDHYKL

SEQ ID NO: 4251 - protein, 8 aa, Homo Sapiens
YEEIAQRS

SEQ ID NO: 4252 - protein, 8 aa, Homo Sapiens
YGVDLHHA

SEQ ID NO: 4253 - protein, 8 aa, Homo Sapiens
YGVDLHKA

SEQ ID NO: 4254 - protein, 8 aa, Homo Sapiens
YLFHVQEV

SEQ ID NO: 4255 - protein, 9 aa, Homo Sapiens
AAADIVNFL

SEQ ID NO: 4256 - protein, 9 aa, Homo Sapiens
ADASLLKKV

SEQ ID NO: 4257 - protein, 9 aa, Homo Sapiens
AENEFVTIK

SEQ ID NO: 4258 - protein, 9 aa, Homo Sapiens
AFADIIHSL

SEQ ID NO: 4259 - protein, 9 aa, Homo Sapiens
AIADHYMQV

SEQ ID NO: 4260 - protein, 9 aa, Homo Sapiens
AIAPNTNNL

SEQ ID NO: 4261 - protein, 9 aa, Homo Sapiens
AICPNNHEV

SEQ ID NO: 4262 - protein, 9 aa, Homo Sapiens
AISEMTDKL

SEQ ID NO: 4263 - protein, 9 aa, Homo Sapiens
ALAAALAHI

SEQ ID NO: 4264 - protein, 9 aa, Homo Sapiens
ALAAKECSL

SEQ ID NO: 4265 - protein, 9 aa, Homo Sapiens
ALAALHVTL

SEQ ID NO: 4266 - protein, 9 aa, Homo Sapiens
ALAALVYCV

SEQ ID NO: 4267 - protein, 9 aa, Homo Sapiens
ALADGVQKV

SEQ ID NO: 4268 - protein, 9 aa, Homo Sapiens
ALADKHATL

SEQ ID NO: 4269 - protein, 9 aa, Homo Sapiens
ALADLQEAV

SEQ ID NO: 4270 - protein, 9 aa, Homo Sapiens
ALADVLRRL

SEQ ID NO: 4271 - protein, 9 aa, Homo Sapiens
ALADVMSQL

SEQ ID NO: 4272 - protein, 9 aa, Homo Sapiens
ALAEALKEV

SEQ ID NO: 4273 - protein, 9 aa, Homo Sapiens
ALAEALRLL

SEQ ID NO: 4274 - protein, 9 aa, Homo Sapiens
ALAEDPQEL

SEQ ID NO: 4275 - protein, 9 aa, Homo Sapiens
ALAEEVEQV

SEQ ID NO: 4276 - protein, 9 aa, Homo Sapiens
ALAEGCPRL

SEQ ID NO: 4277 - protein, 9 aa, Homo Sapiens
ALAEGQLRL

SEQ ID NO: 4278 - protein, 9 aa, Homo Sapiens
ALAEKLDRL

SEQ ID NO: 4279 - protein, 9 aa, Homo Sapiens
ALAEKVKEA

SEQ ID NO: 4280 - protein, 9 aa, Homo Sapiens
ALAELSESL

SEQ ID NO: 4281 - protein, 9 aa, Homo Sapiens
ALAELTKRL

SEQ ID NO: 4282 - protein, 9 aa, Homo Sapiens
ALAEMDRQL

SEQ ID NO: 4283 - protein, 9 aa, Homo Sapiens
ALAERLDIV

SEQ ID NO: 4284 - protein, 9 aa, Homo Sapiens
ALAERQQLI

SEQ ID NO: 4285 - protein, 9 aa, Homo Sapiens
ALAERQSEL

SEQ ID NO: 4286 - protein, 9 aa, Homo Sapiens
ALAEYACKL

SEQ ID NO: 4287 - protein, 9 aa, Homo Sapiens
ALAEYSRLL

SEQ ID NO: 4288 - protein, 9 aa, Homo Sapiens
ALAFSDCRL

SEQ ID NO: 4289 - protein, 9 aa, Homo Sapiens
ALAFVLQHL

SEQ ID NO: 4290 - protein, 9 aa, Homo Sapiens
ALAGLGHEI

SEQ ID NO: 4291 - protein, 9 aa, Homo Sapiens
ALAILLQKL

SEQ ID NO: 4292 - protein, 9 aa, Homo Sapiens
ALAKAPFAA

SEQ ID NO: 4293 - protein, 9 aa, Homo Sapiens
ALAKHLIKI

SEQ ID NO: 4294 - protein, 9 aa, Homo Sapiens
ALAKIDAEL

SEQ ID NO: 4295 - protein, 9 aa, Homo Sapiens
ALAKIEIKL

SEQ ID NO: 4296 - protein, 9 aa, Homo Sapiens
ALAKLVEAI

SEQ ID NO: 4297 - protein, 9 aa, Homo Sapiens
ALAKNSPGL

SEQ ID NO: 4298 - protein, 9 aa, Homo Sapiens
ALAKTEVSL

SEQ ID NO: 4299 - protein, 9 aa, Homo Sapiens
ALANHLIKV

SEQ ID NO: 4300 - protein, 9 aa, Homo Sapiens
ALANLADML

SEQ ID NO: 4301 - protein, 9 aa, Homo Sapiens
ALANMHESL

SEQ ID NO: 4302 - protein, 9 aa, Homo Sapiens
ALAPHEEYI

SEQ ID NO: 4303 - protein, 9 aa, Homo Sapiens
ALAPHLDDA

SEQ ID NO: 4304 - protein, 9 aa, Homo Sapiens
ALAPLLSSL

SEQ ID NO: 4305 - protein, 9 aa, Homo Sapiens
ALAPSTMKI

SEQ ID NO: 4306 - protein, 9 aa, Homo Sapiens
ALAPYLDLL

SEQ ID NO: 4307 - protein, 9 aa, Homo Sapiens
ALAQAVQRA

SEQ ID NO: 4308 - protein, 9 aa, Homo Sapiens
ALAQHQTKL

SEQ ID NO: 4309 - protein, 9 aa, Homo Sapiens
ALAQIPQKV

SEQ ID NO: 4310 - protein, 9 aa, Homo Sapiens
ALASISHVA

SEQ ID NO: 4311 - protein, 9 aa, Homo Sapiens
ALASLENHV

SEQ ID NO: 4312 - protein, 9 aa, Homo Sapiens
ALASVIKEL

SEQ ID NO: 4313 - protein, 9 aa, Homo Sapiens
ALATHILSL

SEQ ID NO: 4314 - protein, 9 aa, Homo Sapiens
ALATLIHQV

SEQ ID NO: 4315 - protein, 9 aa, Homo Sapiens
ALAVFPSLL

SEQ ID NO: 4316 - protein, 9 aa, Homo Sapiens
ALAVMVDHL

SEQ ID NO: 4317 - protein, 9 aa, Homo Sapiens
ALAWNAEQL

SEQ ID NO: 4318 - protein, 9 aa, Homo Sapiens
ALCALVYRL

SEQ ID NO: 4319 - protein, 9 aa, Homo Sapiens
ALCMGNHEL

SEQ ID NO: 4320 - protein, 9 aa, Homo Sapiens
ALCPAAQGL

SEQ ID NO: 4321 - protein, 9 aa, Homo Sapiens
ALCPHLKTL

SEQ ID NO: 4322 - protein, 9 aa, Homo Sapiens
ALCPQVINA

SEQ ID NO: 4323 - protein, 9 aa, Homo Sapiens
ALCPRIHEV

SEQ ID NO: 4324 - protein, 9 aa, Homo Sapiens
ALCRLVELL

SEQ ID NO: 4325 - protein, 9 aa, Homo Sapiens
ALCTKVPEL

SEQ ID NO: 4326 - protein, 9 aa, Homo Sapiens
ALCVIRNLI

SEQ ID NO: 4327 - protein, 9 aa, Homo Sapiens
ALDDRLYCV

SEQ ID NO: 4328 - protein, 9 aa, Homo Sapiens
ALDKITASL

SEQ ID NO: 4329 - protein, 9 aa, Homo Sapiens
ALFDAQAQV

SEQ ID NO: 4330 - protein, 9 aa, Homo Sapiens
ALFEEVPEL

SEQ ID NO: 4331 - protein, 9 aa, Homo Sapiens
ALFEGKVQL

SEQ ID NO: 4332 - protein, 9 aa, Homo Sapiens
ALFNGAQKL

SEQ ID NO: 4333 - protein, 9 aa, Homo Sapiens
ALFPGVALL

SEQ ID NO: 4334 - protein, 9 aa, Homo Sapiens
ALFQHITAL

SEQ ID NO: 4335 - protein, 9 aa, Homo Sapiens
ALFSFLYHL

SEQ ID NO: 4336 - protein, 9 aa, Homo Sapiens
ALFWEQHDL

SEQ ID NO: 4337 - protein, 9 aa, Homo Sapiens
ALFYFASKL

SEQ ID NO: 4338 - protein, 9 aa, Homo Sapiens
ALGECYEKL

SEQ ID NO: 4339 - protein, 9 aa, Homo Sapiens
ALGEPLYRV

SEQ ID NO: 4340 - protein, 9 aa, Homo Sapiens
ALGNIVHGL

SEQ ID NO: 4341 - protein, 9 aa, Homo Sapiens
ALGPKPQGL

SEQ ID NO: 4342 - protein, 9 aa, Homo Sapiens
ALGSLCQRL

SEQ ID NO: 4343 - protein, 9 aa, Homo Sapiens
ALGWATAEL

SEQ ID NO: 4344 - protein, 9 aa, Homo Sapiens
ALHAQVERL

SEQ ID NO: 4345 - protein, 9 aa, Homo Sapiens
ALHDHLATI

SEQ ID NO: 4346 - protein, 9 aa, Homo Sapiens
ALHDILTEI

SEQ ID NO: 4347 - protein, 9 aa, Homo Sapiens
ALHDLLQHV

SEQ ID NO: 4348 - protein, 9 aa, Homo Sapiens
ALHDQLFYL

SEQ ID NO: 4349 - protein, 9 aa, Homo Sapiens
ALHDQLNRL

SEQ ID NO: 4350 - protein, 9 aa, Homo Sapiens
ALHDQSQEL

SEQ ID NO: 4351 - protein, 9 aa, Homo Sapiens
ALHDRAPQL

SEQ ID NO: 4352 - protein, 9 aa, Homo Sapiens
ALHDSSDYL

SEQ ID NO: 4353 - protein, 9 aa, Homo Sapiens
ALHEKEETL

SEQ ID NO: 4354 - protein, 9 aa, Homo Sapiens
ALHENCSQL

SEQ ID NO: 4355 - protein, 9 aa, Homo Sapiens
ALHHAVIFL

SEQ ID NO: 4356 - protein, 9 aa, Homo Sapiens
ALHILVHEL

SEQ ID NO: 4357 - protein, 9 aa, Homo Sapiens
ALHNFIDGL

SEQ ID NO: 4358 - protein, 9 aa, Homo Sapiens
ALHPHTPKV

SEQ ID NO: 4359 - protein, 9 aa, Homo Sapiens
ALHPVQFYL

SEQ ID NO: 4360 - protein, 9 aa, Homo Sapiens
ALHSLTACL

SEQ ID NO: 4361 - protein, 9 aa, Homo Sapiens
ALHSVEVEL

SEQ ID NO: 4362 - protein, 9 aa, Homo Sapiens
ALHWFLNQV

SEQ ID NO: 4363 - protein, 9 aa, Homo Sapiens
ALIDRMVNL

SEQ ID NO: 4364 - protein, 9 aa, Homo Sapiens
ALIEDEHNL

SEQ ID NO: 4365 - protein, 9 aa, Homo Sapiens
ALIEKLVEL

SEQ ID NO: 4366 - protein, 9 aa, Homo Sapiens
ALIGQCIHI

SEQ ID NO: 4367 - protein, 9 aa, Homo Sapiens
ALIPVINKL

SEQ ID NO: 4368 - protein, 9 aa, Homo Sapiens
ALKDEIDVL

SEQ ID NO: 4369 - protein, 9 aa, Homo Sapiens
ALKDEVQEL

SEQ ID NO: 4370 - protein, 9 aa, Homo Sapiens
ALKDKIEKA

SEQ ID NO: 4371 - protein, 9 aa, Homo Sapiens
ALKDLINEA

SEQ ID NO: 4372 - protein, 9 aa, Homo Sapiens
ALKEKIHEL

SEQ ID NO: 4373 - protein, 9 aa, Homo Sapiens
ALKEKVIKA

SEQ ID NO: 4374 - protein, 9 aa, Homo Sapiens
ALKERADSL

SEQ ID NO: 4375 - protein, 9 aa, Homo Sapiens
ALKERVDEL

SEQ ID NO: 4376 - protein, 9 aa, Homo Sapiens
ALKKALAAA

SEQ ID NO: 4377 - protein, 9 aa, Homo Sapiens
ALKKNLEKI

SEQ ID NO: 4378 - protein, 9 aa, Homo Sapiens
ALKNDLVEA

SEQ ID NO: 4379 - protein, 9 aa, Homo Sapiens
ALKPEVDKL

SEQ ID NO: 4380 - protein, 9 aa, Homo Sapiens
ALKSHIMAA

SEQ ID NO: 4381 - protein, 9 aa, Homo Sapiens
ALLDKLYAL

SEQ ID NO: 4382 - protein, 9 aa, Homo Sapiens
ALMADMVYV

SEQ ID NO: 4383 - protein, 9 aa, Homo Sapiens
ALMAQEQKL

SEQ ID NO: 4384 - protein, 9 aa, Homo Sapiens
ALMDEVVKA

SEQ ID NO: 4385 - protein, 9 aa, Homo Sapiens
ALMDQVHHM

SEQ ID NO: 4386 - protein, 9 aa, Homo Sapiens
ALMKHPQFL

SEQ ID NO: 4387 - protein, 9 aa, Homo Sapiens
ALMPKQATV

SEQ ID NO: 4388 - protein, 9 aa, Homo Sapiens
ALMPQLVQL

SEQ ID NO: 4389 - protein, 9 aa, Homo Sapiens
ALMPVLNQV

SEQ ID NO: 4390 - protein, 9 aa, Homo Sapiens
ALNAITKKL

SEQ ID NO: 4391 - protein, 9 aa, Homo Sapiens
ALNDCIYSV

SEQ ID NO: 4392 - protein, 9 aa, Homo Sapiens
ALNDEIRQL

SEQ ID NO: 4393 - protein, 9 aa, Homo Sapiens
ALNDHFVKL

SEQ ID NO: 4394 - protein, 9 aa, Homo Sapiens
ALNEHMTSL

SEQ ID NO: 4395 - protein, 9 aa, Homo Sapiens
ALNEKLVNL

SEQ ID NO: 4396 - protein, 9 aa, Homo Sapiens
ALNELLQHV

SEQ ID NO: 4397 - protein, 9 aa, Homo Sapiens
ALNENIDRV

SEQ ID NO: 4398 - protein, 9 aa, Homo Sapiens
ALNENINQV

SEQ ID NO: 4399 - protein, 9 aa, Homo Sapiens
ALNEQIARL

SEQ ID NO: 4400 - protein, 9 aa, Homo Sapiens
ALNGHVEMV

SEQ ID NO: 4401 - protein, 9 aa, Homo Sapiens
ALNGKLYIV

SEQ ID NO: 4402 - protein, 9 aa, Homo Sapiens
ALNHVVQLL

SEQ ID NO: 4403 - protein, 9 aa, Homo Sapiens
ALNIATHVL

SEQ ID NO: 4404 - protein, 9 aa, Homo Sapiens
ALNNHVEVA

SEQ ID NO: 4405 - protein, 9 aa, Homo Sapiens
ALNNLLHSL

SEQ ID NO: 4406 - protein, 9 aa, Homo Sapiens
ALNQYYVHL

SEQ ID NO: 4407 - protein, 9 aa, Homo Sapiens
ALNRSVQVV

SEQ ID NO: 4408 - protein, 9 aa, Homo Sapiens
ALNSAIDKM

SEQ ID NO: 4409 - protein, 9 aa, Homo Sapiens
ALNSKDAAL

SEQ ID NO: 4410 - protein, 9 aa, Homo Sapiens
ALPDWCEQL

SEQ ID NO: 4411 - protein, 9 aa, Homo Sapiens
ALPELEHNL

SEQ ID NO: 4412 - protein, 9 aa, Homo Sapiens
ALQEKLQYL

SEQ ID NO: 4413 - protein, 9 aa, Homo Sapiens
ALQEKLWNV

SEQ ID NO: 4414 - protein, 9 aa, Homo Sapiens
ALQEMVHQV

SEQ ID NO: 4415 - protein, 9 aa, Homo Sapiens
ALQERLDGL

SEQ ID NO: 4416 - protein, 9 aa, Homo Sapiens
ALQSLLHLL

SEQ ID NO: 4417 - protein, 9 aa, Homo Sapiens
ALRDVSEEL

SEQ ID NO: 4418 - protein, 9 aa, Homo Sapiens
ALREENEQL

SEQ ID NO: 4419 - protein, 9 aa, Homo Sapiens
ALRETVNAL

SEQ ID NO: 4420 - protein, 9 aa, Homo Sapiens
ALRGEIETV

SEQ ID NO: 4421 - protein, 9 aa, Homo Sapiens
ALRPEVERL

SEQ ID NO: 4422 - protein, 9 aa, Homo Sapiens
ALSAIHQKL

SEQ ID NO: 4423 - protein, 9 aa, Homo Sapiens
ALSALNPLL

SEQ ID NO: 4424 - protein, 9 aa, Homo Sapiens
ALSALTARL

SEQ ID NO: 4425 - protein, 9 aa, Homo Sapiens
ALSDGVHKI

SEQ ID NO: 4426 - protein, 9 aa, Homo Sapiens
ALSDHHVYL

SEQ ID NO: 4427 - protein, 9 aa, Homo Sapiens
ALSDIFQAV

SEQ ID NO: 4428 - protein, 9 aa, Homo Sapiens
ALSDLRCNL

SEQ ID NO: 4429 - protein, 9 aa, Homo Sapiens
ALSDSIHTV

SEQ ID NO: 4430 - protein, 9 aa, Homo Sapiens
ALSDTEQRL

SEQ ID NO: 4431 - protein, 9 aa, Homo Sapiens
ALSECAVTL

SEQ ID NO: 4432 - protein, 9 aa, Homo Sapiens
ALSEDINLI

SEQ ID NO: 4433 - protein, 9 aa, Homo Sapiens
ALSEELVQL

SEQ ID NO: 4434 - protein, 9 aa, Homo Sapiens
ALSEKIVSV

SEQ ID NO: 4435 - protein, 9 aa, Homo Sapiens
ALSEKLARL

SEQ ID NO: 4436 - protein, 9 aa, Homo Sapiens
ALSEMVEYI

SEQ ID NO: 4437 - protein, 9 aa, Homo Sapiens
ALSFIRDEV

SEQ ID NO: 4438 - protein, 9 aa, Homo Sapiens
ALSFKTGIA

SEQ ID NO: 4439 - protein, 9 aa, Homo Sapiens
ALSGFGYRL

SEQ ID NO: 4440 - protein, 9 aa, Homo Sapiens
ALSGHLETV

SEQ ID NO: 4441 - protein, 9 aa, Homo Sapiens
ALSGHVSTV

SEQ ID NO: 4442 - protein, 9 aa, Homo Sapiens
ALSHLSTTV

SEQ ID NO: 4443 - protein, 9 aa, Homo Sapiens
ALSIQNYHL

SEQ ID NO: 4444 - protein, 9 aa, Homo Sapiens
ALSKFTSHL

SEQ ID NO: 4445 - protein, 9 aa, Homo Sapiens
ALSKIIAVL

SEQ ID NO: 4446 - protein, 9 aa, Homo Sapiens
ALSLVSCKL

SEQ ID NO: 4447 - protein, 9 aa, Homo Sapiens
ALSMIIKSL

SEQ ID NO: 4448 - protein, 9 aa, Homo Sapiens
ALSNHLNAV

SEQ ID NO: 4449 - protein, 9 aa, Homo Sapiens
ALSNLEVKL

SEQ ID NO: 4450 - protein, 9 aa, Homo Sapiens
ALSNMVAAL

SEQ ID NO: 4451 - protein, 9 aa, Homo Sapiens
ALSPHNILL

SEQ ID NO: 4452 - protein, 9 aa, Homo Sapiens
ALSPLGQLL

SEQ ID NO: 4453 - protein, 9 aa, Homo Sapiens
ALSPLQSTL

SEQ ID NO: 4454 - protein, 9 aa, Homo Sapiens
ALSPNNHEV

SEQ ID NO: 4455 - protein, 9 aa, Homo Sapiens
ALSPNYDHV

SEQ ID NO: 4456 - protein, 9 aa, Homo Sapiens
ALSPQLQQL

SEQ ID NO: 4457 - protein, 9 aa, Homo Sapiens
ALSQINTKL

SEQ ID NO: 4458 - protein, 9 aa, Homo Sapiens
ALSRALSQL

SEQ ID NO: 4459 - protein, 9 aa, Homo Sapiens
ALSRIKRHL

SEQ ID NO: 4460 - protein, 9 aa, Homo Sapiens
ALSRVSVNV

SEQ ID NO: 4461 - protein, 9 aa, Homo Sapiens
ALSSFAHCL

SEQ ID NO: 4462 - protein, 9 aa, Homo Sapiens
ALSSKVQQL

SEQ ID NO: 4463 - protein, 9 aa, Homo Sapiens
ALSSLAVVV

SEQ ID NO: 4464 - protein, 9 aa, Homo Sapiens
ALSSLIHAL

SEQ ID NO: 4465 - protein, 9 aa, Homo Sapiens
ALSSLLQQL

SEQ ID NO: 4466 - protein, 9 aa, Homo Sapiens
ALSSSQAEV

SEQ ID NO: 4467 - protein, 9 aa, Homo Sapiens
ALSSVIKEL

SEQ ID NO: 4468 - protein, 9 aa, Homo Sapiens
ALSTNTTKV

SEQ ID NO: 4469 - protein, 9 aa, Homo Sapiens
ALSTQRDFL

SEQ ID NO: 4470 - protein, 9 aa, Homo Sapiens
ALTEIQEFI

SEQ ID NO: 4471 - protein, 9 aa, Homo Sapiens
ALTELGYNV

SEQ ID NO: 4472 - protein, 9 aa, Homo Sapiens
ALTELLAKI

SEQ ID NO: 4473 - protein, 9 aa, Homo Sapiens
ALTELNTKV

SEQ ID NO: 4474 - protein, 9 aa, Homo Sapiens
ALTELREML

SEQ ID NO: 4475 - protein, 9 aa, Homo Sapiens
ALTHIDHSL

SEQ ID NO: 4476 - protein, 9 aa, Homo Sapiens
ALTRVIYNL

SEQ ID NO: 4477 - protein, 9 aa, Homo Sapiens
ALVDHVAEL

SEQ ID NO: 4478 - protein, 9 aa, Homo Sapiens
ALVEQSQKL

SEQ ID NO: 4479 - protein, 9 aa, Homo Sapiens
ALVGFCDEV

SEQ ID NO: 4480 - protein, 9 aa, Homo Sapiens
ALVQDLAKA

SEQ ID NO: 4481 - protein, 9 aa, Homo Sapiens
ALVSSLHLL

SEQ ID NO: 4482 - protein, 9 aa, Homo Sapiens
ALWDKLFNL

SEQ ID NO: 4483 - protein, 9 aa, Homo Sapiens
ALYAVIEKA

SEQ ID NO: 4484 - protein, 9 aa, Homo Sapiens
ALYDNVEKL

SEQ ID NO: 4485 - protein, 9 aa, Homo Sapiens
ALYGHTQAV

SEQ ID NO: 4486 - protein, 9 aa, Homo Sapiens
ALYHLAIKL

SEQ ID NO: 4487 - protein, 9 aa, Homo Sapiens
ALYPVLEKA

SEQ ID NO: 4488 - protein, 9 aa, Homo Sapiens
ALYSAEHGL

SEQ ID NO: 4489 - protein, 9 aa, Homo Sapiens
ALYTATEKL

SEQ ID NO: 4490 - protein, 9 aa, Homo Sapiens
ALYTVLHRL

SEQ ID NO: 4491 - protein, 9 aa, Homo Sapiens
AMAATYSAL

SEQ ID NO: 4492 - protein, 9 aa, Homo Sapiens
AMADLEQKV

SEQ ID NO: 4493 - protein, 9 aa, Homo Sapiens
AMAKIQAKI

SEQ ID NO: 4494 - protein, 9 aa, Homo Sapiens
AMAMVDHCL

SEQ ID NO: 4495 - protein, 9 aa, Homo Sapiens
AMAPGTVTV

SEQ ID NO: 4496 - protein, 9 aa, Homo Sapiens
AMASIINRL

SEQ ID NO: 4497 - protein, 9 aa, Homo Sapiens
AMASLYDRI

SEQ ID NO: 4498 - protein, 9 aa, Homo Sapiens
AMFDFSEKL

SEQ ID NO: 4499 - protein, 9 aa, Homo Sapiens
AMFGKLMTI

SEQ ID NO: 4500 - protein, 9 aa, Homo Sapiens
AMHGFSVTL

SEQ ID NO: 4501 - protein, 9 aa, Homo Sapiens
AMIELVERL

SEQ ID NO: 4502 - protein, 9 aa, Homo Sapiens
AMIKGLQVL

SEQ ID NO: 4503 - protein, 9 aa, Homo Sapiens
AMKKVVQQL

SEQ ID NO: 4504 - protein, 9 aa, Homo Sapiens
AMMAKAEYL

SEQ ID NO: 4505 - protein, 9 aa, Homo Sapiens
AMNGHTAAV

SEQ ID NO: 4506 - protein, 9 aa, Homo Sapiens
AMNGHVPAV

SEQ ID NO: 4507 - protein, 9 aa, Homo Sapiens
AMRAFADAL

SEQ ID NO: 4508 - protein, 9 aa, Homo Sapiens
AMSSKFFLV

SEQ ID NO: 4509 - protein, 9 aa, Homo Sapiens
AMTKDNNLL

SEQ ID NO: 4510 - protein, 9 aa, Homo Sapiens
AQADLAYQL

SEQ ID NO: 4511 - protein, 9 aa, Homo Sapiens
AQAELQHVL

SEQ ID NO: 4512 - protein, 9 aa, Homo Sapiens
AQAEVYKEL

SEQ ID NO: 4513 - protein, 9 aa, Homo Sapiens
AQAKIYWNL

SEQ ID NO: 4514 - protein, 9 aa, Homo Sapiens
ATADYICKV

SEQ ID NO: 4515 - protein, 9 aa, Homo Sapiens
ATCGHINLV

SEQ ID NO: 4516 - protein, 9 aa, Homo Sapiens
ATFARIWYL

SEQ ID NO: 4517 - protein, 9 aa, Homo Sapiens
ATSDLNIKV

SEQ ID NO: 4518 - protein, 9 aa, Homo Sapiens
ATSGLDHQL

SEQ ID NO: 4519 - protein, 9 aa, Homo Sapiens
ATSYLSHQL

SEQ ID NO: 4520 - protein, 9 aa, Homo Sapiens
AVADLQTRL

SEQ ID NO: 4521 - protein, 9 aa, Homo Sapiens
AVAEINAVM

SEQ ID NO: 4522 - protein, 9 aa, Homo Sapiens
AVAELNYGL

SEQ ID NO: 4523 - protein, 9 aa, Homo Sapiens
AVAGLPHAV

SEQ ID NO: 4524 - protein, 9 aa, Homo Sapiens
AVANIVNSV

SEQ ID NO: 4525 - protein, 9 aa, Homo Sapiens
AVASFVTQL

SEQ ID NO: 4526 - protein, 9 aa, Homo Sapiens
AVASKTYNL

SEQ ID NO: 4527 - protein, 9 aa, Homo Sapiens
AVCGYLVEL

SEQ ID NO: 4528 - protein, 9 aa, Homo Sapiens
AVSDHEATL

SEQ ID NO: 4529 - protein, 9 aa, Homo Sapiens
AVSDILEKL

SEQ ID NO: 4530 - protein, 9 aa, Homo Sapiens
CLYGNVEKV

SEQ ID NO: 4531 - protein, 9 aa, Homo Sapiens
CTAGTLHNL

SEQ ID NO: 4532 - protein, 9 aa, Homo Sapiens
DILRALEKL

SEQ ID NO: 4533 - protein, 9 aa, Homo Sapiens
EALSLLHTL

SEQ ID NO: 4534 - protein, 9 aa, Homo Sapiens
EGPEGLKLI

SEQ ID NO: 4535 - protein, 9 aa, Homo Sapiens
ELAEIYAKL

SEQ ID NO: 4536 - protein, 9 aa, Homo Sapiens
ELAELHANL

SEQ ID NO: 4537 - protein, 9 aa, Homo Sapiens
ELANLYHHV

SEQ ID NO: 4538 - protein, 9 aa, Homo Sapiens
ELAQLYHHV

SEQ ID NO: 4539 - protein, 9 aa, Homo Sapiens
ELKPFIEEL

SEQ ID NO: 4540 - protein, 9 aa, Homo Sapiens
ELSDVLIYL

SEQ ID NO: 4541 - protein, 9 aa, Homo Sapiens
ELSEISERL

SEQ ID NO: 4542 - protein, 9 aa, Homo Sapiens
ELSEKNFQL

SEQ ID NO: 4543 - protein, 9 aa, Homo Sapiens
ELSHINARL

SEQ ID NO: 4544 - protein, 9 aa, Homo Sapiens
ELSKIIQKV

SEQ ID NO: 4545 - protein, 9 aa, Homo Sapiens
ELSYLAHNL

SEQ ID NO: 4546 - protein, 9 aa, Homo Sapiens
FACEKNENL

SEQ ID NO: 4547 - protein, 9 aa, Homo Sapiens
FASGLIHRV

SEQ ID NO: 4548 - protein, 9 aa, Homo Sapiens
FASTILHLV

SEQ ID NO: 4549 - protein, 9 aa, Homo Sapiens
FDKATYDKL

SEQ ID NO: 4550 - protein, 9 aa, Homo Sapiens
FIADHCPTL

SEQ ID NO: 4551 - protein, 9 aa, Homo Sapiens
FIAEHYMFL

SEQ ID NO: 4552 - protein, 9 aa, Homo Sapiens
FIAHFQDNL

SEQ ID NO: 4553 - protein, 9 aa, Homo Sapiens
FIAPSGHGL

SEQ ID NO: 4554 - protein, 9 aa, Homo Sapiens
FIAPTGHSL

SEQ ID NO: 4555 - protein, 9 aa, Homo Sapiens
FICPITREL

SEQ ID NO: 4556 - protein, 9 aa, Homo Sapiens
FIFSDTHEL

SEQ ID NO: 4557 - protein, 9 aa, Homo Sapiens
FIGDVIHNA

SEQ ID NO: 4558 - protein, 9 aa, Homo Sapiens
FISALVDEL

SEQ ID NO: 4559 - protein, 9 aa, Homo Sapiens
FISEFEHRV

SEQ ID NO: 4560 - protein, 9 aa, Homo Sapiens
FISGHTSEL

SEQ ID NO: 4561 - protein, 9 aa, Homo Sapiens
FISHLFMQL

SEQ ID NO: 4562 - protein, 9 aa, Homo Sapiens
FISPFGHGL

SEQ ID NO: 4563 - protein, 9 aa, Homo Sapiens
FISPTGHSL

SEQ ID NO: 4564 - protein, 9 aa, Homo Sapiens
FLADAKWIL

SEQ ID NO: 4565 - protein, 9 aa, Homo Sapiens
FLADDLGGL

SEQ ID NO: 4566 - protein, 9 aa, Homo Sapiens
FLADIVQKL

SEQ ID NO: 4567 - protein, 9 aa, Homo Sapiens
FLADNHHQV

SEQ ID NO: 4568 - protein, 9 aa, Homo Sapiens
FLADPSAFV

SEQ ID NO: 4569 - protein, 9 aa, Homo Sapiens
FLADPVSNM

SEQ ID NO: 4570 - protein, 9 aa, Homo Sapiens
FLAEAARSL

SEQ ID NO: 4571 - protein, 9 aa, Homo Sapiens
FLAEHDYGL

SEQ ID NO: 4572 - protein, 9 aa, Homo Sapiens
FLAEIFKKI

SEQ ID NO: 4573 - protein, 9 aa, Homo Sapiens
FLAESCATL

SEQ ID NO: 4574 - protein, 9 aa, Homo Sapiens
FLAGAVTSV

SEQ ID NO: 4575 - protein, 9 aa, Homo Sapiens
FLAHIYTEL

SEQ ID NO: 4576 - protein, 9 aa, Homo Sapiens
FLAITTDCL

SEQ ID NO: 4577 - protein, 9 aa, Homo Sapiens
FLAKDFNFL

SEQ ID NO: 4578 - protein, 9 aa, Homo Sapiens
FLAKLIAQA

SEQ ID NO: 4579 - protein, 9 aa, Homo Sapiens
FLAKMTNGF

SEQ ID NO: 4580 - protein, 9 aa, Homo Sapiens
FLAPGTCVV

SEQ ID NO: 4581 - protein, 9 aa, Homo Sapiens
FLAQENMRL

SEQ ID NO: 4582 - protein, 9 aa, Homo Sapiens
FLAQHFDKL

SEQ ID NO: 4583 - protein, 9 aa, Homo Sapiens
FLAQRAVEL

SEQ ID NO: 4584 - protein, 9 aa, Homo Sapiens
FLASDVQQL

SEQ ID NO: 4585 - protein, 9 aa, Homo Sapiens
FLASLDRAK

SEQ ID NO: 4586 - protein, 9 aa, Homo Sapiens
FLASSEEKL

SEQ ID NO: 4587 - protein, 9 aa, Homo Sapiens
FLATRNDNI

SEQ ID NO: 4588 - protein, 9 aa, Homo Sapiens
FLCARLLDL

SEQ ID NO: 4589 - protein, 9 aa, Homo Sapiens
FLCKDLWVA

SEQ ID NO: 4590 - protein, 9 aa, Homo Sapiens
FLCNEAKNL

SEQ ID NO: 4591 - protein, 9 aa, Homo Sapiens
FLCNFLIKM

SEQ ID NO: 4592 - protein, 9 aa, Homo Sapiens
FLCPFHLSV

SEQ ID NO: 4593 - protein, 9 aa, Homo Sapiens
FLCTLQKKL

SEQ ID NO: 4594 - protein, 9 aa, Homo Sapiens
FLCVVSKEL

SEQ ID NO: 4595 - protein, 9 aa, Homo Sapiens
FLCVVSREL

SEQ ID NO: 4596 - protein, 9 aa, Homo Sapiens
FLDDLSQKL

SEQ ID NO: 4597 - protein, 9 aa, Homo Sapiens
FLDEKTHEL

SEQ ID NO: 4598 - protein, 9 aa, Homo Sapiens
FLDNLHINL

SEQ ID NO: 4599 - protein, 9 aa, Homo Sapiens
FLECGKTNL

SEQ ID NO: 4600 - protein, 9 aa, Homo Sapiens
FLEESRNQL

SEQ ID NO: 4601 - protein, 9 aa, Homo Sapiens
FLESGKTNL

SEQ ID NO: 4602 - protein, 9 aa, Homo Sapiens
FLETKTQAL

SEQ ID NO: 4603 - protein, 9 aa, Homo Sapiens
FLETNVPLL

SEQ ID NO: 4604 - protein, 9 aa, Homo Sapiens
FLFDHLLTL

SEQ ID NO: 4605 - protein, 9 aa, Homo Sapiens
FLFDRPMHV

SEQ ID NO: 4606 - protein, 9 aa, Homo Sapiens
FLFDTQHFI

SEQ ID NO: 4607 - protein, 9 aa, Homo Sapiens
FLFELPSRL

SEQ ID NO: 4608 - protein, 9 aa, Homo Sapiens
FLFEPVVKA

SEQ ID NO: 4609 - protein, 9 aa, Homo Sapiens
FLFGEVHKA

SEQ ID NO: 4610 - protein, 9 aa, Homo Sapiens
FLFGYPKRL

SEQ ID NO: 4611 - protein, 9 aa, Homo Sapiens
FLFLDRTYV

SEQ ID NO: 4612 - protein, 9 aa, Homo Sapiens
FLFNKVVNL

SEQ ID NO: 4613 - protein, 9 aa, Homo Sapiens
FLFNTENKL

SEQ ID NO: 4614 - protein, 9 aa, Homo Sapiens
FLFSDVCRV

SEQ ID NO: 4615 - protein, 9 aa, Homo Sapiens
FLFSKFIEL

SEQ ID NO: 4616 - protein, 9 aa, Homo Sapiens
FLFTTPCRL

SEQ ID NO: 4617 - protein, 9 aa, Homo Sapiens
FLGDLSHLL

SEQ ID NO: 4618 - protein, 9 aa, Homo Sapiens
FLGDYVENL

SEQ ID NO: 4619 - protein, 9 aa, Homo Sapiens
FLGEINDRL

SEQ ID NO: 4620 - protein, 9 aa, Homo Sapiens
FLGNFQDNL

SEQ ID NO: 4621 - protein, 9 aa, Homo Sapiens
FLGPWPAAS

SEQ ID NO: 4622 - protein, 9 aa, Homo Sapiens
FLGSFIDHV

SEQ ID NO: 4623 - protein, 9 aa, Homo Sapiens
FLGYMVHRL

SEQ ID NO: 4624 - protein, 9 aa, Homo Sapiens
FLHANHERL

SEQ ID NO: 4625 - protein, 9 aa, Homo Sapiens
FLHDHQAEL

SEQ ID NO: 4626 - protein, 9 aa, Homo Sapiens
FLHDNMVEI

SEQ ID NO: 4627 - protein, 9 aa, Homo Sapiens
FLHEATARL

SEQ ID NO: 4628 - protein, 9 aa, Homo Sapiens
FLHEATVRL

SEQ ID NO: 4629 - protein, 9 aa, Homo Sapiens
FLHEKLESL

SEQ ID NO: 4630 - protein, 9 aa, Homo Sapiens
FLHELEEKM

SEQ ID NO: 4631 - protein, 9 aa, Homo Sapiens
FLHVGQAGL

SEQ ID NO: 4632 - protein, 9 aa, Homo Sapiens
FLIGQGAHV

SEQ ID NO: 4633 - protein, 9 aa, Homo Sapiens
FLINFIHTL

SEQ ID NO: 4634 - protein, 9 aa, Homo Sapiens
FLIPIYHQV

SEQ ID NO: 4635 - protein, 9 aa, Homo Sapiens
FLIRESETL

SEQ ID NO: 4636 - protein, 9 aa, Homo Sapiens
FLITILDHL

SEQ ID NO: 4637 - protein, 9 aa, Homo Sapiens
FLKEELVAA

SEQ ID NO: 4638 - protein, 9 aa, Homo Sapiens
FLKEGCELI

SEQ ID NO: 4639 - protein, 9 aa, Homo Sapiens
FLKENGEKL

SEQ ID NO: 4640 - protein, 9 aa, Homo Sapiens
FLKNELDNV

SEQ ID NO: 4641 - protein, 9 aa, Homo Sapiens
FLKNEVERL

SEQ ID NO: 4642 - protein, 9 aa, Homo Sapiens
FLKSNFEYL

SEQ ID NO: 4643 - protein, 9 aa, Homo Sapiens
FLLEKGYEV

SEQ ID NO: 4644 - protein, 9 aa, Homo Sapiens
FLMDFIHQV

SEQ ID NO: 4645 - protein, 9 aa, Homo Sapiens
FLMEEVHMI

SEQ ID NO: 4646 - protein, 9 aa, Homo Sapiens
FLMGPVKQL

SEQ ID NO: 4647 - protein, 9 aa, Homo Sapiens
FLMNEVIKL

SEQ ID NO: 4648 - protein, 9 aa, Homo Sapiens
FLMPTSSEL

SEQ ID NO: 4649 - protein, 9 aa, Homo Sapiens
FLMRHLVHM

SEQ ID NO: 4650 - protein, 9 aa, Homo Sapiens
FLNAKCESA

SEQ ID NO: 4651 - protein, 9 aa, Homo Sapiens
FLNASANKL

SEQ ID NO: 4652 - protein, 9 aa, Homo Sapiens
FLNDEVWNL

SEQ ID NO: 4653 - protein, 9 aa, Homo Sapiens
FLNDPGHLL

SEQ ID NO: 4654 - protein, 9 aa, Homo Sapiens
FLNEDLNQL

SEQ ID NO: 4655 - protein, 9 aa, Homo Sapiens
FLNEEVKSL

SEQ ID NO: 4656 - protein, 9 aa, Homo Sapiens
FLNELIKVL

SEQ ID NO: 4657 - protein, 9 aa, Homo Sapiens
FLNGEVIRL

SEQ ID NO: 4658 - protein, 9 aa, Homo Sapiens
FLNGIIDRI

SEQ ID NO: 4659 - protein, 9 aa, Homo Sapiens
FLNGVCTNI

SEQ ID NO: 4660 - protein, 9 aa, Homo Sapiens
FLNHCLEHL

SEQ ID NO: 4661 - protein, 9 aa, Homo Sapiens
FLNKEILEL

SEQ ID NO: 4662 - protein, 9 aa, Homo Sapiens
FLNKEITSV

SEQ ID NO: 4663 - protein, 9 aa, Homo Sapiens
FLNKLIPVL

SEQ ID NO: 4664 - protein, 9 aa, Homo Sapiens
FLNKYILSL

SEQ ID NO: 4665 - protein, 9 aa, Homo Sapiens
FLNMVCVKL

SEQ ID NO: 4666 - protein, 9 aa, Homo Sapiens
FLNNQEYVL

SEQ ID NO: 4667 - protein, 9 aa, Homo Sapiens
FLNNQIKEL

SEQ ID NO: 4668 - protein, 9 aa, Homo Sapiens
FLNRSIQKL

SEQ ID NO: 4669 - protein, 9 aa, Homo Sapiens
FLPDGCDHL

SEQ ID NO: 4670 - protein, 9 aa, Homo Sapiens
FLPEVIYKM

SEQ ID NO: 4671 - protein, 9 aa, Homo Sapiens
FLPGICKEL

SEQ ID NO: 4672 - protein, 9 aa, Homo Sapiens
FLPLHYDYL

SEQ ID NO: 4673 - protein, 9 aa, Homo Sapiens
FLPLIVNTV

SEQ ID NO: 4674 - protein, 9 aa, Homo Sapiens
FLPQKIIYL

SEQ ID NO: 4675 - protein, 9 aa, Homo Sapiens
FLPSHYNYL

SEQ ID NO: 4676 - protein, 9 aa, Homo Sapiens
FLPSYIIDV

SEQ ID NO: 4677 - protein, 9 aa, Homo Sapiens
FLPTILNQL

SEQ ID NO: 4678 - protein, 9 aa, Homo Sapiens
FLQEHNTTL

SEQ ID NO: 4679 - protein, 9 aa, Homo Sapiens
FLQEKSPAV

SEQ ID NO: 4680 - protein, 9 aa, Homo Sapiens
FLQEYVANL

SEQ ID NO: 4681 - protein, 9 aa, Homo Sapiens
FLQKLISQL

SEQ ID NO: 4682 - protein, 9 aa, Homo Sapiens
FLQPELVKL

SEQ ID NO: 4683 - protein, 9 aa, Homo Sapiens
FLQPGGYHV

SEQ ID NO: 4684 - protein, 9 aa, Homo Sapiens
FLQPNKCFL

SEQ ID NO: 4685 - protein, 9 aa, Homo Sapiens
FLQRFIDPL

SEQ ID NO: 4686 - protein, 9 aa, Homo Sapiens
FLRDNLEWL

SEQ ID NO: 4687 - protein, 9 aa, Homo Sapiens
FLREWVESM

SEQ ID NO: 4688 - protein, 9 aa, Homo Sapiens
FLRNINEYL

SEQ ID NO: 4689 - protein, 9 aa, Homo Sapiens
FLSDHVQEM

SEQ ID NO: 4690 - protein, 9 aa, Homo Sapiens
FLSDLRDML

SEQ ID NO: 4691 - protein, 9 aa, Homo Sapiens
FLSEEGGHV

SEQ ID NO: 4692 - protein, 9 aa, Homo Sapiens
FLSEKDSLL

SEQ ID NO: 4693 - protein, 9 aa, Homo Sapiens
FLSEKLERI

SEQ ID NO: 4694 - protein, 9 aa, Homo Sapiens
FLSELTQQL

SEQ ID NO: 4695 - protein, 9 aa, Homo Sapiens
FLSETCKYL

SEQ ID NO: 4696 - protein, 9 aa, Homo Sapiens
FLSEVFHQA

SEQ ID NO: 4697 - protein, 9 aa, Homo Sapiens
FLSGYYVTL

SEQ ID NO: 4698 - protein, 9 aa, Homo Sapiens
FLSHIPITL

SEQ ID NO: 4699 - protein, 9 aa, Homo Sapiens
FLSILCNNL

SEQ ID NO: 4700 - protein, 9 aa, Homo Sapiens
FLSKDISYL

SEQ ID NO: 4701 - protein, 9 aa, Homo Sapiens
FLSKIEEKL

SEQ ID NO: 4702 - protein, 9 aa, Homo Sapiens
FLSKRLSKA

SEQ ID NO: 4703 - protein, 9 aa, Homo Sapiens
FLSLIGEKV

SEQ ID NO: 4704 - protein, 9 aa, Homo Sapiens
FLSNDTVQL

SEQ ID NO: 4705 - protein, 9 aa, Homo Sapiens
FLSPDKLSL

SEQ ID NO: 4706 - protein, 9 aa, Homo Sapiens
FLSPVDNHM

SEQ ID NO: 4707 - protein, 9 aa, Homo Sapiens
FLSQRETLL

SEQ ID NO: 4708 - protein, 9 aa, Homo Sapiens
FLSQTGHGV

SEQ ID NO: 4709 - protein, 9 aa, Homo Sapiens
FLSRQFESL

SEQ ID NO: 4710 - protein, 9 aa, Homo Sapiens
FLSSFEEKI

SEQ ID NO: 4711 - protein, 9 aa, Homo Sapiens
FLSSSNLSL

SEQ ID NO: 4712 - protein, 9 aa, Homo Sapiens
FLSSVIQNL

SEQ ID NO: 4713 - protein, 9 aa, Homo Sapiens
FLSTLEHHL

SEQ ID NO: 4714 - protein, 9 aa, Homo Sapiens
FLSTNEGKL

SEQ ID NO: 4715 - protein, 9 aa, Homo Sapiens
FLTDREVRL

SEQ ID NO: 4716 - protein, 9 aa, Homo Sapiens
FLTDTSHLL

SEQ ID NO: 4717 - protein, 9 aa, Homo Sapiens
FLTEFINYI

SEQ ID NO: 4718 - protein, 9 aa, Homo Sapiens
FLTEHNSNV

SEQ ID NO: 4719 - protein, 9 aa, Homo Sapiens
FLTGVTTEL

SEQ ID NO: 4720 - protein, 9 aa, Homo Sapiens
FLTKIHEML

SEQ ID NO: 4721 - protein, 9 aa, Homo Sapiens
FLTPLRNFI

SEQ ID NO: 4722 - protein, 9 aa, Homo Sapiens
FLTPLRNIF

SEQ ID NO: 4723 - protein, 9 aa, Homo Sapiens
FLTRIISQL

SEQ ID NO: 4724 - protein, 9 aa, Homo Sapiens
FLVAENERL

SEQ ID NO: 4725 - protein, 9 aa, Homo Sapiens
FLVDGVCTV

SEQ ID NO: 4726 - protein, 9 aa, Homo Sapiens
FLVDIMEHL

SEQ ID NO: 4727 - protein, 9 aa, Homo Sapiens
FLVEHNLVL

SEQ ID NO: 4728 - protein, 9 aa, Homo Sapiens
FLVEHVLTL

SEQ ID NO: 4729 - protein, 9 aa, Homo Sapiens
FLVPTFEQL

SEQ ID NO: 4730 - protein, 9 aa, Homo Sapiens
FLVQNIHTL

SEQ ID NO: 4731 - protein, 9 aa, Homo Sapiens
FLVTVIHTL

SEQ ID NO: 4732 - protein, 9 aa, Homo Sapiens
FLYAGHIFL

SEQ ID NO: 4733 - protein, 9 aa, Homo Sapiens
FLYDDNQRV

SEQ ID NO: 4734 - protein, 9 aa, Homo Sapiens
FLYDTHQNL

SEQ ID NO: 4735 - protein, 9 aa, Homo Sapiens
FLYFEDHGL

SEQ ID NO: 4736 - protein, 9 aa, Homo Sapiens
FLYPFLHTV

SEQ ID NO: 4737 - protein, 9 aa, Homo Sapiens
FLYQYSTRL

SEQ ID NO: 4738 - protein, 9 aa, Homo Sapiens
FMADCPHTI

SEQ ID NO: 4739 - protein, 9 aa, Homo Sapiens
FMAPKAWTV

SEQ ID NO: 4740 - protein, 9 aa, Homo Sapiens
FMAPLQEKV

SEQ ID NO: 4741 - protein, 9 aa, Homo Sapiens
FMAPYTHFT

SEQ ID NO: 4742 - protein, 9 aa, Homo Sapiens
FMASHLDYL

SEQ ID NO: 4743 - protein, 9 aa, Homo Sapiens
FMATIAEGL

SEQ ID NO: 4744 - protein, 9 aa, Homo Sapiens
FMCDKIYQV

SEQ ID NO: 4745 - protein, 9 aa, Homo Sapiens
FMHQIIDQV

SEQ ID NO: 4746 - protein, 9 aa, Homo Sapiens
FMIKHSQKL

SEQ ID NO: 4747 - protein, 9 aa, Homo Sapiens
FMKKYIHVA

SEQ ID NO: 4748 - protein, 9 aa, Homo Sapiens
FMKNKVEQL

SEQ ID NO: 4749 - protein, 9 aa, Homo Sapiens
FMMDKTNIL

SEQ ID NO: 4750 - protein, 9 aa, Homo Sapiens
FMMPRIVNV

SEQ ID NO: 4751 - protein, 9 aa, Homo Sapiens
FMNDAIEKA

SEQ ID NO: 4752 - protein, 9 aa, Homo Sapiens
FMNPHLISV

SEQ ID NO: 4753 - protein, 9 aa, Homo Sapiens
FMNSAIQCL

SEQ ID NO: 4754 - protein, 9 aa, Homo Sapiens
FMNSVIQSL

SEQ ID NO: 4755 - protein, 9 aa, Homo Sapiens
FMSDLMKAL

SEQ ID NO: 4756 - protein, 9 aa, Homo Sapiens
FMSEISDEF

SEQ ID NO: 4757 - protein, 9 aa, Homo Sapiens
FMSLLEEKL

SEQ ID NO: 4758 - protein, 9 aa, Homo Sapiens
FQAEIAQLM

SEQ ID NO: 4759 - protein, 9 aa, Homo Sapiens
FQATIVKAV

SEQ ID NO: 4760 - protein, 9 aa, Homo Sapiens
FQSDTNAML

SEQ ID NO: 4761 - protein, 9 aa, Homo Sapiens
FQTDLIYNL

SEQ ID NO: 4762 - protein, 9 aa, Homo Sapiens
FTADFVRQL

SEQ ID NO: 4763 - protein, 9 aa, Homo Sapiens
FTAEKTDEL

SEQ ID NO: 4764 - protein, 9 aa, Homo Sapiens
FTAWCNSHL

SEQ ID NO: 4765 - protein, 9 aa, Homo Sapiens
FVADFADKL

SEQ ID NO: 4766 - protein, 9 aa, Homo Sapiens
FVDDYTVRV

SEQ ID NO: 4767 - protein, 9 aa, Homo Sapiens
FVIDLQTRL

SEQ ID NO: 4768 - protein, 9 aa, Homo Sapiens
FVIRNIVEA

SEQ ID NO: 4769 - protein, 9 aa, Homo Sapiens
FVNDIFERI

SEQ ID NO: 4770 - protein, 9 aa, Homo Sapiens
FVPEIFHRI

SEQ ID NO: 4771 - protein, 9 aa, Homo Sapiens
GAADIDHKL

SEQ ID NO: 4772 - protein, 9 aa, Homo Sapiens
GEILARQEL

SEQ ID NO: 4773 - protein, 9 aa, Homo Sapiens
GIADLAHLL

SEQ ID NO: 4774 - protein, 9 aa, Homo Sapiens
GIAKHIQKL

SEQ ID NO: 4775 - protein, 9 aa, Homo Sapiens
GIAPCNNRL

SEQ ID NO: 4776 - protein, 9 aa, Homo Sapiens
GIMKKAYEL

SEQ ID NO: 4777 - protein, 9 aa, Homo Sapiens
GLAAENQEL

SEQ ID NO: 4778 - protein, 9 aa, Homo Sapiens
GLAAFRAFL

SEQ ID NO: 4779 - protein, 9 aa, Homo Sapiens
GLADKVYFL

SEQ ID NO: 4780 - protein, 9 aa, Homo Sapiens
GLADRCPAL

SEQ ID NO: 4781 - protein, 9 aa, Homo Sapiens
GLAEDSPKM

SEQ ID NO: 4782 - protein, 9 aa, Homo Sapiens
GLAEFQENV

SEQ ID NO: 4783 - protein, 9 aa, Homo Sapiens
GLAELGHRL

SEQ ID NO: 4784 - protein, 9 aa, Homo Sapiens
GLAENKSTL

SEQ ID NO: 4785 - protein, 9 aa, Homo Sapiens
GLAGPLHGL

SEQ ID NO: 4786 - protein, 9 aa, Homo Sapiens
GLAHSLQHL

SEQ ID NO: 4787 - protein, 9 aa, Homo Sapiens
GLAKAVASV

SEQ ID NO: 4788 - protein, 9 aa, Homo Sapiens
GLAKRVWSL

SEQ ID NO: 4789 - protein, 9 aa, Homo Sapiens
GLALALNKL

SEQ ID NO: 4790 - protein, 9 aa, Homo Sapiens
GLALIAERL

SEQ ID NO: 4791 - protein, 9 aa, Homo Sapiens
GLAMKLQNL

SEQ ID NO: 4792 - protein, 9 aa, Homo Sapiens
GLAPFTEGI

SEQ ID NO: 4793 - protein, 9 aa, Homo Sapiens
GLAPKPVQV

SEQ ID NO: 4794 - protein, 9 aa, Homo Sapiens
GLAPLHIQL

SEQ ID NO: 4795 - protein, 9 aa, Homo Sapiens
GLAPNSNKV

SEQ ID NO: 4796 - protein, 9 aa, Homo Sapiens
GLAPQIHDL

SEQ ID NO: 4797 - protein, 9 aa, Homo Sapiens
GLAQKVDPA

SEQ ID NO: 4798 - protein, 9 aa, Homo Sapiens
GLARLLSRL

SEQ ID NO: 4799 - protein, 9 aa, Homo Sapiens
GLASKAAEL

SEQ ID NO: 4800 - protein, 9 aa, Homo Sapiens
GLATDVQTV

SEQ ID NO: 4801 - protein, 9 aa, Homo Sapiens
GLAVLKHVL

SEQ ID NO: 4802 - protein, 9 aa, Homo Sapiens
GLAVSEHRL

SEQ ID NO: 4803 - protein, 9 aa, Homo Sapiens
GLCERLVSL

SEQ ID NO: 4804 - protein, 9 aa, Homo Sapiens
GLCPHVVVL

SEQ ID NO: 4805 - protein, 9 aa, Homo Sapiens
GLCSRVSTL

SEQ ID NO: 4806 - protein, 9 aa, Homo Sapiens
GLFDQHFRL

SEQ ID NO: 4807 - protein, 9 aa, Homo Sapiens
GLFEAAHVL

SEQ ID NO: 4808 - protein, 9 aa, Homo Sapiens
GLFGHCQNV

SEQ ID NO: 4809 - protein, 9 aa, Homo Sapiens
GLFHGNEML

SEQ ID NO: 4810 - protein, 9 aa, Homo Sapiens
GLFPWTPKL

SEQ ID NO: 4811 - protein, 9 aa, Homo Sapiens
GLFQGKTPL

SEQ ID NO: 4812 - protein, 9 aa, Homo Sapiens
GLFQHICTA

SEQ ID NO: 4813 - protein, 9 aa, Homo Sapiens
GLGPHPCFL

SEQ ID NO: 4814 - protein, 9 aa, Homo Sapiens
GLHDGIQRV

SEQ ID NO: 4815 - protein, 9 aa, Homo Sapiens
GLHENSVRL

SEQ ID NO: 4816 - protein, 9 aa, Homo Sapiens
GLHTVLSKL

SEQ ID NO: 4817 - protein, 9 aa, Homo Sapiens
GLIDHQTYL

SEQ ID NO: 4818 - protein, 9 aa, Homo Sapiens
GLIDKVNEL

SEQ ID NO: 4819 - protein, 9 aa, Homo Sapiens
GLIDRQVTV

SEQ ID NO: 4820 - protein, 9 aa, Homo Sapiens
GLIDVHVHL

SEQ ID NO: 4821 - protein, 9 aa, Homo Sapiens
GLIEILKKV

SEQ ID NO: 4822 - protein, 9 aa, Homo Sapiens
GLIEKNIEL

SEQ ID NO: 4823 - protein, 9 aa, Homo Sapiens
GLIENPALL

SEQ ID NO: 4824 - protein, 9 aa, Homo Sapiens
GLKDKIHHV

SEQ ID NO: 4825 - protein, 9 aa, Homo Sapiens
GLKEGIPAL

SEQ ID NO: 4826 - protein, 9 aa, Homo Sapiens
GLKELSEYV

SEQ ID NO: 4827 - protein, 9 aa, Homo Sapiens
GLKKVIQKV

SEQ ID NO: 4828 - protein, 9 aa, Homo Sapiens
GLKNGVPAV

SEQ ID NO: 4829 - protein, 9 aa, Homo Sapiens
GLKRELEAL

SEQ ID NO: 4830 - protein, 9 aa, Homo Sapiens
GLLGYLHFV

SEQ ID NO: 4831 - protein, 9 aa, Homo Sapiens
GLMKDTHTV

SEQ ID NO: 4832 - protein, 9 aa, Homo Sapiens
GLMRKVPRV

SEQ ID NO: 4833 - protein, 9 aa, Homo Sapiens
GLNDFIQKI

SEQ ID NO: 4834 - protein, 9 aa, Homo Sapiens
GLNDLQTQL

SEQ ID NO: 4835 - protein, 9 aa, Homo Sapiens
GLNEEIARV

SEQ ID NO: 4836 - protein, 9 aa, Homo Sapiens
GLNGHLTKL

SEQ ID NO: 4837 - protein, 9 aa, Homo Sapiens
GLNSIVHKA

SEQ ID NO: 4838 - protein, 9 aa, Homo Sapiens
GLQEAQYRL

SEQ ID NO: 4839 - protein, 9 aa, Homo Sapiens
GLQEGTHEL

SEQ ID NO: 4840 - protein, 9 aa, Homo Sapiens
GLREKAEYL

SEQ ID NO: 4841 - protein, 9 aa, Homo Sapiens
GLRHQVEQL

SEQ ID NO: 4842 - protein, 9 aa, Homo Sapiens
GLSAFLHAI

SEQ ID NO: 4843 - protein, 9 aa, Homo Sapiens
GLSDIHHRM

SEQ ID NO: 4844 - protein, 9 aa, Homo Sapiens
GLSDLRLEL

SEQ ID NO: 4845 - protein, 9 aa, Homo Sapiens
GLSDVFDNL

SEQ ID NO: 4846 - protein, 9 aa, Homo Sapiens
GLSEAMNEL

SEQ ID NO: 4847 - protein, 9 aa, Homo Sapiens
GLSEPIFQL

SEQ ID NO: 4848 - protein, 9 aa, Homo Sapiens
GLSEQIREL

SEQ ID NO: 4849 - protein, 9 aa, Homo Sapiens
GLSERDINL

SEQ ID NO: 4850 - protein, 9 aa, Homo Sapiens
GLSESSVKV

SEQ ID NO: 4851 - protein, 9 aa, Homo Sapiens
GLSGFHTYL

SEQ ID NO: 4852 - protein, 9 aa, Homo Sapiens
GLSHHIHAL

SEQ ID NO: 4853 - protein, 9 aa, Homo Sapiens
GLSHLQQSL

SEQ ID NO: 4854 - protein, 9 aa, Homo Sapiens
GLSHVDYAL

SEQ ID NO: 4855 - protein, 9 aa, Homo Sapiens
GLSHVLNRL

SEQ ID NO: 4856 - protein, 9 aa, Homo Sapiens
GLSIFIYRL

SEQ ID NO: 4857 - protein, 9 aa, Homo Sapiens
GLSNHIAAL

SEQ ID NO: 4858 - protein, 9 aa, Homo Sapiens
GLSNLFCGV

SEQ ID NO: 4859 - protein, 9 aa, Homo Sapiens
GLSNTVMRL

SEQ ID NO: 4860 - protein, 9 aa, Homo Sapiens
GLSPEIHTL

SEQ ID NO: 4861 - protein, 9 aa, Homo Sapiens
GLSPLLQKI

SEQ ID NO: 4862 - protein, 9 aa, Homo Sapiens
GLSPNESKL

SEQ ID NO: 4863 - protein, 9 aa, Homo Sapiens
GLSPSIDTL

SEQ ID NO: 4864 - protein, 9 aa, Homo Sapiens
GLSPSIQTL

SEQ ID NO: 4865 - protein, 9 aa, Homo Sapiens
GLSPTVAVL

SEQ ID NO: 4866 - protein, 9 aa, Homo Sapiens
GLSQITNQL

SEQ ID NO: 4867 - protein, 9 aa, Homo Sapiens
GLSSFDSKL

SEQ ID NO: 4868 - protein, 9 aa, Homo Sapiens
GLSSLCEHL

SEQ ID NO: 4869 - protein, 9 aa, Homo Sapiens
GLSSSVHML

SEQ ID NO: 4870 - protein, 9 aa, Homo Sapiens
GLSVVEHRL

SEQ ID NO: 4871 - protein, 9 aa, Homo Sapiens
GLSYIYNTV

SEQ ID NO: 4872 - protein, 9 aa, Homo Sapiens
GLTPFVFRL

SEQ ID NO: 4873 - protein, 9 aa, Homo Sapiens
GLTRFTDQL

SEQ ID NO: 4874 - protein, 9 aa, Homo Sapiens
GLVVVNHYL

SEQ ID NO: 4875 - protein, 9 aa, Homo Sapiens
GLYELVWRV

SEQ ID NO: 4876 - protein, 9 aa, Homo Sapiens
GLYGAIFRL

SEQ ID NO: 4877 - protein, 9 aa, Homo Sapiens
GLYGKVEGL

SEQ ID NO: 4878 - protein, 9 aa, Homo Sapiens
GLYTGQEYV

SEQ ID NO: 4879 - protein, 9 aa, Homo Sapiens
GMAPFVRTL

SEQ ID NO: 4880 - protein, 9 aa, Homo Sapiens
GMAQKTWEL

SEQ ID NO: 4881 - protein, 9 aa, Homo Sapiens
GMASVISRL

SEQ ID NO: 4882 - protein, 9 aa, Homo Sapiens
GMFQRLDKL

SEQ ID NO: 4883 - protein, 9 aa, Homo Sapiens
GMNKFLSQL

SEQ ID NO: 4884 - protein, 9 aa, Homo Sapiens
GQAEVLNFL

SEQ ID NO: 4885 - protein, 9 aa, Homo Sapiens
GVAEKTQLL

SEQ ID NO: 4886 - protein, 9 aa, Homo Sapiens
GVGPVPARA

SEQ ID NO: 4887 - protein, 9 aa, Homo Sapiens
GVSAITCYL

SEQ ID NO: 4888 - protein, 9 aa, Homo Sapiens
GVSDLVCFV

SEQ ID NO: 4889 - protein, 9 aa, Homo Sapiens
HIADIVHTL

SEQ ID NO: 4890 - protein, 9 aa, Homo Sapiens
HIPDVITYL

SEQ ID NO: 4891 - protein, 9 aa, Homo Sapiens
HIPNIFQKI

SEQ ID NO: 4892 - protein, 9 aa, Homo Sapiens
HISRLLQEL

SEQ ID NO: 4893 - protein, 9 aa, Homo Sapiens
HLAAIATEL

SEQ ID NO: 4894 - protein, 9 aa, Homo Sapiens
HLADFTPRL

SEQ ID NO: 4895 - protein, 9 aa, Homo Sapiens
HLAEALEQL

SEQ ID NO: 4896 - protein, 9 aa, Homo Sapiens
HLAEALHQA

SEQ ID NO: 4897 - protein, 9 aa, Homo Sapiens
HLAEHSLQV

SEQ ID NO: 4898 - protein, 9 aa, Homo Sapiens
HLAEIKRKL

SEQ ID NO: 4899 - protein, 9 aa, Homo Sapiens
HLAEKTSSL

SEQ ID NO: 4900 - protein, 9 aa, Homo Sapiens
HLAELIAEL

SEQ ID NO: 4901 - protein, 9 aa, Homo Sapiens
HLAELQEKI

SEQ ID NO: 4902 - protein, 9 aa, Homo Sapiens
HLAESESLL

SEQ ID NO: 4903 - protein, 9 aa, Homo Sapiens
HLAEVLERV

SEQ ID NO: 4904 - protein, 9 aa, Homo Sapiens
HLAEVSAEV

SEQ ID NO: 4905 - protein, 9 aa, Homo Sapiens
HLAIKLEQV

SEQ ID NO: 4906 - protein, 9 aa, Homo Sapiens
HLAKLYDNL

SEQ ID NO: 4907 - protein, 9 aa, Homo Sapiens
HLAKVTAEV

SEQ ID NO: 4908 - protein, 9 aa, Homo Sapiens
HLANIVERL

SEQ ID NO: 4909 - protein, 9 aa, Homo Sapiens
HLANIVERV

SEQ ID NO: 4910 - protein, 9 aa, Homo Sapiens
HLANTYISV

SEQ ID NO: 4911 - protein, 9 aa, Homo Sapiens
HLAPENFYI

SEQ ID NO: 4912 - protein, 9 aa, Homo Sapiens
HLAPLWPFL

SEQ ID NO: 4913 - protein, 9 aa, Homo Sapiens
HLAQSLHKL

SEQ ID NO: 4914 - protein, 9 aa, Homo Sapiens
HLASIHGYL

SEQ ID NO: 4915 - protein, 9 aa, Homo Sapiens
HLASKIEEA

SEQ ID NO: 4916 - protein, 9 aa, Homo Sapiens
HLAVNDFEL

SEQ ID NO: 4917 - protein, 9 aa, Homo Sapiens
HLAVVAPRL

SEQ ID NO: 4918 - protein, 9 aa, Homo Sapiens
HLCANLMQL

SEQ ID NO: 4919 - protein, 9 aa, Homo Sapiens
HLCEHIWTL

SEQ ID NO: 4920 - protein, 9 aa, Homo Sapiens
HLCELLPRL

SEQ ID NO: 4921 - protein, 9 aa, Homo Sapiens
HLCGHVDTI

SEQ ID NO: 4922 - protein, 9 aa, Homo Sapiens
HLCSMNETL

SEQ ID NO: 4923 - protein, 9 aa, Homo Sapiens
HLFEDAYLL

SEQ ID NO: 4924 - protein, 9 aa, Homo Sapiens
HLFNVAHTL

SEQ ID NO: 4925 - protein, 9 aa, Homo Sapiens
HLFRKFHYL

SEQ ID NO: 4926 - protein, 9 aa, Homo Sapiens
HLGEYQAAV

SEQ ID NO: 4927 - protein, 9 aa, Homo Sapiens
HLGHILFLL

SEQ ID NO: 4928 - protein, 9 aa, Homo Sapiens
HLGQIENYL

SEQ ID NO: 4929 - protein, 9 aa, Homo Sapiens
HLKDGVPGL

SEQ ID NO: 4930 - protein, 9 aa, Homo Sapiens
HLKVHIERV

SEQ ID NO: 4931 - protein, 9 aa, Homo Sapiens
HLMNHMNLL

SEQ ID NO: 4932 - protein, 9 aa, Homo Sapiens
HLNATVNNL

SEQ ID NO: 4933 - protein, 9 aa, Homo Sapiens
HLNEHLYNM

SEQ ID NO: 4934 - protein, 9 aa, Homo Sapiens
HLNGHIKQV

SEQ ID NO: 4935 - protein, 9 aa, Homo Sapiens
HLNGKVSHL

SEQ ID NO: 4936 - protein, 9 aa, Homo Sapiens
HLNMFIQNL

SEQ ID NO: 4937 - protein, 9 aa, Homo Sapiens
HLNPHTNMV

SEQ ID NO: 4938 - protein, 9 aa, Homo Sapiens
HLPDFVKQL

SEQ ID NO: 4939 - protein, 9 aa, Homo Sapiens
HLPDVCVNL

SEQ ID NO: 4940 - protein, 9 aa, Homo Sapiens
HLPSDFTPA

SEQ ID NO: 4941 - protein, 9 aa, Homo Sapiens
HLSAILEAL

SEQ ID NO: 4942 - protein, 9 aa, Homo Sapiens
HLSDHLSEL

SEQ ID NO: 4943 - protein, 9 aa, Homo Sapiens
HLSDMLQQL

SEQ ID NO: 4944 - protein, 9 aa, Homo Sapiens
HLSEETVML

SEQ ID NO: 4945 - protein, 9 aa, Homo Sapiens
HLSELNTKL

SEQ ID NO: 4946 - protein, 9 aa, Homo Sapiens
HLSELVQQI

SEQ ID NO: 4947 - protein, 9 aa, Homo Sapiens
HLSHIKESV

SEQ ID NO: 4948 - protein, 9 aa, Homo Sapiens
HLSIINEYL

SEQ ID NO: 4949 - protein, 9 aa, Homo Sapiens
HLSKIETRI

SEQ ID NO: 4950 - protein, 9 aa, Homo Sapiens
HLSNILSEV

SEQ ID NO: 4951 - protein, 9 aa, Homo Sapiens
HLSNMEVQV

SEQ ID NO: 4952 - protein, 9 aa, Homo Sapiens
HLSNYQYLL

SEQ ID NO: 4953 - protein, 9 aa, Homo Sapiens
HLSSIEVLI

SEQ ID NO: 4954 - protein, 9 aa, Homo Sapiens
HLSSLIAQL

SEQ ID NO: 4955 - protein, 9 aa, Homo Sapiens
HLSTSLDNL

SEQ ID NO: 4956 - protein, 9 aa, Homo Sapiens
HLSTVEFLL

SEQ ID NO: 4957 - protein, 9 aa, Homo Sapiens
HLTDITLKV

SEQ ID NO: 4958 - protein, 9 aa, Homo Sapiens
HLVDFDCHL

SEQ ID NO: 4959 - protein, 9 aa, Homo Sapiens
HLYSSIEHL

SEQ ID NO: 4960 - protein, 9 aa, Homo Sapiens
HMGDILYKL

SEQ ID NO: 4961 - protein, 9 aa, Homo Sapiens
HMSEICTEL

SEQ ID NO: 4962 - protein, 9 aa, Homo Sapiens
HQAQIDHYL

SEQ ID NO: 4963 - protein, 9 aa, Homo Sapiens
HVVDFFNRV

SEQ ID NO: 4964 - protein, 9 aa, Homo Sapiens
IAREFSPDL

SEQ ID NO: 4965 - protein, 9 aa, Homo Sapiens
IIADNIIFL

SEQ ID NO: 4966 - protein, 9 aa, Homo Sapiens
IIFVPVPQL

SEQ ID NO: 4967 - protein, 9 aa, Homo Sapiens
IIKGKVEEV

SEQ ID NO: 4968 - protein, 9 aa, Homo Sapiens
IISELDRQI

SEQ ID NO: 4969 - protein, 9 aa, Homo Sapiens
IIVDIFHGL

SEQ ID NO: 4970 - protein, 9 aa, Homo Sapiens
IKEPIWETL

SEQ ID NO: 4971 - protein, 9 aa, Homo Sapiens
ILAAETDRL

SEQ ID NO: 4972 - protein, 9 aa, Homo Sapiens
ILAAHVPTL

SEQ ID NO: 4973 - protein, 9 aa, Homo Sapiens
ILAAIVNHL

SEQ ID NO: 4974 - protein, 9 aa, Homo Sapiens
ILAALQERL

SEQ ID NO: 4975 - protein, 9 aa, Homo Sapiens
ILAAVETRL

SEQ ID NO: 4976 - protein, 9 aa, Homo Sapiens
ILADATAKM

SEQ ID NO: 4977 - protein, 9 aa, Homo Sapiens
ILADATEQV

SEQ ID NO: 4978 - protein, 9 aa, Homo Sapiens
ILADCTLIL

SEQ ID NO: 4979 - protein, 9 aa, Homo Sapiens
ILADIQSHM

SEQ ID NO: 4980 - protein, 9 aa, Homo Sapiens
ILADIVISA

SEQ ID NO: 4981 - protein, 9 aa, Homo Sapiens
ILADKTRQL

SEQ ID NO: 4982 - protein, 9 aa, Homo Sapiens
ILADLEDYL

SEQ ID NO: 4983 - protein, 9 aa, Homo Sapiens
ILAEIARIL

SEQ ID NO: 4984 - protein, 9 aa, Homo Sapiens
ILAELLLRV

SEQ ID NO: 4985 - protein, 9 aa, Homo Sapiens
ILAETQPEL

SEQ ID NO: 4986 - protein, 9 aa, Homo Sapiens
ILAHEIHVL

SEQ ID NO: 4987 - protein, 9 aa, Homo Sapiens
ILANDGVLL

SEQ ID NO: 4988 - protein, 9 aa, Homo Sapiens
ILANHAIKL

SEQ ID NO: 4989 - protein, 9 aa, Homo Sapiens
ILANNCPAL

SEQ ID NO: 4990 - protein, 9 aa, Homo Sapiens
ILAPTVQEL

SEQ ID NO: 4991 - protein, 9 aa, Homo Sapiens
ILAPVVKEI

SEQ ID NO: 4992 - protein, 9 aa, Homo Sapiens
ILAQQPDRL

SEQ ID NO: 4993 - protein, 9 aa, Homo Sapiens
ILASEETYL

SEQ ID NO: 4994 - protein, 9 aa, Homo Sapiens
ILASLLRNL

SEQ ID NO: 4995 - protein, 9 aa, Homo Sapiens
ILATNTQKV

SEQ ID NO: 4996 - protein, 9 aa, Homo Sapiens
ILATPLQNL

SEQ ID NO: 4997 - protein, 9 aa, Homo Sapiens
ILATRTQNV

SEQ ID NO: 4998 - protein, 9 aa, Homo Sapiens
ILCEHPNQV

SEQ ID NO: 4999 - protein, 9 aa, Homo Sapiens
ILCELINKL

SEQ ID NO: 5000 - protein, 9 aa, Homo Sapiens
ILDCIYNEV

SEQ ID NO: 5001 - protein, 9 aa, Homo Sapiens
ILFGHENRV

SEQ ID NO: 5002 - protein, 9 aa, Homo Sapiens
ILGPIPSHM

SEQ ID NO: 5003 - protein, 9 aa, Homo Sapiens
ILGPKPQGV

SEQ ID NO: 5004 - protein, 9 aa, Homo Sapiens
ILGPQGNTI

SEQ ID NO: 5005 - protein, 9 aa, Homo Sapiens
ILGTHNITV

SEQ ID NO: 5006 - protein, 9 aa, Homo Sapiens
ILHANPQLL

SEQ ID NO: 5007 - protein, 9 aa, Homo Sapiens
ILHDDCAFL

SEQ ID NO: 5008 - protein, 9 aa, Homo Sapiens
ILHDDEVTV

SEQ ID NO: 5009 - protein, 9 aa, Homo Sapiens
ILHDIDCLL

SEQ ID NO: 5010 - protein, 9 aa, Homo Sapiens
ILHGEVNKV

SEQ ID NO: 5011 - protein, 9 aa, Homo Sapiens
ILHHEYFLL

SEQ ID NO: 5012 - protein, 9 aa, Homo Sapiens
ILHHVNIGL

SEQ ID NO: 5013 - protein, 9 aa, Homo Sapiens
ILHPEVQTL

SEQ ID NO: 5014 - protein, 9 aa, Homo Sapiens
ILHRVIQEL

SEQ ID NO: 5015 - protein, 9 aa, Homo Sapiens
ILHSVTTNL

SEQ ID NO: 5016 - protein, 9 aa, Homo Sapiens
ILHTDVVYL

SEQ ID NO: 5017 - protein, 9 aa, Homo Sapiens
ILIGKENLL

SEQ ID NO: 5018 - protein, 9 aa, Homo Sapiens
ILINKADLL

SEQ ID NO: 5019 - protein, 9 aa, Homo Sapiens
ILKARLEYL

SEQ ID NO: 5020 - protein, 9 aa, Homo Sapiens
ILKDDNHSL

SEQ ID NO: 5021 - protein, 9 aa, Homo Sapiens
ILKEDSPGL

SEQ ID NO: 5022 - protein, 9 aa, Homo Sapiens
ILKEISPLL

SEQ ID NO: 5023 - protein, 9 aa, Homo Sapiens
ILKGQIQEA

SEQ ID NO: 5024 - protein, 9 aa, Homo Sapiens
ILKKVLEAL

SEQ ID NO: 5025 - protein, 9 aa, Homo Sapiens
ILKSHVEKL

SEQ ID NO: 5026 - protein, 9 aa, Homo Sapiens
ILLEHNYAL

SEQ ID NO: 5027 - protein, 9 aa, Homo Sapiens
ILMDKERLL

SEQ ID NO: 5028 - protein, 9 aa, Homo Sapiens
ILMEHIHKL

SEQ ID NO: 5029 - protein, 9 aa, Homo Sapiens
ILMGVLKEV

SEQ ID NO: 5030 - protein, 9 aa, Homo Sapiens
ILMSLQKVL

SEQ ID NO: 5031 - protein, 9 aa, Homo Sapiens
ILNDNINLL

SEQ ID NO: 5032 - protein, 9 aa, Homo Sapiens
ILNEIVNFV

SEQ ID NO: 5033 - protein, 9 aa, Homo Sapiens
ILNERVELL

SEQ ID NO: 5034 - protein, 9 aa, Homo Sapiens
ILNNKIPEA

SEQ ID NO: 5035 - protein, 9 aa, Homo Sapiens
ILNNLKAFL

SEQ ID NO: 5036 - protein, 9 aa, Homo Sapiens
ILNNNLNTL

SEQ ID NO: 5037 - protein, 9 aa, Homo Sapiens
ILNPEVVTV

SEQ ID NO: 5038 - protein, 9 aa, Homo Sapiens
ILNSMVSKL

SEQ ID NO: 5039 - protein, 9 aa, Homo Sapiens
ILNSNEHLL

SEQ ID NO: 5040 - protein, 9 aa, Homo Sapiens
ILNTTLDLL

SEQ ID NO: 5041 - protein, 9 aa, Homo Sapiens
ILNYVLVRV

SEQ ID NO: 5042 - protein, 9 aa, Homo Sapiens
ILQDGRIFI

SEQ ID NO: 5043 - protein, 9 aa, Homo Sapiens
ILQEREYRL

SEQ ID NO: 5044 - protein, 9 aa, Homo Sapiens
ILQNKIDLV

SEQ ID NO: 5045 - protein, 9 aa, Homo Sapiens
ILRDTSEDL

SEQ ID NO: 5046 - protein, 9 aa, Homo Sapiens
ILREDPAYL

SEQ ID NO: 5047 - protein, 9 aa, Homo Sapiens
ILSAFVDRL

SEQ ID NO: 5048 - protein, 9 aa, Homo Sapiens
ILSAIEHKA

SEQ ID NO: 5049 - protein, 9 aa, Homo Sapiens
ILSALVTRL

SEQ ID NO: 5050 - protein, 9 aa, Homo Sapiens
ILSDACSKL

SEQ ID NO: 5051 - protein, 9 aa, Homo Sapiens
ILSDDCATL

SEQ ID NO: 5052 - protein, 9 aa, Homo Sapiens
ILSDKNSSV

SEQ ID NO: 5053 - protein, 9 aa, Homo Sapiens
ILSDVASRL

SEQ ID NO: 5054 - protein, 9 aa, Homo Sapiens
ILSDVQRKV

SEQ ID NO: 5055 - protein, 9 aa, Homo Sapiens
ILSEFSSKL

SEQ ID NO: 5056 - protein, 9 aa, Homo Sapiens
ILSEIKEAV

SEQ ID NO: 5057 - protein, 9 aa, Homo Sapiens
ILSELAPSL

SEQ ID NO: 5058 - protein, 9 aa, Homo Sapiens
ILSELVEKI

SEQ ID NO: 5059 - protein, 9 aa, Homo Sapiens
ILSESLHSL

SEQ ID NO: 5060 - protein, 9 aa, Homo Sapiens
ILSEVERNL

SEQ ID NO: 5061 - protein, 9 aa, Homo Sapiens
ILSEVQQAV

SEQ ID NO: 5062 - protein, 9 aa, Homo Sapiens
ILSGVIRSV

SEQ ID NO: 5063 - protein, 9 aa, Homo Sapiens
ILSGVVTKM

SEQ ID NO: 5064 - protein, 9 aa, Homo Sapiens
ILSHIKASL

SEQ ID NO: 5065 - protein, 9 aa, Homo Sapiens
ILSHLSSEL

SEQ ID NO: 5066 - protein, 9 aa, Homo Sapiens
ILSKKQNEL

SEQ ID NO: 5067 - protein, 9 aa, Homo Sapiens
ILSPSLDFV

SEQ ID NO: 5068 - protein, 9 aa, Homo Sapiens
ILSPWGAEV

SEQ ID NO: 5069 - protein, 9 aa, Homo Sapiens
ILSQYITFV

SEQ ID NO: 5070 - protein, 9 aa, Homo Sapiens
ILSSFESRL

SEQ ID NO: 5071 - protein, 9 aa, Homo Sapiens
ILTDITKGV

SEQ ID NO: 5072 - protein, 9 aa, Homo Sapiens
ILTESENKL

SEQ ID NO: 5073 - protein, 9 aa, Homo Sapiens
ILTSYINEL

SEQ ID NO: 5074 - protein, 9 aa, Homo Sapiens
ILTTLIHLV

SEQ ID NO: 5075 - protein, 9 aa, Homo Sapiens
ILYDDDERL

SEQ ID NO: 5076 - protein, 9 aa, Homo Sapiens
ILYDKLEKI

SEQ ID NO: 5077 - protein, 9 aa, Homo Sapiens
ILYDLQQNL

SEQ ID NO: 5078 - protein, 9 aa, Homo Sapiens
ILYGEVEKL

SEQ ID NO: 5079 - protein, 9 aa, Homo Sapiens
ILYGKIIHL

SEQ ID NO: 5080 - protein, 9 aa, Homo Sapiens
ILYSKTEHL

SEQ ID NO: 5081 - protein, 9 aa, Homo Sapiens
IMAKQVEQL

SEQ ID NO: 5082 - protein, 9 aa, Homo Sapiens
IMHDCVVKL

SEQ ID NO: 5083 - protein, 9 aa, Homo Sapiens
IMNGHVDCV

SEQ ID NO: 5084 - protein, 9 aa, Homo Sapiens
IMSGRTDRL

SEQ ID NO: 5085 - protein, 9 aa, Homo Sapiens
ISSDAVLQR

SEQ ID NO: 5086 - protein, 9 aa, Homo Sapiens
ISTLITNLI

SEQ ID NO: 5087 - protein, 9 aa, Homo Sapiens
ITAPIEAQV

SEQ ID NO: 5088 - protein, 9 aa, Homo Sapiens
ITKELIEII

SEQ ID NO: 5089 - protein, 9 aa, Homo Sapiens
ITNEIVDYI

SEQ ID NO: 5090 - protein, 9 aa, Homo Sapiens
ITQIEHEVS

SEQ ID NO: 5091 - protein, 9 aa, Homo Sapiens
ITSELVSKI

SEQ ID NO: 5092 - protein, 9 aa, Homo Sapiens
IVAKHTSAL

SEQ ID NO: 5093 - protein, 9 aa, Homo Sapiens
IVHEALYFL

SEQ ID NO: 5094 - protein, 9 aa, Homo Sapiens
IVSEKTDKL

SEQ ID NO: 5095 - protein, 9 aa, Homo Sapiens
KAAVMVHQL

SEQ ID NO: 5096 - protein, 9 aa, Homo Sapiens
KIADFGWSV

SEQ ID NO: 5097 - protein, 9 aa, Homo Sapiens
KIADTSNML

SEQ ID NO: 5098 - protein, 9 aa, Homo Sapiens
KIAEGVNSL

SEQ ID NO: 5099 - protein, 9 aa, Homo Sapiens
KIAEIEAEM

SEQ ID NO: 5100 - protein, 9 aa, Homo Sapiens
KIAEIKSLL

SEQ ID NO: 5101 - protein, 9 aa, Homo Sapiens
KIAEKTAAL

SEQ ID NO: 5102 - protein, 9 aa, Homo Sapiens
KIAELNANL

SEQ ID NO: 5103 - protein, 9 aa, Homo Sapiens
KIAELNTKL

SEQ ID NO: 5104 - protein, 9 aa, Homo Sapiens
KIAFIFNNL

SEQ ID NO: 5105 - protein, 9 aa, Homo Sapiens
KIAGSSPRL

SEQ ID NO: 5106 - protein, 9 aa, Homo Sapiens
KIAGYVTHL

SEQ ID NO: 5107 - protein, 9 aa, Homo Sapiens
KIAKESQFL

SEQ ID NO: 5108 - protein, 9 aa, Homo Sapiens
KIAPNTPQL

SEQ ID NO: 5109 - protein, 9 aa, Homo Sapiens
KICDYLFNV

SEQ ID NO: 5110 - protein, 9 aa, Homo Sapiens
KICELQARL

SEQ ID NO: 5111 - protein, 9 aa, Homo Sapiens
KICEMLSLL

SEQ ID NO: 5112 - protein, 9 aa, Homo Sapiens
KIIDFIYTA

SEQ ID NO: 5113 - protein, 9 aa, Homo Sapiens
KIKEGAENL

SEQ ID NO: 5114 - protein, 9 aa, Homo Sapiens
KIQKVKEAL

SEQ ID NO: 5115 - protein, 9 aa, Homo Sapiens
KISDIQSQL

SEQ ID NO: 5116 - protein, 9 aa, Homo Sapiens
KISELTTEV

SEQ ID NO: 5117 - protein, 9 aa, Homo Sapiens
KISEVVELL

SEQ ID NO: 5118 - protein, 9 aa, Homo Sapiens
KITDLQNQL

SEQ ID NO: 5119 - protein, 9 aa, Homo Sapiens
KLAAAISEV

SEQ ID NO: 5120 - protein, 9 aa, Homo Sapiens
KLAAVVNNL

SEQ ID NO: 5121 - protein, 9 aa, Homo Sapiens
KLADAKIFL

SEQ ID NO: 5122 - protein, 9 aa, Homo Sapiens
KLADFGTCM

SEQ ID NO: 5123 - protein, 9 aa, Homo Sapiens
KLADICKNL

SEQ ID NO: 5124 - protein, 9 aa, Homo Sapiens
KLADKLYNL

SEQ ID NO: 5125 - protein, 9 aa, Homo Sapiens
KLADLQKQV

SEQ ID NO: 5126 - protein, 9 aa, Homo Sapiens
KLADQCTGL

SEQ ID NO: 5127 - protein, 9 aa, Homo Sapiens
KLADQYPHL

SEQ ID NO: 5128 - protein, 9 aa, Homo Sapiens
KLAEAHVNL

SEQ ID NO: 5129 - protein, 9 aa, Homo Sapiens
KLAECQDQL

SEQ ID NO: 5130 - protein, 9 aa, Homo Sapiens
KLAEFIDFL

SEQ ID NO: 5131 - protein, 9 aa, Homo Sapiens
KLAEGVQLL

SEQ ID NO: 5132 - protein, 9 aa, Homo Sapiens
KLAEIRHEV

SEQ ID NO: 5133 - protein, 9 aa, Homo Sapiens
KLAEIVKQV

SEQ ID NO: 5134 - protein, 9 aa, Homo Sapiens
KLAELARQL

SEQ ID NO: 5135 - protein, 9 aa, Homo Sapiens
KLAENACTL

SEQ ID NO: 5136 - protein, 9 aa, Homo Sapiens
KLAENEITL

SEQ ID NO: 5137 - protein, 9 aa, Homo Sapiens
KLAEQYESF

SEQ ID NO: 5138 - protein, 9 aa, Homo Sapiens
KLAESKVSV

SEQ ID NO: 5139 - protein, 9 aa, Homo Sapiens
KLAESVEKA

SEQ ID NO: 5140 - protein, 9 aa, Homo Sapiens
KLAEVDKCL

SEQ ID NO: 5141 - protein, 9 aa, Homo Sapiens
KLAEVSQNI

SEQ ID NO: 5142 - protein, 9 aa, Homo Sapiens
KLAGLVEEL

SEQ ID NO: 5143 - protein, 9 aa, Homo Sapiens
KLAKLQAQV

SEQ ID NO: 5144 - protein, 9 aa, Homo Sapiens
KLALEQQQL

SEQ ID NO: 5145 - protein, 9 aa, Homo Sapiens
KLAQALHEM

SEQ ID NO: 5146 - protein, 9 aa, Homo Sapiens
KLAQQQAAL

SEQ ID NO: 5147 - protein, 9 aa, Homo Sapiens
KLAQQSQAL

SEQ ID NO: 5148 - protein, 9 aa, Homo Sapiens
KLAQSVQKL

SEQ ID NO: 5149 - protein, 9 aa, Homo Sapiens
KLCDIIVHI

SEQ ID NO: 5150 - protein, 9 aa, Homo Sapiens
KLCDVTLKI

SEQ ID NO: 5151 - protein, 9 aa, Homo Sapiens
KLCDVTTGL

SEQ ID NO: 5152 - protein, 9 aa, Homo Sapiens
KLCEGFNEV

SEQ ID NO: 5153 - protein, 9 aa, Homo Sapiens
KLCEKIINI

SEQ ID NO: 5154 - protein, 9 aa, Homo Sapiens
KLCERIEGL

SEQ ID NO: 5155 - protein, 9 aa, Homo Sapiens
KLCERVTKV

SEQ ID NO: 5156 - protein, 9 aa, Homo Sapiens
KLCKLQEAL

SEQ ID NO: 5157 - protein, 9 aa, Homo Sapiens
KLCPTNQEV

SEQ ID NO: 5158 - protein, 9 aa, Homo Sapiens
KLCSFQEEM

SEQ ID NO: 5159 - protein, 9 aa, Homo Sapiens
KLCSSAETL

SEQ ID NO: 5160 - protein, 9 aa, Homo Sapiens
KLDDCTLQL

SEQ ID NO: 5161 - protein, 9 aa, Homo Sapiens
KLDDIVQHI

SEQ ID NO: 5162 - protein, 9 aa, Homo Sapiens
KLEDGPKFL

SEQ ID NO: 5163 - protein, 9 aa, Homo Sapiens
KLFDASHSL

SEQ ID NO: 5164 - protein, 9 aa, Homo Sapiens
KLFDLDEKL

SEQ ID NO: 5165 - protein, 9 aa, Homo Sapiens
KLFDQANKL

SEQ ID NO: 5166 - protein, 9 aa, Homo Sapiens
KLFDRPQEL

SEQ ID NO: 5167 - protein, 9 aa, Homo Sapiens
KLFDTQHRV

SEQ ID NO: 5168 - protein, 9 aa, Homo Sapiens
KLFDTQQFL

SEQ ID NO: 5169 - protein, 9 aa, Homo Sapiens
KLFEKSTGL

SEQ ID NO: 5170 - protein, 9 aa, Homo Sapiens
KLFEKVKEV

SEQ ID NO: 5171 - protein, 9 aa, Homo Sapiens
KLFGHLTSA

SEQ ID NO: 5172 - protein, 9 aa, Homo Sapiens
KLFGMIITI

SEQ ID NO: 5173 - protein, 9 aa, Homo Sapiens
KLFGQPPCA

SEQ ID NO: 5174 - protein, 9 aa, Homo Sapiens
KLFPYEEHL

SEQ ID NO: 5175 - protein, 9 aa, Homo Sapiens
KLFSLEHFL

SEQ ID NO: 5176 - protein, 9 aa, Homo Sapiens
KLFSYCVKV

SEQ ID NO: 5177 - protein, 9 aa, Homo Sapiens
KLGAVFNQV

SEQ ID NO: 5178 - protein, 9 aa, Homo Sapiens
KLGDLMVLL

SEQ ID NO: 5179 - protein, 9 aa, Homo Sapiens
KLGEILANL

SEQ ID NO: 5180 - protein, 9 aa, Homo Sapiens
KLGEIVTTI

SEQ ID NO: 5181 - protein, 9 aa, Homo Sapiens
KLGPAGTTI

SEQ ID NO: 5182 - protein, 9 aa, Homo Sapiens
KLGPAPKTL

SEQ ID NO: 5183 - protein, 9 aa, Homo Sapiens
KLHAVVETL

SEQ ID NO: 5184 - protein, 9 aa, Homo Sapiens
KLHDINAQL

SEQ ID NO: 5185 - protein, 9 aa, Homo Sapiens
KLHDRLAQL

SEQ ID NO: 5186 - protein, 9 aa, Homo Sapiens
KLHDVEHVL

SEQ ID NO: 5187 - protein, 9 aa, Homo Sapiens
KLHEEIEHL

SEQ ID NO: 5188 - protein, 9 aa, Homo Sapiens
KLHGVNINV

SEQ ID NO: 5189 - protein, 9 aa, Homo Sapiens
KLHYVVTEV

SEQ ID NO: 5190 - protein, 9 aa, Homo Sapiens
KLIANNTTV

SEQ ID NO: 5191 - protein, 9 aa, Homo Sapiens
KLIDDVHRL

SEQ ID NO: 5192 - protein, 9 aa, Homo Sapiens
KLIDKLDSL

SEQ ID NO: 5193 - protein, 9 aa, Homo Sapiens
KLIDRTESL

SEQ ID NO: 5194 - protein, 9 aa, Homo Sapiens
KLIEECTDL

SEQ ID NO: 5195 - protein, 9 aa, Homo Sapiens
KLIEKNYFL

SEQ ID NO: 5196 - protein, 9 aa, Homo Sapiens
KLIGQVHEV

SEQ ID NO: 5197 - protein, 9 aa, Homo Sapiens
KLIKSLEAA

SEQ ID NO: 5198 - protein, 9 aa, Homo Sapiens
KLIPFLEKL

SEQ ID NO: 5199 - protein, 9 aa, Homo Sapiens
KLIPLCHQL

SEQ ID NO: 5200 - protein, 9 aa, Homo Sapiens
KLISDINKA

SEQ ID NO: 5201 - protein, 9 aa, Homo Sapiens
KLISELQKL

SEQ ID NO: 5202 - protein, 9 aa, Homo Sapiens
KLKDSEAEL

SEQ ID NO: 5203 - protein, 9 aa, Homo Sapiens
KLKEDLAKA

SEQ ID NO: 5204 - protein, 9 aa, Homo Sapiens
KLKEEIDLL

SEQ ID NO: 5205 - protein, 9 aa, Homo Sapiens
KLKEYVDCL

SEQ ID NO: 5206 - protein, 9 aa, Homo Sapiens
KLKKEIEEL

SEQ ID NO: 5207 - protein, 9 aa, Homo Sapiens
KLKNVIHKI

SEQ ID NO: 5208 - protein, 9 aa, Homo Sapiens
KLKSAIEQA

SEQ ID NO: 5209 - protein, 9 aa, Homo Sapiens
KLLDVVHPA

SEQ ID NO: 5210 - protein, 9 aa, Homo Sapiens
KLMDHIYAV

SEQ ID NO: 5211 - protein, 9 aa, Homo Sapiens
KLMDKVVRL

SEQ ID NO: 5212 - protein, 9 aa, Homo Sapiens
KLMDQLEAL

SEQ ID NO: 5213 - protein, 9 aa, Homo Sapiens
KLMEEIREL

SEQ ID NO: 5214 - protein, 9 aa, Homo Sapiens
KLMELLEEI

SEQ ID NO: 5215 - protein, 9 aa, Homo Sapiens
KLMELYERL

SEQ ID NO: 5216 - protein, 9 aa, Homo Sapiens
KLMGQIHQI

SEQ ID NO: 5217 - protein, 9 aa, Homo Sapiens
KLMQQQQEV

SEQ ID NO: 5218 - protein, 9 aa, Homo Sapiens
KLNAKLAEL

SEQ ID NO: 5219 - protein, 9 aa, Homo Sapiens
KLNATNIEL

SEQ ID NO: 5220 - protein, 9 aa, Homo Sapiens
KLNDALDRL

SEQ ID NO: 5221 - protein, 9 aa, Homo Sapiens
KLNDLIQRL

SEQ ID NO: 5222 - protein, 9 aa, Homo Sapiens
KLNDLNSSV

SEQ ID NO: 5223 - protein, 9 aa, Homo Sapiens
KLNDTYVNV

SEQ ID NO: 5224 - protein, 9 aa, Homo Sapiens
KLNEIVDQI

SEQ ID NO: 5225 - protein, 9 aa, Homo Sapiens
KLNEQQSVL

SEQ ID NO: 5226 - protein, 9 aa, Homo Sapiens
KLNERLAKL

SEQ ID NO: 5227 - protein, 9 aa, Homo Sapiens
KLNFFIHNL

SEQ ID NO: 5228 - protein, 9 aa, Homo Sapiens
KLNFIVTGL

SEQ ID NO: 5229 - protein, 9 aa, Homo Sapiens
KLNGNLEKI

SEQ ID NO: 5230 - protein, 9 aa, Homo Sapiens
KLNHLLERL

SEQ ID NO: 5231 - protein, 9 aa, Homo Sapiens
KLNPGIAYV

SEQ ID NO: 5232 - protein, 9 aa, Homo Sapiens
KLNPQQFEV

SEQ ID NO: 5233 - protein, 9 aa, Homo Sapiens
KLNTLVQKL

SEQ ID NO: 5234 - protein, 9 aa, Homo Sapiens
KLQEFLQTL

SEQ ID NO: 5235 - protein, 9 aa, Homo Sapiens
KLQEKIQEL

SEQ ID NO: 5236 - protein, 9 aa, Homo Sapiens
KLQELNYNL

SEQ ID NO: 5237 - protein, 9 aa, Homo Sapiens
KLQEQIFHL

SEQ ID NO: 5238 - protein, 9 aa, Homo Sapiens
KLQEVLDYL

SEQ ID NO: 5239 - protein, 9 aa, Homo Sapiens
KLRDSLELL

SEQ ID NO: 5240 - protein, 9 aa, Homo Sapiens
KLREDLERL

SEQ ID NO: 5241 - protein, 9 aa, Homo Sapiens
KLSDLDNKL

SEQ ID NO: 5242 - protein, 9 aa, Homo Sapiens
KLSDLYYDI

SEQ ID NO: 5243 - protein, 9 aa, Homo Sapiens
KLSDNILKL

SEQ ID NO: 5244 - protein, 9 aa, Homo Sapiens
KLSDQANTL

SEQ ID NO: 5245 - protein, 9 aa, Homo Sapiens
KLSDSRIAL

SEQ ID NO: 5246 - protein, 9 aa, Homo Sapiens
KLSEATREL

SEQ ID NO: 5247 - protein, 9 aa, Homo Sapiens
KLSEDIDLL

SEQ ID NO: 5248 - protein, 9 aa, Homo Sapiens
KLSEECNSL

SEQ ID NO: 5249 - protein, 9 aa, Homo Sapiens
KLSEENRHL

SEQ ID NO: 5250 - protein, 9 aa, Homo Sapiens
KLSEFDVEM

SEQ ID NO: 5251 - protein, 9 aa, Homo Sapiens
KLSEIPLTL

SEQ ID NO: 5252 - protein, 9 aa, Homo Sapiens
KLSEKIDQL

SEQ ID NO: 5253 - protein, 9 aa, Homo Sapiens
KLSELQLRV

SEQ ID NO: 5254 - protein, 9 aa, Homo Sapiens
KLSEQKEQL

SEQ ID NO: 5255 - protein, 9 aa, Homo Sapiens
KLSEVERSL

SEQ ID NO: 5256 - protein, 9 aa, Homo Sapiens
KLSEVNKRL

SEQ ID NO: 5257 - protein, 9 aa, Homo Sapiens
KLSFIIRTV

SEQ ID NO: 5258 - protein, 9 aa, Homo Sapiens
KLSGKLYLV

SEQ ID NO: 5259 - protein, 9 aa, Homo Sapiens
KLSGLTTNV

SEQ ID NO: 5260 - protein, 9 aa, Homo Sapiens
KLSGVLDEL

SEQ ID NO: 5261 - protein, 9 aa, Homo Sapiens
KLSHYLTLL

SEQ ID NO: 5262 - protein, 9 aa, Homo Sapiens
KLSLNMDNL

SEQ ID NO: 5263 - protein, 9 aa, Homo Sapiens
KLSLVAAML

SEQ ID NO: 5264 - protein, 9 aa, Homo Sapiens
KLSQIRKQL

SEQ ID NO: 5265 - protein, 9 aa, Homo Sapiens
KLSQLEEHL

SEQ ID NO: 5266 - protein, 9 aa, Homo Sapiens
KLSQNISEL

SEQ ID NO: 5267 - protein, 9 aa, Homo Sapiens
KLSQYLIQL

SEQ ID NO: 5268 - protein, 9 aa, Homo Sapiens
KLSSHEEAL

SEQ ID NO: 5269 - protein, 9 aa, Homo Sapiens
KLSSTQQSL

SEQ ID NO: 5270 - protein, 9 aa, Homo Sapiens
KLTAFVNTL

SEQ ID NO: 5271 - protein, 9 aa, Homo Sapiens
KLTDIQIEL

SEQ ID NO: 5272 - protein, 9 aa, Homo Sapiens
KLTEENTTL

SEQ ID NO: 5273 - protein, 9 aa, Homo Sapiens
KLTEIRHEV

SEQ ID NO: 5274 - protein, 9 aa, Homo Sapiens
KLTESNQKL

SEQ ID NO: 5275 - protein, 9 aa, Homo Sapiens
KLTGIKHEL

SEQ ID NO: 5276 - protein, 9 aa, Homo Sapiens
KLTQILSYL

SEQ ID NO: 5277 - protein, 9 aa, Homo Sapiens
KLVDCIIEV

SEQ ID NO: 5278 - protein, 9 aa, Homo Sapiens
KLVEYIVKA

SEQ ID NO: 5279 - protein, 9 aa, Homo Sapiens
KLVPWSQCL

SEQ ID NO: 5280 - protein, 9 aa, Homo Sapiens
KLVQIEYAL

SEQ ID NO: 5281 - protein, 9 aa, Homo Sapiens
KLYDGFQYL

SEQ ID NO: 5282 - protein, 9 aa, Homo Sapiens
KLYEAVPQL

SEQ ID NO: 5283 - protein, 9 aa, Homo Sapiens
KLYSEMEQL

SEQ ID NO: 5284 - protein, 9 aa, Homo Sapiens
KLYSSEQLL

SEQ ID NO: 5285 - protein, 9 aa, Homo Sapiens
KMADIEYRL

SEQ ID NO: 5286 - protein, 9 aa, Homo Sapiens
KMADILEKI

SEQ ID NO: 5287 - protein, 9 aa, Homo Sapiens
KMADMYTRL

SEQ ID NO: 5288 - protein, 9 aa, Homo Sapiens
KMAECYTML

SEQ ID NO: 5289 - protein, 9 aa, Homo Sapiens
KMAEIKVKL

SEQ ID NO: 5290 - protein, 9 aa, Homo Sapiens
KMAEMLVEL

SEQ ID NO: 5291 - protein, 9 aa, Homo Sapiens
KMAIITTHL

SEQ ID NO: 5292 - protein, 9 aa, Homo Sapiens
KMAQALEEL

SEQ ID NO: 5293 - protein, 9 aa, Homo Sapiens
KMCDHLIRA

SEQ ID NO: 5294 - protein, 9 aa, Homo Sapiens
KMFFLIDKV

SEQ ID NO: 5295 - protein, 9 aa, Homo Sapiens
KMKAIVEKL

SEQ ID NO: 5296 - protein, 9 aa, Homo Sapiens
KMKDTVQKL

SEQ ID NO: 5297 - protein, 9 aa, Homo Sapiens
KMKETLQNV

SEQ ID NO: 5298 - protein, 9 aa, Homo Sapiens
KMKSVIENA

SEQ ID NO: 5299 - protein, 9 aa, Homo Sapiens
KMMDKVEFV

SEQ ID NO: 5300 - protein, 9 aa, Homo Sapiens
KMNAKLEEL

SEQ ID NO: 5301 - protein, 9 aa, Homo Sapiens
KMNEKIASL

SEQ ID NO: 5302 - protein, 9 aa, Homo Sapiens
KMNEKLYTV

SEQ ID NO: 5303 - protein, 9 aa, Homo Sapiens
KMNGKVWDL

SEQ ID NO: 5304 - protein, 9 aa, Homo Sapiens
KMPEINAKV

SEQ ID NO: 5305 - protein, 9 aa, Homo Sapiens
KMSEKILLL

SEQ ID NO: 5306 - protein, 9 aa, Homo Sapiens
KMSELQTYV

SEQ ID NO: 5307 - protein, 9 aa, Homo Sapiens
KMSELRVTL

SEQ ID NO: 5308 - protein, 9 aa, Homo Sapiens
KMSSLLERL

SEQ ID NO: 5309 - protein, 9 aa, Homo Sapiens
KMVEKCWKL

SEQ ID NO: 5310 - protein, 9 aa, Homo Sapiens
KMYGYVDTL

SEQ ID NO: 5311 - protein, 9 aa, Homo Sapiens
KQAEIVKRL

SEQ ID NO: 5312 - protein, 9 aa, Homo Sapiens
KSQQLTDFI

SEQ ID NO: 5313 - protein, 9 aa, Homo Sapiens
KTADICQML

SEQ ID NO: 5314 - protein, 9 aa, Homo Sapiens
KTAEFLSKL

SEQ ID NO: 5315 - protein, 9 aa, Homo Sapiens
KTAEMNEKL

SEQ ID NO: 5316 - protein, 9 aa, Homo Sapiens
KTAFYSFYL

SEQ ID NO: 5317 - protein, 9 aa, Homo Sapiens
KTASINQNV

SEQ ID NO: 5318 - protein, 9 aa, Homo Sapiens
KTIDYIQFL

SEQ ID NO: 5319 - protein, 9 aa, Homo Sapiens
KTSDFNTFL

SEQ ID NO: 5320 - protein, 9 aa, Homo Sapiens
KVADLVLML

SEQ ID NO: 5321 - protein, 9 aa, Homo Sapiens
KVAELFEKL

SEQ ID NO: 5322 - protein, 9 aa, Homo Sapiens
KVASLLHQV

SEQ ID NO: 5323 - protein, 9 aa, Homo Sapiens
KVSDILLRL

SEQ ID NO: 5324 - protein, 9 aa, Homo Sapiens
KVSELTERL

SEQ ID NO: 5325 - protein, 9 aa, Homo Sapiens
KVSELVQFL

SEQ ID NO: 5326 - protein, 9 aa, Homo Sapiens
KVSQLIHHL

SEQ ID NO: 5327 - protein, 9 aa, Homo Sapiens
LFNKQLESI

SEQ ID NO: 5328 - protein, 9 aa, Homo Sapiens
LFPGKVHSL

SEQ ID NO: 5329 - protein, 9 aa, Homo Sapiens
LIADLKYEL

SEQ ID NO: 5330 - protein, 9 aa, Homo Sapiens
LIAKVIQNL

SEQ ID NO: 5331 - protein, 9 aa, Homo Sapiens
LICGFIIKL

SEQ ID NO: 5332 - protein, 9 aa, Homo Sapiens
LIPMIIHQL

SEQ ID NO: 5333 - protein, 9 aa, Homo Sapiens
LIQGKDLLI

SEQ ID NO: 5334 - protein, 9 aa, Homo Sapiens
LISDLEHRL

SEQ ID NO: 5335 - protein, 9 aa, Homo Sapiens
LISEIEYRL

SEQ ID NO: 5336 - protein, 9 aa, Homo Sapiens
LISPLVQLL

SEQ ID NO: 5337 - protein, 9 aa, Homo Sapiens
LLADERNEL

SEQ ID NO: 5338 - protein, 9 aa, Homo Sapiens
LLADKVLKL

SEQ ID NO: 5339 - protein, 9 aa, Homo Sapiens
LLADLARRL

SEQ ID NO: 5340 - protein, 9 aa, Homo Sapiens
LLADLKTMV

SEQ ID NO: 5341 - protein, 9 aa, Homo Sapiens
LLADRSMEL

SEQ ID NO: 5342 - protein, 9 aa, Homo Sapiens
LLAEAESEL

SEQ ID NO: 5343 - protein, 9 aa, Homo Sapiens
LLAEAKYYL

SEQ ID NO: 5344 - protein, 9 aa, Homo Sapiens
LLAEALNQV

SEQ ID NO: 5345 - protein, 9 aa, Homo Sapiens
LLAEENQRL

SEQ ID NO: 5346 - protein, 9 aa, Homo Sapiens
LLAEHIKSL

SEQ ID NO: 5347 - protein, 9 aa, Homo Sapiens
LLAEKEEKL

SEQ ID NO: 5348 - protein, 9 aa, Homo Sapiens
LLAEKIYKI

SEQ ID NO: 5349 - protein, 9 aa, Homo Sapiens
LLAEKVEQL

SEQ ID NO: 5350 - protein, 9 aa, Homo Sapiens
LLAELEGKL

SEQ ID NO: 5351 - protein, 9 aa, Homo Sapiens
LLAELLTHL

SEQ ID NO: 5352 - protein, 9 aa, Homo Sapiens
LLAELTKTL

SEQ ID NO: 5353 - protein, 9 aa, Homo Sapiens
LLAETHYQL

SEQ ID NO: 5354 - protein, 9 aa, Homo Sapiens
LLAEVIENL

SEQ ID NO: 5355 - protein, 9 aa, Homo Sapiens
LLAFVQTHL

SEQ ID NO: 5356 - protein, 9 aa, Homo Sapiens
LLAGQRHLL

SEQ ID NO: 5357 - protein, 9 aa, Homo Sapiens
LLAKKISQL

SEQ ID NO: 5358 - protein, 9 aa, Homo Sapiens
LLAKLLSQL

SEQ ID NO: 5359 - protein, 9 aa, Homo Sapiens
LLANKVPAA

SEQ ID NO: 5360 - protein, 9 aa, Homo Sapiens
LLANSIHGL

SEQ ID NO: 5361 - protein, 9 aa, Homo Sapiens
LLAPAPAQA

SEQ ID NO: 5362 - protein, 9 aa, Homo Sapiens
LLAPIRVLL

SEQ ID NO: 5363 - protein, 9 aa, Homo Sapiens
LLAPISEQI

SEQ ID NO: 5364 - protein, 9 aa, Homo Sapiens
LLAPKLNEA

SEQ ID NO: 5365 - protein, 9 aa, Homo Sapiens
LLAQTTHFL

SEQ ID NO: 5366 - protein, 9 aa, Homo Sapiens
LLASFGDRV

SEQ ID NO: 5367 - protein, 9 aa, Homo Sapiens
LLASLVKRL

SEQ ID NO: 5368 - protein, 9 aa, Homo Sapiens
LLATEIERL

SEQ ID NO: 5369 - protein, 9 aa, Homo Sapiens
LLATKNSHL

SEQ ID NO: 5370 - protein, 9 aa, Homo Sapiens
LLAVQSNKI

SEQ ID NO: 5371 - protein, 9 aa, Homo Sapiens
LLCDIVLHV

SEQ ID NO: 5372 - protein, 9 aa, Homo Sapiens
LLCDLINKL

SEQ ID NO: 5373 - protein, 9 aa, Homo Sapiens
LLCEHAEKL

SEQ ID NO: 5374 - protein, 9 aa, Homo Sapiens
LLCGSLTRL

SEQ ID NO: 5375 - protein, 9 aa, Homo Sapiens
LLCSLVKTI

SEQ ID NO: 5376 - protein, 9 aa, Homo Sapiens
LLDSCTKLL

SEQ ID NO: 5377 - protein, 9 aa, Homo Sapiens
LLEDSCHYL

SEQ ID NO: 5378 - protein, 9 aa, Homo Sapiens
LLFDEYHKL

SEQ ID NO: 5379 - protein, 9 aa, Homo Sapiens
LLFDQNDKV

SEQ ID NO: 5380 - protein, 9 aa, Homo Sapiens
LLFDRPMHV

SEQ ID NO: 5381 - protein, 9 aa, Homo Sapiens
LLFERATFL

SEQ ID NO: 5382 - protein, 9 aa, Homo Sapiens
LLFSHEEEL

SEQ ID NO: 5383 - protein, 9 aa, Homo Sapiens
LLFSKTYKL

SEQ ID NO: 5384 - protein, 9 aa, Homo Sapiens
LLFSKVERL

SEQ ID NO: 5385 - protein, 9 aa, Homo Sapiens
LLGDMEWRL

SEQ ID NO: 5386 - protein, 9 aa, Homo Sapiens
LLGPEGQHL

SEQ ID NO: 5387 - protein, 9 aa, Homo Sapiens
LLGPKPFPL

SEQ ID NO: 5388 - protein, 9 aa, Homo Sapiens
LLGPNGPAV

SEQ ID NO: 5389 - protein, 9 aa, Homo Sapiens
LLGPPPVGV

SEQ ID NO: 5390 - protein, 9 aa, Homo Sapiens
LLGPRLVLA

SEQ ID NO: 5391 - protein, 9 aa, Homo Sapiens
LLGPSIDSV

SEQ ID NO: 5392 - protein, 9 aa, Homo Sapiens
LLGWIQNKI

SEQ ID NO: 5393 - protein, 9 aa, Homo Sapiens
LLHDQIEKL

SEQ ID NO: 5394 - protein, 9 aa, Homo Sapiens
LLHEENFSV

SEQ ID NO: 5395 - protein, 9 aa, Homo Sapiens
LLHEKLYEL

SEQ ID NO: 5396 - protein, 9 aa, Homo Sapiens
LLHERVNEL

SEQ ID NO: 5397 - protein, 9 aa, Homo Sapiens
LLHFQSQFL

SEQ ID NO: 5398 - protein, 9 aa, Homo Sapiens
LLHGHIVEL

SEQ ID NO: 5399 - protein, 9 aa, Homo Sapiens
LLHGLECVV

SEQ ID NO: 5400 - protein, 9 aa, Homo Sapiens
LLHGLNTSL

SEQ ID NO: 5401 - protein, 9 aa, Homo Sapiens
LLHNCVQEL

SEQ ID NO: 5402 - protein, 9 aa, Homo Sapiens
LLHSFVDSV

SEQ ID NO: 5403 - protein, 9 aa, Homo Sapiens
LLIDKTENL

SEQ ID NO: 5404 - protein, 9 aa, Homo Sapiens
LLIEKCNTV

SEQ ID NO: 5405 - protein, 9 aa, Homo Sapiens
LLIGHLERV

SEQ ID NO: 5406 - protein, 9 aa, Homo Sapiens
LLIPGLATA

SEQ ID NO: 5407 - protein, 9 aa, Homo Sapiens
LLISESQKL

SEQ ID NO: 5408 - protein, 9 aa, Homo Sapiens
LLKDCTDSL

SEQ ID NO: 5409 - protein, 9 aa, Homo Sapiens
LLKDSIVQL

SEQ ID NO: 5410 - protein, 9 aa, Homo Sapiens
LLKNHLETL

SEQ ID NO: 5411 - protein, 9 aa, Homo Sapiens
LLKQGQDNL

SEQ ID NO: 5412 - protein, 9 aa, Homo Sapiens
LLMDRVDEM

SEQ ID NO: 5413 - protein, 9 aa, Homo Sapiens
LLMEHIQEI

SEQ ID NO: 5414 - protein, 9 aa, Homo Sapiens
LLMRLLQQL

SEQ ID NO: 5415 - protein, 9 aa, Homo Sapiens
LLNDFEERL

SEQ ID NO: 5416 - protein, 9 aa, Homo Sapiens
LLNDHIYVV

SEQ ID NO: 5417 - protein, 9 aa, Homo Sapiens
LLNDLEARL

SEQ ID NO: 5418 - protein, 9 aa, Homo Sapiens
LLNECREML

SEQ ID NO: 5419 - protein, 9 aa, Homo Sapiens
LLNEILEQV

SEQ ID NO: 5420 - protein, 9 aa, Homo Sapiens
LLNETRDML

SEQ ID NO: 5421 - protein, 9 aa, Homo Sapiens
LLNGMTQKL

SEQ ID NO: 5422 - protein, 9 aa, Homo Sapiens
LLNHRIFQL

SEQ ID NO: 5423 - protein, 9 aa, Homo Sapiens
LLNKAPEYL

SEQ ID NO: 5424 - protein, 9 aa, Homo Sapiens
LLNKEENTL

SEQ ID NO: 5425 - protein, 9 aa, Homo Sapiens
LLNKSIIRV

SEQ ID NO: 5426 - protein, 9 aa, Homo Sapiens
LLNNAFEEL

SEQ ID NO: 5427 - protein, 9 aa, Homo Sapiens
LLNNSDERL

SEQ ID NO: 5428 - protein, 9 aa, Homo Sapiens
LLNPHLRQL

SEQ ID NO: 5429 - protein, 9 aa, Homo Sapiens
LLNPSLQKV

SEQ ID NO: 5430 - protein, 9 aa, Homo Sapiens
LLNSATTSL

SEQ ID NO: 5431 - protein, 9 aa, Homo Sapiens
LLNSEVHML

SEQ ID NO: 5432 - protein, 9 aa, Homo Sapiens
LLNSKEAAL

SEQ ID NO: 5433 - protein, 9 aa, Homo Sapiens
LLPDIISRL

SEQ ID NO: 5434 - protein, 9 aa, Homo Sapiens
LLPDIVTCV

SEQ ID NO: 5435 - protein, 9 aa, Homo Sapiens
LLPDLIQKV

SEQ ID NO: 5436 - protein, 9 aa, Homo Sapiens
LLPDNVHYV

SEQ ID NO: 5437 - protein, 9 aa, Homo Sapiens
LLPEICHFL

SEQ ID NO: 5438 - protein, 9 aa, Homo Sapiens
LLQDHPWLL

SEQ ID NO: 5439 - protein, 9 aa, Homo Sapiens
LLQDKQFEL

SEQ ID NO: 5440 - protein, 9 aa, Homo Sapiens
LLQEKVNQL

SEQ ID NO: 5441 - protein, 9 aa, Homo Sapiens
LLQESLAQA

SEQ ID NO: 5442 - protein, 9 aa, Homo Sapiens
LLQEVEHQL

SEQ ID NO: 5443 - protein, 9 aa, Homo Sapiens
LLREKVEFL

SEQ ID NO: 5444 - protein, 9 aa, Homo Sapiens
LLSAAENFL

SEQ ID NO: 5445 - protein, 9 aa, Homo Sapiens
LLSAAVCRA

SEQ ID NO: 5446 - protein, 9 aa, Homo Sapiens
LLSAEPVPA

SEQ ID NO: 5447 - protein, 9 aa, Homo Sapiens
LLSAIHNSL

SEQ ID NO: 5448 - protein, 9 aa, Homo Sapiens
LLSDCVRHL

SEQ ID NO: 5449 - protein, 9 aa, Homo Sapiens
LLSDIERQI

SEQ ID NO: 5450 - protein, 9 aa, Homo Sapiens
LLSDLTKQI

SEQ ID NO: 5451 - protein, 9 aa, Homo Sapiens
LLSDSSLHL

SEQ ID NO: 5452 - protein, 9 aa, Homo Sapiens
LLSDTVQHL

SEQ ID NO: 5453 - protein, 9 aa, Homo Sapiens
LLSDVRFVL

SEQ ID NO: 5454 - protein, 9 aa, Homo Sapiens
LLSDYGYHL

SEQ ID NO: 5455 - protein, 9 aa, Homo Sapiens
LLSDYIRLI

SEQ ID NO: 5456 - protein, 9 aa, Homo Sapiens
LLSEAVQKI

SEQ ID NO: 5457 - protein, 9 aa, Homo Sapiens
LLSEEEYHL

SEQ ID NO: 5458 - protein, 9 aa, Homo Sapiens
LLSEHVIAI

SEQ ID NO: 5459 - protein, 9 aa, Homo Sapiens
LLSEIEEHL

SEQ ID NO: 5460 - protein, 9 aa, Homo Sapiens
LLSELLEHL

SEQ ID NO: 5461 - protein, 9 aa, Homo Sapiens
LLSESNERL

SEQ ID NO: 5462 - protein, 9 aa, Homo Sapiens
LLSGERVQL

SEQ ID NO: 5463 - protein, 9 aa, Homo Sapiens
LLSGQLNTL

SEQ ID NO: 5464 - protein, 9 aa, Homo Sapiens
LLSGRISTL

SEQ ID NO: 5465 - protein, 9 aa, Homo Sapiens
LLSHVEQLL

SEQ ID NO: 5466 - protein, 9 aa, Homo Sapiens
LLSHVIVAL

SEQ ID NO: 5467 - protein, 9 aa, Homo Sapiens
LLSKAVQCL

SEQ ID NO: 5468 - protein, 9 aa, Homo Sapiens
LLSKFLTNL

SEQ ID NO: 5469 - protein, 9 aa, Homo Sapiens
LLSKSIEQL

SEQ ID NO: 5470 - protein, 9 aa, Homo Sapiens
LLSKVLIYL

SEQ ID NO: 5471 - protein, 9 aa, Homo Sapiens
LLSLIDEKL

SEQ ID NO: 5472 - protein, 9 aa, Homo Sapiens
LLSNLFHGM

SEQ ID NO: 5473 - protein, 9 aa, Homo Sapiens
LLSNLYDKL

SEQ ID NO: 5474 - protein, 9 aa, Homo Sapiens
LLSNNNQAL

SEQ ID NO: 5475 - protein, 9 aa, Homo Sapiens
LLSPHNPAL

SEQ ID NO: 5476 - protein, 9 aa, Homo Sapiens
LLSPHSQVL

SEQ ID NO: 5477 - protein, 9 aa, Homo Sapiens
LLSPSNEKL

SEQ ID NO: 5478 - protein, 9 aa, Homo Sapiens
LLSPTQHHV

SEQ ID NO: 5479 - protein, 9 aa, Homo Sapiens
LLSQAQYHV

SEQ ID NO: 5480 - protein, 9 aa, Homo Sapiens
LLSQSVHYL

SEQ ID NO: 5481 - protein, 9 aa, Homo Sapiens
LLSSHVRGV

SEQ ID NO: 5482 - protein, 9 aa, Homo Sapiens
LLSSIEDKV

SEQ ID NO: 5483 - protein, 9 aa, Homo Sapiens
LLSSIVEEL

SEQ ID NO: 5484 - protein, 9 aa, Homo Sapiens
LLSSVDQPL

SEQ ID NO: 5485 - protein, 9 aa, Homo Sapiens
LLSTVVRTL

SEQ ID NO: 5486 - protein, 9 aa, Homo Sapiens
LLSTYICKV

SEQ ID NO: 5487 - protein, 9 aa, Homo Sapiens
LLTDFCTHL

SEQ ID NO: 5488 - protein, 9 aa, Homo Sapiens
LLTDLQDHL

SEQ ID NO: 5489 - protein, 9 aa, Homo Sapiens
LLTEIRAVV

SEQ ID NO: 5490 - protein, 9 aa, Homo Sapiens
LLTELSNSL

SEQ ID NO: 5491 - protein, 9 aa, Homo Sapiens
LLTEQIHSL

SEQ ID NO: 5492 - protein, 9 aa, Homo Sapiens
LLVGFVHYL

SEQ ID NO: 5493 - protein, 9 aa, Homo Sapiens
LLYPRQEVV

SEQ ID NO: 5494 - protein, 9 aa, Homo Sapiens
LLYYQTNYL

SEQ ID NO: 5495 - protein, 9 aa, Homo Sapiens
LMAHAVTQL

SEQ ID NO: 5496 - protein, 9 aa, Homo Sapiens
LMCKKLTKL

SEQ ID NO: 5497 - protein, 9 aa, Homo Sapiens
LMKDLADEL

SEQ ID NO: 5498 - protein, 9 aa, Homo Sapiens
LMKQYIEFV

SEQ ID NO: 5499 - protein, 9 aa, Homo Sapiens
LMNAVVQTV

SEQ ID NO: 5500 - protein, 9 aa, Homo Sapiens
LMNPMVPGL

SEQ ID NO: 5501 - protein, 9 aa, Homo Sapiens
LMNQMNARL

SEQ ID NO: 5502 - protein, 9 aa, Homo Sapiens
LMSALAARL

SEQ ID NO: 5503 - protein, 9 aa, Homo Sapiens
LMSDLFNKL

SEQ ID NO: 5504 - protein, 9 aa, Homo Sapiens
LMVDHVTEV

SEQ ID NO: 5505 - protein, 9 aa, Homo Sapiens
LNKNLEEKL

SEQ ID NO: 5506 - protein, 9 aa, Homo Sapiens
LSRNHLSSI

SEQ ID NO: 5507 - protein, 9 aa, Homo Sapiens
LTADAHHYL

SEQ ID NO: 5508 - protein, 9 aa, Homo Sapiens
LTNDWEDHL

SEQ ID NO: 5509 - protein, 9 aa, Homo Sapiens
LTRVTLDIL

SEQ ID NO: 5510 - protein, 9 aa, Homo Sapiens
LTSELITHI

SEQ ID NO: 5511 - protein, 9 aa, Homo Sapiens
LTSVINQKL

SEQ ID NO: 5512 - protein, 9 aa, Homo Sapiens
LVAEIITHL

SEQ ID NO: 5513 - protein, 9 aa, Homo Sapiens
LVPEFVHSI

SEQ ID NO: 5514 - protein, 9 aa, Homo Sapiens
LVRTLRVLL

SEQ ID NO: 5515 - protein, 9 aa, Homo Sapiens
LYEKDIEEL

SEQ ID NO: 5516 - protein, 9 aa, Homo Sapiens
LYGPKIDRA

SEQ ID NO: 5517 - protein, 9 aa, Homo Sapiens
MIADIHCMI

SEQ ID NO: 5518 - protein, 9 aa, Homo Sapiens
MIYDSLDYA

SEQ ID NO: 5519 - protein, 9 aa, Homo Sapiens
MLADIPVTI

SEQ ID NO: 5520 - protein, 9 aa, Homo Sapiens
MLAECQENL

SEQ ID NO: 5521 - protein, 9 aa, Homo Sapiens
MLAEMAMKV

SEQ ID NO: 5522 - protein, 9 aa, Homo Sapiens
MLAGFITTL

SEQ ID NO: 5523 - protein, 9 aa, Homo Sapiens
MLAKHVITL

SEQ ID NO: 5524 - protein, 9 aa, Homo Sapiens
MLAKLMSEL

SEQ ID NO: 5525 - protein, 9 aa, Homo Sapiens
MLANDIARL

SEQ ID NO: 5526 - protein, 9 aa, Homo Sapiens
MLANKNASL

SEQ ID NO: 5527 - protein, 9 aa, Homo Sapiens
MLAQDSHLL

SEQ ID NO: 5528 - protein, 9 aa, Homo Sapiens
MLASAVEKL

SEQ ID NO: 5529 - protein, 9 aa, Homo Sapiens
MLASMFHSL

SEQ ID NO: 5530 - protein, 9 aa, Homo Sapiens
MLATRVFSL

SEQ ID NO: 5531 - protein, 9 aa, Homo Sapiens
MLAWINESL

SEQ ID NO: 5532 - protein, 9 aa, Homo Sapiens
MLFTGGYGL

SEQ ID NO: 5533 - protein, 9 aa, Homo Sapiens
MLHEKTSKL

SEQ ID NO: 5534 - protein, 9 aa, Homo Sapiens
MLHSKLSQL

SEQ ID NO: 5535 - protein, 9 aa, Homo Sapiens
MLHTVTDMV

SEQ ID NO: 5536 - protein, 9 aa, Homo Sapiens
MLIEDVDAL

SEQ ID NO: 5537 - protein, 9 aa, Homo Sapiens
MLIQENQEL

SEQ ID NO: 5538 - protein, 9 aa, Homo Sapiens
MLMTVIYLL

SEQ ID NO: 5539 - protein, 9 aa, Homo Sapiens
MLNEHDFEV

SEQ ID NO: 5540 - protein, 9 aa, Homo Sapiens
MLPGFLHRL

SEQ ID NO: 5541 - protein, 9 aa, Homo Sapiens
MLPSILNQL

SEQ ID NO: 5542 - protein, 9 aa, Homo Sapiens
MLRNACERL

SEQ ID NO: 5543 - protein, 9 aa, Homo Sapiens
MLSAIQSEV

SEQ ID NO: 5544 - protein, 9 aa, Homo Sapiens
MLSDNTAKL

SEQ ID NO: 5545 - protein, 9 aa, Homo Sapiens
MLSDRLTFL

SEQ ID NO: 5546 - protein, 9 aa, Homo Sapiens
MLSEHTSKL

SEQ ID NO: 5547 - protein, 9 aa, Homo Sapiens
MLSESSSFL

SEQ ID NO: 5548 - protein, 9 aa, Homo Sapiens
MLSQLIQQL

SEQ ID NO: 5549 - protein, 9 aa, Homo Sapiens
MLSRIEKQL

SEQ ID NO: 5550 - protein, 9 aa, Homo Sapiens
MLSSIKCVL

SEQ ID NO: 5551 - protein, 9 aa, Homo Sapiens
MLSVAEHFL

SEQ ID NO: 5552 - protein, 9 aa, Homo Sapiens
MLTEIEHKV

SEQ ID NO: 5553 - protein, 9 aa, Homo Sapiens
MLYEKLLTA

SEQ ID NO: 5554 - protein, 9 aa, Homo Sapiens
MMADMYNRM

SEQ ID NO: 5555 - protein, 9 aa, Homo Sapiens
MMNEKLDQL

SEQ ID NO: 5556 - protein, 9 aa, Homo Sapiens
MMSQKIQQL

SEQ ID NO: 5557 - protein, 9 aa, Homo Sapiens
MTSEIHNTV

SEQ ID NO: 5558 - protein, 9 aa, Homo Sapiens
MTSNIVQCL

SEQ ID NO: 5559 - protein, 9 aa, Homo Sapiens
MVAEILHHL

SEQ ID NO: 5560 - protein, 9 aa, Homo Sapiens
NIAETLHFL

SEQ ID NO: 5561 - protein, 9 aa, Homo Sapiens
NITELVNYL

SEQ ID NO: 5562 - protein, 9 aa, Homo Sapiens
NLAAATDQL

SEQ ID NO: 5563 - protein, 9 aa, Homo Sapiens
NLAEAQQKL

SEQ ID NO: 5564 - protein, 9 aa, Homo Sapiens
NLAEDIMRL

SEQ ID NO: 5565 - protein, 9 aa, Homo Sapiens
NLAEKPKTV

SEQ ID NO: 5566 - protein, 9 aa, Homo Sapiens
NLAENISRV

SEQ ID NO: 5567 - protein, 9 aa, Homo Sapiens
NLAEQHLGL

SEQ ID NO: 5568 - protein, 9 aa, Homo Sapiens
NLAGISERL

SEQ ID NO: 5569 - protein, 9 aa, Homo Sapiens
NLAGVYSEV

SEQ ID NO: 5570 - protein, 9 aa, Homo Sapiens
NLAHKTYSL

SEQ ID NO: 5571 - protein, 9 aa, Homo Sapiens
NLAKCIVSV

SEQ ID NO: 5572 - protein, 9 aa, Homo Sapiens
NLAKFNQVL

SEQ ID NO: 5573 - protein, 9 aa, Homo Sapiens
NLAKITQQM

SEQ ID NO: 5574 - protein, 9 aa, Homo Sapiens
NLAPFNTAL

SEQ ID NO: 5575 - protein, 9 aa, Homo Sapiens
NLASFIEQV

SEQ ID NO: 5576 - protein, 9 aa, Homo Sapiens
NLASKIEEA

SEQ ID NO: 5577 - protein, 9 aa, Homo Sapiens
NLCGINQKL

SEQ ID NO: 5578 - protein, 9 aa, Homo Sapiens
NLCRSNQLL

SEQ ID NO: 5579 - protein, 9 aa, Homo Sapiens
NLFHYLTEV

SEQ ID NO: 5580 - protein, 9 aa, Homo Sapiens
NLFKHLAKA

SEQ ID NO: 5581 - protein, 9 aa, Homo Sapiens
NLFKKVYLL

SEQ ID NO: 5582 - protein, 9 aa, Homo Sapiens
NLISALEEA

SEQ ID NO: 5583 - protein, 9 aa, Homo Sapiens
NLKEAIETI

SEQ ID NO: 5584 - protein, 9 aa, Homo Sapiens
NLKEGLQYL

SEQ ID NO: 5585 - protein, 9 aa, Homo Sapiens
NLMEIVKKL

SEQ ID NO: 5586 - protein, 9 aa, Homo Sapiens
NLNEKINHL

SEQ ID NO: 5587 - protein, 9 aa, Homo Sapiens
NLNGTLHEL

SEQ ID NO: 5588 - protein, 9 aa, Homo Sapiens
NLPAFVNRL

SEQ ID NO: 5589 - protein, 9 aa, Homo Sapiens
NLSDIQNVL

SEQ ID NO: 5590 - protein, 9 aa, Homo Sapiens
NLSDLLEKL

SEQ ID NO: 5591 - protein, 9 aa, Homo Sapiens
NLSDMVHKI

SEQ ID NO: 5592 - protein, 9 aa, Homo Sapiens
NLSEIESRL

SEQ ID NO: 5593 - protein, 9 aa, Homo Sapiens
NLSNFLIHL

SEQ ID NO: 5594 - protein, 9 aa, Homo Sapiens
NLSSIRAML

SEQ ID NO: 5595 - protein, 9 aa, Homo Sapiens
NLSSITSHL

SEQ ID NO: 5596 - protein, 9 aa, Homo Sapiens
NLSTIKQLL

SEQ ID NO: 5597 - protein, 9 aa, Homo Sapiens
NLSTKTEAV

SEQ ID NO: 5598 - protein, 9 aa, Homo Sapiens
NLTDICTQL

SEQ ID NO: 5599 - protein, 9 aa, Homo Sapiens
NLVEKTPAL

SEQ ID NO: 5600 - protein, 9 aa, Homo Sapiens
NLVTFGHSL

SEQ ID NO: 5601 - protein, 9 aa, Homo Sapiens
NLYGLLHGL

SEQ ID NO: 5602 - protein, 9 aa, Homo Sapiens
NLYPETFAL

SEQ ID NO: 5603 - protein, 9 aa, Homo Sapiens
NLYPGCENV

SEQ ID NO: 5604 - protein, 9 aa, Homo Sapiens
NMAAFTTTL

SEQ ID NO: 5605 - protein, 9 aa, Homo Sapiens
NMAEIMAKA

SEQ ID NO: 5606 - protein, 9 aa, Homo Sapiens
NMASFVRQL

SEQ ID NO: 5607 - protein, 9 aa, Homo Sapiens
NMSEFVCNL

SEQ ID NO: 5608 - protein, 9 aa, Homo Sapiens
NQAVILYHL

SEQ ID NO: 5609 - protein, 9 aa, Homo Sapiens
NTAEIQHCL

SEQ ID NO: 5610 - protein, 9 aa, Homo Sapiens
NVIERLQEA

SEQ ID NO: 5611 - protein, 9 aa, Homo Sapiens
PLAPFNQLL

SEQ ID NO: 5612 - protein, 9 aa, Homo Sapiens
PLGPAPVSV

SEQ ID NO: 5613 - protein, 9 aa, Homo Sapiens
QAADLAYQL

SEQ ID NO: 5614 - protein, 9 aa, Homo Sapiens
QIADLQQKL

SEQ ID NO: 5615 - protein, 9 aa, Homo Sapiens
QLAAYRDLL

SEQ ID NO: 5616 - protein, 9 aa, Homo Sapiens
QLAESVDVL

SEQ ID NO: 5617 - protein, 9 aa, Homo Sapiens
QLAGFSHQI

SEQ ID NO: 5618 - protein, 9 aa, Homo Sapiens
QLAGLQQEL

SEQ ID NO: 5619 - protein, 9 aa, Homo Sapiens
QLALVIARL

SEQ ID NO: 5620 - protein, 9 aa, Homo Sapiens
QLANFCRIL

SEQ ID NO: 5621 - protein, 9 aa, Homo Sapiens
QLANFQEML

SEQ ID NO: 5622 - protein, 9 aa, Homo Sapiens
QLAPIWDKL

SEQ ID NO: 5623 - protein, 9 aa, Homo Sapiens
QLAPVFQRV

SEQ ID NO: 5624 - protein, 9 aa, Homo Sapiens
QLAQFVHEV

SEQ ID NO: 5625 - protein, 9 aa, Homo Sapiens
QLAWFDTDL

SEQ ID NO: 5626 - protein, 9 aa, Homo Sapiens
QLCDLETKL

SEQ ID NO: 5627 - protein, 9 aa, Homo Sapiens
QLCDLNAEL

SEQ ID NO: 5628 - protein, 9 aa, Homo Sapiens
QLCEDIIQL

SEQ ID NO: 5629 - protein, 9 aa, Homo Sapiens
QLFETDHNL

SEQ ID NO: 5630 - protein, 9 aa, Homo Sapiens
QLFSEIHNL

SEQ ID NO: 5631 - protein, 9 aa, Homo Sapiens
QLHEKTSQL

SEQ ID NO: 5632 - protein, 9 aa, Homo Sapiens
QLIDIIHTA

SEQ ID NO: 5633 - protein, 9 aa, Homo Sapiens
QLIDKVWQL

SEQ ID NO: 5634 - protein, 9 aa, Homo Sapiens
QLIDLDHKL

SEQ ID NO: 5635 - protein, 9 aa, Homo Sapiens
QLIDYERQL

SEQ ID NO: 5636 - protein, 9 aa, Homo Sapiens
QLKHKLEQL

SEQ ID NO: 5637 - protein, 9 aa, Homo Sapiens
QLMEQVAQL

SEQ ID NO: 5638 - protein, 9 aa, Homo Sapiens
QLMGEIAKA

SEQ ID NO: 5639 - protein, 9 aa, Homo Sapiens
QLNDVAHLV

SEQ ID NO: 5640 - protein, 9 aa, Homo Sapiens
QLNEKVAQL

SEQ ID NO: 5641 - protein, 9 aa, Homo Sapiens
QLNELQAQL

SEQ ID NO: 5642 - protein, 9 aa, Homo Sapiens
QLNEQLVTL

SEQ ID NO: 5643 - protein, 9 aa, Homo Sapiens
QLNEQVHSL

SEQ ID NO: 5644 - protein, 9 aa, Homo Sapiens
QLNETLTKL

SEQ ID NO: 5645 - protein, 9 aa, Homo Sapiens
QLNEVIEKL

SEQ ID NO: 5646 - protein, 9 aa, Homo Sapiens
QLNRYIEKL

SEQ ID NO: 5647 - protein, 9 aa, Homo Sapiens
QLNTKVAKL

SEQ ID NO: 5648 - protein, 9 aa, Homo Sapiens
QLNVVIHQL

SEQ ID NO: 5649 - protein, 9 aa, Homo Sapiens
QLREQSEQL

SEQ ID NO: 5650 - protein, 9 aa, Homo Sapiens
QLRNVIERL

SEQ ID NO: 5651 - protein, 9 aa, Homo Sapiens
QLSDVAEKL

SEQ ID NO: 5652 - protein, 9 aa, Homo Sapiens
QLSEIPAEL

SEQ ID NO: 5653 - protein, 9 aa, Homo Sapiens
QLSEVFIQL

SEQ ID NO: 5654 - protein, 9 aa, Homo Sapiens
QLSPVLLYL

SEQ ID NO: 5655 - protein, 9 aa, Homo Sapiens
QLSQLQKQL

SEQ ID NO: 5656 - protein, 9 aa, Homo Sapiens
QLSQVLHRL

SEQ ID NO: 5657 - protein, 9 aa, Homo Sapiens
QLSSYEDKL

SEQ ID NO: 5658 - protein, 9 aa, Homo Sapiens
QLSTIRSFL

SEQ ID NO: 5659 - protein, 9 aa, Homo Sapiens
QLSTVITQV

SEQ ID NO: 5660 - protein, 9 aa, Homo Sapiens
QLSWLINRL

SEQ ID NO: 5661 - protein, 9 aa, Homo Sapiens
QLVDFQWKL

SEQ ID NO: 5662 - protein, 9 aa, Homo Sapiens
QLVDIIEKV

SEQ ID NO: 5663 - protein, 9 aa, Homo Sapiens
QLYEGKEQM

SEQ ID NO: 5664 - protein, 9 aa, Homo Sapiens
QLYLKLWNL

SEQ ID NO: 5665 - protein, 9 aa, Homo Sapiens
QMAEIAVNA

SEQ ID NO: 5666 - protein, 9 aa, Homo Sapiens
QMAELHSKL

SEQ ID NO: 5667 - protein, 9 aa, Homo Sapiens
QMAGLLARL

SEQ ID NO: 5668 - protein, 9 aa, Homo Sapiens
QMAKLNQQM

SEQ ID NO: 5669 - protein, 9 aa, Homo Sapiens
QMAQIVERL

SEQ ID NO: 5670 - protein, 9 aa, Homo Sapiens
QMISRIEYV

SEQ ID NO: 5671 - protein, 9 aa, Homo Sapiens
QMSEIEAKV

SEQ ID NO: 5672 - protein, 9 aa, Homo Sapiens
QMSEQVHTL

SEQ ID NO: 5673 - protein, 9 aa, Homo Sapiens
QQKAALQEL

SEQ ID NO: 5674 - protein, 9 aa, Homo Sapiens
QVCAIIERV

SEQ ID NO: 5675 - protein, 9 aa, Homo Sapiens
QVSNLIHYL

SEQ ID NO: 5676 - protein, 9 aa, Homo Sapiens
RAADVLVYL

SEQ ID NO: 5677 - protein, 9 aa, Homo Sapiens
RFPGLNENL

SEQ ID NO: 5678 - protein, 9 aa, Homo Sapiens
RIAEFTTNL

SEQ ID NO: 5679 - protein, 9 aa, Homo Sapiens
RIAELLTEL

SEQ ID NO: 5680 - protein, 9 aa, Homo Sapiens
RIAEYAFKL

SEQ ID NO: 5681 - protein, 9 aa, Homo Sapiens
RIALYCHQL

SEQ ID NO: 5682 - protein, 9 aa, Homo Sapiens
RIIDTVAQV

SEQ ID NO: 5683 - protein, 9 aa, Homo Sapiens
RISPLCHNL

SEQ ID NO: 5684 - protein, 9 aa, Homo Sapiens
RISTINILL

SEQ ID NO: 5685 - protein, 9 aa, Homo Sapiens
RLAACVNLI

SEQ ID NO: 5686 - protein, 9 aa, Homo Sapiens
RLAAFYSQV

SEQ ID NO: 5687 - protein, 9 aa, Homo Sapiens
RLAAIKNAM

SEQ ID NO: 5688 - protein, 9 aa, Homo Sapiens
RLAALEQNV

SEQ ID NO: 5689 - protein, 9 aa, Homo Sapiens
RLAALQHRL

SEQ ID NO: 5690 - protein, 9 aa, Homo Sapiens
RLAAMANNL

SEQ ID NO: 5691 - protein, 9 aa, Homo Sapiens
RLAAYISGL

SEQ ID NO: 5692 - protein, 9 aa, Homo Sapiens
RLADKSVLV

SEQ ID NO: 5693 - protein, 9 aa, Homo Sapiens
RLAEHIVSM

SEQ ID NO: 5694 - protein, 9 aa, Homo Sapiens
RLAELEEFI

SEQ ID NO: 5695 - protein, 9 aa, Homo Sapiens
RLAELERKL

SEQ ID NO: 5696 - protein, 9 aa, Homo Sapiens
RLAELQEQL

SEQ ID NO: 5697 - protein, 9 aa, Homo Sapiens
RLAEMCRSL

SEQ ID NO: 5698 - protein, 9 aa, Homo Sapiens
RLAEPSQML

SEQ ID NO: 5699 - protein, 9 aa, Homo Sapiens
RLAEQIATL

SEQ ID NO: 5700 - protein, 9 aa, Homo Sapiens
RLAEQQPLL

SEQ ID NO: 5701 - protein, 9 aa, Homo Sapiens
RLAETQEEI

SEQ ID NO: 5702 - protein, 9 aa, Homo Sapiens
RLAEVEEKL

SEQ ID NO: 5703 - protein, 9 aa, Homo Sapiens
RLAEVKDSL

SEQ ID NO: 5704 - protein, 9 aa, Homo Sapiens
RLAEVKGNL

SEQ ID NO: 5705 - protein, 9 aa, Homo Sapiens
RLAEVNTKL

SEQ ID NO: 5706 - protein, 9 aa, Homo Sapiens
RLAEVVHEL

SEQ ID NO: 5707 - protein, 9 aa, Homo Sapiens
RLAHHLVAL

SEQ ID NO: 5708 - protein, 9 aa, Homo Sapiens
RLAHVGPRL

SEQ ID NO: 5709 - protein, 9 aa, Homo Sapiens
RLAHYIDRV

SEQ ID NO: 5710 - protein, 9 aa, Homo Sapiens
RLAKKLQQL

SEQ ID NO: 5711 - protein, 9 aa, Homo Sapiens
RLAKLNKEL

SEQ ID NO: 5712 - protein, 9 aa, Homo Sapiens
RLAKVVKTL

SEQ ID NO: 5713 - protein, 9 aa, Homo Sapiens
RLAKYNQLL

SEQ ID NO: 5714 - protein, 9 aa, Homo Sapiens
RLALVISEL

SEQ ID NO: 5715 - protein, 9 aa, Homo Sapiens
RLAPAQWFL

SEQ ID NO: 5716 - protein, 9 aa, Homo Sapiens
RLAPTLSQL

SEQ ID NO: 5717 - protein, 9 aa, Homo Sapiens
RLAPYIIDL

SEQ ID NO: 5718 - protein, 9 aa, Homo Sapiens
RLAQEAVTL

SEQ ID NO: 5719 - protein, 9 aa, Homo Sapiens
RLAQHITYV

SEQ ID NO: 5720 - protein, 9 aa, Homo Sapiens
RLAQICSSI

SEQ ID NO: 5721 - protein, 9 aa, Homo Sapiens
RLASMATLL

SEQ ID NO: 5722 - protein, 9 aa, Homo Sapiens
RLASVAQEL

SEQ ID NO: 5723 - protein, 9 aa, Homo Sapiens
RLATALQKL

SEQ ID NO: 5724 - protein, 9 aa, Homo Sapiens
RLATKYHTV

SEQ ID NO: 5725 - protein, 9 aa, Homo Sapiens
RLATLNEKL

SEQ ID NO: 5726 - protein, 9 aa, Homo Sapiens
RLAVYIDKV

SEQ ID NO: 5727 - protein, 9 aa, Homo Sapiens
RLAVYIDRV

SEQ ID NO: 5728 - protein, 9 aa, Homo Sapiens
RLCEIFTRM

SEQ ID NO: 5729 - protein, 9 aa, Homo Sapiens
RLCPLVEHL

SEQ ID NO: 5730 - protein, 9 aa, Homo Sapiens
RLFAVLEQL

SEQ ID NO: 5731 - protein, 9 aa, Homo Sapiens
RLFDEPQLA

SEQ ID NO: 5732 - protein, 9 aa, Homo Sapiens
RLFEGNALL

SEQ ID NO: 5733 - protein, 9 aa, Homo Sapiens
RLFESINNL

SEQ ID NO: 5734 - protein, 9 aa, Homo Sapiens
RLFESSQYL

SEQ ID NO: 5735 - protein, 9 aa, Homo Sapiens
RLFEVPHEL

SEQ ID NO: 5736 - protein, 9 aa, Homo Sapiens
RLFHKTVYL

SEQ ID NO: 5737 - protein, 9 aa, Homo Sapiens
RLFPGSSFL

SEQ ID NO: 5738 - protein, 9 aa, Homo Sapiens
RLFTQEYIL

SEQ ID NO: 5739 - protein, 9 aa, Homo Sapiens
RLGPPPSHA

SEQ ID NO: 5740 - protein, 9 aa, Homo Sapiens
RLGPSVVGL

SEQ ID NO: 5741 - protein, 9 aa, Homo Sapiens
RLGPVPPGL

SEQ ID NO: 5742 - protein, 9 aa, Homo Sapiens
RLGPVPSGL

SEQ ID NO: 5743 - protein, 9 aa, Homo Sapiens
RLGSVNENL

SEQ ID NO: 5744 - protein, 9 aa, Homo Sapiens
RLHDVLMEL

SEQ ID NO: 5745 - protein, 9 aa, Homo Sapiens
RLIDLHTNV

SEQ ID NO: 5746 - protein, 9 aa, Homo Sapiens
RLIEEENML

SEQ ID NO: 5747 - protein, 9 aa, Homo Sapiens
RLIEHCDHI

SEQ ID NO: 5748 - protein, 9 aa, Homo Sapiens
RLIEQEEYL

SEQ ID NO: 5749 - protein, 9 aa, Homo Sapiens
RLIESLFTI

SEQ ID NO: 5750 - protein, 9 aa, Homo Sapiens
RLKEKVDSL

SEQ ID NO: 5751 - protein, 9 aa, Homo Sapiens
RLKPALETL

SEQ ID NO: 5752 - protein, 9 aa, Homo Sapiens
RLKPEIQCV

SEQ ID NO: 5753 - protein, 9 aa, Homo Sapiens
RLKQEIERL

SEQ ID NO: 5754 - protein, 9 aa, Homo Sapiens
RLMEICESL

SEQ ID NO: 5755 - protein, 9 aa, Homo Sapiens
RLMNDMTAV

SEQ ID NO: 5756 - protein, 9 aa, Homo Sapiens
RLMNETTAV

SEQ ID NO: 5757 - protein, 9 aa, Homo Sapiens
RLNDGNEYL

SEQ ID NO: 5758 - protein, 9 aa, Homo Sapiens
RLNDTIQLL

SEQ ID NO: 5759 - protein, 9 aa, Homo Sapiens
RLNEAAVTV

SEQ ID NO: 5760 - protein, 9 aa, Homo Sapiens
RLNEIEAAL

SEQ ID NO: 5761 - protein, 9 aa, Homo Sapiens
RLNEKHDFL

SEQ ID NO: 5762 - protein, 9 aa, Homo Sapiens
RLNEKNYEL

SEQ ID NO: 5763 - protein, 9 aa, Homo Sapiens
RLNEVIRTL

SEQ ID NO: 5764 - protein, 9 aa, Homo Sapiens
RLNKKVVLL

SEQ ID NO: 5765 - protein, 9 aa, Homo Sapiens
RLNKVISEL

SEQ ID NO: 5766 - protein, 9 aa, Homo Sapiens
RLNSRIEHL

SEQ ID NO: 5767 - protein, 9 aa, Homo Sapiens
RLPEIYIQL

SEQ ID NO: 5768 - protein, 9 aa, Homo Sapiens
RLREVSEKL

SEQ ID NO: 5769 - protein, 9 aa, Homo Sapiens
RLSDAQIYV

SEQ ID NO: 5770 - protein, 9 aa, Homo Sapiens
RLSDFTESL

SEQ ID NO: 5771 - protein, 9 aa, Homo Sapiens
RLSDLYHRL

SEQ ID NO: 5772 - protein, 9 aa, Homo Sapiens
RLSDTVDKL

SEQ ID NO: 5773 - protein, 9 aa, Homo Sapiens
RLSDVQIYV

SEQ ID NO: 5774 - protein, 9 aa, Homo Sapiens
RLSDYLFTL

SEQ ID NO: 5775 - protein, 9 aa, Homo Sapiens
RLSEEIDQL

SEQ ID NO: 5776 - protein, 9 aa, Homo Sapiens
RLSETDFKV

SEQ ID NO: 5777 - protein, 9 aa, Homo Sapiens
RLSETVDKL

SEQ ID NO: 5778 - protein, 9 aa, Homo Sapiens
RLSEVQASL

SEQ ID NO: 5779 - protein, 9 aa, Homo Sapiens
RLSINTQLL

SEQ ID NO: 5780 - protein, 9 aa, Homo Sapiens
RLSPIENFL

SEQ ID NO: 5781 - protein, 9 aa, Homo Sapiens
RLSPVSPAL

SEQ ID NO: 5782 - protein, 9 aa, Homo Sapiens
RLSSVNAEV

SEQ ID NO: 5783 - protein, 9 aa, Homo Sapiens
RLSTALARL

SEQ ID NO: 5784 - protein, 9 aa, Homo Sapiens
RLSVSTETL

SEQ ID NO: 5785 - protein, 9 aa, Homo Sapiens
RLTDYVAFL

SEQ ID NO: 5786 - protein, 9 aa, Homo Sapiens
RLTEYIHCL

SEQ ID NO: 5787 - protein, 9 aa, Homo Sapiens
RLVEIQYEL

SEQ ID NO: 5788 - protein, 9 aa, Homo Sapiens
RLYHITDQV

SEQ ID NO: 5789 - protein, 9 aa, Homo Sapiens
RLYQECEKL

SEQ ID NO: 5790 - protein, 9 aa, Homo Sapiens
RLYSVSYLL

SEQ ID NO: 5791 - protein, 9 aa, Homo Sapiens
RMADLSELL

SEQ ID NO: 5792 - protein, 9 aa, Homo Sapiens
RMADSTTML

SEQ ID NO: 5793 - protein, 9 aa, Homo Sapiens
RMASRVDAV

SEQ ID NO: 5794 - protein, 9 aa, Homo Sapiens
RMAVLNEQV

SEQ ID NO: 5795 - protein, 9 aa, Homo Sapiens
RMIDIQTRM

SEQ ID NO: 5796 - protein, 9 aa, Homo Sapiens
RMKEFLDSL

SEQ ID NO: 5797 - protein, 9 aa, Homo Sapiens
RMNEAVQAL

SEQ ID NO: 5798 - protein, 9 aa, Homo Sapiens
RMSDDVHSL

SEQ ID NO: 5799 - protein, 9 aa, Homo Sapiens
RQADKVWRL

SEQ ID NO: 5800 - protein, 9 aa, Homo Sapiens
RQIDKIQCA

SEQ ID NO: 5801 - protein, 9 aa, Homo Sapiens
RVADILTQL

SEQ ID NO: 5802 - protein, 9 aa, Homo Sapiens
RVSELQVLL

SEQ ID NO: 5803 - protein, 9 aa, Homo Sapiens
SAADLVHFL

SEQ ID NO: 5804 - protein, 9 aa, Homo Sapiens
SAAELNYGL

SEQ ID NO: 5805 - protein, 9 aa, Homo Sapiens
SDPFTHLAP

SEQ ID NO: 5806 - protein, 9 aa, Homo Sapiens
SIAAFIQRL

SEQ ID NO: 5807 - protein, 9 aa, Homo Sapiens
SIAECLTYL

SEQ ID NO: 5808 - protein, 9 aa, Homo Sapiens
SIAEMGAYV

SEQ ID NO: 5809 - protein, 9 aa, Homo Sapiens
SIAEQAHEL

SEQ ID NO: 5810 - protein, 9 aa, Homo Sapiens
SIAEVSQNL

SEQ ID NO: 5811 - protein, 9 aa, Homo Sapiens
SIAEVVHQL

SEQ ID NO: 5812 - protein, 9 aa, Homo Sapiens
SIAGIFKEV

SEQ ID NO: 5813 - protein, 9 aa, Homo Sapiens
SICGTLHSV

SEQ ID NO: 5814 - protein, 9 aa, Homo Sapiens
SIFEFVHAL

SEQ ID NO: 5815 - protein, 9 aa, Homo Sapiens
SIHDLEQRI

SEQ ID NO: 5816 - protein, 9 aa, Homo Sapiens
SIHEFCINL

SEQ ID NO: 5817 - protein, 9 aa, Homo Sapiens
SIPEINHRL

SEQ ID NO: 5818 - protein, 9 aa, Homo Sapiens
SIPELQNFL

SEQ ID NO: 5819 - protein, 9 aa, Homo Sapiens
SISDVIAQV

SEQ ID NO: 5820 - protein, 9 aa, Homo Sapiens
SISELSARL

SEQ ID NO: 5821 - protein, 9 aa, Homo Sapiens
SLAADIPRL

SEQ ID NO: 5822 - protein, 9 aa, Homo Sapiens
SLADCIPLL

SEQ ID NO: 5823 - protein, 9 aa, Homo Sapiens
SLADFEKAL

SEQ ID NO: 5824 - protein, 9 aa, Homo Sapiens
SLADFMQEV

SEQ ID NO: 5825 - protein, 9 aa, Homo Sapiens
SLADHEYTA

SEQ ID NO: 5826 - protein, 9 aa, Homo Sapiens
SLADIAQKL

SEQ ID NO: 5827 - protein, 9 aa, Homo Sapiens
SLADIKESM

SEQ ID NO: 5828 - protein, 9 aa, Homo Sapiens
SLADLYFRA

SEQ ID NO: 5829 - protein, 9 aa, Homo Sapiens
SLADSLYNL

SEQ ID NO: 5830 - protein, 9 aa, Homo Sapiens
SLADVHIEV

SEQ ID NO: 5831 - protein, 9 aa, Homo Sapiens
SLAEEHEGL

SEQ ID NO: 5832 - protein, 9 aa, Homo Sapiens
SLAEETRAL

SEQ ID NO: 5833 - protein, 9 aa, Homo Sapiens
SLAEFVQSL

SEQ ID NO: 5834 - protein, 9 aa, Homo Sapiens
SLAEGRLYL

SEQ ID NO: 5835 - protein, 9 aa, Homo Sapiens
SLAEHHEVL

SEQ ID NO: 5836 - protein, 9 aa, Homo Sapiens
SLAEHQANL

SEQ ID NO: 5837 - protein, 9 aa, Homo Sapiens
SLAEIFKVL

SEQ ID NO: 5838 - protein, 9 aa, Homo Sapiens
SLAEIHSNM

SEQ ID NO: 5839 - protein, 9 aa, Homo Sapiens
SLAEKETHL

SEQ ID NO: 5840 - protein, 9 aa, Homo Sapiens
SLAEKIQAL

SEQ ID NO: 5841 - protein, 9 aa, Homo Sapiens
SLAELDEKI

SEQ ID NO: 5842 - protein, 9 aa, Homo Sapiens
SLAELEKRL

SEQ ID NO: 5843 - protein, 9 aa, Homo Sapiens
SLAELIQAL

SEQ ID NO: 5844 - protein, 9 aa, Homo Sapiens
SLAELRNQM

SEQ ID NO: 5845 - protein, 9 aa, Homo Sapiens
SLAERSSLL

SEQ ID NO: 5846 - protein, 9 aa, Homo Sapiens
SLAERVDRL

SEQ ID NO: 5847 - protein, 9 aa, Homo Sapiens
SLAESLDQA

SEQ ID NO: 5848 - protein, 9 aa, Homo Sapiens
SLAEVLQQL

SEQ ID NO: 5849 - protein, 9 aa, Homo Sapiens
SLAEVNTQL

SEQ ID NO: 5850 - protein, 9 aa, Homo Sapiens
SLAEVQCHL

SEQ ID NO: 5851 - protein, 9 aa, Homo Sapiens
SLAGKIQKL

SEQ ID NO: 5852 - protein, 9 aa, Homo Sapiens
SLAGNTYQL

SEQ ID NO: 5853 - protein, 9 aa, Homo Sapiens
SLAGQTYAV

SEQ ID NO: 5854 - protein, 9 aa, Homo Sapiens
SLAKALCYI

SEQ ID NO: 5855 - protein, 9 aa, Homo Sapiens
SLAKIPATL

SEQ ID NO: 5856 - protein, 9 aa, Homo Sapiens
SLAKIYTEA

SEQ ID NO: 5857 - protein, 9 aa, Homo Sapiens
SLAKTISKI

SEQ ID NO: 5858 - protein, 9 aa, Homo Sapiens
SLANETHQL

SEQ ID NO: 5859 - protein, 9 aa, Homo Sapiens
SLANIIRQL

SEQ ID NO: 5860 - protein, 9 aa, Homo Sapiens
SLAPHFNSL

SEQ ID NO: 5861 - protein, 9 aa, Homo Sapiens
SLAPIIVHV

SEQ ID NO: 5862 - protein, 9 aa, Homo Sapiens
SLAPLFFKL

SEQ ID NO: 5863 - protein, 9 aa, Homo Sapiens
SLAPLKEEL

SEQ ID NO: 5864 - protein, 9 aa, Homo Sapiens
SLAPYRDYL

SEQ ID NO: 5865 - protein, 9 aa, Homo Sapiens
SLAQALQEL

SEQ ID NO: 5866 - protein, 9 aa, Homo Sapiens
SLAQMVSGL

SEQ ID NO: 5867 - protein, 9 aa, Homo Sapiens
SLAQYLINA

SEQ ID NO: 5868 - protein, 9 aa, Homo Sapiens
SLAQYLINV

SEQ ID NO: 5869 - protein, 9 aa, Homo Sapiens
SLAQYNPKL

SEQ ID NO: 5870 - protein, 9 aa, Homo Sapiens
SLARHLMTL

SEQ ID NO: 5871 - protein, 9 aa, Homo Sapiens
SLARILSLL

SEQ ID NO: 5872 - protein, 9 aa, Homo Sapiens
SLASCLSRL

SEQ ID NO: 5873 - protein, 9 aa, Homo Sapiens
SLASHDSTL

SEQ ID NO: 5874 - protein, 9 aa, Homo Sapiens
SLASHIQSL

SEQ ID NO: 5875 - protein, 9 aa, Homo Sapiens
SLASIQELL

SEQ ID NO: 5876 - protein, 9 aa, Homo Sapiens
SLASKLSRL

SEQ ID NO: 5877 - protein, 9 aa, Homo Sapiens
SLASLTEKI

SEQ ID NO: 5878 - protein, 9 aa, Homo Sapiens
SLASTLSKL

SEQ ID NO: 5879 - protein, 9 aa, Homo Sapiens
SLATHLQEL

SEQ ID NO: 5880 - protein, 9 aa, Homo Sapiens
SLATHVKKL

SEQ ID NO: 5881 - protein, 9 aa, Homo Sapiens
SLATMIDRI

SEQ ID NO: 5882 - protein, 9 aa, Homo Sapiens
SLATRISTL

SEQ ID NO: 5883 - protein, 9 aa, Homo Sapiens
SLATSLPRL

SEQ ID NO: 5884 - protein, 9 aa, Homo Sapiens
SLATVKKQL

SEQ ID NO: 5885 - protein, 9 aa, Homo Sapiens
SLAVDSSFL

SEQ ID NO: 5886 - protein, 9 aa, Homo Sapiens
SLAVHTDKV

SEQ ID NO: 5887 - protein, 9 aa, Homo Sapiens
SLAVSSPRL

SEQ ID NO: 5888 - protein, 9 aa, Homo Sapiens
SLAWDVPAA

SEQ ID NO: 5889 - protein, 9 aa, Homo Sapiens
SLCDLKSRL

SEQ ID NO: 5890 - protein, 9 aa, Homo Sapiens
SLCHLDLQL

SEQ ID NO: 5891 - protein, 9 aa, Homo Sapiens
SLCHVLPDL

SEQ ID NO: 5892 - protein, 9 aa, Homo Sapiens
SLCNSIISL

SEQ ID NO: 5893 - protein, 9 aa, Homo Sapiens
SLCPDLMEI

SEQ ID NO: 5894 - protein, 9 aa, Homo Sapiens
SLCPSLISL

SEQ ID NO: 5895 - protein, 9 aa, Homo Sapiens
SLCQEINRV

SEQ ID NO: 5896 - protein, 9 aa, Homo Sapiens
SLCQRLVKL

SEQ ID NO: 5897 - protein, 9 aa, Homo Sapiens
SLDQIFETL

SEQ ID NO: 5898 - protein, 9 aa, Homo Sapiens
SLFAQCEAV

SEQ ID NO: 5899 - protein, 9 aa, Homo Sapiens
SLFDAVSSL

SEQ ID NO: 5900 - protein, 9 aa, Homo Sapiens
SLFEGTWYL

SEQ ID NO: 5901 - protein, 9 aa, Homo Sapiens
SLFERLVKV

SEQ ID NO: 5902 - protein, 9 aa, Homo Sapiens
SLFERLVVL

SEQ ID NO: 5903 - protein, 9 aa, Homo Sapiens
SLFGGSVKL

SEQ ID NO: 5904 - protein, 9 aa, Homo Sapiens
SLFGGTSGL

SEQ ID NO: 5905 - protein, 9 aa, Homo Sapiens
SLFGNIKGA

SEQ ID NO: 5906 - protein, 9 aa, Homo Sapiens
SLFHYSEYL

SEQ ID NO: 5907 - protein, 9 aa, Homo Sapiens
SLFKGICAL

SEQ ID NO: 5908 - protein, 9 aa, Homo Sapiens
SLFKLIVKV

SEQ ID NO: 5909 - protein, 9 aa, Homo Sapiens
SLFKRLYSL

SEQ ID NO: 5910 - protein, 9 aa, Homo Sapiens
SLFNGSHYL

SEQ ID NO: 5911 - protein, 9 aa, Homo Sapiens
SLFPHAICL

SEQ ID NO: 5912 - protein, 9 aa, Homo Sapiens
SLFRVITEV

SEQ ID NO: 5913 - protein, 9 aa, Homo Sapiens
SLFSAVHKI

SEQ ID NO: 5914 - protein, 9 aa, Homo Sapiens
SLFSKENVL

SEQ ID NO: 5915 - protein, 9 aa, Homo Sapiens
SLGDIYFKL

SEQ ID NO: 5916 - protein, 9 aa, Homo Sapiens
SLGPQPLVA

SEQ ID NO: 5917 - protein, 9 aa, Homo Sapiens
SLGSFICKL

SEQ ID NO: 5918 - protein, 9 aa, Homo Sapiens
SLGSINQRL

SEQ ID NO: 5919 - protein, 9 aa, Homo Sapiens
SLGSIYTRL

SEQ ID NO: 5920 - protein, 9 aa, Homo Sapiens
SLHDAIMIV

SEQ ID NO: 5921 - protein, 9 aa, Homo Sapiens
SLHDTVTTL

SEQ ID NO: 5922 - protein, 9 aa, Homo Sapiens
SLHDVLFEL

SEQ ID NO: 5923 - protein, 9 aa, Homo Sapiens
SLHEFLVNL

SEQ ID NO: 5924 - protein, 9 aa, Homo Sapiens
SLHHLINAL

SEQ ID NO: 5925 - protein, 9 aa, Homo Sapiens
SLHPGSSAL

SEQ ID NO: 5926 - protein, 9 aa, Homo Sapiens
SLHSVIIQL

SEQ ID NO: 5927 - protein, 9 aa, Homo Sapiens
SLHSVVQTL

SEQ ID NO: 5928 - protein, 9 aa, Homo Sapiens
SLIAKVATA

SEQ ID NO: 5929 - protein, 9 aa, Homo Sapiens
SLIDGIKRA

SEQ ID NO: 5930 - protein, 9 aa, Homo Sapiens
SLIDKTTAA

SEQ ID NO: 5931 - protein, 9 aa, Homo Sapiens
SLIEKIPTA

SEQ ID NO: 5932 - protein, 9 aa, Homo Sapiens
SLIEKSCQL

SEQ ID NO: 5933 - protein, 9 aa, Homo Sapiens
SLIEKVTQL

SEQ ID NO: 5934 - protein, 9 aa, Homo Sapiens
SLIEQTTAL

SEQ ID NO: 5935 - protein, 9 aa, Homo Sapiens
SLIFKLEEL

SEQ ID NO: 5936 - protein, 9 aa, Homo Sapiens
SLIGHLQTL

SEQ ID NO: 5937 - protein, 9 aa, Homo Sapiens
SLIKQSAQL

SEQ ID NO: 5938 - protein, 9 aa, Homo Sapiens
SLINENQSL

SEQ ID NO: 5939 - protein, 9 aa, Homo Sapiens
SLIRNLEQL

SEQ ID NO: 5940 - protein, 9 aa, Homo Sapiens
SLIRSVVAL

SEQ ID NO: 5941 - protein, 9 aa, Homo Sapiens
SLISGIIRA

SEQ ID NO: 5942 - protein, 9 aa, Homo Sapiens
SLISINNKL

SEQ ID NO: 5943 - protein, 9 aa, Homo Sapiens
SLITRLLEV

SEQ ID NO: 5944 - protein, 9 aa, Homo Sapiens
SLKAHVQEV

SEQ ID NO: 5945 - protein, 9 aa, Homo Sapiens
SLKDDLTKL

SEQ ID NO: 5946 - protein, 9 aa, Homo Sapiens
SLKDGNAFL

SEQ ID NO: 5947 - protein, 9 aa, Homo Sapiens
SLKDKVENL

SEQ ID NO: 5948 - protein, 9 aa, Homo Sapiens
SLKDRIHCV

SEQ ID NO: 5949 - protein, 9 aa, Homo Sapiens
SLKEALQKA

SEQ ID NO: 5950 - protein, 9 aa, Homo Sapiens
SLKEDIQKA

SEQ ID NO: 5951 - protein, 9 aa, Homo Sapiens
SLKETIEEL

SEQ ID NO: 5952 - protein, 9 aa, Homo Sapiens
SLKGTLDNL

SEQ ID NO: 5953 - protein, 9 aa, Homo Sapiens
SLKLECDKL

SEQ ID NO: 5954 - protein, 9 aa, Homo Sapiens
SLKLGLDKA

SEQ ID NO: 5955 - protein, 9 aa, Homo Sapiens
SLKNRIESV

SEQ ID NO: 5956 - protein, 9 aa, Homo Sapiens
SLKQELEQL

SEQ ID NO: 5957 - protein, 9 aa, Homo Sapiens
SLKQETQGL

SEQ ID NO: 5958 - protein, 9 aa, Homo Sapiens
SLKRMLEKL

SEQ ID NO: 5959 - protein, 9 aa, Homo Sapiens
SLKRSLEQA

SEQ ID NO: 5960 - protein, 9 aa, Homo Sapiens
SLKSEAESL

SEQ ID NO: 5961 - protein, 9 aa, Homo Sapiens
SLKSKLEHA

SEQ ID NO: 5962 - protein, 9 aa, Homo Sapiens
SLKTLLECV

SEQ ID NO: 5963 - protein, 9 aa, Homo Sapiens
SLLDLEQKL

SEQ ID NO: 5964 - protein, 9 aa, Homo Sapiens
SLLQTQHAL

SEQ ID NO: 5965 - protein, 9 aa, Homo Sapiens
SLMDLQERL

SEQ ID NO: 5966 - protein, 9 aa, Homo Sapiens
SLMEKISKL

SEQ ID NO: 5967 - protein, 9 aa, Homo Sapiens
SLMGTLSKL

SEQ ID NO: 5968 - protein, 9 aa, Homo Sapiens
SLMKLVSDL

SEQ ID NO: 5969 - protein, 9 aa, Homo Sapiens
SLMPEEEFL

SEQ ID NO: 5970 - protein, 9 aa, Homo Sapiens
SLMPKMHLL

SEQ ID NO: 5971 - protein, 9 aa, Homo Sapiens
SLMSHAIEL

SEQ ID NO: 5972 - protein, 9 aa, Homo Sapiens
SLNEREQEL

SEQ ID NO: 5973 - protein, 9 aa, Homo Sapiens
SLNGLEVHL

SEQ ID NO: 5974 - protein, 9 aa, Homo Sapiens
SLNHFTHSV

SEQ ID NO: 5975 - protein, 9 aa, Homo Sapiens
SLNHLLNYV

SEQ ID NO: 5976 - protein, 9 aa, Homo Sapiens
SLNKHVEAV

SEQ ID NO: 5977 - protein, 9 aa, Homo Sapiens
SLNKQIAQL

SEQ ID NO: 5978 - protein, 9 aa, Homo Sapiens
SLNKQIETV

SEQ ID NO: 5979 - protein, 9 aa, Homo Sapiens
SLNKRVEEL

SEQ ID NO: 5980 - protein, 9 aa, Homo Sapiens
SLNKSLQNL

SEQ ID NO: 5981 - protein, 9 aa, Homo Sapiens
SLNPLIQML

SEQ ID NO: 5982 - protein, 9 aa, Homo Sapiens
SLNPMSDKL

SEQ ID NO: 5983 - protein, 9 aa, Homo Sapiens
SLPDFCHKF

SEQ ID NO: 5984 - protein, 9 aa, Homo Sapiens
SLPDIKVYL

SEQ ID NO: 5985 - protein, 9 aa, Homo Sapiens
SLQEEIAFL

SEQ ID NO: 5986 - protein, 9 aa, Homo Sapiens
SLQEGSYLL

SEQ ID NO: 5987 - protein, 9 aa, Homo Sapiens
SLREACETV

SEQ ID NO: 5988 - protein, 9 aa, Homo Sapiens
SLREQLEGV

SEQ ID NO: 5989 - protein, 9 aa, Homo Sapiens
SLRERIEFL

SEQ ID NO: 5990 - protein, 9 aa, Homo Sapiens
SLRPAVERL

SEQ ID NO: 5991 - protein, 9 aa, Homo Sapiens
SLSAIFNNV

SEQ ID NO: 5992 - protein, 9 aa, Homo Sapiens
SLSASHNQL

SEQ ID NO: 5993 - protein, 9 aa, Homo Sapiens
SLSDARDAL

SEQ ID NO: 5994 - protein, 9 aa, Homo Sapiens
SLSDAVQRL

SEQ ID NO: 5995 - protein, 9 aa, Homo Sapiens
SLSDIEWHI

SEQ ID NO: 5996 - protein, 9 aa, Homo Sapiens
SLSDRDSYL

SEQ ID NO: 5997 - protein, 9 aa, Homo Sapiens
SLSDTHDRL

SEQ ID NO: 5998 - protein, 9 aa, Homo Sapiens
SLSDTVEKL

SEQ ID NO: 5999 - protein, 9 aa, Homo Sapiens
SLSDVQHNI

SEQ ID NO: 6000 - protein, 9 aa, Homo Sapiens
SLSEELAKL

SEQ ID NO: 6001 - protein, 9 aa, Homo Sapiens
SLSEIEKLL

SEQ ID NO: 6002 - protein, 9 aa, Homo Sapiens
SLSEKQYFL

SEQ ID NO: 6003 - protein, 9 aa, Homo Sapiens
SLSEKTVLL

SEQ ID NO: 6004 - protein, 9 aa, Homo Sapiens
SLSELRQHL

SEQ ID NO: 6005 - protein, 9 aa, Homo Sapiens
SLSENQSLL

SEQ ID NO: 6006 - protein, 9 aa, Homo Sapiens
SLSERIMQL

SEQ ID NO: 6007 - protein, 9 aa, Homo Sapiens
SLSESWYNL

SEQ ID NO: 6008 - protein, 9 aa, Homo Sapiens
SLSETNKGL

SEQ ID NO: 6009 - protein, 9 aa, Homo Sapiens
SLSEVRECL

SEQ ID NO: 6010 - protein, 9 aa, Homo Sapiens
SLSEYDQCL

SEQ ID NO: 6011 - protein, 9 aa, Homo Sapiens
SLSEYRQSL

SEQ ID NO: 6012 - protein, 9 aa, Homo Sapiens
SLSEYVSRM

SEQ ID NO: 6013 - protein, 9 aa, Homo Sapiens
SLSFMNPRL

SEQ ID NO: 6014 - protein, 9 aa, Homo Sapiens
SLSGKIQKL

SEQ ID NO: 6015 - protein, 9 aa, Homo Sapiens
SLSGYINYL

SEQ ID NO: 6016 - protein, 9 aa, Homo Sapiens
SLSHINAYA

SEQ ID NO: 6017 - protein, 9 aa, Homo Sapiens
SLSLHNNLL

SEQ ID NO: 6018 - protein, 9 aa, Homo Sapiens
SLSLNNNKL

SEQ ID NO: 6019 - protein, 9 aa, Homo Sapiens
SLSNIVRNL

SEQ ID NO: 6020 - protein, 9 aa, Homo Sapiens
SLSNSLHKV

SEQ ID NO: 6021 - protein, 9 aa, Homo Sapiens
SLSNVQETL

SEQ ID NO: 6022 - protein, 9 aa, Homo Sapiens
SLSPFNDVV

SEQ ID NO: 6023 - protein, 9 aa, Homo Sapiens
SLSPGTHLL

SEQ ID NO: 6024 - protein, 9 aa, Homo Sapiens
SLSQASHAV

SEQ ID NO: 6025 - protein, 9 aa, Homo Sapiens
SLSQHINWV

SEQ ID NO: 6026 - protein, 9 aa, Homo Sapiens
SLSQHNDFL

SEQ ID NO: 6027 - protein, 9 aa, Homo Sapiens
SLSQVFLHL

SEQ ID NO: 6028 - protein, 9 aa, Homo Sapiens
SLSQVLQRL

SEQ ID NO: 6029 - protein, 9 aa, Homo Sapiens
SLSRSVQQL

SEQ ID NO: 6030 - protein, 9 aa, Homo Sapiens
SLSRVLTEL

SEQ ID NO: 6031 - protein, 9 aa, Homo Sapiens
SLSSCFAQL

SEQ ID NO: 6032 - protein, 9 aa, Homo Sapiens
SLSSFLERL

SEQ ID NO: 6033 - protein, 9 aa, Homo Sapiens
SLSSHQSSL

SEQ ID NO: 6034 - protein, 9 aa, Homo Sapiens
SLSSLLVKL

SEQ ID NO: 6035 - protein, 9 aa, Homo Sapiens
SLSSVLSHV

SEQ ID NO: 6036 - protein, 9 aa, Homo Sapiens
SLSTLQQQL

SEQ ID NO: 6037 - protein, 9 aa, Homo Sapiens
SLSTVFVVL

SEQ ID NO: 6038 - protein, 9 aa, Homo Sapiens
SLTAHLHQA

SEQ ID NO: 6039 - protein, 9 aa, Homo Sapiens
SLTEYIHHL

SEQ ID NO: 6040 - protein, 9 aa, Homo Sapiens
SLTSEIHFL

SEQ ID NO: 6041 - protein, 9 aa, Homo Sapiens
SLVDIYSQL

SEQ ID NO: 6042 - protein, 9 aa, Homo Sapiens
SLVDQSAAL

SEQ ID NO: 6043 - protein, 9 aa, Homo Sapiens
SLVEIRNFL

SEQ ID NO: 6044 - protein, 9 aa, Homo Sapiens
SLYDQAEKL

SEQ ID NO: 6045 - protein, 9 aa, Homo Sapiens
SLYDWNVKL

SEQ ID NO: 6046 - protein, 9 aa, Homo Sapiens
SLYDYNPNL

SEQ ID NO: 6047 - protein, 9 aa, Homo Sapiens
SLYEENNKL

SEQ ID NO: 6048 - protein, 9 aa, Homo Sapiens
SLYEMVSRV

SEQ ID NO: 6049 - protein, 9 aa, Homo Sapiens
SLYGASPGL

SEQ ID NO: 6050 - protein, 9 aa, Homo Sapiens
SLYHGYELL

SEQ ID NO: 6051 - protein, 9 aa, Homo Sapiens
SLYSQVHQI

SEQ ID NO: 6052 - protein, 9 aa, Homo Sapiens
SMAAFVPAA

SEQ ID NO: 6053 - protein, 9 aa, Homo Sapiens
SMAALTSHL

SEQ ID NO: 6054 - protein, 9 aa, Homo Sapiens
SMAEILRSL

SEQ ID NO: 6055 - protein, 9 aa, Homo Sapiens
SMAEVDAAM

SEQ ID NO: 6056 - protein, 9 aa, Homo Sapiens
SMASVLEQL

SEQ ID NO: 6057 - protein, 9 aa, Homo Sapiens
SMAVVIPEA

SEQ ID NO: 6058 - protein, 9 aa, Homo Sapiens
SMCILLDHL

SEQ ID NO: 6059 - protein, 9 aa, Homo Sapiens
SMEEIFQHL

SEQ ID NO: 6060 - protein, 9 aa, Homo Sapiens
SMFEFSEKL

SEQ ID NO: 6061 - protein, 9 aa, Homo Sapiens
SMISKLKQA

SEQ ID NO: 6062 - protein, 9 aa, Homo Sapiens
SMKDDLERV

SEQ ID NO: 6063 - protein, 9 aa, Homo Sapiens
SMMDRMFAL

SEQ ID NO: 6064 - protein, 9 aa, Homo Sapiens
SMMDVDHQI

SEQ ID NO: 6065 - protein, 9 aa, Homo Sapiens
SMPELHNFL

SEQ ID NO: 6066 - protein, 9 aa, Homo Sapiens
SMSADVPLV

SEQ ID NO: 6067 - protein, 9 aa, Homo Sapiens
SMSAVVQEL

SEQ ID NO: 6068 - protein, 9 aa, Homo Sapiens
SMTSIRQFV

SEQ ID NO: 6069 - protein, 9 aa, Homo Sapiens
SMYGKEELL

SEQ ID NO: 6070 - protein, 9 aa, Homo Sapiens
SMYSKPECL

SEQ ID NO: 6071 - protein, 9 aa, Homo Sapiens
SQAEIEARL

SEQ ID NO: 6072 - protein, 9 aa, Homo Sapiens
SQAGLNQKL

SEQ ID NO: 6073 - protein, 9 aa, Homo Sapiens
SQCSAQHYV

SEQ ID NO: 6074 - protein, 9 aa, Homo Sapiens
SQIQKVEPA

SEQ ID NO: 6075 - protein, 9 aa, Homo Sapiens
SSLLEKGLD

SEQ ID NO: 6076 - protein, 9 aa, Homo Sapiens
STCEFVRTL

SEQ ID NO: 6077 - protein, 9 aa, Homo Sapiens
STSKWNHLL

SEQ ID NO: 6078 - protein, 9 aa, Homo Sapiens
STSNIQVGL

SEQ ID NO: 6079 - protein, 9 aa, Homo Sapiens
SVADLAHVL

SEQ ID NO: 6080 - protein, 9 aa, Homo Sapiens
SVAELQSRL

SEQ ID NO: 6081 - protein, 9 aa, Homo Sapiens
SVAESLNYV

SEQ ID NO: 6082 - protein, 9 aa, Homo Sapiens
SVAKTSQLL

SEQ ID NO: 6083 - protein, 9 aa, Homo Sapiens
SVAMHTNYL

SEQ ID NO: 6084 - protein, 9 aa, Homo Sapiens
SVANHNSFL

SEQ ID NO: 6085 - protein, 9 aa, Homo Sapiens
SVAPFADYL

SEQ ID NO: 6086 - protein, 9 aa, Homo Sapiens
SVAPFDQNL

SEQ ID NO: 6087 - protein, 9 aa, Homo Sapiens
SVAQLEARL

SEQ ID NO: 6088 - protein, 9 aa, Homo Sapiens
SVNPYIVKL

SEQ ID NO: 6089 - protein, 9 aa, Homo Sapiens
SVSHITQHL

SEQ ID NO: 6090 - protein, 9 aa, Homo Sapiens
SVSKLIHYV

SEQ ID NO: 6091 - protein, 9 aa, Homo Sapiens
SVSQINHKL

SEQ ID NO: 6092 - protein, 9 aa, Homo Sapiens
SVSSVVHYL

SEQ ID NO: 6093 - protein, 9 aa, Homo Sapiens
SVTYDLSKL

SEQ ID NO: 6094 - protein, 9 aa, Homo Sapiens
TICEHLQYL

SEQ ID NO: 6095 - protein, 9 aa, Homo Sapiens
TLAAIIEHL

SEQ ID NO: 6096 - protein, 9 aa, Homo Sapiens
TLAAVIRKL

SEQ ID NO: 6097 - protein, 9 aa, Homo Sapiens
TLAAVLQRI

SEQ ID NO: 6098 - protein, 9 aa, Homo Sapiens
TLADFKNVL

SEQ ID NO: 6099 - protein, 9 aa, Homo Sapiens
TLADIYREL

SEQ ID NO: 6100 - protein, 9 aa, Homo Sapiens
TLADLVHHV

SEQ ID NO: 6101 - protein, 9 aa, Homo Sapiens
TLADMATRL

SEQ ID NO: 6102 - protein, 9 aa, Homo Sapiens
TLADVLYHV

SEQ ID NO: 6103 - protein, 9 aa, Homo Sapiens
TLADYLHLL

SEQ ID NO: 6104 - protein, 9 aa, Homo Sapiens
TLAEAGAKI

SEQ ID NO: 6105 - protein, 9 aa, Homo Sapiens
TLAEHQQLI

SEQ ID NO: 6106 - protein, 9 aa, Homo Sapiens
TLAEKIQTI

SEQ ID NO: 6107 - protein, 9 aa, Homo Sapiens
TLAELQNNM

SEQ ID NO: 6108 - protein, 9 aa, Homo Sapiens
TLAEQRDEL

SEQ ID NO: 6109 - protein, 9 aa, Homo Sapiens
TLAESSDHV

SEQ ID NO: 6110 - protein, 9 aa, Homo Sapiens
TLAETIQGL

SEQ ID NO: 6111 - protein, 9 aa, Homo Sapiens
TLAETLVNL

SEQ ID NO: 6112 - protein, 9 aa, Homo Sapiens
TLAEVSTRL

SEQ ID NO: 6113 - protein, 9 aa, Homo Sapiens
TLAFVSPSL

SEQ ID NO: 6114 - protein, 9 aa, Homo Sapiens
TLAGLHVRL

SEQ ID NO: 6115 - protein, 9 aa, Homo Sapiens
TLAHIHYGV

SEQ ID NO: 6116 - protein, 9 aa, Homo Sapiens
TLAKCLYEL

SEQ ID NO: 6117 - protein, 9 aa, Homo Sapiens
TLAKYLMEL

SEQ ID NO: 6118 - protein, 9 aa, Homo Sapiens
TLALLTHRL

SEQ ID NO: 6119 - protein, 9 aa, Homo Sapiens
TLANVIRQL

SEQ ID NO: 6120 - protein, 9 aa, Homo Sapiens
TLAPTWEEL

SEQ ID NO: 6121 - protein, 9 aa, Homo Sapiens
TLAQHSVEL

SEQ ID NO: 6122 - protein, 9 aa, Homo Sapiens
TLAQIHKGL

SEQ ID NO: 6123 - protein, 9 aa, Homo Sapiens
TLASIIKEV

SEQ ID NO: 6124 - protein, 9 aa, Homo Sapiens
TLASKVDQL

SEQ ID NO: 6125 - protein, 9 aa, Homo Sapiens
TLASSLHTL

SEQ ID NO: 6126 - protein, 9 aa, Homo Sapiens
TLATLHTAL

SEQ ID NO: 6127 - protein, 9 aa, Homo Sapiens
TLCDLYETL

SEQ ID NO: 6128 - protein, 9 aa, Homo Sapiens
TLCDVILMV

SEQ ID NO: 6129 - protein, 9 aa, Homo Sapiens
TLCDVTLRV

SEQ ID NO: 6130 - protein, 9 aa, Homo Sapiens
TLCLIQNKL

SEQ ID NO: 6131 - protein, 9 aa, Homo Sapiens
TLCPAIHKL

SEQ ID NO: 6132 - protein, 9 aa, Homo Sapiens
TLCQFHNQV

SEQ ID NO: 6133 - protein, 9 aa, Homo Sapiens
TLCQTQMKL

SEQ ID NO: 6134 - protein, 9 aa, Homo Sapiens
TLFAGAHEL

SEQ ID NO: 6135 - protein, 9 aa, Homo Sapiens
TLFDYEVRL

SEQ ID NO: 6136 - protein, 9 aa, Homo Sapiens
TLFFQQNAL

SEQ ID NO: 6137 - protein, 9 aa, Homo Sapiens
TLFPGTDHI

SEQ ID NO: 6138 - protein, 9 aa, Homo Sapiens
TLFPSKIGV

SEQ ID NO: 6139 - protein, 9 aa, Homo Sapiens
TLGPKPFQL

SEQ ID NO: 6140 - protein, 9 aa, Homo Sapiens
TLHALCNLL

SEQ ID NO: 6141 - protein, 9 aa, Homo Sapiens
TLHSLISEL

SEQ ID NO: 6142 - protein, 9 aa, Homo Sapiens
TLHSVDQYL

SEQ ID NO: 6143 - protein, 9 aa, Homo Sapiens
TLIEDILGV

SEQ ID NO: 6144 - protein, 9 aa, Homo Sapiens
TLISELVQA

SEQ ID NO: 6145 - protein, 9 aa, Homo Sapiens
TLKEEVNEL

SEQ ID NO: 6146 - protein, 9 aa, Homo Sapiens
TLKEEVQKL

SEQ ID NO: 6147 - protein, 9 aa, Homo Sapiens
TLKETNEEL

SEQ ID NO: 6148 - protein, 9 aa, Homo Sapiens
TLKEYLESL

SEQ ID NO: 6149 - protein, 9 aa, Homo Sapiens
TLKITLDNA

SEQ ID NO: 6150 - protein, 9 aa, Homo Sapiens
TLKQGIERV

SEQ ID NO: 6151 - protein, 9 aa, Homo Sapiens
TLKRKLDQV

SEQ ID NO: 6152 - protein, 9 aa, Homo Sapiens
TLKRQLDEV

SEQ ID NO: 6153 - protein, 9 aa, Homo Sapiens
TLKRTIEAL

SEQ ID NO: 6154 - protein, 9 aa, Homo Sapiens
TLKSTVEAL

SEQ ID NO: 6155 - protein, 9 aa, Homo Sapiens
TLLEKDYFL

SEQ ID NO: 6156 - protein, 9 aa, Homo Sapiens
TLMEALHYM

SEQ ID NO: 6157 - protein, 9 aa, Homo Sapiens
TLNDKVEFL

SEQ ID NO: 6158 - protein, 9 aa, Homo Sapiens
TLNDREYQL

SEQ ID NO: 6159 - protein, 9 aa, Homo Sapiens
TLNEKLFLL

SEQ ID NO: 6160 - protein, 9 aa, Homo Sapiens
TLNEKLTAL

SEQ ID NO: 6161 - protein, 9 aa, Homo Sapiens
TLNEMSHKL

SEQ ID NO: 6162 - protein, 9 aa, Homo Sapiens
TLNKFIEEL

SEQ ID NO: 6163 - protein, 9 aa, Homo Sapiens
TLNKFTEEL

SEQ ID NO: 6164 - protein, 9 aa, Homo Sapiens
TLNKLIKRL

SEQ ID NO: 6165 - protein, 9 aa, Homo Sapiens
TLNNLVEKL

SEQ ID NO: 6166 - protein, 9 aa, Homo Sapiens
TLNSFIHVL

SEQ ID NO: 6167 - protein, 9 aa, Homo Sapiens
TLNSHLNKV

SEQ ID NO: 6168 - protein, 9 aa, Homo Sapiens
TLQDIVYKL

SEQ ID NO: 6169 - protein, 9 aa, Homo Sapiens
TLQEKIHRL

SEQ ID NO: 6170 - protein, 9 aa, Homo Sapiens
TLREHLERL

SEQ ID NO: 6171 - protein, 9 aa, Homo Sapiens
TLSDFAVRL

SEQ ID NO: 6172 - protein, 9 aa, Homo Sapiens
TLSDIKALI

SEQ ID NO: 6173 - protein, 9 aa, Homo Sapiens
TLSDIMVSL

SEQ ID NO: 6174 - protein, 9 aa, Homo Sapiens
TLSDLRVYL

SEQ ID NO: 6175 - protein, 9 aa, Homo Sapiens
TLSDMEYRL

SEQ ID NO: 6176 - protein, 9 aa, Homo Sapiens
TLSDVLDRV

SEQ ID NO: 6177 - protein, 9 aa, Homo Sapiens
TLSDVLSRL

SEQ ID NO: 6178 - protein, 9 aa, Homo Sapiens
TLSDVVVGL

SEQ ID NO: 6179 - protein, 9 aa, Homo Sapiens
TLSDYTTCL

SEQ ID NO: 6180 - protein, 9 aa, Homo Sapiens
TLSEKLDLL

SEQ ID NO: 6181 - protein, 9 aa, Homo Sapiens
TLSELKTVL

SEQ ID NO: 6182 - protein, 9 aa, Homo Sapiens
TLSERLWGL

SEQ ID NO: 6183 - protein, 9 aa, Homo Sapiens
TLSEVLTKI

SEQ ID NO: 6184 - protein, 9 aa, Homo Sapiens
TLSEVNRYL

SEQ ID NO: 6185 - protein, 9 aa, Homo Sapiens
TLSEVTNQL

SEQ ID NO: 6186 - protein, 9 aa, Homo Sapiens
TLSGHSQEV

SEQ ID NO: 6187 - protein, 9 aa, Homo Sapiens
TLSGHTNAV

SEQ ID NO: 6188 - protein, 9 aa, Homo Sapiens
TLSGLQHVL

SEQ ID NO: 6189 - protein, 9 aa, Homo Sapiens
TLSPVNHSL

SEQ ID NO: 6190 - protein, 9 aa, Homo Sapiens
TLSQITNNI

SEQ ID NO: 6191 - protein, 9 aa, Homo Sapiens
TLSSFITKI

SEQ ID NO: 6192 - protein, 9 aa, Homo Sapiens
TLSSIRHMI

SEQ ID NO: 6193 - protein, 9 aa, Homo Sapiens
TLSSQISRL

SEQ ID NO: 6194 - protein, 9 aa, Homo Sapiens
TLSSVASKL

SEQ ID NO: 6195 - protein, 9 aa, Homo Sapiens
TLSTQQNTL

SEQ ID NO: 6196 - protein, 9 aa, Homo Sapiens
TLSTVISKV

SEQ ID NO: 6197 - protein, 9 aa, Homo Sapiens
TLSVIRDYL

SEQ ID NO: 6198 - protein, 9 aa, Homo Sapiens
TLTDIEQKV

SEQ ID NO: 6199 - protein, 9 aa, Homo Sapiens
TLTEICRRL

SEQ ID NO: 6200 - protein, 9 aa, Homo Sapiens
TLTELRAFL

SEQ ID NO: 6201 - protein, 9 aa, Homo Sapiens
TLTEYCSTL

SEQ ID NO: 6202 - protein, 9 aa, Homo Sapiens
TLTNIIHNL

SEQ ID NO: 6203 - protein, 9 aa, Homo Sapiens
TLTNVIHNL

SEQ ID NO: 6204 - protein, 9 aa, Homo Sapiens
TLVDFDNHL

SEQ ID NO: 6205 - protein, 9 aa, Homo Sapiens
TLYDHVDEV

SEQ ID NO: 6206 - protein, 9 aa, Homo Sapiens
TLYEHNNEL

SEQ ID NO: 6207 - protein, 9 aa, Homo Sapiens
TMAIIVNKL

SEQ ID NO: 6208 - protein, 9 aa, Homo Sapiens
TMASVCHTL

SEQ ID NO: 6209 - protein, 9 aa, Homo Sapiens
TMGPRPAAA

SEQ ID NO: 6210 - protein, 9 aa, Homo Sapiens
TMIEICEKL

SEQ ID NO: 6211 - protein, 9 aa, Homo Sapiens
TMINAIPVA

SEQ ID NO: 6212 - protein, 9 aa, Homo Sapiens
TMKTYVEKV

SEQ ID NO: 6213 - protein, 9 aa, Homo Sapiens
TMPDLYHLL

SEQ ID NO: 6214 - protein, 9 aa, Homo Sapiens
TTSDIDYAL

SEQ ID NO: 6215 - protein, 9 aa, Homo Sapiens
TVADHIQKV

SEQ ID NO: 6216 - protein, 9 aa, Homo Sapiens
TVAEINATM

SEQ ID NO: 6217 - protein, 9 aa, Homo Sapiens
TVAELVQFL

SEQ ID NO: 6218 - protein, 9 aa, Homo Sapiens
TVAPFNPTV

SEQ ID NO: 6219 - protein, 9 aa, Homo Sapiens
VIAAVSHEL

SEQ ID NO: 6220 - protein, 9 aa, Homo Sapiens
VIAEILRGV

SEQ ID NO: 6221 - protein, 9 aa, Homo Sapiens
VIAEQIQHL

SEQ ID NO: 6222 - protein, 9 aa, Homo Sapiens
VIANINNCL

SEQ ID NO: 6223 - protein, 9 aa, Homo Sapiens
VISGINEKL

SEQ ID NO: 6224 - protein, 9 aa, Homo Sapiens
VISPLNQLL

SEQ ID NO: 6225 - protein, 9 aa, Homo Sapiens
VISSIRNFL

SEQ ID NO: 6226 - protein, 9 aa, Homo Sapiens
VLAAITSHM

SEQ ID NO: 6227 - protein, 9 aa, Homo Sapiens
VLADACWAL

SEQ ID NO: 6228 - protein, 9 aa, Homo Sapiens
VLADFEAGL

SEQ ID NO: 6229 - protein, 9 aa, Homo Sapiens
VLADIAKQV

SEQ ID NO: 6230 - protein, 9 aa, Homo Sapiens
VLADLKVQL

SEQ ID NO: 6231 - protein, 9 aa, Homo Sapiens
VLADQEVRL

SEQ ID NO: 6232 - protein, 9 aa, Homo Sapiens
VLADQVWTL

SEQ ID NO: 6233 - protein, 9 aa, Homo Sapiens
VLADTCWAI

SEQ ID NO: 6234 - protein, 9 aa, Homo Sapiens
VLADTKELV

SEQ ID NO: 6235 - protein, 9 aa, Homo Sapiens
VLAEAVTGL

SEQ ID NO: 6236 - protein, 9 aa, Homo Sapiens
VLAEIPQQV

SEQ ID NO: 6237 - protein, 9 aa, Homo Sapiens
VLAEKCPNL

SEQ ID NO: 6238 - protein, 9 aa, Homo Sapiens
VLAELVRLG

SEQ ID NO: 6239 - protein, 9 aa, Homo Sapiens
VLAEQLHQA

SEQ ID NO: 6240 - protein, 9 aa, Homo Sapiens
VLAERCVLL

SEQ ID NO: 6241 - protein, 9 aa, Homo Sapiens
VLAESYEKI

SEQ ID NO: 6242 - protein, 9 aa, Homo Sapiens
VLAEVPTQL

SEQ ID NO: 6243 - protein, 9 aa, Homo Sapiens
VLAFLVHEL

SEQ ID NO: 6244 - protein, 9 aa, Homo Sapiens
VLAFVLDHL

SEQ ID NO: 6245 - protein, 9 aa, Homo Sapiens
VLAGFVNGL

SEQ ID NO: 6246 - protein, 9 aa, Homo Sapiens
VLAGHDNRV

SEQ ID NO: 6247 - protein, 9 aa, Homo Sapiens
VLAGVSQQL

SEQ ID NO: 6248 - protein, 9 aa, Homo Sapiens
VLAHTILGV

SEQ ID NO: 6249 - protein, 9 aa, Homo Sapiens
VLAHVTNRL

SEQ ID NO: 6250 - protein, 9 aa, Homo Sapiens
VLAHYADVL

SEQ ID NO: 6251 - protein, 9 aa, Homo Sapiens
VLAKIVNYM

SEQ ID NO: 6252 - protein, 9 aa, Homo Sapiens
VLAKQLVHL

SEQ ID NO: 6253 - protein, 9 aa, Homo Sapiens
VLAPLGFTL

SEQ ID NO: 6254 - protein, 9 aa, Homo Sapiens
VLAPMFERL

SEQ ID NO: 6255 - protein, 9 aa, Homo Sapiens
VLAQQIATL

SEQ ID NO: 6256 - protein, 9 aa, Homo Sapiens
VLAQVFTEL

SEQ ID NO: 6257 - protein, 9 aa, Homo Sapiens
VLARTIEYL

SEQ ID NO: 6258 - protein, 9 aa, Homo Sapiens
VLASHYIHI

SEQ ID NO: 6259 - protein, 9 aa, Homo Sapiens
VLASLIIRL

SEQ ID NO: 6260 - protein, 9 aa, Homo Sapiens
VLATFVHML

SEQ ID NO: 6261 - protein, 9 aa, Homo Sapiens
VLATLLNNL

SEQ ID NO: 6262 - protein, 9 aa, Homo Sapiens
VLAWVKEKV

SEQ ID NO: 6263 - protein, 9 aa, Homo Sapiens
VLAYFLPEA

SEQ ID NO: 6264 - protein, 9 aa, Homo Sapiens
VLCELINAL

SEQ ID NO: 6265 - protein, 9 aa, Homo Sapiens
VLCGAVKQL

SEQ ID NO: 6266 - protein, 9 aa, Homo Sapiens
VLCSQQWKL

SEQ ID NO: 6267 - protein, 9 aa, Homo Sapiens
VLCTDSQGL

SEQ ID NO: 6268 - protein, 9 aa, Homo Sapiens
VLDDKDYFL

SEQ ID NO: 6269 - protein, 9 aa, Homo Sapiens
VLDSFCEGL

SEQ ID NO: 6270 - protein, 9 aa, Homo Sapiens
VLFDHVGCL

SEQ ID NO: 6271 - protein, 9 aa, Homo Sapiens
VLFGLLREV

SEQ ID NO: 6272 - protein, 9 aa, Homo Sapiens
VLFGVETHV

SEQ ID NO: 6273 - protein, 9 aa, Homo Sapiens
VLFNKLTYL

SEQ ID NO: 6274 - protein, 9 aa, Homo Sapiens
VLFPGTDHI

SEQ ID NO: 6275 - protein, 9 aa, Homo Sapiens
VLFPGYTHL

SEQ ID NO: 6276 - protein, 9 aa, Homo Sapiens
VLGEKTSNL

SEQ ID NO: 6277 - protein, 9 aa, Homo Sapiens
VLGPGPPPL

SEQ ID NO: 6278 - protein, 9 aa, Homo Sapiens
VLGPKIEAV

SEQ ID NO: 6279 - protein, 9 aa, Homo Sapiens
VLGTNSFVK

SEQ ID NO: 6280 - protein, 9 aa, Homo Sapiens
VLGTSNFKV

SEQ ID NO: 6281 - protein, 9 aa, Homo Sapiens
VLHDISSLL

SEQ ID NO: 6282 - protein, 9 aa, Homo Sapiens
VLHEGTNFV

SEQ ID NO: 6283 - protein, 9 aa, Homo Sapiens
VLHEHIQRL

SEQ ID NO: 6284 - protein, 9 aa, Homo Sapiens
VLHRNIDRL

SEQ ID NO: 6285 - protein, 9 aa, Homo Sapiens
VLHRNLIYL

SEQ ID NO: 6286 - protein, 9 aa, Homo Sapiens
VLHVKTESL

SEQ ID NO: 6287 - protein, 9 aa, Homo Sapiens
VLHYFVEFL

SEQ ID NO: 6288 - protein, 9 aa, Homo Sapiens
VLIDYQRNV

SEQ ID NO: 6289 - protein, 9 aa, Homo Sapiens
VLIGSEHGL

SEQ ID NO: 6290 - protein, 9 aa, Homo Sapiens
VLIGSNHSL

SEQ ID NO: 6291 - protein, 9 aa, Homo Sapiens
VLIPKLPQL

SEQ ID NO: 6292 - protein, 9 aa, Homo Sapiens
VLIRRIHKV

SEQ ID NO: 6293 - protein, 9 aa, Homo Sapiens
VLKDYIAYA

SEQ ID NO: 6294 - protein, 9 aa, Homo Sapiens
VLKEIVERV

SEQ ID NO: 6295 - protein, 9 aa, Homo Sapiens
VLKEKLDSL

SEQ ID NO: 6296 - protein, 9 aa, Homo Sapiens
VLKENADFL

SEQ ID NO: 6297 - protein, 9 aa, Homo Sapiens
VLKESLDQL

SEQ ID NO: 6298 - protein, 9 aa, Homo Sapiens
VLKEYLDNV

SEQ ID NO: 6299 - protein, 9 aa, Homo Sapiens
VLKGDVEKL

SEQ ID NO: 6300 - protein, 9 aa, Homo Sapiens
VLKKHTEYL

SEQ ID NO: 6301 - protein, 9 aa, Homo Sapiens
VLKVFLENV

SEQ ID NO: 6302 - protein, 9 aa, Homo Sapiens
VLMDRLPSL

SEQ ID NO: 6303 - protein, 9 aa, Homo Sapiens
VLMEMSYRL

SEQ ID NO: 6304 - protein, 9 aa, Homo Sapiens
VLMENIVYL

SEQ ID NO: 6305 - protein, 9 aa, Homo Sapiens
VLMEYIRSL

SEQ ID NO: 6306 - protein, 9 aa, Homo Sapiens
VLMKALEYL

SEQ ID NO: 6307 - protein, 9 aa, Homo Sapiens
VLMPWIHEL

SEQ ID NO: 6308 - protein, 9 aa, Homo Sapiens
VLNARIQKA

SEQ ID NO: 6309 - protein, 9 aa, Homo Sapiens
VLNAYVTHL

SEQ ID NO: 6310 - protein, 9 aa, Homo Sapiens
VLNEDVRNL

SEQ ID NO: 6311 - protein, 9 aa, Homo Sapiens
VLNEKLEQL

SEQ ID NO: 6312 - protein, 9 aa, Homo Sapiens
VLNEYFHNV

SEQ ID NO: 6313 - protein, 9 aa, Homo Sapiens
VLNNVVIHL

SEQ ID NO: 6314 - protein, 9 aa, Homo Sapiens
VLQDQVDEL

SEQ ID NO: 6315 - protein, 9 aa, Homo Sapiens
VLQDTVEQL

SEQ ID NO: 6316 - protein, 9 aa, Homo Sapiens
VLQNGGDKL

SEQ ID NO: 6317 - protein, 9 aa, Homo Sapiens
VLREGAESL

SEQ ID NO: 6318 - protein, 9 aa, Homo Sapiens
VLSALLTRI

SEQ ID NO: 6319 - protein, 9 aa, Homo Sapiens
VLSDEFSHL

SEQ ID NO: 6320 - protein, 9 aa, Homo Sapiens
VLSDIIQNL

SEQ ID NO: 6321 - protein, 9 aa, Homo Sapiens
VLSDLSTKL

SEQ ID NO: 6322 - protein, 9 aa, Homo Sapiens
VLSEKIDSL

SEQ ID NO: 6323 - protein, 9 aa, Homo Sapiens
VLSEKVSQL

SEQ ID NO: 6324 - protein, 9 aa, Homo Sapiens
VLSELAARL

SEQ ID NO: 6325 - protein, 9 aa, Homo Sapiens
VLSELLWQV

SEQ ID NO: 6326 - protein, 9 aa, Homo Sapiens
VLSEQQNGL

SEQ ID NO: 6327 - protein, 9 aa, Homo Sapiens
VLSESKCNL

SEQ ID NO: 6328 - protein, 9 aa, Homo Sapiens
VLSEVECHL

SEQ ID NO: 6329 - protein, 9 aa, Homo Sapiens
VLSHMNDVL

SEQ ID NO: 6330 - protein, 9 aa, Homo Sapiens
VLSKHNNEL

SEQ ID NO: 6331 - protein, 9 aa, Homo Sapiens
VLSNNIDHL

SEQ ID NO: 6332 - protein, 9 aa, Homo Sapiens
VLSNVEVTL

SEQ ID NO: 6333 - protein, 9 aa, Homo Sapiens
VLSQHFQTV

SEQ ID NO: 6334 - protein, 9 aa, Homo Sapiens
VLSQSQHSL

SEQ ID NO: 6335 - protein, 9 aa, Homo Sapiens
VLSRINQRL

SEQ ID NO: 6336 - protein, 9 aa, Homo Sapiens
VLSRLVESL

SEQ ID NO: 6337 - protein, 9 aa, Homo Sapiens
VLSSGTQAV

SEQ ID NO: 6338 - protein, 9 aa, Homo Sapiens
VLSSIEGRV

SEQ ID NO: 6339 - protein, 9 aa, Homo Sapiens
VLSTCEHRL

SEQ ID NO: 6340 - protein, 9 aa, Homo Sapiens
VLTEHSEEL

SEQ ID NO: 6341 - protein, 9 aa, Homo Sapiens
VLTEHVAAA

SEQ ID NO: 6342 - protein, 9 aa, Homo Sapiens
VLVDQTTGL

SEQ ID NO: 6343 - protein, 9 aa, Homo Sapiens
VLWDRTFSL

SEQ ID NO: 6344 - protein, 9 aa, Homo Sapiens
VLYDRIQAA

SEQ ID NO: 6345 - protein, 9 aa, Homo Sapiens
VLYPGCDTL

SEQ ID NO: 6346 - protein, 9 aa, Homo Sapiens
VMADIRELI

SEQ ID NO: 6347 - protein, 9 aa, Homo Sapiens
VMAEGTAVL

SEQ ID NO: 6348 - protein, 9 aa, Homo Sapiens
VMAELAKEL

SEQ ID NO: 6349 - protein, 9 aa, Homo Sapiens
VMAPRTLVL

SEQ ID NO: 6350 - protein, 9 aa, Homo Sapiens
VMAQILEHL

SEQ ID NO: 6351 - protein, 9 aa, Homo Sapiens
VMIQHVENL

SEQ ID NO: 6352 - protein, 9 aa, Homo Sapiens
VMKKIIETV

SEQ ID NO: 6353 - protein, 9 aa, Homo Sapiens
VMNEKLHRL

SEQ ID NO: 6354 - protein, 9 aa, Homo Sapiens
VMVDIHDQL

SEQ ID NO: 6355 - protein, 9 aa, Homo Sapiens
VMVEQSEKL

SEQ ID NO: 6356 - protein, 9 aa, Homo Sapiens
VMYGKVYRI

SEQ ID NO: 6357 - protein, 9 aa, Homo Sapiens
VTRDLVSEV

SEQ ID NO: 6358 - protein, 9 aa, Homo Sapiens
VVADLFHSL

SEQ ID NO: 6359 - protein, 9 aa, Homo Sapiens
VVCGLIFRL

SEQ ID NO: 6360 - protein, 9 aa, Homo Sapiens
WAGCALGAL

SEQ ID NO: 6361 - protein, 9 aa, Homo Sapiens
WLAEETSSL

SEQ ID NO: 6362 - protein, 9 aa, Homo Sapiens
WLAEKLPTL

SEQ ID NO: 6363 - protein, 9 aa, Homo Sapiens
WLAETTHAL

SEQ ID NO: 6364 - protein, 9 aa, Homo Sapiens
WLAEVEDKL

SEQ ID NO: 6365 - protein, 9 aa, Homo Sapiens
WLHESTNLL

SEQ ID NO: 6366 - protein, 9 aa, Homo Sapiens
WLHGLESQI

SEQ ID NO: 6367 - protein, 9 aa, Homo Sapiens
WLVDHVYAI

SEQ ID NO: 6368 - protein, 9 aa, Homo Sapiens
YASGINVNL

SEQ ID NO: 6369 - protein, 9 aa, Homo Sapiens
YAYDGKDYI

SEQ ID NO: 6370 - protein, 9 aa, Homo Sapiens
YGAEALERM

SEQ ID NO: 6371 - protein, 9 aa, Homo Sapiens
YIAEEYSRL

SEQ ID NO: 6372 - protein, 9 aa, Homo Sapiens
YIAHLRQIL

SEQ ID NO: 6373 - protein, 9 aa, Homo Sapiens
YIAPLKALV

SEQ ID NO: 6374 - protein, 9 aa, Homo Sapiens
YIAPMTEKL

SEQ ID NO: 6375 - protein, 9 aa, Homo Sapiens
YIATIHSRL

SEQ ID NO: 6376 - protein, 9 aa, Homo Sapiens
YICDYHKNL

SEQ ID NO: 6377 - protein, 9 aa, Homo Sapiens
YIFAVAHRL

SEQ ID NO: 6378 - protein, 9 aa, Homo Sapiens
YIFDNCHEL

SEQ ID NO: 6379 - protein, 9 aa, Homo Sapiens
YISECLKKL

SEQ ID NO: 6380 - protein, 9 aa, Homo Sapiens
YISNATHML

SEQ ID NO: 6381 - protein, 9 aa, Homo Sapiens
YLADIFTKL

SEQ ID NO: 6382 - protein, 9 aa, Homo Sapiens
YLADLFKHL

SEQ ID NO: 6383 - protein, 9 aa, Homo Sapiens
YLADLYHFV

SEQ ID NO: 6384 - protein, 9 aa, Homo Sapiens
YLAGEAPTL

SEQ ID NO: 6385 - protein, 9 aa, Homo Sapiens
YLAGLHANI

SEQ ID NO: 6386 - protein, 9 aa, Homo Sapiens
YLAGQIARA

SEQ ID NO: 6387 - protein, 9 aa, Homo Sapiens
YLAHFIEGL

SEQ ID NO: 6388 - protein, 9 aa, Homo Sapiens
YLAHLAHHL

SEQ ID NO: 6389 - protein, 9 aa, Homo Sapiens
YLAKVKSLL

SEQ ID NO: 6390 - protein, 9 aa, Homo Sapiens
YLANGQTKV

SEQ ID NO: 6391 - protein, 9 aa, Homo Sapiens
YLAPENGYL

SEQ ID NO: 6392 - protein, 9 aa, Homo Sapiens
YLAPFLRNV

SEQ ID NO: 6393 - protein, 9 aa, Homo Sapiens
YLAPHVRTL

SEQ ID NO: 6394 - protein, 9 aa, Homo Sapiens
YLAPSNQSV

SEQ ID NO: 6395 - protein, 9 aa, Homo Sapiens
YLAQHYDKI

SEQ ID NO: 6396 - protein, 9 aa, Homo Sapiens
YLAQVYQHL

SEQ ID NO: 6397 - protein, 9 aa, Homo Sapiens
YLARFLEGL

SEQ ID NO: 6398 - protein, 9 aa, Homo Sapiens
YLASLEKKL

SEQ ID NO: 6399 - protein, 9 aa, Homo Sapiens
YLASLIRSV

SEQ ID NO: 6400 - protein, 9 aa, Homo Sapiens
YLATLTEKM

SEQ ID NO: 6401 - protein, 9 aa, Homo Sapiens
YLATVRSDL

SEQ ID NO: 6402 - protein, 9 aa, Homo Sapiens
YLCDEQKEL

SEQ ID NO: 6403 - protein, 9 aa, Homo Sapiens
YLCMKTLLL

SEQ ID NO: 6404 - protein, 9 aa, Homo Sapiens
YLCYEVERL

SEQ ID NO: 6405 - protein, 9 aa, Homo Sapiens
YLEDGFAYV

SEQ ID NO: 6406 - protein, 9 aa, Homo Sapiens
YLEDILAKL

SEQ ID NO: 6407 - protein, 9 aa, Homo Sapiens
YLEEAPKFL

SEQ ID NO: 6408 - protein, 9 aa, Homo Sapiens
YLENGKETL

SEQ ID NO: 6409 - protein, 9 aa, Homo Sapiens
YLFCDDHKL

SEQ ID NO: 6410 - protein, 9 aa, Homo Sapiens
YLFERIKEL

SEQ ID NO: 6411 - protein, 9 aa, Homo Sapiens
YLFKCPQSV

SEQ ID NO: 6412 - protein, 9 aa, Homo Sapiens
YLFNSVVNV

SEQ ID NO: 6413 - protein, 9 aa, Homo Sapiens
YLFTIINSL

SEQ ID NO: 6414 - protein, 9 aa, Homo Sapiens
YLFTSPQRV

SEQ ID NO: 6415 - protein, 9 aa, Homo Sapiens
YLGDVSERV

SEQ ID NO: 6416 - protein, 9 aa, Homo Sapiens
YLGEQIQKL

SEQ ID NO: 6417 - protein, 9 aa, Homo Sapiens
YLGHLQQYV

SEQ ID NO: 6418 - protein, 9 aa, Homo Sapiens
YLGNINPQM

SEQ ID NO: 6419 - protein, 9 aa, Homo Sapiens
YLGPHIASV

SEQ ID NO: 6420 - protein, 9 aa, Homo Sapiens
YLGQIQHIL

SEQ ID NO: 6421 - protein, 9 aa, Homo Sapiens
YLGRLAHEV

SEQ ID NO: 6422 - protein, 9 aa, Homo Sapiens
YLGTVAARL

SEQ ID NO: 6423 - protein, 9 aa, Homo Sapiens
YLHDFLKYL

SEQ ID NO: 6424 - protein, 9 aa, Homo Sapiens
YLHEFRDKL

SEQ ID NO: 6425 - protein, 9 aa, Homo Sapiens
YLHHILRQL

SEQ ID NO: 6426 - protein, 9 aa, Homo Sapiens
YLHNQGIGV

SEQ ID NO: 6427 - protein, 9 aa, Homo Sapiens
YLHREVVEL

SEQ ID NO: 6428 - protein, 9 aa, Homo Sapiens
YLHSGQVAL

SEQ ID NO: 6429 - protein, 9 aa, Homo Sapiens
YLHSQVVSV

SEQ ID NO: 6430 - protein, 9 aa, Homo Sapiens
YLHSYLTYI

SEQ ID NO: 6431 - protein, 9 aa, Homo Sapiens
YLHTNVALV

SEQ ID NO: 6432 - protein, 9 aa, Homo Sapiens
YLHTYESEI

SEQ ID NO: 6433 - protein, 9 aa, Homo Sapiens
YLIASIDHL

SEQ ID NO: 6434 - protein, 9 aa, Homo Sapiens
YLICEDYKL

SEQ ID NO: 6435 - protein, 9 aa, Homo Sapiens
YLIKDIRFL

SEQ ID NO: 6436 - protein, 9 aa, Homo Sapiens
YLINEIDRI

SEQ ID NO: 6437 - protein, 9 aa, Homo Sapiens
YLIPFSSKL

SEQ ID NO: 6438 - protein, 9 aa, Homo Sapiens
YLIPLLERL

SEQ ID NO: 6439 - protein, 9 aa, Homo Sapiens
YLIPNIKHL

SEQ ID NO: 6440 - protein, 9 aa, Homo Sapiens
YLITLLEHL

SEQ ID NO: 6441 - protein, 9 aa, Homo Sapiens
YLKDEIEEL

SEQ ID NO: 6442 - protein, 9 aa, Homo Sapiens
YLKDGDVML

SEQ ID NO: 6443 - protein, 9 aa, Homo Sapiens
YLKDIVENL

SEQ ID NO: 6444 - protein, 9 aa, Homo Sapiens
YLKDKLDET

SEQ ID NO: 6445 - protein, 9 aa, Homo Sapiens
YLKDLIEEV

SEQ ID NO: 6446 - protein, 9 aa, Homo Sapiens
YLKEAVTTL

SEQ ID NO: 6447 - protein, 9 aa, Homo Sapiens
YLKEETQLL

SEQ ID NO: 6448 - protein, 9 aa, Homo Sapiens
YLKEILEQL

SEQ ID NO: 6449 - protein, 9 aa, Homo Sapiens
YLKEILQDL

SEQ ID NO: 6450 - protein, 9 aa, Homo Sapiens
YLKLRCDLL

SEQ ID NO: 6451 - protein, 9 aa, Homo Sapiens
YLKSSDNRL

SEQ ID NO: 6452 - protein, 9 aa, Homo Sapiens
YLKVLVDSL

SEQ ID NO: 6453 - protein, 9 aa, Homo Sapiens
YLLDLHSYL

SEQ ID NO: 6454 - protein, 9 aa, Homo Sapiens
YLLESVNKL

SEQ ID NO: 6455 - protein, 9 aa, Homo Sapiens
YLLPAIVHI

SEQ ID NO: 6456 - protein, 9 aa, Homo Sapiens
YLMEVTHDL

SEQ ID NO: 6457 - protein, 9 aa, Homo Sapiens
YLNALVHLI

SEQ ID NO: 6458 - protein, 9 aa, Homo Sapiens
YLNCIVEKV

SEQ ID NO: 6459 - protein, 9 aa, Homo Sapiens
YLNDFTHEI

SEQ ID NO: 6460 - protein, 9 aa, Homo Sapiens
YLNDGLWHM

SEQ ID NO: 6461 - protein, 9 aa, Homo Sapiens
YLNDLHEVL

SEQ ID NO: 6462 - protein, 9 aa, Homo Sapiens
YLNDLIHSV

SEQ ID NO: 6463 - protein, 9 aa, Homo Sapiens
YLNEQGDRV

SEQ ID NO: 6464 - protein, 9 aa, Homo Sapiens
YLNHLIQGL

SEQ ID NO: 6465 - protein, 9 aa, Homo Sapiens
YLNISRNLL

SEQ ID NO: 6466 - protein, 9 aa, Homo Sapiens
YLNKEIEEA

SEQ ID NO: 6467 - protein, 9 aa, Homo Sapiens
YLNKHIQKV

SEQ ID NO: 6468 - protein, 9 aa, Homo Sapiens
YLNNVVEQL

SEQ ID NO: 6469 - protein, 9 aa, Homo Sapiens
YLNPLERKL

SEQ ID NO: 6470 - protein, 9 aa, Homo Sapiens
YLNQHIEHV

SEQ ID NO: 6471 - protein, 9 aa, Homo Sapiens
YLNQHVNRI

SEQ ID NO: 6472 - protein, 9 aa, Homo Sapiens
YLNSILQHA

SEQ ID NO: 6473 - protein, 9 aa, Homo Sapiens
YLNSILQVL

SEQ ID NO: 6474 - protein, 9 aa, Homo Sapiens
YLNVQVKEL

SEQ ID NO: 6475 - protein, 9 aa, Homo Sapiens
YLPDIQERL

SEQ ID NO: 6476 - protein, 9 aa, Homo Sapiens
YLPEVKDLL

SEQ ID NO: 6477 - protein, 9 aa, Homo Sapiens
YLPQLFYHL

SEQ ID NO: 6478 - protein, 9 aa, Homo Sapiens
YLPTHTSLL

SEQ ID NO: 6479 - protein, 9 aa, Homo Sapiens
YLPTLWVKL

SEQ ID NO: 6480 - protein, 9 aa, Homo Sapiens
YLPYPIHQV

SEQ ID NO: 6481 - protein, 9 aa, Homo Sapiens
YLQAHTQSV

SEQ ID NO: 6482 - protein, 9 aa, Homo Sapiens
YLQCKLEQL

SEQ ID NO: 6483 - protein, 9 aa, Homo Sapiens
YLQDTMNHV

SEQ ID NO: 6484 - protein, 9 aa, Homo Sapiens
YLQDYTDRV

SEQ ID NO: 6485 - protein, 9 aa, Homo Sapiens
YLQEHAQEV

SEQ ID NO: 6486 - protein, 9 aa, Homo Sapiens
YLQEIQTQL

SEQ ID NO: 6487 - protein, 9 aa, Homo Sapiens
YLQEKLHAL

SEQ ID NO: 6488 - protein, 9 aa, Homo Sapiens
YLQGLEARL

SEQ ID NO: 6489 - protein, 9 aa, Homo Sapiens
YLQIHPQEL

SEQ ID NO: 6490 - protein, 9 aa, Homo Sapiens
YLQQVNHKL

SEQ ID NO: 6491 - protein, 9 aa, Homo Sapiens
YLQSEPCYV

SEQ ID NO: 6492 - protein, 9 aa, Homo Sapiens
YLQSITPCL

SEQ ID NO: 6493 - protein, 9 aa, Homo Sapiens
YLRKLTELL

SEQ ID NO: 6494 - protein, 9 aa, Homo Sapiens
YLSADHELL

SEQ ID NO: 6495 - protein, 9 aa, Homo Sapiens
YLSAKVEAL

SEQ ID NO: 6496 - protein, 9 aa, Homo Sapiens
YLSDNVHLV

SEQ ID NO: 6497 - protein, 9 aa, Homo Sapiens
YLSDPCPGL

SEQ ID NO: 6498 - protein, 9 aa, Homo Sapiens
YLSDSLRNL

SEQ ID NO: 6499 - protein, 9 aa, Homo Sapiens
YLSDYDNSL

SEQ ID NO: 6500 - protein, 9 aa, Homo Sapiens
YLSEAGASL

SEQ ID NO: 6501 - protein, 9 aa, Homo Sapiens
YLSEAGAYL

SEQ ID NO: 6502 - protein, 9 aa, Homo Sapiens
YLSEEVQAV

SEQ ID NO: 6503 - protein, 9 aa, Homo Sapiens
YLSEKVLAA

SEQ ID NO: 6504 - protein, 9 aa, Homo Sapiens
YLSELSEHV

SEQ ID NO: 6505 - protein, 9 aa, Homo Sapiens
YLSEQQEKL

SEQ ID NO: 6506 - protein, 9 aa, Homo Sapiens
YLSGIAHFL

SEQ ID NO: 6507 - protein, 9 aa, Homo Sapiens
YLSGYGVEL

SEQ ID NO: 6508 - protein, 9 aa, Homo Sapiens
YLSHIATEM

SEQ ID NO: 6509 - protein, 9 aa, Homo Sapiens
YLSKELASL

SEQ ID NO: 6510 - protein, 9 aa, Homo Sapiens
YLSKIIPAL

SEQ ID NO: 6511 - protein, 9 aa, Homo Sapiens
YLSKSLEKL

SEQ ID NO: 6512 - protein, 9 aa, Homo Sapiens
YLSLLNQQL

SEQ ID NO: 6513 - protein, 9 aa, Homo Sapiens
YLSNADERL

SEQ ID NO: 6514 - protein, 9 aa, Homo Sapiens
YLSPDLSKI

SEQ ID NO: 6515 - protein, 9 aa, Homo Sapiens
YLSPDLSKV

SEQ ID NO: 6516 - protein, 9 aa, Homo Sapiens
YLSPKLWAL

SEQ ID NO: 6517 - protein, 9 aa, Homo Sapiens
YLSQQQNMM

SEQ ID NO: 6518 - protein, 9 aa, Homo Sapiens
YLSSIQHLL

SEQ ID NO: 6519 - protein, 9 aa, Homo Sapiens
YLSSKLKQL

SEQ ID NO: 6520 - protein, 9 aa, Homo Sapiens
YLSSLQPRL

SEQ ID NO: 6521 - protein, 9 aa, Homo Sapiens
YLSTQVDRL

SEQ ID NO: 6522 - protein, 9 aa, Homo Sapiens
YLSVKIWDL

SEQ ID NO: 6523 - protein, 9 aa, Homo Sapiens
YLSWKAHRL

SEQ ID NO: 6524 - protein, 9 aa, Homo Sapiens
YLTAATHGL

SEQ ID NO: 6525 - protein, 9 aa, Homo Sapiens
YLTDRVMTV

SEQ ID NO: 6526 - protein, 9 aa, Homo Sapiens
YLTELIDRF

SEQ ID NO: 6527 - protein, 9 aa, Homo Sapiens
YLTHDSPSV

SEQ ID NO: 6528 - protein, 9 aa, Homo Sapiens
YLTPQSNHL

SEQ ID NO: 6529 - protein, 9 aa, Homo Sapiens
YLTRLLQSL

SEQ ID NO: 6530 - protein, 9 aa, Homo Sapiens
YLVDFTQKI

SEQ ID NO: 6531 - protein, 9 aa, Homo Sapiens
YLVEDIQHI

SEQ ID NO: 6532 - protein, 9 aa, Homo Sapiens
YLVKIFEEL

SEQ ID NO: 6533 - protein, 9 aa, Homo Sapiens
YLVKREDYL

SEQ ID NO: 6534 - protein, 9 aa, Homo Sapiens
YLVPELDGV

SEQ ID NO: 6535 - protein, 9 aa, Homo Sapiens
YLVTSIAKA

SEQ ID NO: 6536 - protein, 9 aa, Homo Sapiens
YLVVKIEKV

SEQ ID NO: 6537 - protein, 9 aa, Homo Sapiens
YLVYILNEL

SEQ ID NO: 6538 - protein, 9 aa, Homo Sapiens
YLWSRVEKL

SEQ ID NO: 6539 - protein, 9 aa, Homo Sapiens
YLYCGQEGL

SEQ ID NO: 6540 - protein, 9 aa, Homo Sapiens
YLYDLNHTL

SEQ ID NO: 6541 - protein, 9 aa, Homo Sapiens
YLYPDITRL

SEQ ID NO: 6542 - protein, 9 aa, Homo Sapiens
YLYTKEQLL

SEQ ID NO: 6543 - protein, 9 aa, Homo Sapiens
YLYVDKNFI

SEQ ID NO: 6544 - protein, 9 aa, Homo Sapiens
YMAAYIENA

SEQ ID NO: 6545 - protein, 9 aa, Homo Sapiens
YMAELIERL

SEQ ID NO: 6546 - protein, 9 aa, Homo Sapiens
YMAEREDEL

SEQ ID NO: 6547 - protein, 9 aa, Homo Sapiens
YMAKVIEKL

SEQ ID NO: 6548 - protein, 9 aa, Homo Sapiens
YMAPEVVEA

SEQ ID NO: 6549 - protein, 9 aa, Homo Sapiens
YMEEIYHRI

SEQ ID NO: 6550 - protein, 9 aa, Homo Sapiens
YMFEAREFL

SEQ ID NO: 6551 - protein, 9 aa, Homo Sapiens
YMHFLENQV

SEQ ID NO: 6552 - protein, 9 aa, Homo Sapiens
YMIAHITGL

SEQ ID NO: 6553 - protein, 9 aa, Homo Sapiens
YMLDLQKQL

SEQ ID NO: 6554 - protein, 9 aa, Homo Sapiens
YMLEHVITL

SEQ ID NO: 6555 - protein, 9 aa, Homo Sapiens
YMMPVNSEV

SEQ ID NO: 6556 - protein, 9 aa, Homo Sapiens
YMNAALQAL

SEQ ID NO: 6557 - protein, 9 aa, Homo Sapiens
YMNHIMVSV

SEQ ID NO: 6558 - protein, 9 aa, Homo Sapiens
YMNNDLIGL

SEQ ID NO: 6559 - protein, 9 aa, Homo Sapiens
YMNSVIQQL

SEQ ID NO: 6560 - protein, 9 aa, Homo Sapiens
YMRDKLDTL

SEQ ID NO: 6561 - protein, 9 aa, Homo Sapiens
YMSDSFINV

SEQ ID NO: 6562 - protein, 9 aa, Homo Sapiens
YMYEKESEL

SEQ ID NO: 6563 - protein, 9 aa, Homo Sapiens
YQAEIPDRL

SEQ ID NO: 6564 - protein, 9 aa, Homo Sapiens
YQFSKNFSL

SEQ ID NO: 6565 - protein, 9 aa, Homo Sapiens
YQNQEIHNL

SEQ ID NO: 6566 - protein, 9 aa, Homo Sapiens
YSAPCTYEL

SEQ ID NO: 6567 - protein, 9 aa, Homo Sapiens
YTAEIKQNL

SEQ ID NO: 6568 - protein, 9 aa, Homo Sapiens
YTCERNDQL

SEQ ID NO: 6569 - protein, 9 aa, Homo Sapiens
YTMEELHQL

SEQ ID NO: 6570 - protein, 9 aa, Homo Sapiens
YTNEKLQQL

SEQ ID NO: 6571 - protein, 9 aa, Homo Sapiens
YTSDLHFQV

SEQ ID NO: 6572 - protein, 9 aa, Homo Sapiens
YTSEVQAIL

SEQ ID NO: 6573 - protein, 9 aa, Homo Sapiens
YVAELIQQL

SEQ ID NO: 6574 - protein, 9 aa, Homo Sapiens
YVAEREDEL

SEQ ID NO: 6575 - protein, 9 aa, Homo Sapiens
YVAPHLNNL

SEQ ID NO: 6576 - protein, 9 aa, Homo Sapiens
YVASNQHEV

SEQ ID NO: 6577 - protein, 9 aa, Homo Sapiens
YVFPGVTRL

SEQ ID NO: 6578 - protein, 9 aa, Homo Sapiens
YVKDRVEKV

SEQ ID NO: 6579 - protein, 9 aa, Homo Sapiens
YVSEILEKV

SEQ ID NO: 6580 - protein, 9 aa, Homo Sapiens
YVSKYINYI

SEQ ID NO: 6581 - protein, 9 aa, Homo Sapiens
YVVPFVAKV

SEQ ID NO: 6582 - protein, 9 aa, Homo Sapiens
YVYSGVETL

SEQ ID NO: 6583 - protein, 10 aa, Homo Sapiens
AAFEFDIHQV

SEQ ID NO: 6584 - protein, 10 aa, Homo Sapiens
AIFDRVLTEL

SEQ ID NO: 6585 - protein, 10 aa, Homo Sapiens
AIIDGKIFCV

SEQ ID NO: 6586 - protein, 10 aa, Homo Sapiens
ALADGVTMQV

SEQ ID NO: 6587 - protein, 10 aa, Homo Sapiens
ALADGVVSQA

SEQ ID NO: 6588 - protein, 10 aa, Homo Sapiens
ALADIAQSQL

SEQ ID NO: 6589 - protein, 10 aa, Homo Sapiens
ALADVAYYTM

SEQ ID NO: 6590 - protein, 10 aa, Homo Sapiens
ALAEASGDFI

SEQ ID NO: 6591 - protein, 10 aa, Homo Sapiens
ALAEFLQRKL

SEQ ID NO: 6592 - protein, 10 aa, Homo Sapiens
ALAEIAKAEL

SEQ ID NO: 6593 - protein, 10 aa, Homo Sapiens
ALAGFQQRAL

SEQ ID NO: 6594 - protein, 10 aa, Homo Sapiens
ALAKAIEKNV

SEQ ID NO: 6595 - protein, 10 aa, Homo Sapiens
ALAPMEAAKV

SEQ ID NO: 6596 - protein, 10 aa, Homo Sapiens
ALARFRQAQL

SEQ ID NO: 6597 - protein, 10 aa, Homo Sapiens
ALASGKIAAA

SEQ ID NO: 6598 - protein, 10 aa, Homo Sapiens
ALAYIMDNKL

SEQ ID NO: 6599 - protein, 10 aa, Homo Sapiens
ALCDIKQAYT

SEQ ID NO: 6600 - protein, 10 aa, Homo Sapiens
ALCEENMRGV

SEQ ID NO: 6601 - protein, 10 aa, Homo Sapiens
ALEGSTQPLL

SEQ ID NO: 6602 - protein, 10 aa, Homo Sapiens
ALFMYKPKKV

SEQ ID NO: 6603 - protein, 10 aa, Homo Sapiens
ALFPAPLAQI

SEQ ID NO: 6604 - protein, 10 aa, Homo Sapiens
ALFPELPKSA

SEQ ID NO: 6605 - protein, 10 aa, Homo Sapiens
ALFPGCERGL

SEQ ID NO: 6606 - protein, 10 aa, Homo Sapiens
ALFPGDVDRL

SEQ ID NO: 6607 - protein, 10 aa, Homo Sapiens
ALFPKDVDRL

SEQ ID NO: 6608 - protein, 10 aa, Homo Sapiens
ALFQPHLINV

SEQ ID NO: 6609 - protein, 10 aa, Homo Sapiens
ALFQRPPLIA

SEQ ID NO: 6610 - protein, 10 aa, Homo Sapiens
ALFRDKVVAL

SEQ ID NO: 6611 - protein, 10 aa, Homo Sapiens
ALFSDTPANA

SEQ ID NO: 6612 - protein, 10 aa, Homo Sapiens
ALFSEKSVGL

SEQ ID NO: 6613 - protein, 10 aa, Homo Sapiens
ALIDEQILCV

SEQ ID NO: 6614 - protein, 10 aa, Homo Sapiens
ALIERGTAKL

SEQ ID NO: 6615 - protein, 10 aa, Homo Sapiens
ALKSGKLVTA

SEQ ID NO: 6616 - protein, 10 aa, Homo Sapiens
ALLEDSCHYL

SEQ ID NO: 6617 - protein, 10 aa, Homo Sapiens
ALMAGCIQEA

SEQ ID NO: 6618 - protein, 10 aa, Homo Sapiens
ALMAHAMEEV

SEQ ID NO: 6619 - protein, 10 aa, Homo Sapiens
ALNPNEIQRA

SEQ ID NO: 6620 - protein, 10 aa, Homo Sapiens
ALPDIKVLTL

SEQ ID NO: 6621 - protein, 10 aa, Homo Sapiens
ALQEACEAYL

SEQ ID NO: 6622 - protein, 10 aa, Homo Sapiens
ALQEASEAYL

SEQ ID NO: 6623 - protein, 10 aa, Homo Sapiens
ALSDLALHFL

SEQ ID NO: 6624 - protein, 10 aa, Homo Sapiens
ALSELSDLHA

SEQ ID NO: 6625 - protein, 10 aa, Homo Sapiens
ALSGLDMVGV

SEQ ID NO: 6626 - protein, 10 aa, Homo Sapiens
ALSGVTSHGL

SEQ ID NO: 6627 - protein, 10 aa, Homo Sapiens
ALSPVPSHWM

SEQ ID NO: 6628 - protein, 10 aa, Homo Sapiens
ALSQAREHQL

SEQ ID NO: 6629 - protein, 10 aa, Homo Sapiens
ALSSDKIAAL

SEQ ID NO: 6630 - protein, 10 aa, Homo Sapiens
ALVDGPCTQV

SEQ ID NO: 6631 - protein, 10 aa, Homo Sapiens
ALYDHLMDFL

SEQ ID NO: 6632 - protein, 10 aa, Homo Sapiens
ALYEKDNTYL

SEQ ID NO: 6633 - protein, 10 aa, Homo Sapiens
ALYHFSSSEL

SEQ ID NO: 6634 - protein, 10 aa, Homo Sapiens
ALYNKEMECL

SEQ ID NO: 6635 - protein, 10 aa, Homo Sapiens
ALYPGQLVQL

SEQ ID NO: 6636 - protein, 10 aa, Homo Sapiens
ALYPMAQCHL

SEQ ID NO: 6637 - protein, 10 aa, Homo Sapiens
ALYQKLITSA

SEQ ID NO: 6638 - protein, 10 aa, Homo Sapiens
AMFDHIPVGV

SEQ ID NO: 6639 - protein, 10 aa, Homo Sapiens
AMFEPDMQEA

SEQ ID NO: 6640 - protein, 10 aa, Homo Sapiens
AMFPDTIPRV

SEQ ID NO: 6641 - protein, 10 aa, Homo Sapiens
AMIAVVPGYI

SEQ ID NO: 6642 - protein, 10 aa, Homo Sapiens
AMYPDQVQLL

SEQ ID NO: 6643 - protein, 10 aa, Homo Sapiens
AQAEIEQYRL

SEQ ID NO: 6644 - protein, 10 aa, Homo Sapiens
AQYEEIANRS

SEQ ID NO: 6645 - protein, 10 aa, Homo Sapiens
AQYEHDLEVA

SEQ ID NO: 6646 - protein, 10 aa, Homo Sapiens
AVFDKTLAEL

SEQ ID NO: 6647 - protein, 10 aa, Homo Sapiens
AVGADAAYVF

SEQ ID NO: 6648 - protein, 10 aa, Homo Sapiens
AVYEGHVSCV

SEQ ID NO: 6649 - protein, 10 aa, Homo Sapiens
ELADIKQAYL

SEQ ID NO: 6650 - protein, 10 aa, Homo Sapiens
FAYDGKDYLT

SEQ ID NO: 6651 - protein, 10 aa, Homo Sapiens
FAYPNRPDVL

SEQ ID NO: 6652 - protein, 10 aa, Homo Sapiens
FGYPFRLNEA

SEQ ID NO: 6653 - protein, 10 aa, Homo Sapiens
FICDYELHEL

SEQ ID NO: 6654 - protein, 10 aa, Homo Sapiens
FIFEKKLAQA

SEQ ID NO: 6655 - protein, 10 aa, Homo Sapiens
FIFSEKPVFV

SEQ ID NO: 6656 - protein, 10 aa, Homo Sapiens
FIYHGEVPQA

SEQ ID NO: 6657 - protein, 10 aa, Homo Sapiens
FLAEDALNTV

SEQ ID NO: 6658 - protein, 10 aa, Homo Sapiens
FLAEDPKVTL

SEQ ID NO: 6659 - protein, 10 aa, Homo Sapiens
FLAEEGFYKF

SEQ ID NO: 6660 - protein, 10 aa, Homo Sapiens
FLAEEKHLHV

SEQ ID NO: 6661 - protein, 10 aa, Homo Sapiens
FLAEHDYGLF

SEQ ID NO: 6662 - protein, 10 aa, Homo Sapiens
FLAEHPNVTL

SEQ ID NO: 6663 - protein, 10 aa, Homo Sapiens
FLAERLYAEV

SEQ ID NO: 6664 - protein, 10 aa, Homo Sapiens
FLAPISSSKL

SEQ ID NO: 6665 - protein, 10 aa, Homo Sapiens
FLARHSNVNL

SEQ ID NO: 6666 - protein, 10 aa, Homo Sapiens
FLASDLDQKM

SEQ ID NO: 6667 - protein, 10 aa, Homo Sapiens
FLASVVDPRV

SEQ ID NO: 6668 - protein, 10 aa, Homo Sapiens
FLCNEAKNLL

SEQ ID NO: 6669 - protein, 10 aa, Homo Sapiens
FLFDEEMEQM

SEQ ID NO: 6670 - protein, 10 aa, Homo Sapiens
FLFDGSPTYV

SEQ ID NO: 6671 - protein, 10 aa, Homo Sapiens
FLFGEEPSKL

SEQ ID NO: 6672 - protein, 10 aa, Homo Sapiens
FLFNLPDQKA

SEQ ID NO: 6673 - protein, 10 aa, Homo Sapiens
FLFNTENKLL

SEQ ID NO: 6674 - protein, 10 aa, Homo Sapiens
FLFPNKESLI

SEQ ID NO: 6675 - protein, 10 aa, Homo Sapiens
FLGENISNFL

SEQ ID NO: 6676 - protein, 10 aa, Homo Sapiens
FLHDHVDLQV

SEQ ID NO: 6677 - protein, 10 aa, Homo Sapiens
FLHETGGAMV

SEQ ID NO: 6678 - protein, 10 aa, Homo Sapiens
FLHWYTGEGM

SEQ ID NO: 6679 - protein, 10 aa, Homo Sapiens
FLIDKNGCVV

SEQ ID NO: 6680 - protein, 10 aa, Homo Sapiens
FLIEEQKIVV

SEQ ID NO: 6681 - protein, 10 aa, Homo Sapiens
FLIEGTISRA

SEQ ID NO: 6682 - protein, 10 aa, Homo Sapiens
FLIGPKLYEA

SEQ ID NO: 6683 - protein, 10 aa, Homo Sapiens
FLIPFETRQL

SEQ ID NO: 6684 - protein, 10 aa, Homo Sapiens
FLKNEKGQYI

SEQ ID NO: 6685 - protein, 10 aa, Homo Sapiens
FLKPDDIQYF

SEQ ID NO: 6686 - protein, 10 aa, Homo Sapiens
FLKQGEDHCL

SEQ ID NO: 6687 - protein, 10 aa, Homo Sapiens
FLLPIKTVGV

SEQ ID NO: 6688 - protein, 10 aa, Homo Sapiens
FLNPDEVHAI

SEQ ID NO: 6689 - protein, 10 aa, Homo Sapiens
FLPEFAGTQL

SEQ ID NO: 6690 - protein, 10 aa, Homo Sapiens
FLPSHSLDTV

SEQ ID NO: 6691 - protein, 10 aa, Homo Sapiens
FLQEEPGQLL

SEQ ID NO: 6692 - protein, 10 aa, Homo Sapiens
FLQEGDLISA

SEQ ID NO: 6693 - protein, 10 aa, Homo Sapiens
FLQENTHVRL

SEQ ID NO: 6694 - protein, 10 aa, Homo Sapiens
FLQPGGYHVL

SEQ ID NO: 6695 - protein, 10 aa, Homo Sapiens
FLSDAEIIQL

SEQ ID NO: 6696 - protein, 10 aa, Homo Sapiens
FLSDIPSSQI

SEQ ID NO: 6697 - protein, 10 aa, Homo Sapiens
FLSEHPNVTL

SEQ ID NO: 6698 - protein, 10 aa, Homo Sapiens
FLSEVSENKL

SEQ ID NO: 6699 - protein, 10 aa, Homo Sapiens
FLSPKVDPSL

SEQ ID NO: 6700 - protein, 10 aa, Homo Sapiens
FLSQEHQQQV

SEQ ID NO: 6701 - protein, 10 aa, Homo Sapiens
FLSQIESDCL

SEQ ID NO: 6702 - protein, 10 aa, Homo Sapiens
FLSQIESDRL

SEQ ID NO: 6703 - protein, 10 aa, Homo Sapiens
FLSTLHEVYL

SEQ ID NO: 6704 - protein, 10 aa, Homo Sapiens
FLSYCPGMGV

SEQ ID NO: 6705 - protein, 10 aa, Homo Sapiens
FLWPDEDSRL

SEQ ID NO: 6706 - protein, 10 aa, Homo Sapiens
FLWVGATPHL

SEQ ID NO: 6707 - protein, 10 aa, Homo Sapiens
FLYAAQPELL

SEQ ID NO: 6708 - protein, 10 aa, Homo Sapiens
FLYEKLDRKV

SEQ ID NO: 6709 - protein, 10 aa, Homo Sapiens
FLYGSNAAFL

SEQ ID NO: 6710 - protein, 10 aa, Homo Sapiens
FLYKEKLVSV

SEQ ID NO: 6711 - protein, 10 aa, Homo Sapiens
FLYNHGIGTL

SEQ ID NO: 6712 - protein, 10 aa, Homo Sapiens
FLYPGKNGRL

SEQ ID NO: 6713 - protein, 10 aa, Homo Sapiens
FLYQQQGRLD

SEQ ID NO: 6714 - protein, 10 aa, Homo Sapiens
FLYTGEGDTV

SEQ ID NO: 6715 - protein, 10 aa, Homo Sapiens
FMAEHLEETL

SEQ ID NO: 6716 - protein, 10 aa, Homo Sapiens
FMAPIDHTTM

SEQ ID NO: 6717 - protein, 10 aa, Homo Sapiens
FMFDEKLVTV

SEQ ID NO: 6718 - protein, 10 aa, Homo Sapiens
FMFEGHDTTA

SEQ ID NO: 6719 - protein, 10 aa, Homo Sapiens
FMIDRDNSVF

SEQ ID NO: 6720 - protein, 10 aa, Homo Sapiens
FMKPGKVVLV

SEQ ID NO: 6721 - protein, 10 aa, Homo Sapiens
FQYESKVFYL

SEQ ID NO: 6722 - protein, 10 aa, Homo Sapiens
FQYPCYQEGL

SEQ ID NO: 6723 - protein, 10 aa, Homo Sapiens
FTFEGKLEAA

SEQ ID NO: 6724 - protein, 10 aa, Homo Sapiens
FVFDRPLPVS

SEQ ID NO: 6725 - protein, 10 aa, Homo Sapiens
FVYGGPQVQL

SEQ ID NO: 6726 - protein, 10 aa, Homo Sapiens
GIFGGHIRSV

SEQ ID NO: 6727 - protein, 10 aa, Homo Sapiens
GISDLAQHYL

SEQ ID NO: 6728 - protein, 10 aa, Homo Sapiens
GLAAGRTFLL

SEQ ID NO: 6729 - protein, 10 aa, Homo Sapiens
GLAGVKIAEV

SEQ ID NO: 6730 - protein, 10 aa, Homo Sapiens
GLAKRPGALL

SEQ ID NO: 6731 - protein, 10 aa, Homo Sapiens
GLAPLGEYRL

SEQ ID NO: 6732 - protein, 10 aa, Homo Sapiens
GLFGETLRAA

SEQ ID NO: 6733 - protein, 10 aa, Homo Sapiens
GLFGKELHKV

SEQ ID NO: 6734 - protein, 10 aa, Homo Sapiens
GLFPGGRHEL

SEQ ID NO: 6735 - protein, 10 aa, Homo Sapiens
GLFSNDIPHV

SEQ ID NO: 6736 - protein, 10 aa, Homo Sapiens
GLFTGLTPRL

SEQ ID NO: 6737 - protein, 10 aa, Homo Sapiens
GLIDDLQHCL

SEQ ID NO: 6738 - protein, 10 aa, Homo Sapiens
GLIDVKPLGV

SEQ ID NO: 6739 - protein, 10 aa, Homo Sapiens
GLIGVGLINV

SEQ ID NO: 6740 - protein, 10 aa, Homo Sapiens
GLKPGQDANL

SEQ ID NO: 6741 - protein, 10 aa, Homo Sapiens
GLSDHIQEEL

SEQ ID NO: 6742 - protein, 10 aa, Homo Sapiens
GLSDTATYKV

SEQ ID NO: 6743 - protein, 10 aa, Homo Sapiens
GLSKIVEHQV

SEQ ID NO: 6744 - protein, 10 aa, Homo Sapiens
GLSSLRDLNV

SEQ ID NO: 6745 - protein, 10 aa, Homo Sapiens
GLVAFEPHAL

SEQ ID NO: 6746 - protein, 10 aa, Homo Sapiens
GLWRGEEVTL

SEQ ID NO: 6747 - protein, 10 aa, Homo Sapiens
GLYDGPVCEV

SEQ ID NO: 6748 - protein, 10 aa, Homo Sapiens
GLYDKTCQFL

SEQ ID NO: 6749 - protein, 10 aa, Homo Sapiens
GLYEFPLNKV

SEQ ID NO: 6750 - protein, 10 aa, Homo Sapiens
GLYHFRDQIL

SEQ ID NO: 6751 - protein, 10 aa, Homo Sapiens
GLYPFRVNSA

SEQ ID NO: 6752 - protein, 10 aa, Homo Sapiens
GLYSDRISEL

SEQ ID NO: 6753 - protein, 10 aa, Homo Sapiens
GLYTGEVTEI

SEQ ID NO: 6754 - protein, 10 aa, Homo Sapiens
GMADICKNYI

SEQ ID NO: 6755 - protein, 10 aa, Homo Sapiens
GMAEFLDKHV

SEQ ID NO: 6756 - protein, 10 aa, Homo Sapiens
GMFKNLLKEV

SEQ ID NO: 6757 - protein, 10 aa, Homo Sapiens
GMYELKPECA

SEQ ID NO: 6758 - protein, 10 aa, Homo Sapiens
GMYYGRDVNV

SEQ ID NO: 6759 - protein, 10 aa, Homo Sapiens
GQFPSYLETV

SEQ ID NO: 6760 - protein, 10 aa, Homo Sapiens
GQYEGHEAEL

SEQ ID NO: 6761 - protein, 10 aa, Homo Sapiens
GVYGGSVHEA

SEQ ID NO: 6762 - protein, 10 aa, Homo Sapiens
HKDYIFLLLI

SEQ ID NO: 6763 - protein, 10 aa, Homo Sapiens
HLADLADFAL

SEQ ID NO: 6764 - protein, 10 aa, Homo Sapiens
HLAPFTDEQL

SEQ ID NO: 6765 - protein, 10 aa, Homo Sapiens
HLFDHVVNRV

SEQ ID NO: 6766 - protein, 10 aa, Homo Sapiens
HLFPGENCTL

SEQ ID NO: 6767 - protein, 10 aa, Homo Sapiens
HLFSGHLSTL

SEQ ID NO: 6768 - protein, 10 aa, Homo Sapiens
HLKEDQTEYL

SEQ ID NO: 6769 - protein, 10 aa, Homo Sapiens
HLNPNGHHFL

SEQ ID NO: 6770 - protein, 10 aa, Homo Sapiens
IGASVDPAGV

SEQ ID NO: 6771 - protein, 10 aa, Homo Sapiens
ILADCKASEV

SEQ ID NO: 6772 - protein, 10 aa, Homo Sapiens
ILADEQDVHM

SEQ ID NO: 6773 - protein, 10 aa, Homo Sapiens
ILADHPDAPM

SEQ ID NO: 6774 - protein, 10 aa, Homo Sapiens
ILAPCKLETV

SEQ ID NO: 6775 - protein, 10 aa, Homo Sapiens
ILAQVASEHL

SEQ ID NO: 6776 - protein, 10 aa, Homo Sapiens
ILCEALQHNL

SEQ ID NO: 6777 - protein, 10 aa, Homo Sapiens
ILDEIEEHNI

SEQ ID NO: 6778 - protein, 10 aa, Homo Sapiens
ILEEGKEILV

SEQ ID NO: 6779 - protein, 10 aa, Homo Sapiens
ILFNKKENAL

SEQ ID NO: 6780 - protein, 10 aa, Homo Sapiens
ILFPDIIARA

SEQ ID NO: 6781 - protein, 10 aa, Homo Sapiens
ILFSEGLIKA

SEQ ID NO: 6782 - protein, 10 aa, Homo Sapiens
ILIDENDNKI

SEQ ID NO: 6783 - protein, 10 aa, Homo Sapiens
ILKDVIPPLE

SEQ ID NO: 6784 - protein, 10 aa, Homo Sapiens
ILSDRQQHAL

SEQ ID NO: 6785 - protein, 10 aa, Homo Sapiens
ILSHINTVFV

SEQ ID NO: 6786 - protein, 10 aa, Homo Sapiens
ILSTIDRELL

SEQ ID NO: 6787 - protein, 10 aa, Homo Sapiens
ILYDKDHYKL

SEQ ID NO: 6788 - protein, 10 aa, Homo Sapiens
ILYPAAIVTI

SEQ ID NO: 6789 - protein, 10 aa, Homo Sapiens
IMAEGKQHAL

SEQ ID NO: 6790 - protein, 10 aa, Homo Sapiens
IMNEAKDFYL

SEQ ID NO: 6791 - protein, 10 aa, Homo Sapiens
IMWGYKDPLV

SEQ ID NO: 6792 - protein, 10 aa, Homo Sapiens
IVFNGPHLLL

SEQ ID NO: 6793 - protein, 10 aa, Homo Sapiens
KDKGAICTKL

SEQ ID NO: 6794 - protein, 10 aa, Homo Sapiens
KIADFGLARI

SEQ ID NO: 6795 - protein, 10 aa, Homo Sapiens
KIADFGLARV

SEQ ID NO: 6796 - protein, 10 aa, Homo Sapiens
KIFDEILVNA

SEQ ID NO: 6797 - protein, 10 aa, Homo Sapiens
KLADFGLARA

SEQ ID NO: 6798 - protein, 10 aa, Homo Sapiens
KLADIQIEQL

SEQ ID NO: 6799 - protein, 10 aa, Homo Sapiens
KLADISINYV

SEQ ID NO: 6800 - protein, 10 aa, Homo Sapiens
KLAEAERVGL

SEQ ID NO: 6801 - protein, 10 aa, Homo Sapiens
KLAEGAGIQL

SEQ ID NO: 6802 - protein, 10 aa, Homo Sapiens
KLAELKQECL

SEQ ID NO: 6803 - protein, 10 aa, Homo Sapiens
KLAENIDAQL

SEQ ID NO: 6804 - protein, 10 aa, Homo Sapiens
KLAGLEGAKL

SEQ ID NO: 6805 - protein, 10 aa, Homo Sapiens
KLAPNQTKEL

SEQ ID NO: 6806 - protein, 10 aa, Homo Sapiens
KLCEGFNEVL

SEQ ID NO: 6807 - protein, 10 aa, Homo Sapiens
KLFADAVQEL

SEQ ID NO: 6808 - protein, 10 aa, Homo Sapiens
KLFDDKLQNC

SEQ ID NO: 6809 - protein, 10 aa, Homo Sapiens
KLFEGENEHL

SEQ ID NO: 6810 - protein, 10 aa, Homo Sapiens
KLFEPYVVHV

SEQ ID NO: 6811 - protein, 10 aa, Homo Sapiens
KLFNEHIEAL

SEQ ID NO: 6812 - protein, 10 aa, Homo Sapiens
KLFNGTFLKA

SEQ ID NO: 6813 - protein, 10 aa, Homo Sapiens
KLFPDTPLAL

SEQ ID NO: 6814 - protein, 10 aa, Homo Sapiens
KLFPQETLFL

SEQ ID NO: 6815 - protein, 10 aa, Homo Sapiens
KLFPWAQIRL

SEQ ID NO: 6816 - protein, 10 aa, Homo Sapiens
KLFPYIQKGL

SEQ ID NO: 6817 - protein, 10 aa, Homo Sapiens
KLFQLPTPPL

SEQ ID NO: 6818 - protein, 10 aa, Homo Sapiens
KLFQSKLIKA

SEQ ID NO: 6819 - protein, 10 aa, Homo Sapiens
KLFSEGLFSA

SEQ ID NO: 6820 - protein, 10 aa, Homo Sapiens
KLFSKCILGA

SEQ ID NO: 6821 - protein, 10 aa, Homo Sapiens
KLFTDGDAAL

SEQ ID NO: 6822 - protein, 10 aa, Homo Sapiens
KLFTNDCIFL

SEQ ID NO: 6823 - protein, 10 aa, Homo Sapiens
KLFVGFLNRA

SEQ ID NO: 6824 - protein, 10 aa, Homo Sapiens
KLFVGLEHAV

SEQ ID NO: 6825 - protein, 10 aa, Homo Sapiens
KLHDVELHQV

SEQ ID NO: 6826 - protein, 10 aa, Homo Sapiens
KLIDGQVIQL

SEQ ID NO: 6827 - protein, 10 aa, Homo Sapiens
KLKPGDLVGV

SEQ ID NO: 6828 - protein, 10 aa, Homo Sapiens
KLMDLDVEQL

SEQ ID NO: 6829 - protein, 10 aa, Homo Sapiens
KLMDLRNEYL

SEQ ID NO: 6830 - protein, 10 aa, Homo Sapiens
KLMKEDGTTL

SEQ ID NO: 6831 - protein, 10 aa, Homo Sapiens
KLNPAANHRL

SEQ ID NO: 6832 - protein, 10 aa, Homo Sapiens
KLPDFLTAKL

SEQ ID NO: 6833 - protein, 10 aa, Homo Sapiens
KLQDAEIARL

SEQ ID NO: 6834 - protein, 10 aa, Homo Sapiens
KLSDISGQEM

SEQ ID NO: 6835 - protein, 10 aa, Homo Sapiens
KLSDLLKYYL

SEQ ID NO: 6836 - protein, 10 aa, Homo Sapiens
KLSDLQSVNV

SEQ ID NO: 6837 - protein, 10 aa, Homo Sapiens
KLTEMRGIYA

SEQ ID NO: 6838 - protein, 10 aa, Homo Sapiens
KLYDIDVAKV

SEQ ID NO: 6839 - protein, 10 aa, Homo Sapiens
KLYEGKTKEV

SEQ ID NO: 6840 - protein, 10 aa, Homo Sapiens
KLYEKKLLKL

SEQ ID NO: 6841 - protein, 10 aa, Homo Sapiens
KLYQYYLDHL

SEQ ID NO: 6842 - protein, 10 aa, Homo Sapiens
KLYTGKPNLV

SEQ ID NO: 6843 - protein, 10 aa, Homo Sapiens
KLYTGLEYDL

SEQ ID NO: 6844 - protein, 10 aa, Homo Sapiens
KMADIEYRLS

SEQ ID NO: 6845 - protein, 10 aa, Homo Sapiens
KMADIGGHAI

SEQ ID NO: 6846 - protein, 10 aa, Homo Sapiens
KMAEFLDWSL

SEQ ID NO: 6847 - protein, 10 aa, Homo Sapiens
KMFAEEEAEL

SEQ ID NO: 6848 - protein, 10 aa, Homo Sapiens
KMFESFIESV

SEQ ID NO: 6849 - protein, 10 aa, Homo Sapiens
KMFGAKDSEL

SEQ ID NO: 6850 - protein, 10 aa, Homo Sapiens
KMFLGDNAHL

SEQ ID NO: 6851 - protein, 10 aa, Homo Sapiens
KMFNQDIEKL

SEQ ID NO: 6852 - protein, 10 aa, Homo Sapiens
KMPDFGQVTV

SEQ ID NO: 6853 - protein, 10 aa, Homo Sapiens
KMYEEFLSKV

SEQ ID NO: 6854 - protein, 10 aa, Homo Sapiens
KMYGYVDTLL

SEQ ID NO: 6855 - protein, 10 aa, Homo Sapiens
KMYNKEVQTV

SEQ ID NO: 6856 - protein, 10 aa, Homo Sapiens
KQAEINENNV

SEQ ID NO: 6857 - protein, 10 aa, Homo Sapiens
KQFEGSTSFV

SEQ ID NO: 6858 - protein, 10 aa, Homo Sapiens
KQFPLIISSV

SEQ ID NO: 6859 - protein, 10 aa, Homo Sapiens
KVFELDLVTL

SEQ ID NO: 6860 - protein, 10 aa, Homo Sapiens
KVFQGTDEQL

SEQ ID NO: 6861 - protein, 10 aa, Homo Sapiens
KVFSGALQEA

SEQ ID NO: 6862 - protein, 10 aa, Homo Sapiens
LAIREACIKL

SEQ ID NO: 6863 - protein, 10 aa, Homo Sapiens
LEAQARVHQL

SEQ ID NO: 6864 - protein, 10 aa, Homo Sapiens
LFDKATYDKL

SEQ ID NO: 6865 - protein, 10 aa, Homo Sapiens
LFLHAGIVLP

SEQ ID NO: 6866 - protein, 10 aa, Homo Sapiens
LIAEENALRG

SEQ ID NO: 6867 - protein, 10 aa, Homo Sapiens
LLADCNDHQM

SEQ ID NO: 6868 - protein, 10 aa, Homo Sapiens
LLAEDDELHL

SEQ ID NO: 6869 - protein, 10 aa, Homo Sapiens
LLAEIGAVTL

SEQ ID NO: 6870 - protein, 10 aa, Homo Sapiens
LLAELREYNL

SEQ ID NO: 6871 - protein, 10 aa, Homo Sapiens
LLAWFPLQEA

SEQ ID NO: 6872 - protein, 10 aa, Homo Sapiens
LLFDDIDHNM

SEQ ID NO: 6873 - protein, 10 aa, Homo Sapiens
LLFEGEKITI

SEQ ID NO: 6874 - protein, 10 aa, Homo Sapiens
LLFGKIGYYL

SEQ ID NO: 6875 - protein, 10 aa, Homo Sapiens
LLFPHPVNQV

SEQ ID NO: 6876 - protein, 10 aa, Homo Sapiens
LLFPSDVQTL

SEQ ID NO: 6877 - protein, 10 aa, Homo Sapiens
LLHAGGLARA

SEQ ID NO: 6878 - protein, 10 aa, Homo Sapiens
LLNPAYDVYL

SEQ ID NO: 6879 - protein, 10 aa, Homo Sapiens
LLPDQPPYHL

SEQ ID NO: 6880 - protein, 10 aa, Homo Sapiens
LLSAAEPVPA

SEQ ID NO: 6881 - protein, 10 aa, Homo Sapiens
LLSEHGEVKL

SEQ ID NO: 6882 - protein, 10 aa, Homo Sapiens
LLSEQGDVKL

SEQ ID NO: 6883 - protein, 10 aa, Homo Sapiens
LLSHSLLVTL

SEQ ID NO: 6884 - protein, 10 aa, Homo Sapiens
LLYDDKGVGL

SEQ ID NO: 6885 - protein, 10 aa, Homo Sapiens
LLYEDIPDKV

SEQ ID NO: 6886 - protein, 10 aa, Homo Sapiens
LLYGGDLHSA

SEQ ID NO: 6887 - protein, 10 aa, Homo Sapiens
LLYPCIDSHL

SEQ ID NO: 6888 - protein, 10 aa, Homo Sapiens
LLYQGPHNTL

SEQ ID NO: 6889 - protein, 10 aa, Homo Sapiens
LMPYFLLTQA

SEQ ID NO: 6890 - protein, 10 aa, Homo Sapiens
LTFRDPLALL

SEQ ID NO: 6891 - protein, 10 aa, Homo Sapiens
LTGQRVLDAL

SEQ ID NO: 6892 - protein, 10 aa, Homo Sapiens
LVYEGQLSQA

SEQ ID NO: 6893 - protein, 10 aa, Homo Sapiens
MLFSGQGSLL

SEQ ID NO: 6894 - protein, 10 aa, Homo Sapiens
MMFGGKQVVV

SEQ ID NO: 6895 - protein, 10 aa, Homo Sapiens
NDMRQEYEQL

SEQ ID NO: 6896 - protein, 10 aa, Homo Sapiens
NIAEGLRALL

SEQ ID NO: 6897 - protein, 10 aa, Homo Sapiens
NIKNIPIPTL

SEQ ID NO: 6898 - protein, 10 aa, Homo Sapiens
NLFDLGGQYL

SEQ ID NO: 6899 - protein, 10 aa, Homo Sapiens
NLFPSNLVVA

SEQ ID NO: 6900 - protein, 10 aa, Homo Sapiens
NLYSKMLAKV

SEQ ID NO: 6901 - protein, 10 aa, Homo Sapiens
NNMRSQYEQL

SEQ ID NO: 6902 - protein, 10 aa, Homo Sapiens
QLFDNDRTQL

SEQ ID NO: 6903 - protein, 10 aa, Homo Sapiens
QLFQDEVAKA

SEQ ID NO: 6904 - protein, 10 aa, Homo Sapiens
QLIGIQDGYL

SEQ ID NO: 6905 - protein, 10 aa, Homo Sapiens
QLSNGEPHFL

SEQ ID NO: 6906 - protein, 10 aa, Homo Sapiens
QLYPENSEQL

SEQ ID NO: 6907 - protein, 10 aa, Homo Sapiens
QLYRGLGGQL

SEQ ID NO: 6908 - protein, 10 aa, Homo Sapiens
QVFPGLLERV

SEQ ID NO: 6909 - protein, 10 aa, Homo Sapiens
RAILPHAGLL

SEQ ID NO: 6910 - protein, 10 aa, Homo Sapiens
RIFGKKQMRI

SEQ ID NO: 6911 - protein, 10 aa, Homo Sapiens
RLANKIEHEL

SEQ ID NO: 6912 - protein, 10 aa, Homo Sapiens
RLCDSKGAYL

SEQ ID NO: 6913 - protein, 10 aa, Homo Sapiens
RLFADILNDV

SEQ ID NO: 6914 - protein, 10 aa, Homo Sapiens
RLFEGTGARL

SEQ ID NO: 6915 - protein, 10 aa, Homo Sapiens
RLFNDPVAMV

SEQ ID NO: 6916 - protein, 10 aa, Homo Sapiens
RLFNEHLVSA

SEQ ID NO: 6917 - protein, 10 aa, Homo Sapiens
RLFPGAPPTA

SEQ ID NO: 6918 - protein, 10 aa, Homo Sapiens
RLFQQKLDEL

SEQ ID NO: 6919 - protein, 10 aa, Homo Sapiens
RLFSKSIETL

SEQ ID NO: 6920 - protein, 10 aa, Homo Sapiens
RLFTDVIICV

SEQ ID NO: 6921 - protein, 10 aa, Homo Sapiens
RLFTEKILRA

SEQ ID NO: 6922 - protein, 10 aa, Homo Sapiens
RLIDDMVAQA

SEQ ID NO: 6923 - protein, 10 aa, Homo Sapiens
RLIDDMVAQV

SEQ ID NO: 6924 - protein, 10 aa, Homo Sapiens
RLKEEGNEQF

SEQ ID NO: 6925 - protein, 10 aa, Homo Sapiens
RLMNLPLHSV

SEQ ID NO: 6926 - protein, 10 aa, Homo Sapiens
RLMQGDEICL

SEQ ID NO: 6927 - protein, 10 aa, Homo Sapiens
RLPDINIYQL

SEQ ID NO: 6928 - protein, 10 aa, Homo Sapiens
RLYHEDHPQL

SEQ ID NO: 6929 - protein, 10 aa, Homo Sapiens
RLYPEGLAQL

SEQ ID NO: 6930 - protein, 10 aa, Homo Sapiens
RLYPFKNDEV

SEQ ID NO: 6931 - protein, 10 aa, Homo Sapiens
RLYPWGVVEV

SEQ ID NO: 6932 - protein, 10 aa, Homo Sapiens
RMFADDLHNL

SEQ ID NO: 6933 - protein, 10 aa, Homo Sapiens
RMFDGKFVVA

SEQ ID NO: 6934 - protein, 10 aa, Homo Sapiens
RMYPFQIHSI

SEQ ID NO: 6935 - protein, 10 aa, Homo Sapiens
RQYPWGVAEV

SEQ ID NO: 6936 - protein, 10 aa, Homo Sapiens
SIPDIEQPNV

SEQ ID NO: 6937 - protein, 10 aa, Homo Sapiens
SIQLHGAKLL

SEQ ID NO: 6938 - protein, 10 aa, Homo Sapiens
SIYPLHDVFV

SEQ ID NO: 6939 - protein, 10 aa, Homo Sapiens
SLADGRDRPL

SEQ ID NO: 6940 - protein, 10 aa, Homo Sapiens
SLADLQNDEV

SEQ ID NO: 6941 - protein, 10 aa, Homo Sapiens
SLADVDPMQL

SEQ ID NO: 6942 - protein, 10 aa, Homo Sapiens
SLADVMSEQL

SEQ ID NO: 6943 - protein, 10 aa, Homo Sapiens
SLAETDKITL

SEQ ID NO: 6944 - protein, 10 aa, Homo Sapiens
SLAGIPSPSL

SEQ ID NO: 6945 - protein, 10 aa, Homo Sapiens
SLANLDTNKL

SEQ ID NO: 6946 - protein, 10 aa, Homo Sapiens
SLANNPQYKL

SEQ ID NO: 6947 - protein, 10 aa, Homo Sapiens
SLAPDGRTFV

SEQ ID NO: 6948 - protein, 10 aa, Homo Sapiens
SLAPDTRLFV

SEQ ID NO: 6949 - protein, 10 aa, Homo Sapiens
SLAPNIISQL

SEQ ID NO: 6950 - protein, 10 aa, Homo Sapiens
SLAPNSRYYL

SEQ ID NO: 6951 - protein, 10 aa, Homo Sapiens
SLCDSPHQNL

SEQ ID NO: 6952 - protein, 10 aa, Homo Sapiens
SLFAGGMLRV

SEQ ID NO: 6953 - protein, 10 aa, Homo Sapiens
SLFAQRLKTL

SEQ ID NO: 6954 - protein, 10 aa, Homo Sapiens
SLFDAKERTV

SEQ ID NO: 6955 - protein, 10 aa, Homo Sapiens
SLFEGKALGL

SEQ ID NO: 6956 - protein, 10 aa, Homo Sapiens
SLFEKATDEL

SEQ ID NO: 6957 - protein, 10 aa, Homo Sapiens
SLFEKGLKNV

SEQ ID NO: 6958 - protein, 10 aa, Homo Sapiens
SLFGEAPQNL

SEQ ID NO: 6959 - protein, 10 aa, Homo Sapiens
SLFGGSVKLA

SEQ ID NO: 6960 - protein, 10 aa, Homo Sapiens
SLFGQDVKAV

SEQ ID NO: 6961 - protein, 10 aa, Homo Sapiens
SLFGQKHNAV

SEQ ID NO: 6962 - protein, 10 aa, Homo Sapiens
SLFGYSPAAA

SEQ ID NO: 6963 - protein, 10 aa, Homo Sapiens
SLFNGALDQA

SEQ ID NO: 6964 - protein, 10 aa, Homo Sapiens
SLFPGKLEVV

SEQ ID NO: 6965 - protein, 10 aa, Homo Sapiens
SLFPHNPQFI

SEQ ID NO: 6966 - protein, 10 aa, Homo Sapiens
SLFSGILKEM

SEQ ID NO: 6967 - protein, 10 aa, Homo Sapiens
SLFSGKPEVL

SEQ ID NO: 6968 - protein, 10 aa, Homo Sapiens
SLFSHSLISI

SEQ ID NO: 6969 - protein, 10 aa, Homo Sapiens
SLINVGLISV

SEQ ID NO: 6970 - protein, 10 aa, Homo Sapiens
SLKPGKIDHL

SEQ ID NO: 6971 - protein, 10 aa, Homo Sapiens
SLPDFGISYV

SEQ ID NO: 6972 - protein, 10 aa, Homo Sapiens
SLSDLHKFCL

SEQ ID NO: 6973 - protein, 10 aa, Homo Sapiens
SLSDLTGSLL

SEQ ID NO: 6974 - protein, 10 aa, Homo Sapiens
SLSELQISYV

SEQ ID NO: 6975 - protein, 10 aa, Homo Sapiens
SLSNIQQHSV

SEQ ID NO: 6976 - protein, 10 aa, Homo Sapiens
SLYGDLDSAL

SEQ ID NO: 6977 - protein, 10 aa, Homo Sapiens
SLYGGDSKFL

SEQ ID NO: 6978 - protein, 10 aa, Homo Sapiens
SLYSEKEVFI

SEQ ID NO: 6979 - protein, 10 aa, Homo Sapiens
SMFGKLIDLA

SEQ ID NO: 6980 - protein, 10 aa, Homo Sapiens
SMFTSNLKEA

SEQ ID NO: 6981 - protein, 10 aa, Homo Sapiens
SMKEVDEQML

SEQ ID NO: 6982 - protein, 10 aa, Homo Sapiens
SMYGVDLHHA

SEQ ID NO: 6983 - protein, 10 aa, Homo Sapiens
SMYGVDLHKA

SEQ ID NO: 6984 - protein, 10 aa, Homo Sapiens
SMYPIALTRA

SEQ ID NO: 6985 - protein, 10 aa, Homo Sapiens
SMYPTRIEGA

SEQ ID NO: 6986 - protein, 10 aa, Homo Sapiens
STFPGAEHCL

SEQ ID NO: 6987 - protein, 10 aa, Homo Sapiens
SVFGGKNIHV

SEQ ID NO: 6988 - protein, 10 aa, Homo Sapiens
TIPDFIFANV

SEQ ID NO: 6989 - protein, 10 aa, Homo Sapiens
TLADFCDQQL

SEQ ID NO: 6990 - protein, 10 aa, Homo Sapiens
TLADSVGHHL

SEQ ID NO: 6991 - protein, 10 aa, Homo Sapiens
TLAEIAKAEL

SEQ ID NO: 6992 - protein, 10 aa, Homo Sapiens
TLAEIAKVEL

SEQ ID NO: 6993 - protein, 10 aa, Homo Sapiens
TLAEVPEHVL

SEQ ID NO: 6994 - protein, 10 aa, Homo Sapiens
TLFAGYTDNL

SEQ ID NO: 6995 - protein, 10 aa, Homo Sapiens
TLFDHAPDKL

SEQ ID NO: 6996 - protein, 10 aa, Homo Sapiens
TLFKGFGDRL

SEQ ID NO: 6997 - protein, 10 aa, Homo Sapiens
TLFPGKVHSL

SEQ ID NO: 6998 - protein, 10 aa, Homo Sapiens
TLFPKDVQLA

SEQ ID NO: 6999 - protein, 10 aa, Homo Sapiens
TLFPVRLLVA

SEQ ID NO: 7000 - protein, 10 aa, Homo Sapiens
TLFQHQIIHA

SEQ ID NO: 7001 - protein, 10 aa, Homo Sapiens
TLHGLQQYYV

SEQ ID NO: 7002 - protein, 10 aa, Homo Sapiens
TLIDDKPYCA

SEQ ID NO: 7003 - protein, 10 aa, Homo Sapiens
TLYEVKSENL

SEQ ID NO: 7004 - protein, 10 aa, Homo Sapiens
TLYPLHILFV

SEQ ID NO: 7005 - protein, 10 aa, Homo Sapiens
TMYPGIADRM

SEQ ID NO: 7006 - protein, 10 aa, Homo Sapiens
TMYPGLPSRL

SEQ ID NO: 7007 - protein, 10 aa, Homo Sapiens
TVQGLSLQEL

SEQ ID NO: 7008 - protein, 10 aa, Homo Sapiens
TVYGGYLCSV

SEQ ID NO: 7009 - protein, 10 aa, Homo Sapiens
VDGAYMTKVD

SEQ ID NO: 7010 - protein, 10 aa, Homo Sapiens
VLADVMDDQL

SEQ ID NO: 7011 - protein, 10 aa, Homo Sapiens
VLAEIDPKQL

SEQ ID NO: 7012 - protein, 10 aa, Homo Sapiens
VLAEIPEQFL

SEQ ID NO: 7013 - protein, 10 aa, Homo Sapiens
VLAGLQHPNI

SEQ ID NO: 7014 - protein, 10 aa, Homo Sapiens
VLANGLDNKL

SEQ ID NO: 7015 - protein, 10 aa, Homo Sapiens
VLEGRAQPQL

SEQ ID NO: 7016 - protein, 10 aa, Homo Sapiens
VLFDDELLMV

SEQ ID NO: 7017 - protein, 10 aa, Homo Sapiens
VLFDKVCEHL

SEQ ID NO: 7018 - protein, 10 aa, Homo Sapiens
VLFEDAVAHI

SEQ ID NO: 7019 - protein, 10 aa, Homo Sapiens
VLFEGRTVQL

SEQ ID NO: 7020 - protein, 10 aa, Homo Sapiens
VLFEHAVGYA

SEQ ID NO: 7021 - protein, 10 aa, Homo Sapiens
VLFEKEVNEV

SEQ ID NO: 7022 - protein, 10 aa, Homo Sapiens
VLFGAVITGA

SEQ ID NO: 7023 - protein, 10 aa, Homo Sapiens
VLFGQVVRGL

SEQ ID NO: 7024 - protein, 10 aa, Homo Sapiens
VLFGREVSPA

SEQ ID NO: 7025 - protein, 10 aa, Homo Sapiens
VLFKAQLEKA

SEQ ID NO: 7026 - protein, 10 aa, Homo Sapiens
VLFPESPARA

SEQ ID NO: 7027 - protein, 10 aa, Homo Sapiens
VLIGGKPDRV

SEQ ID NO: 7028 - protein, 10 aa, Homo Sapiens
VLKEEASDYL

SEQ ID NO: 7029 - protein, 10 aa, Homo Sapiens
VLKEGSEYRV

SEQ ID NO: 7030 - protein, 10 aa, Homo Sapiens
VLPNFLPYNV

SEQ ID NO: 7031 - protein, 10 aa, Homo Sapiens
VLSAADKGNV

SEQ ID NO: 7032 - protein, 10 aa, Homo Sapiens
VLSDIKSIGL

SEQ ID NO: 7033 - protein, 10 aa, Homo Sapiens
VLYGGLLEHL

SEQ ID NO: 7034 - protein, 10 aa, Homo Sapiens
VLYGPKIDRA

SEQ ID NO: 7035 - protein, 10 aa, Homo Sapiens
VLYPASPHGV

SEQ ID NO: 7036 - protein, 10 aa, Homo Sapiens
VLYPHEPTAV

SEQ ID NO: 7037 - protein, 10 aa, Homo Sapiens
VMFGGKQVVV

SEQ ID NO: 7038 - protein, 10 aa, Homo Sapiens
VMFRTPLASV

SEQ ID NO: 7039 - protein, 10 aa, Homo Sapiens
VMIAGKVAVV

SEQ ID NO: 7040 - protein, 10 aa, Homo Sapiens
VTLWICGLKL

SEQ ID NO: 7041 - protein, 10 aa, Homo Sapiens
WLKEHVEPVF

SEQ ID NO: 7042 - protein, 10 aa, Homo Sapiens
YAYDGKDYIA

SEQ ID NO: 7043 - protein, 10 aa, Homo Sapiens
YDAEISQIHQ

SEQ ID NO: 7044 - protein, 10 aa, Homo Sapiens
YIFEGLGHLI

SEQ ID NO: 7045 - protein, 10 aa, Homo Sapiens
YIYDKDMEII

SEQ ID NO: 7046 - protein, 10 aa, Homo Sapiens
YLADTTHTSL

SEQ ID NO: 7047 - protein, 10 aa, Homo Sapiens
YLAELVTPIL

SEQ ID NO: 7048 - protein, 10 aa, Homo Sapiens
YLAPGDYHCF

SEQ ID NO: 7049 - protein, 10 aa, Homo Sapiens
YLAREGLIRA

SEQ ID NO: 7050 - protein, 10 aa, Homo Sapiens
YLASDEITTV

SEQ ID NO: 7051 - protein, 10 aa, Homo Sapiens
YLDEDTIYHL

SEQ ID NO: 7052 - protein, 10 aa, Homo Sapiens
YLDIKGLLDV

SEQ ID NO: 7053 - protein, 10 aa, Homo Sapiens
YLEGTKAQYL

SEQ ID NO: 7054 - protein, 10 aa, Homo Sapiens
YLEKGKETLL

SEQ ID NO: 7055 - protein, 10 aa, Homo Sapiens
YLFDRNGVCL

SEQ ID NO: 7056 - protein, 10 aa, Homo Sapiens
YLFEQVQHNL

SEQ ID NO: 7057 - protein, 10 aa, Homo Sapiens
YLHESTQDEL

SEQ ID NO: 7058 - protein, 10 aa, Homo Sapiens
YLIDEPSAYL

SEQ ID NO: 7059 - protein, 10 aa, Homo Sapiens
YLIDFKHHFM

SEQ ID NO: 7060 - protein, 10 aa, Homo Sapiens
YLIDRDPTYF

SEQ ID NO: 7061 - protein, 10 aa, Homo Sapiens
YLINSPVVRA

SEQ ID NO: 7062 - protein, 10 aa, Homo Sapiens
YLIQSVPAEL

SEQ ID NO: 7063 - protein, 10 aa, Homo Sapiens
YLITGNLEKL

SEQ ID NO: 7064 - protein, 10 aa, Homo Sapiens
YLKDGPYITA

SEQ ID NO: 7065 - protein, 10 aa, Homo Sapiens
YLKGGVADAL

SEQ ID NO: 7066 - protein, 10 aa, Homo Sapiens
YLMEGSYNKV

SEQ ID NO: 7067 - protein, 10 aa, Homo Sapiens
YLMEQNVTKL

SEQ ID NO: 7068 - protein, 10 aa, Homo Sapiens
YLNDLHEVLL

SEQ ID NO: 7069 - protein, 10 aa, Homo Sapiens
YLNKAGIVQA

SEQ ID NO: 7070 - protein, 10 aa, Homo Sapiens
YLNKDTHDQL

SEQ ID NO: 7071 - protein, 10 aa, Homo Sapiens
YLNKNALTTL

SEQ ID NO: 7072 - protein, 10 aa, Homo Sapiens
YLPENKPCYL

SEQ ID NO: 7073 - protein, 10 aa, Homo Sapiens
YLSDEGHYWV

SEQ ID NO: 7074 - protein, 10 aa, Homo Sapiens
YLSDIPIHNA

SEQ ID NO: 7075 - protein, 10 aa, Homo Sapiens
YLSDIPLHDA

SEQ ID NO: 7076 - protein, 10 aa, Homo Sapiens
YLSEIEMAKA

SEQ ID NO: 7077 - protein, 10 aa, Homo Sapiens
YLSEVGDTQV

SEQ ID NO: 7078 - protein, 10 aa, Homo Sapiens
YLSQEHQQQV

SEQ ID NO: 7079 - protein, 10 aa, Homo Sapiens
YLYGQTTTYL

SEQ ID NO: 7080 - protein, 10 aa, Homo Sapiens
YLYKQPAEHL

SEQ ID NO: 7081 - protein, 10 aa, Homo Sapiens
YLYNWKCPSM

SEQ ID NO: 7082 - protein, 10 aa, Homo Sapiens
YLYPIKNLEM

SEQ ID NO: 7083 - protein, 10 aa, Homo Sapiens
YMFEEVPIVI

SEQ ID NO: 7084 - protein, 10 aa, Homo Sapiens
YMFPDTMLQA

SEQ ID NO: 7085 - protein, 10 aa, Homo Sapiens
YMFQHIEESF

SEQ ID NO: 7086 - protein, 10 aa, Homo Sapiens
YMYEKESELI

SEQ ID NO: 7087 - protein, 10 aa, Homo Sapiens
YQAPDIDVQL

SEQ ID NO: 7088 - protein, 10 aa, Homo Sapiens
YQWDDPDPRL

SEQ ID NO: 7089 - protein, 10 aa, Homo Sapiens
YVFDGKPPQL

SEQ ID NO: 7090 - protein, 10 aa, Homo Sapiens
YVFEGKMLEA

SEQ ID NO: 7091 - protein, 11 aa, Homo Sapiens
AEQNRKDAEAW

SEQ ID NO: 7092 - protein, 11 aa, Homo Sapiens
AEQRGELAIKD

SEQ ID NO: 7093 - protein, 11 aa, Homo Sapiens
AGGVQRQEVVC

SEQ ID NO: 7094 - protein, 11 aa, Homo Sapiens
ALADILSEPTM

SEQ ID NO: 7095 - protein, 11 aa, Homo Sapiens
ALADKELLPSV

SEQ ID NO: 7096 - protein, 11 aa, Homo Sapiens
ALADVPELARL

SEQ ID NO: 7097 - protein, 11 aa, Homo Sapiens
ALAEMLKENKV

SEQ ID NO: 7098 - protein, 11 aa, Homo Sapiens
ALAEMPDSAAA

SEQ ID NO: 7099 - protein, 11 aa, Homo Sapiens
ALAGPEVEAHL

SEQ ID NO: 7100 - protein, 11 aa, Homo Sapiens
ALAHEKFTKEL

SEQ ID NO: 7101 - protein, 11 aa, Homo Sapiens
ALANRKIGHFL

SEQ ID NO: 7102 - protein, 11 aa, Homo Sapiens
ALCDPTVASRL

SEQ ID NO: 7103 - protein, 11 aa, Homo Sapiens
ALCPQVINAAL

SEQ ID NO: 7104 - protein, 11 aa, Homo Sapiens
ALCSEAALQAI

SEQ ID NO: 7105 - protein, 11 aa, Homo Sapiens
ALEEPDDQNRI

SEQ ID NO: 7106 - protein, 11 aa, Homo Sapiens
ALFDCDGNGEL

SEQ ID NO: 7107 - protein, 11 aa, Homo Sapiens
ALFDEQHREEM

SEQ ID NO: 7108 - protein, 11 aa, Homo Sapiens
ALFEAAREVTL

SEQ ID NO: 7109 - protein, 11 aa, Homo Sapiens
ALFEQKGPVYV

SEQ ID NO: 7110 - protein, 11 aa, Homo Sapiens
ALFNKGGSVFL

SEQ ID NO: 7111 - protein, 11 aa, Homo Sapiens
ALFPENFHQNL

SEQ ID NO: 7112 - protein, 11 aa, Homo Sapiens
ALFPHLLQPVL

SEQ ID NO: 7113 - protein, 11 aa, Homo Sapiens
ALFSKAEEQLL

SEQ ID NO: 7114 - protein, 11 aa, Homo Sapiens
ALFWADKVASL

SEQ ID NO: 7115 - protein, 11 aa, Homo Sapiens
ALGEEALLRYV

SEQ ID NO: 7116 - protein, 11 aa, Homo Sapiens
ALGTDAEGQKV

SEQ ID NO: 7117 - protein, 11 aa, Homo Sapiens
ALIEAEKVAQV

SEQ ID NO: 7118 - protein, 11 aa, Homo Sapiens
ALKEDDPKAAL

SEQ ID NO: 7119 - protein, 11 aa, Homo Sapiens
ALKELMEIEEV

SEQ ID NO: 7120 - protein, 11 aa, Homo Sapiens
ALNARGGGNQV

SEQ ID NO: 7121 - protein, 11 aa, Homo Sapiens
ALPSEELNRQL

SEQ ID NO: 7122 - protein, 11 aa, Homo Sapiens
ALQEACEAYLV

SEQ ID NO: 7123 - protein, 11 aa, Homo Sapiens
ALQEASEAYLV

SEQ ID NO: 7124 - protein, 11 aa, Homo Sapiens
ALSDIEKNYQL

SEQ ID NO: 7125 - protein, 11 aa, Homo Sapiens
ALTDITNLNHL

SEQ ID NO: 7126 - protein, 11 aa, Homo Sapiens
ALYILGDKAQL

SEQ ID NO: 7127 - protein, 11 aa, Homo Sapiens
AMASLGALALL

SEQ ID NO: 7128 - protein, 11 aa, Homo Sapiens
AMATESILHFA

SEQ ID NO: 7129 - protein, 11 aa, Homo Sapiens
AVADENQNHHL

SEQ ID NO: 7130 - protein, 11 aa, Homo Sapiens
AVAGPEMQVKL

SEQ ID NO: 7131 - protein, 11 aa, Homo Sapiens
AVEDLESVGKG

SEQ ID NO: 7132 - protein, 11 aa, Homo Sapiens
FIADSHQNFAL

SEQ ID NO: 7133 - protein, 11 aa, Homo Sapiens
FICEQDHQNFL

SEQ ID NO: 7134 - protein, 11 aa, Homo Sapiens
FLADPDTVNHL

SEQ ID NO: 7135 - protein, 11 aa, Homo Sapiens
FLADPSAFVAA

SEQ ID NO: 7136 - protein, 11 aa, Homo Sapiens
FLADRGVDNTF

SEQ ID NO: 7137 - protein, 11 aa, Homo Sapiens
FLAEEKHLHVL

SEQ ID NO: 7138 - protein, 11 aa, Homo Sapiens
FLAEGLRNENL

SEQ ID NO: 7139 - protein, 11 aa, Homo Sapiens
FLAEIEALEKM

SEQ ID NO: 7140 - protein, 11 aa, Homo Sapiens
FLAHDQAVRTL

SEQ ID NO: 7141 - protein, 11 aa, Homo Sapiens
FLANNPFSCKL

SEQ ID NO: 7142 - protein, 11 aa, Homo Sapiens
FLASESLIKQI

SEQ ID NO: 7143 - protein, 11 aa, Homo Sapiens
FLCEPRNGHAL

SEQ ID NO: 7144 - protein, 11 aa, Homo Sapiens
FLFDGSPTYVL

SEQ ID NO: 7145 - protein, 11 aa, Homo Sapiens
FLFNELKGETM

SEQ ID NO: 7146 - protein, 11 aa, Homo Sapiens
FLFSEKPEKNL

SEQ ID NO: 7147 - protein, 11 aa, Homo Sapiens
FLGQTEAQYHL

SEQ ID NO: 7148 - protein, 11 aa, Homo Sapiens
FLHEESILERV

SEQ ID NO: 7149 - protein, 11 aa, Homo Sapiens
FLIDIVPRDEL

SEQ ID NO: 7150 - protein, 11 aa, Homo Sapiens
FLIEPEHVNTV

SEQ ID NO: 7151 - protein, 11 aa, Homo Sapiens
FLIGDEAATHL

SEQ ID NO: 7152 - protein, 11 aa, Homo Sapiens
FLIGQGAHVGA

SEQ ID NO: 7153 - protein, 11 aa, Homo Sapiens
FLKEDSQSCRV

SEQ ID NO: 7154 - protein, 11 aa, Homo Sapiens
FLLGPEGQHLL

SEQ ID NO: 7155 - protein, 11 aa, Homo Sapiens
FLNDTTKPVGL

SEQ ID NO: 7156 - protein, 11 aa, Homo Sapiens
FLNEHPGGEEV

SEQ ID NO: 7157 - protein, 11 aa, Homo Sapiens
FLNSVTDIHQL

SEQ ID NO: 7158 - protein, 11 aa, Homo Sapiens
FLPDPSALQNL

SEQ ID NO: 7159 - protein, 11 aa, Homo Sapiens
FLPETRIMTSV

SEQ ID NO: 7160 - protein, 11 aa, Homo Sapiens
FLPPEHTIVYI

SEQ ID NO: 7161 - protein, 11 aa, Homo Sapiens
FLSEEGGHVAV

SEQ ID NO: 7162 - protein, 11 aa, Homo Sapiens
FLSPHQLQQHL

SEQ ID NO: 7163 - protein, 11 aa, Homo Sapiens
FLSPLNPAHQL

SEQ ID NO: 7164 - protein, 11 aa, Homo Sapiens
FLTAAKKARAG

SEQ ID NO: 7165 - protein, 11 aa, Homo Sapiens
FLVGEAARALS

SEQ ID NO: 7166 - protein, 11 aa, Homo Sapiens
FLYPAAQLQHL

SEQ ID NO: 7167 - protein, 11 aa, Homo Sapiens
FLYQQQGRLDK

SEQ ID NO: 7168 - protein, 11 aa, Homo Sapiens
FLYSSGDKEQL

SEQ ID NO: 7169 - protein, 11 aa, Homo Sapiens
FMIDASVHPTL

SEQ ID NO: 7170 - protein, 11 aa, Homo Sapiens
FQHEENLLQQV

SEQ ID NO: 7171 - protein, 11 aa, Homo Sapiens
FVADEELVHLL

SEQ ID NO: 7172 - protein, 11 aa, Homo Sapiens
FVANDSTLFTL

SEQ ID NO: 7173 - protein, 11 aa, Homo Sapiens
GLADASLLKKV

SEQ ID NO: 7174 - protein, 11 aa, Homo Sapiens
GLADNTVIAKV

SEQ ID NO: 7175 - protein, 11 aa, Homo Sapiens
GLADPSALTQA

SEQ ID NO: 7176 - protein, 11 aa, Homo Sapiens
GLAEDIDKGEV

SEQ ID NO: 7177 - protein, 11 aa, Homo Sapiens
GLAPPQHLIRV

SEQ ID NO: 7178 - protein, 11 aa, Homo Sapiens
GLAPSKSTVYV

SEQ ID NO: 7179 - protein, 11 aa, Homo Sapiens
GLATTQINNKA

SEQ ID NO: 7180 - protein, 11 aa, Homo Sapiens
GLFAHPSLWQL

SEQ ID NO: 7181 - protein, 11 aa, Homo Sapiens
GLFDYNSQQQL

SEQ ID NO: 7182 - protein, 11 aa, Homo Sapiens
GLFSDPESQTL

SEQ ID NO: 7183 - protein, 11 aa, Homo Sapiens
GLIDIENPNRV

SEQ ID NO: 7184 - protein, 11 aa, Homo Sapiens
GLIDTKELEPL

SEQ ID NO: 7185 - protein, 11 aa, Homo Sapiens
GLPPEYLQVHL

SEQ ID NO: 7186 - protein, 11 aa, Homo Sapiens
GLTSTDLLFHL

SEQ ID NO: 7187 - protein, 11 aa, Homo Sapiens
GLVDEKALAQA

SEQ ID NO: 7188 - protein, 11 aa, Homo Sapiens
GLYDSQNPPTV

SEQ ID NO: 7189 - protein, 11 aa, Homo Sapiens
GLYEAIADHYM

SEQ ID NO: 7190 - protein, 11 aa, Homo Sapiens
GLYGIKDDVFL

SEQ ID NO: 7191 - protein, 11 aa, Homo Sapiens
GMAGPAAEITV

SEQ ID NO: 7192 - protein, 11 aa, Homo Sapiens
GQMDTKGLVRA

SEQ ID NO: 7193 - protein, 11 aa, Homo Sapiens
HLADLPVEPHL

SEQ ID NO: 7194 - protein, 11 aa, Homo Sapiens
HLNENIEKGLL

SEQ ID NO: 7195 - protein, 11 aa, Homo Sapiens
IIADPKTDHRL

SEQ ID NO: 7196 - protein, 11 aa, Homo Sapiens
ILADIIQNSTL

SEQ ID NO: 7197 - protein, 11 aa, Homo Sapiens
ILADLHSADQL

SEQ ID NO: 7198 - protein, 11 aa, Homo Sapiens
ILADMADVYKL

SEQ ID NO: 7199 - protein, 11 aa, Homo Sapiens
ILANDGVLLAA

SEQ ID NO: 7200 - protein, 11 aa, Homo Sapiens
ILAPAGSLPKI

SEQ ID NO: 7201 - protein, 11 aa, Homo Sapiens
ILAQITGTEHL

SEQ ID NO: 7202 - protein, 11 aa, Homo Sapiens
ILFDCPGQIEL

SEQ ID NO: 7203 - protein, 11 aa, Homo Sapiens
ILIHEDSMNLL

SEQ ID NO: 7204 - protein, 11 aa, Homo Sapiens
ILKEADQKEQF

SEQ ID NO: 7205 - protein, 11 aa, Homo Sapiens
ILKNMTEAEKA

SEQ ID NO: 7206 - protein, 11 aa, Homo Sapiens
ILNDPSQSEVM

SEQ ID NO: 7207 - protein, 11 aa, Homo Sapiens
ILNSVRATDTL

SEQ ID NO: 7208 - protein, 11 aa, Homo Sapiens
ILRDTSEDLGL

SEQ ID NO: 7209 - protein, 11 aa, Homo Sapiens
IMFDDIGRNFL

SEQ ID NO: 7210 - protein, 11 aa, Homo Sapiens
ISERYGPVFTI

SEQ ID NO: 7211 - protein, 11 aa, Homo Sapiens
ITAPIEAQVRL

SEQ ID NO: 7212 - protein, 11 aa, Homo Sapiens
ITQIEHEVSSS

SEQ ID NO: 7213 - protein, 11 aa, Homo Sapiens
KIIDEDGLLNL

SEQ ID NO: 7214 - protein, 11 aa, Homo Sapiens
KKDVDNAYMIK

SEQ ID NO: 7215 - protein, 11 aa, Homo Sapiens
KLADDVDLEQV

SEQ ID NO: 7216 - protein, 11 aa, Homo Sapiens
KLADFGDAVQL

SEQ ID NO: 7217 - protein, 11 aa, Homo Sapiens
KLADFGVAGQL

SEQ ID NO: 7218 - protein, 11 aa, Homo Sapiens
KLADMNQEYQL

SEQ ID NO: 7219 - protein, 11 aa, Homo Sapiens
KLANILFTQEL

SEQ ID NO: 7220 - protein, 11 aa, Homo Sapiens
KLAPITYPQGL

SEQ ID NO: 7221 - protein, 11 aa, Homo Sapiens
KLATLNIHDYL

SEQ ID NO: 7222 - protein, 11 aa, Homo Sapiens
KLFDRPQELKL

SEQ ID NO: 7223 - protein, 11 aa, Homo Sapiens
KLFNESHGIFL

SEQ ID NO: 7224 - protein, 11 aa, Homo Sapiens
KLFPGFEIETV

SEQ ID NO: 7225 - protein, 11 aa, Homo Sapiens
KLFTAESLIGL

SEQ ID NO: 7226 - protein, 11 aa, Homo Sapiens
KLIDETQDMLL

SEQ ID NO: 7227 - protein, 11 aa, Homo Sapiens
KLIDFGSGALL

SEQ ID NO: 7228 - protein, 11 aa, Homo Sapiens
KLIDLSQVMYL

SEQ ID NO: 7229 - protein, 11 aa, Homo Sapiens
KLIECGWKDQL

SEQ ID NO: 7230 - protein, 11 aa, Homo Sapiens
KLIEVDDERKL

SEQ ID NO: 7231 - protein, 11 aa, Homo Sapiens
KLIGVHCTHGL

SEQ ID NO: 7232 - protein, 11 aa, Homo Sapiens
KLKEKTEQETL

SEQ ID NO: 7233 - protein, 11 aa, Homo Sapiens
KLKEQREAELL

SEQ ID NO: 7234 - protein, 11 aa, Homo Sapiens
KLKKVDKIEEL

SEQ ID NO: 7235 - protein, 11 aa, Homo Sapiens
KLSEPSSLQYL

SEQ ID NO: 7236 - protein, 11 aa, Homo Sapiens
KLYDKIDPEKL

SEQ ID NO: 7237 - protein, 11 aa, Homo Sapiens
KLYDNLLEQNL

SEQ ID NO: 7238 - protein, 11 aa, Homo Sapiens
KMADEDALRKI

SEQ ID NO: 7239 - protein, 11 aa, Homo Sapiens
KMAEEKLTHKM

SEQ ID NO: 7240 - protein, 11 aa, Homo Sapiens
KMAGIEITEEM

SEQ ID NO: 7241 - protein, 11 aa, Homo Sapiens
KMPQSMPEYAL

SEQ ID NO: 7242 - protein, 11 aa, Homo Sapiens
KTAEAQLAYEL

SEQ ID NO: 7243 - protein, 11 aa, Homo Sapiens
KVMNEKLQHCM

SEQ ID NO: 7244 - protein, 11 aa, Homo Sapiens
LLAANNLLAGL

SEQ ID NO: 7245 - protein, 11 aa, Homo Sapiens
LLADVVLQPRL

SEQ ID NO: 7246 - protein, 11 aa, Homo Sapiens
LLAELPASVHA

SEQ ID NO: 7247 - protein, 11 aa, Homo Sapiens
LLAETHYQLGL

SEQ ID NO: 7248 - protein, 11 aa, Homo Sapiens
LLFDHLEPIEL

SEQ ID NO: 7249 - protein, 11 aa, Homo Sapiens
LLGERVALNTL

SEQ ID NO: 7250 - protein, 11 aa, Homo Sapiens
LLIDDKGTIKL

SEQ ID NO: 7251 - protein, 11 aa, Homo Sapiens
LLNEPDGTFLL

SEQ ID NO: 7252 - protein, 11 aa, Homo Sapiens
LLQELTDIDTL

SEQ ID NO: 7253 - protein, 11 aa, Homo Sapiens
LLSHSLLVTLA

SEQ ID NO: 7254 - protein, 11 aa, Homo Sapiens
LLVEPSRNDLL

SEQ ID NO: 7255 - protein, 11 aa, Homo Sapiens
LMAEQEKTLAL

SEQ ID NO: 7256 - protein, 11 aa, Homo Sapiens
LSLSSETKPKL

SEQ ID NO: 7257 - protein, 11 aa, Homo Sapiens
MLIEEGGLQHL

SEQ ID NO: 7258 - protein, 11 aa, Homo Sapiens
MQAPRAALVFA

SEQ ID NO: 7259 - protein, 11 aa, Homo Sapiens
NLAGENILNPL

SEQ ID NO: 7260 - protein, 11 aa, Homo Sapiens
NLFEWAKNSPL

SEQ ID NO: 7261 - protein, 11 aa, Homo Sapiens
PLADAHLTKKL

SEQ ID NO: 7262 - protein, 11 aa, Homo Sapiens
QLPESAYMHQL

SEQ ID NO: 7263 - protein, 11 aa, Homo Sapiens
RLADLKQLWGL

SEQ ID NO: 7264 - protein, 11 aa, Homo Sapiens
RLAELTVDEFL

SEQ ID NO: 7265 - protein, 11 aa, Homo Sapiens
RLAEVGQYEQV

SEQ ID NO: 7266 - protein, 11 aa, Homo Sapiens
RLAPGYINQEV

SEQ ID NO: 7267 - protein, 11 aa, Homo Sapiens
RLAQDYLQCVL

SEQ ID NO: 7268 - protein, 11 aa, Homo Sapiens
RLFDANKAELF

SEQ ID NO: 7269 - protein, 11 aa, Homo Sapiens
RLFDDSTVTTV

SEQ ID NO: 7270 - protein, 11 aa, Homo Sapiens
RLFEAQGKPEL

SEQ ID NO: 7271 - protein, 11 aa, Homo Sapiens
RLFGPVDSEQL

SEQ ID NO: 7272 - protein, 11 aa, Homo Sapiens
RLFNVDRHVGM

SEQ ID NO: 7273 - protein, 11 aa, Homo Sapiens
RLIGDAAKNQL

SEQ ID NO: 7274 - protein, 11 aa, Homo Sapiens
RLIGDAAKNQV

SEQ ID NO: 7275 - protein, 11 aa, Homo Sapiens
RLKEDVEKNLA

SEQ ID NO: 7276 - protein, 11 aa, Homo Sapiens
RLPPDTLLQQV

SEQ ID NO: 7277 - protein, 11 aa, Homo Sapiens
RLPPEGILHNV

SEQ ID NO: 7278 - protein, 11 aa, Homo Sapiens
RLQETEGMVAV

SEQ ID NO: 7279 - protein, 11 aa, Homo Sapiens
RLVEDIFQQNV

SEQ ID NO: 7280 - protein, 11 aa, Homo Sapiens
RLYEAYLPETF

SEQ ID NO: 7281 - protein, 11 aa, Homo Sapiens
RLYHEADKTYM

SEQ ID NO: 7282 - protein, 11 aa, Homo Sapiens
RMANRDLLSSV

SEQ ID NO: 7283 - protein, 11 aa, Homo Sapiens
RMIDIEGKGHL

SEQ ID NO: 7284 - protein, 11 aa, Homo Sapiens
RVANQDLQVQL

SEQ ID NO: 7285 - protein, 11 aa, Homo Sapiens
RVDPNGSRYLL

SEQ ID NO: 7286 - protein, 11 aa, Homo Sapiens
SIAKAGILTTL

SEQ ID NO: 7287 - protein, 11 aa, Homo Sapiens
SIAPENLQHDI

SEQ ID NO: 7288 - protein, 11 aa, Homo Sapiens
SLAAVEKLHHL

SEQ ID NO: 7289 - protein, 11 aa, Homo Sapiens
SLADDSVLERL

SEQ ID NO: 7290 - protein, 11 aa, Homo Sapiens
SLAEEKLQASV

SEQ ID NO: 7291 - protein, 11 aa, Homo Sapiens
SLAGDVALQQL

SEQ ID NO: 7292 - protein, 11 aa, Homo Sapiens
SLAKDELGYCL

SEQ ID NO: 7293 - protein, 11 aa, Homo Sapiens
SLAMLSKAHRA

SEQ ID NO: 7294 - protein, 11 aa, Homo Sapiens
SLAQAHILKKA

SEQ ID NO: 7295 - protein, 11 aa, Homo Sapiens
SLARAALQELL

SEQ ID NO: 7296 - protein, 11 aa, Homo Sapiens
SLAVEKLSHWL

SEQ ID NO: 7297 - protein, 11 aa, Homo Sapiens
SLFQGVEFHYV

SEQ ID NO: 7298 - protein, 11 aa, Homo Sapiens
SLMEESGICKV

SEQ ID NO: 7299 - protein, 11 aa, Homo Sapiens
SLNEFGEKWEL

SEQ ID NO: 7300 - protein, 11 aa, Homo Sapiens
SLNQQGAHSAL

SEQ ID NO: 7301 - protein, 11 aa, Homo Sapiens
SLPKNDLLQRL

SEQ ID NO: 7302 - protein, 11 aa, Homo Sapiens
SLSAAQLQHLL

SEQ ID NO: 7303 - protein, 11 aa, Homo Sapiens
SLSADKFQVLL

SEQ ID NO: 7304 - protein, 11 aa, Homo Sapiens
SLSDDRLNHLL

SEQ ID NO: 7305 - protein, 11 aa, Homo Sapiens
SLSGISLQKKL

SEQ ID NO: 7306 - protein, 11 aa, Homo Sapiens
SLVEGEAVHLA

SEQ ID NO: 7307 - protein, 11 aa, Homo Sapiens
SLVESHLSDQL

SEQ ID NO: 7308 - protein, 11 aa, Homo Sapiens
SMADIPLGFGV

SEQ ID NO: 7309 - protein, 11 aa, Homo Sapiens
SMADMDMSHSL

SEQ ID NO: 7310 - protein, 11 aa, Homo Sapiens
SMDNNRSLDLD

SEQ ID NO: 7311 - protein, 11 aa, Homo Sapiens
SMKETSYEEAL

SEQ ID NO: 7312 - protein, 11 aa, Homo Sapiens
SQAGKGLMHHL

SEQ ID NO: 7313 - protein, 11 aa, Homo Sapiens
SVAEGRALMSV

SEQ ID NO: 7314 - protein, 11 aa, Homo Sapiens
SVAEINGTMNA

SEQ ID NO: 7315 - protein, 11 aa, Homo Sapiens
SVAPDTINNHV

SEQ ID NO: 7316 - protein, 11 aa, Homo Sapiens
SVAPKNALVQL

SEQ ID NO: 7317 - protein, 11 aa, Homo Sapiens
SVASAQLQEKL

SEQ ID NO: 7318 - protein, 11 aa, Homo Sapiens
SVVNEDFLHDL

SEQ ID NO: 7319 - protein, 11 aa, Homo Sapiens
SVYDGHGGEEV

SEQ ID NO: 7320 - protein, 11 aa, Homo Sapiens
TEELNREVATN

SEQ ID NO: 7321 - protein, 11 aa, Homo Sapiens
TIIDLPGITRV

SEQ ID NO: 7322 - protein, 11 aa, Homo Sapiens
TLADCNLLPKL

SEQ ID NO: 7323 - protein, 11 aa, Homo Sapiens
TLADCSLLPKL

SEQ ID NO: 7324 - protein, 11 aa, Homo Sapiens
TLAEPPAKGLL

SEQ ID NO: 7325 - protein, 11 aa, Homo Sapiens
TLAGHTLTAEL

SEQ ID NO: 7326 - protein, 11 aa, Homo Sapiens
TLFPAIEKNIV

SEQ ID NO: 7327 - protein, 11 aa, Homo Sapiens
TLIDLPGHESL

SEQ ID NO: 7328 - protein, 11 aa, Homo Sapiens
TLIDLPGITKV

SEQ ID NO: 7329 - protein, 11 aa, Homo Sapiens
TLIRSDAVALV

SEQ ID NO: 7330 - protein, 11 aa, Homo Sapiens
TLKELTVREYL

SEQ ID NO: 7331 - protein, 11 aa, Homo Sapiens
TLMPEKLSHKL

SEQ ID NO: 7332 - protein, 11 aa, Homo Sapiens
TLYDIAHTPGV

SEQ ID NO: 7333 - protein, 11 aa, Homo Sapiens
TMAKESSIIGV

SEQ ID NO: 7334 - protein, 11 aa, Homo Sapiens
TVASLGAQTLP

SEQ ID NO: 7335 - protein, 11 aa, Homo Sapiens
VLAEDEEMNRM

SEQ ID NO: 7336 - protein, 11 aa, Homo Sapiens
VLAERESLYQL

SEQ ID NO: 7337 - protein, 11 aa, Homo Sapiens
VLAQDPENQAL

SEQ ID NO: 7338 - protein, 11 aa, Homo Sapiens
VLFDKATYDKL

SEQ ID NO: 7339 - protein, 11 aa, Homo Sapiens
VLFPHMPCAYL

SEQ ID NO: 7340 - protein, 11 aa, Homo Sapiens
VLKAIEQADLL

SEQ ID NO: 7341 - protein, 11 aa, Homo Sapiens
VLMEDRLTNRL

SEQ ID NO: 7342 - protein, 11 aa, Homo Sapiens
VLNEFDAIQKA

SEQ ID NO: 7343 - protein, 11 aa, Homo Sapiens
VLSPADKTNVK

SEQ ID NO: 7344 - protein, 11 aa, Homo Sapiens
VLSPQELQKVL

SEQ ID NO: 7345 - protein, 11 aa, Homo Sapiens
VLVEDSNNHHL

SEQ ID NO: 7346 - protein, 11 aa, Homo Sapiens
VLVSESLMCKI

SEQ ID NO: 7347 - protein, 11 aa, Homo Sapiens
VMFECDKGFYL

SEQ ID NO: 7348 - protein, 11 aa, Homo Sapiens
VMQDPEFLQSV

SEQ ID NO: 7349 - protein, 11 aa, Homo Sapiens
VTIKKDVDGAY

SEQ ID NO: 7350 - protein, 11 aa, Homo Sapiens
VVAESELQKEL

SEQ ID NO: 7351 - protein, 11 aa, Homo Sapiens
WLANEGLITRL

SEQ ID NO: 7352 - protein, 11 aa, Homo Sapiens
WLIEDGKVVTV

SEQ ID NO: 7353 - protein, 11 aa, Homo Sapiens
YAYDGKDYIAL

SEQ ID NO: 7354 - protein, 11 aa, Homo Sapiens
YIATITDKELL

SEQ ID NO: 7355 - protein, 11 aa, Homo Sapiens
YLAEAKKGETL

SEQ ID NO: 7356 - protein, 11 aa, Homo Sapiens
YLAPFLRNVEL

SEQ ID NO: 7357 - protein, 11 aa, Homo Sapiens
YLFDVQRNNIA

SEQ ID NO: 7358 - protein, 11 aa, Homo Sapiens
YLFEQVQHNLL

SEQ ID NO: 7359 - protein, 11 aa, Homo Sapiens
YLGDGPLQHYI

SEQ ID NO: 7360 - protein, 11 aa, Homo Sapiens
YLHDQNPDAAL

SEQ ID NO: 7361 - protein, 11 aa, Homo Sapiens
YLISQVEGHQV

SEQ ID NO: 7362 - protein, 11 aa, Homo Sapiens
YLKGGVADALL

SEQ ID NO: 7363 - protein, 11 aa, Homo Sapiens
YLLDIGCGTGL

SEQ ID NO: 7364 - protein, 11 aa, Homo Sapiens
YLNPDQSGEFM

SEQ ID NO: 7365 - protein, 11 aa, Homo Sapiens
YLNPKGDSARA

SEQ ID NO: 7366 - protein, 11 aa, Homo Sapiens
YLSEDVFQHAV

SEQ ID NO: 7367 - protein, 11 aa, Homo Sapiens
YLSQEHQQQVL

SEQ ID NO: 7368 - protein, 11 aa, Homo Sapiens
YLTPESFDQKV

SEQ ID NO: 7369 - protein, 11 aa, Homo Sapiens
YLVDDSFSQAL

SEQ ID NO: 7370 - protein, 11 aa, Homo Sapiens
YLYESGETEKL

SEQ ID NO: 7371 - protein, 11 aa, Homo Sapiens
YMATSGLDHQL

SEQ ID NO: 7372 - protein, 11 aa, Homo Sapiens
YMGEEKLIASV

SEQ ID NO: 7373 - protein, 11 aa, Homo Sapiens
YMIGSEVGNYL

SEQ ID NO: 7374 - protein, 8 aa, Homo Sapiens
AIHRIIEV

SEQ ID NO: 7375 - protein, 8 aa, Homo Sapiens
ALGHVRYV

SEQ ID NO: 7376 - protein, 8 aa, Homo Sapiens
ALGKILSV

SEQ ID NO: 7377 - protein, 8 aa, Homo Sapiens
ALGNVRTV

SEQ ID NO: 7378 - protein, 8 aa, Homo Sapiens
ALGSVVAV

SEQ ID NO: 7379 - protein, 8 aa, Homo Sapiens
ALHKVIMV

SEQ ID NO: 7380 - protein, 8 aa, Homo Sapiens
FGGHIRSV

SEQ ID NO: 7381 - protein, 8 aa, Homo Sapiens
FIATVREV

SEQ ID NO: 7382 - protein, 8 aa, Homo Sapiens
FLARTVQV

SEQ ID NO: 7383 - protein, 8 aa, Homo Sapiens
FLATIMGV

SEQ ID NO: 7384 - protein, 8 aa, Homo Sapiens
FLFRITQV

SEQ ID NO: 7385 - protein, 8 aa, Homo Sapiens
FLFRLINI

SEQ ID NO: 7386 - protein, 8 aa, Homo Sapiens
FLGKLLEA

SEQ ID NO: 7387 - protein, 8 aa, Homo Sapiens
FLWKITNV

SEQ ID NO: 7388 - protein, 8 aa, Homo Sapiens
FLYKVVQV

SEQ ID NO: 7389 - protein, 8 aa, Homo Sapiens
GLFRTIAL

SEQ ID NO: 7390 - protein, 8 aa, Homo Sapiens
IIRKPVTV

SEQ ID NO: 7391 - protein, 8 aa, Homo Sapiens
ILFHVVAI

SEQ ID NO: 7392 - protein, 8 aa, Homo Sapiens
ILHDVVEV

SEQ ID NO: 7393 - protein, 8 aa, Homo Sapiens
LKDLVKVI

SEQ ID NO: 7394 - protein, 8 aa, Homo Sapiens
LLFWVTEV

SEQ ID NO: 7395 - protein, 8 aa, Homo Sapiens
LMEHIHKL

SEQ ID NO: 7396 - protein, 8 aa, Homo Sapiens
LSSHVRGV

SEQ ID NO: 7397 - protein, 8 aa, Homo Sapiens
MKAFISKV

SEQ ID NO: 7398 - protein, 8 aa, Homo Sapiens
SLGKVFGV

SEQ ID NO: 7399 - protein, 8 aa, Homo Sapiens
TIFRTISV

SEQ ID NO: 7400 - protein, 8 aa, Homo Sapiens
TMFRVEYA

SEQ ID NO: 7401 - protein, 8 aa, Homo Sapiens
VLNKVITV

SEQ ID NO: 7402 - protein, 8 aa, Homo Sapiens
VMYRVIQV

SEQ ID NO: 7403 - protein, 8 aa, Homo Sapiens
YLATVTGI

SEQ ID NO: 7404 - protein, 8 aa, Homo Sapiens
YLFHVQEV

SEQ ID NO: 7405 - protein, 8 aa, Homo Sapiens
YLFKVVLI

SEQ ID NO: 7406 - protein, 8 aa, Homo Sapiens
YLFLVRVV

SEQ ID NO: 7407 - protein, 8 aa, Homo Sapiens
YLGKIKRV

SEQ ID NO: 7408 - protein, 8 aa, Homo Sapiens
YLGKVLEL

SEQ ID NO: 7409 - protein, 8 aa, Homo Sapiens
YLGQVAIL

SEQ ID NO: 7410 - protein, 8 aa, Homo Sapiens
YLGQVTTI

SEQ ID NO: 7411 - protein, 8 aa, Homo Sapiens
YLNFIRGV

SEQ ID NO: 7412 - protein, 8 aa, Homo Sapiens
YLNSVVQV

SEQ ID NO: 7413 - protein, 9 aa, Homo Sapiens
AARPQVVAV

SEQ ID NO: 7414 - protein, 9 aa, Homo Sapiens
ADASLLKKV

SEQ ID NO: 7415 - protein, 9 aa, Homo Sapiens
AIANAISVV

SEQ ID NO: 7416 - protein, 9 aa, Homo Sapiens
AIAPIIAAV

SEQ ID NO: 7417 - protein, 9 aa, Homo Sapiens
AIAYILQGV

SEQ ID NO: 7418 - protein, 9 aa, Homo Sapiens
AIKDNVVIV

SEQ ID NO: 7419 - protein, 9 aa, Homo Sapiens
AIKEILTQV

SEQ ID NO: 7420 - protein, 9 aa, Homo Sapiens
AIKELLDTV

SEQ ID NO: 7421 - protein, 9 aa, Homo Sapiens
AIKKELTQI

SEQ ID NO: 7422 - protein, 9 aa, Homo Sapiens
AIKTELTQI

SEQ ID NO: 7423 - protein, 9 aa, Homo Sapiens
AINPKLLQL

SEQ ID NO: 7424 - protein, 9 aa, Homo Sapiens
AIQDHLLEV

SEQ ID NO: 7425 - protein, 9 aa, Homo Sapiens
AIRDGVIEA

SEQ ID NO: 7426 - protein, 9 aa, Homo Sapiens
AISGIIMGI

SEQ ID NO: 7427 - protein, 9 aa, Homo Sapiens
AIVDKVPSV

SEQ ID NO: 7428 - protein, 9 aa, Homo Sapiens
ALAAALAHI

SEQ ID NO: 7429 - protein, 9 aa, Homo Sapiens
ALAAFISSV

SEQ ID NO: 7430 - protein, 9 aa, Homo Sapiens
ALAATVFCV

SEQ ID NO: 7431 - protein, 9 aa, Homo Sapiens
ALADGVQKV

SEQ ID NO: 7432 - protein, 9 aa, Homo Sapiens
ALADLLLAL

SEQ ID NO: 7433 - protein, 9 aa, Homo Sapiens
ALADVMSQL

SEQ ID NO: 7434 - protein, 9 aa, Homo Sapiens
ALAEALKEV

SEQ ID NO: 7435 - protein, 9 aa, Homo Sapiens
ALAEALRLL

SEQ ID NO: 7436 - protein, 9 aa, Homo Sapiens
ALAEEVEQV

SEQ ID NO: 7437 - protein, 9 aa, Homo Sapiens
ALAELESVL

SEQ ID NO: 7438 - protein, 9 aa, Homo Sapiens
ALAELTKRL

SEQ ID NO: 7439 - protein, 9 aa, Homo Sapiens
ALAGGITMV

SEQ ID NO: 7440 - protein, 9 aa, Homo Sapiens
ALAGIVTNV

SEQ ID NO: 7441 - protein, 9 aa, Homo Sapiens
ALAKAPFAA

SEQ ID NO: 7442 - protein, 9 aa, Homo Sapiens
ALAKHLIKI

SEQ ID NO: 7443 - protein, 9 aa, Homo Sapiens
ALAKKPHII

SEQ ID NO: 7444 - protein, 9 aa, Homo Sapiens
ALAKLVEAI

SEQ ID NO: 7445 - protein, 9 aa, Homo Sapiens
ALANGVSRI

SEQ ID NO: 7446 - protein, 9 aa, Homo Sapiens
ALANHLIKV

SEQ ID NO: 7447 - protein, 9 aa, Homo Sapiens
ALANKLFGA

SEQ ID NO: 7448 - protein, 9 aa, Homo Sapiens
ALANQIPTV

SEQ ID NO: 7449 - protein, 9 aa, Homo Sapiens
ALAPAPPQV

SEQ ID NO: 7450 - protein, 9 aa, Homo Sapiens
ALAPGLPTA

SEQ ID NO: 7451 - protein, 9 aa, Homo Sapiens
ALAPGVRAV

SEQ ID NO: 7452 - protein, 9 aa, Homo Sapiens
ALAPLLSSL

SEQ ID NO: 7453 - protein, 9 aa, Homo Sapiens
ALAPSTMKI

SEQ ID NO: 7454 - protein, 9 aa, Homo Sapiens
ALAQRLLEV

SEQ ID NO: 7455 - protein, 9 aa, Homo Sapiens
ALARPGLTI

SEQ ID NO: 7456 - protein, 9 aa, Homo Sapiens
ALASEPLKV

SEQ ID NO: 7457 - protein, 9 aa, Homo Sapiens
ALASHILTA

SEQ ID NO: 7458 - protein, 9 aa, Homo Sapiens
ALASVIMGL

SEQ ID NO: 7459 - protein, 9 aa, Homo Sapiens
ALATHILSL

SEQ ID NO: 7460 - protein, 9 aa, Homo Sapiens
ALATKLLSL

SEQ ID NO: 7461 - protein, 9 aa, Homo Sapiens
ALATLIHQV

SEQ ID NO: 7462 - protein, 9 aa, Homo Sapiens
ALATSPITV

SEQ ID NO: 7463 - protein, 9 aa, Homo Sapiens
ALAVNISAA

SEQ ID NO: 7464 - protein, 9 aa, Homo Sapiens
ALFEAAREV

SEQ ID NO: 7465 - protein, 9 aa, Homo Sapiens
ALFGALFLA

SEQ ID NO: 7466 - protein, 9 aa, Homo Sapiens
ALFGIPMAL

SEQ ID NO: 7467 - protein, 9 aa, Homo Sapiens
ALFISPALI

SEQ ID NO: 7468 - protein, 9 aa, Homo Sapiens
ALFPGPGNA

SEQ ID NO: 7469 - protein, 9 aa, Homo Sapiens
ALFPGVALL

SEQ ID NO: 7470 - protein, 9 aa, Homo Sapiens
ALFPLLPKV

SEQ ID NO: 7471 - protein, 9 aa, Homo Sapiens
ALFQHITAL

SEQ ID NO: 7472 - protein, 9 aa, Homo Sapiens
ALFQRPPLI

SEQ ID NO: 7473 - protein, 9 aa, Homo Sapiens
ALFVKTKEV

SEQ ID NO: 7474 - protein, 9 aa, Homo Sapiens
ALGPKPQGL

SEQ ID NO: 7475 - protein, 9 aa, Homo Sapiens
ALGPRWALV

SEQ ID NO: 7476 - protein, 9 aa, Homo Sapiens
ALHAAVIAI

SEQ ID NO: 7477 - protein, 9 aa, Homo Sapiens
ALHDHLATI

SEQ ID NO: 7478 - protein, 9 aa, Homo Sapiens
ALHDILTEI

SEQ ID NO: 7479 - protein, 9 aa, Homo Sapiens
ALHGMVALV

SEQ ID NO: 7480 - protein, 9 aa, Homo Sapiens
ALHHRILAL

SEQ ID NO: 7481 - protein, 9 aa, Homo Sapiens
ALHWFLNQV

SEQ ID NO: 7482 - protein, 9 aa, Homo Sapiens
ALIDRMVNL

SEQ ID NO: 7483 - protein, 9 aa, Homo Sapiens
ALIEKLVEL

SEQ ID NO: 7484 - protein, 9 aa, Homo Sapiens
ALIFKIASA

SEQ ID NO: 7485 - protein, 9 aa, Homo Sapiens
ALINNIVEI

SEQ ID NO: 7486 - protein, 9 aa, Homo Sapiens
ALINVLNAL

SEQ ID NO: 7487 - protein, 9 aa, Homo Sapiens
ALIPDLNQI

SEQ ID NO: 7488 - protein, 9 aa, Homo Sapiens
ALIPVINKL

SEQ ID NO: 7489 - protein, 9 aa, Homo Sapiens
ALIQGLKET

SEQ ID NO: 7490 - protein, 9 aa, Homo Sapiens
ALIQQATTV

SEQ ID NO: 7491 - protein, 9 aa, Homo Sapiens
ALIRVISKL

SEQ ID NO: 7492 - protein, 9 aa, Homo Sapiens
ALISQVLEA

SEQ ID NO: 7493 - protein, 9 aa, Homo Sapiens
ALITRIFGV

SEQ ID NO: 7494 - protein, 9 aa, Homo Sapiens
ALKAIVNVI

SEQ ID NO: 7495 - protein, 9 aa, Homo Sapiens
ALKALLRSL

SEQ ID NO: 7496 - protein, 9 aa, Homo Sapiens
ALKATLVES

SEQ ID NO: 7497 - protein, 9 aa, Homo Sapiens
ALKAVLVDL

SEQ ID NO: 7498 - protein, 9 aa, Homo Sapiens
ALKDAMLEL

SEQ ID NO: 7499 - protein, 9 aa, Homo Sapiens
ALKDEVQEL

SEQ ID NO: 7500 - protein, 9 aa, Homo Sapiens
ALKDFVASI

SEQ ID NO: 7501 - protein, 9 aa, Homo Sapiens
ALKDIVINA

SEQ ID NO: 7502 - protein, 9 aa, Homo Sapiens
ALKDLINEA

SEQ ID NO: 7503 - protein, 9 aa, Homo Sapiens
ALKDPVHTV

SEQ ID NO: 7504 - protein, 9 aa, Homo Sapiens
ALKDSILKI

SEQ ID NO: 7505 - protein, 9 aa, Homo Sapiens
ALKDTIGKL

SEQ ID NO: 7506 - protein, 9 aa, Homo Sapiens
ALKEAGVFV

SEQ ID NO: 7507 - protein, 9 aa, Homo Sapiens
ALKECIRAL

SEQ ID NO: 7508 - protein, 9 aa, Homo Sapiens
ALKEIKAEV

SEQ ID NO: 7509 - protein, 9 aa, Homo Sapiens
ALKEIQAEV

SEQ ID NO: 7510 - protein, 9 aa, Homo Sapiens
ALKEITRQL

SEQ ID NO: 7511 - protein, 9 aa, Homo Sapiens
ALKEKIHEL

SEQ ID NO: 7512 - protein, 9 aa, Homo Sapiens
ALKEKVTSL

SEQ ID NO: 7513 - protein, 9 aa, Homo Sapiens
ALKELVSTI

SEQ ID NO: 7514 - protein, 9 aa, Homo Sapiens
ALKGHLYAV

SEQ ID NO: 7515 - protein, 9 aa, Homo Sapiens
ALKKEVGDI

SEQ ID NO: 7516 - protein, 9 aa, Homo Sapiens
ALKKNLEKI

SEQ ID NO: 7517 - protein, 9 aa, Homo Sapiens
ALKKVIIMI

SEQ ID NO: 7518 - protein, 9 aa, Homo Sapiens
ALKLFLREL

SEQ ID NO: 7519 - protein, 9 aa, Homo Sapiens
ALKLRVAVL

SEQ ID NO: 7520 - protein, 9 aa, Homo Sapiens
ALKLVITAL

SEQ ID NO: 7521 - protein, 9 aa, Homo Sapiens
ALKNDLVEA

SEQ ID NO: 7522 - protein, 9 aa, Homo Sapiens
ALKPDLVNV

SEQ ID NO: 7523 - protein, 9 aa, Homo Sapiens
ALKPEVDKL

SEQ ID NO: 7524 - protein, 9 aa, Homo Sapiens
ALKPFLPQL

SEQ ID NO: 7525 - protein, 9 aa, Homo Sapiens
ALKPQVSSI

SEQ ID NO: 7526 - protein, 9 aa, Homo Sapiens
ALKSLLQEA

SEQ ID NO: 7527 - protein, 9 aa, Homo Sapiens
ALLDRIVSV

SEQ ID NO: 7528 - protein, 9 aa, Homo Sapiens
ALLDWVTSV

SEQ ID NO: 7529 - protein, 9 aa, Homo Sapiens
ALLEKPGEL

SEQ ID NO: 7530 - protein, 9 aa, Homo Sapiens
ALLNILSEV

SEQ ID NO: 7531 - protein, 9 aa, Homo Sapiens
ALMADMVYV

SEQ ID NO: 7532 - protein, 9 aa, Homo Sapiens
ALMPVLNQV

SEQ ID NO: 7533 - protein, 9 aa, Homo Sapiens
ALNEHMTSL

SEQ ID NO: 7534 - protein, 9 aa, Homo Sapiens
ALNEKLVNL

SEQ ID NO: 7535 - protein, 9 aa, Homo Sapiens
ALNELLQHV

SEQ ID NO: 7536 - protein, 9 aa, Homo Sapiens
ALNENINQV

SEQ ID NO: 7537 - protein, 9 aa, Homo Sapiens
ALNEQIARL

SEQ ID NO: 7538 - protein, 9 aa, Homo Sapiens
ALNFIISYL

SEQ ID NO: 7539 - protein, 9 aa, Homo Sapiens
ALNGHVEMV

SEQ ID NO: 7540 - protein, 9 aa, Homo Sapiens
ALNGKLYIV

SEQ ID NO: 7541 - protein, 9 aa, Homo Sapiens
ALNLYMHQV

SEQ ID NO: 7542 - protein, 9 aa, Homo Sapiens
ALNNHVEVA

SEQ ID NO: 7543 - protein, 9 aa, Homo Sapiens
ALNPEIVSV

SEQ ID NO: 7544 - protein, 9 aa, Homo Sapiens
ALNPKLTVI

SEQ ID NO: 7545 - protein, 9 aa, Homo Sapiens
ALNRSVQVV

SEQ ID NO: 7546 - protein, 9 aa, Homo Sapiens
ALNSGILTI

SEQ ID NO: 7547 - protein, 9 aa, Homo Sapiens
ALNSKILSV

SEQ ID NO: 7548 - protein, 9 aa, Homo Sapiens
ALPARLTQV

SEQ ID NO: 7549 - protein, 9 aa, Homo Sapiens
ALPEERLSV

SEQ ID NO: 7550 - protein, 9 aa, Homo Sapiens
ALPPVLTTV

SEQ ID NO: 7551 - protein, 9 aa, Homo Sapiens
ALQDFLLSV

SEQ ID NO: 7552 - protein, 9 aa, Homo Sapiens
ALQEKVQAV

SEQ ID NO: 7553 - protein, 9 aa, Homo Sapiens
ALQPHLAAI

SEQ ID NO: 7554 - protein, 9 aa, Homo Sapiens
ALRAGLTLA

SEQ ID NO: 7555 - protein, 9 aa, Homo Sapiens
ALRAQLHQL

SEQ ID NO: 7556 - protein, 9 aa, Homo Sapiens
ALRDMLDQV

SEQ ID NO: 7557 - protein, 9 aa, Homo Sapiens
ALRDQIPEL

SEQ ID NO: 7558 - protein, 9 aa, Homo Sapiens
ALRDVIKAL

SEQ ID NO: 7559 - protein, 9 aa, Homo Sapiens
ALRETVNAL

SEQ ID NO: 7560 - protein, 9 aa, Homo Sapiens
ALRETVVEV

SEQ ID NO: 7561 - protein, 9 aa, Homo Sapiens
ALRGEIETV

SEQ ID NO: 7562 - protein, 9 aa, Homo Sapiens
ALRKEIKQL

SEQ ID NO: 7563 - protein, 9 aa, Homo Sapiens
ALRNWVFQV

SEQ ID NO: 7564 - protein, 9 aa, Homo Sapiens
ALRPGVTGA

SEQ ID NO: 7565 - protein, 9 aa, Homo Sapiens
ALRPSVVSI

SEQ ID NO: 7566 - protein, 9 aa, Homo Sapiens
ALRSFLQAL

SEQ ID NO: 7567 - protein, 9 aa, Homo Sapiens
ALRSILRQI

SEQ ID NO: 7568 - protein, 9 aa, Homo Sapiens
ALRSKLVRL

SEQ ID NO: 7569 - protein, 9 aa, Homo Sapiens
ALRSNLRTV

SEQ ID NO: 7570 - protein, 9 aa, Homo Sapiens
ALRSSPLTV

SEQ ID NO: 7571 - protein, 9 aa, Homo Sapiens
ALRVFVESV

SEQ ID NO: 7572 - protein, 9 aa, Homo Sapiens
ALRVLLVQV

SEQ ID NO: 7573 - protein, 9 aa, Homo Sapiens
ALRVVVALV

SEQ ID NO: 7574 - protein, 9 aa, Homo Sapiens
ALSALTARL

SEQ ID NO: 7575 - protein, 9 aa, Homo Sapiens
ALSASLARV

SEQ ID NO: 7576 - protein, 9 aa, Homo Sapiens
ALSDIFQAV

SEQ ID NO: 7577 - protein, 9 aa, Homo Sapiens
ALSDLEITL

SEQ ID NO: 7578 - protein, 9 aa, Homo Sapiens
ALSDSIHTV

SEQ ID NO: 7579 - protein, 9 aa, Homo Sapiens
ALSEKIVSV

SEQ ID NO: 7580 - protein, 9 aa, Homo Sapiens
ALSEKLARL

SEQ ID NO: 7581 - protein, 9 aa, Homo Sapiens
ALSELATAV

SEQ ID NO: 7582 - protein, 9 aa, Homo Sapiens
ALSELIILT

SEQ ID NO: 7583 - protein, 9 aa, Homo Sapiens
ALSGHLETV

SEQ ID NO: 7584 - protein, 9 aa, Homo Sapiens
ALSGHLGEV

SEQ ID NO: 7585 - protein, 9 aa, Homo Sapiens
ALSGHVSTV

SEQ ID NO: 7586 - protein, 9 aa, Homo Sapiens
ALSNHLNAV

SEQ ID NO: 7587 - protein, 9 aa, Homo Sapiens
ALSNLEVKL

SEQ ID NO: 7588 - protein, 9 aa, Homo Sapiens
ALSPHNILL

SEQ ID NO: 7589 - protein, 9 aa, Homo Sapiens
ALSQINTKL

SEQ ID NO: 7590 - protein, 9 aa, Homo Sapiens
ALSQLVPCV

SEQ ID NO: 7591 - protein, 9 aa, Homo Sapiens
ALSQRTITV

SEQ ID NO: 7592 - protein, 9 aa, Homo Sapiens
ALSSLIHAL

SEQ ID NO: 7593 - protein, 9 aa, Homo Sapiens
ALTALISQV

SEQ ID NO: 7594 - protein, 9 aa, Homo Sapiens
ALTDFVRSV

SEQ ID NO: 7595 - protein, 9 aa, Homo Sapiens
ALTELLAKI

SEQ ID NO: 7596 - protein, 9 aa, Homo Sapiens
ALTLNLTEV

SEQ ID NO: 7597 - protein, 9 aa, Homo Sapiens
ALTRALALA

SEQ ID NO: 7598 - protein, 9 aa, Homo Sapiens
ALTSLLKTV

SEQ ID NO: 7599 - protein, 9 aa, Homo Sapiens
ALVDHVAEL

SEQ ID NO: 7600 - protein, 9 aa, Homo Sapiens
ALVEKLESL

SEQ ID NO: 7601 - protein, 9 aa, Homo Sapiens
ALVLLLTEV

SEQ ID NO: 7602 - protein, 9 aa, Homo Sapiens
ALVLNLLQI

SEQ ID NO: 7603 - protein, 9 aa, Homo Sapiens
ALVQDLAKA

SEQ ID NO: 7604 - protein, 9 aa, Homo Sapiens
ALVSTIQFV

SEQ ID NO: 7605 - protein, 9 aa, Homo Sapiens
ALYGKLLKL

SEQ ID NO: 7606 - protein, 9 aa, Homo Sapiens
ALYNHISEL

SEQ ID NO: 7607 - protein, 9 aa, Homo Sapiens
ALYNWLIQV

SEQ ID NO: 7608 - protein, 9 aa, Homo Sapiens
ALYPNVVQV

SEQ ID NO: 7609 - protein, 9 aa, Homo Sapiens
ALYPVLEKA

SEQ ID NO: 7610 - protein, 9 aa, Homo Sapiens
ALYSELLAV

SEQ ID NO: 7611 - protein, 9 aa, Homo Sapiens
ALYTVIETV

SEQ ID NO: 7612 - protein, 9 aa, Homo Sapiens
ALYVAVVNV

SEQ ID NO: 7613 - protein, 9 aa, Homo Sapiens
AMAASPHAV

SEQ ID NO: 7614 - protein, 9 aa, Homo Sapiens
AMAAVPAKV

SEQ ID NO: 7615 - protein, 9 aa, Homo Sapiens
AMAEMVLQV

SEQ ID NO: 7616 - protein, 9 aa, Homo Sapiens
AMAETLKTL

SEQ ID NO: 7617 - protein, 9 aa, Homo Sapiens
AMAPGTVTV

SEQ ID NO: 7618 - protein, 9 aa, Homo Sapiens
AMFGKLMTI

SEQ ID NO: 7619 - protein, 9 aa, Homo Sapiens
AMIDQVLEL

SEQ ID NO: 7620 - protein, 9 aa, Homo Sapiens
AMIERITFI

SEQ ID NO: 7621 - protein, 9 aa, Homo Sapiens
AMINRFQFV

SEQ ID NO: 7622 - protein, 9 aa, Homo Sapiens
AMKDTLTNI

SEQ ID NO: 7623 - protein, 9 aa, Homo Sapiens
AMKDVLLPL

SEQ ID NO: 7624 - protein, 9 aa, Homo Sapiens
AMKEALVQV

SEQ ID NO: 7625 - protein, 9 aa, Homo Sapiens
AMKKVVQQL

SEQ ID NO: 7626 - protein, 9 aa, Homo Sapiens
AMKPKPLSV

SEQ ID NO: 7627 - protein, 9 aa, Homo Sapiens
AMNDILAQV

SEQ ID NO: 7628 - protein, 9 aa, Homo Sapiens
AMNGHVPAV

SEQ ID NO: 7629 - protein, 9 aa, Homo Sapiens
AMNGKSFSV

SEQ ID NO: 7630 - protein, 9 aa, Homo Sapiens
AMNRFIGAV

SEQ ID NO: 7631 - protein, 9 aa, Homo Sapiens
AMNSQILEV

SEQ ID NO: 7632 - protein, 9 aa, Homo Sapiens
AMQDRYMEV

SEQ ID NO: 7633 - protein, 9 aa, Homo Sapiens
AMQEYIAVV

SEQ ID NO: 7634 - protein, 9 aa, Homo Sapiens
AMQSRLATL

SEQ ID NO: 7635 - protein, 9 aa, Homo Sapiens
AMREEVRQL

SEQ ID NO: 7636 - protein, 9 aa, Homo Sapiens
AMRKLVRSV

SEQ ID NO: 7637 - protein, 9 aa, Homo Sapiens
AMYTLPRQA

SEQ ID NO: 7638 - protein, 9 aa, Homo Sapiens
AMYVYPPNV

SEQ ID NO: 7639 - protein, 9 aa, Homo Sapiens
AQHENVPFI

SEQ ID NO: 7640 - protein, 9 aa, Homo Sapiens
AQHPNIVTV

SEQ ID NO: 7641 - protein, 9 aa, Homo Sapiens
AQIDHYLGL

SEQ ID NO: 7642 - protein, 9 aa, Homo Sapiens
AQIEVVPSA

SEQ ID NO: 7643 - protein, 9 aa, Homo Sapiens
AQIGWIQTV

SEQ ID NO: 7644 - protein, 9 aa, Homo Sapiens
AQILQILTV

SEQ ID NO: 7645 - protein, 9 aa, Homo Sapiens
AQKKLISQV

SEQ ID NO: 7646 - protein, 9 aa, Homo Sapiens
ATIGELAQV

SEQ ID NO: 7647 - protein, 9 aa, Homo Sapiens
ATKGRILTV

SEQ ID NO: 7648 - protein, 9 aa, Homo Sapiens
AVAAVLTQV

SEQ ID NO: 7649 - protein, 9 aa, Homo Sapiens
AVADLQTRL

SEQ ID NO: 7650 - protein, 9 aa, Homo Sapiens
AVANIVNSV

SEQ ID NO: 7651 - protein, 9 aa, Homo Sapiens
AVATFLQSV

SEQ ID NO: 7652 - protein, 9 aa, Homo Sapiens
AVIGLTKSV

SEQ ID NO: 7653 - protein, 9 aa, Homo Sapiens
AVIHYLLQV

SEQ ID NO: 7654 - protein, 9 aa, Homo Sapiens
AVINRVQKV

SEQ ID NO: 7655 - protein, 9 aa, Homo Sapiens
AVITKVKGV

SEQ ID NO: 7656 - protein, 9 aa, Homo Sapiens
AVLTLFTPI

SEQ ID NO: 7657 - protein, 9 aa, Homo Sapiens
AVRDGLRAV

SEQ ID NO: 7658 - protein, 9 aa, Homo Sapiens
AVSDHISKV

SEQ ID NO: 7659 - protein, 9 aa, Homo Sapiens
AVYERVTTI

SEQ ID NO: 7660 - protein, 9 aa, Homo Sapiens
CLADAVVKI

SEQ ID NO: 7661 - protein, 9 aa, Homo Sapiens
CLAVAVGHV

SEQ ID NO: 7662 - protein, 9 aa, Homo Sapiens
CLRPALYEV

SEQ ID NO: 7663 - protein, 9 aa, Homo Sapiens
CLYGNVEKV

SEQ ID NO: 7664 - protein, 9 aa, Homo Sapiens
DTISLSMFV

SEQ ID NO: 7665 - protein, 9 aa, Homo Sapiens
ELAERVPAI

SEQ ID NO: 7666 - protein, 9 aa, Homo Sapiens
ELANKLITV

SEQ ID NO: 7667 - protein, 9 aa, Homo Sapiens
FIAEHYMFL

SEQ ID NO: 7668 - protein, 9 aa, Homo Sapiens
FIAPVTLKV

SEQ ID NO: 7669 - protein, 9 aa, Homo Sapiens
FIAQKILAL

SEQ ID NO: 7670 - protein, 9 aa, Homo Sapiens
FIIGRVIKA

SEQ ID NO: 7671 - protein, 9 aa, Homo Sapiens
FIINGIEKV

SEQ ID NO: 7672 - protein, 9 aa, Homo Sapiens
FIIQGLRSV

SEQ ID NO: 7673 - protein, 9 aa, Homo Sapiens
FIKQILDGV

SEQ ID NO: 7674 - protein, 9 aa, Homo Sapiens
FIMEGGAMV

SEQ ID NO: 7675 - protein, 9 aa, Homo Sapiens
FINSRIITV

SEQ ID NO: 7676 - protein, 9 aa, Homo Sapiens
FIQSIISTV

SEQ ID NO: 7677 - protein, 9 aa, Homo Sapiens
FIREHIEEL

SEQ ID NO: 7678 - protein, 9 aa, Homo Sapiens
FIRELISNA

SEQ ID NO: 7679 - protein, 9 aa, Homo Sapiens
FISEPARTV

SEQ ID NO: 7680 - protein, 9 aa, Homo Sapiens
FISGHTSEL

SEQ ID NO: 7681 - protein, 9 aa, Homo Sapiens
FISSSILYV

SEQ ID NO: 7682 - protein, 9 aa, Homo Sapiens
FLADIVQKL

SEQ ID NO: 7683 - protein, 9 aa, Homo Sapiens
FLADPSAFV

SEQ ID NO: 7684 - protein, 9 aa, Homo Sapiens
FLAEAARSL

SEQ ID NO: 7685 - protein, 9 aa, Homo Sapiens
FLAELPGSL

SEQ ID NO: 7686 - protein, 9 aa, Homo Sapiens
FLAGAVTSV

SEQ ID NO: 7687 - protein, 9 aa, Homo Sapiens
FLAGEIRET

SEQ ID NO: 7688 - protein, 9 aa, Homo Sapiens
FLAKLIAQA

SEQ ID NO: 7689 - protein, 9 aa, Homo Sapiens
FLANIGTSV

SEQ ID NO: 7690 - protein, 9 aa, Homo Sapiens
FLANLHITA

SEQ ID NO: 7691 - protein, 9 aa, Homo Sapiens
FLANVSTVL

SEQ ID NO: 7692 - protein, 9 aa, Homo Sapiens
FLAPLLAKL

SEQ ID NO: 7693 - protein, 9 aa, Homo Sapiens
FLAPRLLSL

SEQ ID NO: 7694 - protein, 9 aa, Homo Sapiens
FLAPWATIA

SEQ ID NO: 7695 - protein, 9 aa, Homo Sapiens
FLAQRAVEL

SEQ ID NO: 7696 - protein, 9 aa, Homo Sapiens
FLAVKPDGV

SEQ ID NO: 7697 - protein, 9 aa, Homo Sapiens
FLAVRVQQV

SEQ ID NO: 7698 - protein, 9 aa, Homo Sapiens
FLAVSLVKV

SEQ ID NO: 7699 - protein, 9 aa, Homo Sapiens
FLAYAIRAA

SEQ ID NO: 7700 - protein, 9 aa, Homo Sapiens
FLEKLLPPV

SEQ ID NO: 7701 - protein, 9 aa, Homo Sapiens
FLEVRVAVV

SEQ ID NO: 7702 - protein, 9 aa, Homo Sapiens
FLFDHLLTL

SEQ ID NO: 7703 - protein, 9 aa, Homo Sapiens
FLFDRPMHV

SEQ ID NO: 7704 - protein, 9 aa, Homo Sapiens
FLFELPSRL

SEQ ID NO: 7705 - protein, 9 aa, Homo Sapiens
FLFEPVVKA

SEQ ID NO: 7706 - protein, 9 aa, Homo Sapiens
FLFGEVHKA

SEQ ID NO: 7707 - protein, 9 aa, Homo Sapiens
FLFGLPLGV

SEQ ID NO: 7708 - protein, 9 aa, Homo Sapiens
FLFGSIRGA

SEQ ID NO: 7709 - protein, 9 aa, Homo Sapiens
FLFGYPKRL

SEQ ID NO: 7710 - protein, 9 aa, Homo Sapiens
FLFNKVVNL

SEQ ID NO: 7711 - protein, 9 aa, Homo Sapiens
FLFNLPLNI

SEQ ID NO: 7712 - protein, 9 aa, Homo Sapiens
FLFPHSVLV

SEQ ID NO: 7713 - protein, 9 aa, Homo Sapiens
FLFQEPRSI

SEQ ID NO: 7714 - protein, 9 aa, Homo Sapiens
FLFQGFRLV

SEQ ID NO: 7715 - protein, 9 aa, Homo Sapiens
FLFTTPCRL

SEQ ID NO: 7716 - protein, 9 aa, Homo Sapiens
FLGEKIASV

SEQ ID NO: 7717 - protein, 9 aa, Homo Sapiens
FLGKLTIPV

SEQ ID NO: 7718 - protein, 9 aa, Homo Sapiens
FLGPWPAAS

SEQ ID NO: 7719 - protein, 9 aa, Homo Sapiens
FLGVIPQFV

SEQ ID NO: 7720 - protein, 9 aa, Homo Sapiens
FLHARLRTA

SEQ ID NO: 7721 - protein, 9 aa, Homo Sapiens
FLHDNMVEI

SEQ ID NO: 7722 - protein, 9 aa, Homo Sapiens
FLHSSVKMV

SEQ ID NO: 7723 - protein, 9 aa, Homo Sapiens
FLHTLVPFL

SEQ ID NO: 7724 - protein, 9 aa, Homo Sapiens
FLIAALDVL

SEQ ID NO: 7725 - protein, 9 aa, Homo Sapiens
FLIEEQKIV

SEQ ID NO: 7726 - protein, 9 aa, Homo Sapiens
FLIGGLLRI

SEQ ID NO: 7727 - protein, 9 aa, Homo Sapiens
FLIGQGAHV

SEQ ID NO: 7728 - protein, 9 aa, Homo Sapiens
FLINFIHTL

SEQ ID NO: 7729 - protein, 9 aa, Homo Sapiens
FLIPFVITV

SEQ ID NO: 7730 - protein, 9 aa, Homo Sapiens
FLIPIYHQV

SEQ ID NO: 7731 - protein, 9 aa, Homo Sapiens
FLIPVLNGL

SEQ ID NO: 7732 - protein, 9 aa, Homo Sapiens
FLIQNVLRL

SEQ ID NO: 7733 - protein, 9 aa, Homo Sapiens
FLISKGANV

SEQ ID NO: 7734 - protein, 9 aa, Homo Sapiens
FLISRLIKL

SEQ ID NO: 7735 - protein, 9 aa, Homo Sapiens
FLITILDHL

SEQ ID NO: 7736 - protein, 9 aa, Homo Sapiens
FLKADVVFL

SEQ ID NO: 7737 - protein, 9 aa, Homo Sapiens
FLKANILGL

SEQ ID NO: 7738 - protein, 9 aa, Homo Sapiens
FLKAWLEYL

SEQ ID NO: 7739 - protein, 9 aa, Homo Sapiens
FLKDISTTL

SEQ ID NO: 7740 - protein, 9 aa, Homo Sapiens
FLKDKFVEI

SEQ ID NO: 7741 - protein, 9 aa, Homo Sapiens
FLKDLVASV

SEQ ID NO: 7742 - protein, 9 aa, Homo Sapiens
FLKEPILNI

SEQ ID NO: 7743 - protein, 9 aa, Homo Sapiens
FLKEQMILV

SEQ ID NO: 7744 - protein, 9 aa, Homo Sapiens
FLKESSKVV

SEQ ID NO: 7745 - protein, 9 aa, Homo Sapiens
FLKGFLTEV

SEQ ID NO: 7746 - protein, 9 aa, Homo Sapiens
FLKGGALGV

SEQ ID NO: 7747 - protein, 9 aa, Homo Sapiens
FLKIDVPTA

SEQ ID NO: 7748 - protein, 9 aa, Homo Sapiens
FLKIIHTSV

SEQ ID NO: 7749 - protein, 9 aa, Homo Sapiens
FLKINVSEL

SEQ ID NO: 7750 - protein, 9 aa, Homo Sapiens
FLKNELDNV

SEQ ID NO: 7751 - protein, 9 aa, Homo Sapiens
FLKNEVERL

SEQ ID NO: 7752 - protein, 9 aa, Homo Sapiens
FLKNEVVKA

SEQ ID NO: 7753 - protein, 9 aa, Homo Sapiens
FLKNYLTNL

SEQ ID NO: 7754 - protein, 9 aa, Homo Sapiens
FLKPGILTG

SEQ ID NO: 7755 - protein, 9 aa, Homo Sapiens
FLKVDLLLV

SEQ ID NO: 7756 - protein, 9 aa, Homo Sapiens
FLLEGIRSL

SEQ ID NO: 7757 - protein, 9 aa, Homo Sapiens
FLLEKPFSV

SEQ ID NO: 7758 - protein, 9 aa, Homo Sapiens
FLLPILSQI

SEQ ID NO: 7759 - protein, 9 aa, Homo Sapiens
FLMDFIHQV

SEQ ID NO: 7760 - protein, 9 aa, Homo Sapiens
FLNEIQQSI

SEQ ID NO: 7761 - protein, 9 aa, Homo Sapiens
FLNELIKVL

SEQ ID NO: 7762 - protein, 9 aa, Homo Sapiens
FLNGLEILL

SEQ ID NO: 7763 - protein, 9 aa, Homo Sapiens
FLNKEILEL

SEQ ID NO: 7764 - protein, 9 aa, Homo Sapiens
FLNKEITSV

SEQ ID NO: 7765 - protein, 9 aa, Homo Sapiens
FLNKLIPVL

SEQ ID NO: 7766 - protein, 9 aa, Homo Sapiens
FLNLGIEQV

SEQ ID NO: 7767 - protein, 9 aa, Homo Sapiens
FLNNQIKEL

SEQ ID NO: 7768 - protein, 9 aa, Homo Sapiens
FLNPAQRAL

SEQ ID NO: 7769 - protein, 9 aa, Homo Sapiens
FLNPGILEA

SEQ ID NO: 7770 - protein, 9 aa, Homo Sapiens
FLPAGIVAV

SEQ ID NO: 7771 - protein, 9 aa, Homo Sapiens
FLPEAPAEL

SEQ ID NO: 7772 - protein, 9 aa, Homo Sapiens
FLPEPMGTA

SEQ ID NO: 7773 - protein, 9 aa, Homo Sapiens
FLPESVAVV

SEQ ID NO: 7774 - protein, 9 aa, Homo Sapiens
FLPIHLLGL

SEQ ID NO: 7775 - protein, 9 aa, Homo Sapiens
FLPLIVNTV

SEQ ID NO: 7776 - protein, 9 aa, Homo Sapiens
FLPSFLSYI

SEQ ID NO: 7777 - protein, 9 aa, Homo Sapiens
FLQEHNTTL

SEQ ID NO: 7778 - protein, 9 aa, Homo Sapiens
FLQEYGLSV

SEQ ID NO: 7779 - protein, 9 aa, Homo Sapiens
FLQPHLDAV

SEQ ID NO: 7780 - protein, 9 aa, Homo Sapiens
FLQTKIATL

SEQ ID NO: 7781 - protein, 9 aa, Homo Sapiens
FLRDNLEWL

SEQ ID NO: 7782 - protein, 9 aa, Homo Sapiens
FLRERLFEA

SEQ ID NO: 7783 - protein, 9 aa, Homo Sapiens
FLREWVESM

SEQ ID NO: 7784 - protein, 9 aa, Homo Sapiens
FLREYFERL

SEQ ID NO: 7785 - protein, 9 aa, Homo Sapiens
FLRPMLQYV

SEQ ID NO: 7786 - protein, 9 aa, Homo Sapiens
FLRSDLIEV

SEQ ID NO: 7787 - protein, 9 aa, Homo Sapiens
FLRSLLGSI

SEQ ID NO: 7788 - protein, 9 aa, Homo Sapiens
FLSAIVSSV

SEQ ID NO: 7789 - protein, 9 aa, Homo Sapiens
FLSEKDSLL

SEQ ID NO: 7790 - protein, 9 aa, Homo Sapiens
FLSEKLERI

SEQ ID NO: 7791 - protein, 9 aa, Homo Sapiens
FLSELQYYL

SEQ ID NO: 7792 - protein, 9 aa, Homo Sapiens
FLSELTQQL

SEQ ID NO: 7793 - protein, 9 aa, Homo Sapiens
FLSLINVGL

SEQ ID NO: 7794 - protein, 9 aa, Homo Sapiens
FLSPLLPLL

SEQ ID NO: 7795 - protein, 9 aa, Homo Sapiens
FLSPLLTLL

SEQ ID NO: 7796 - protein, 9 aa, Homo Sapiens
FLSQTGHGV

SEQ ID NO: 7797 - protein, 9 aa, Homo Sapiens
FLSSVIQNL

SEQ ID NO: 7798 - protein, 9 aa, Homo Sapiens
FLTEFINYI

SEQ ID NO: 7799 - protein, 9 aa, Homo Sapiens
FLTKKLREI

SEQ ID NO: 7800 - protein, 9 aa, Homo Sapiens
FLTVTGKTV

SEQ ID NO: 7801 - protein, 9 aa, Homo Sapiens
FLVERLLHI

SEQ ID NO: 7802 - protein, 9 aa, Homo Sapiens
FLVPVLEAL

SEQ ID NO: 7803 - protein, 9 aa, Homo Sapiens
FLVQNIHTL

SEQ ID NO: 7804 - protein, 9 aa, Homo Sapiens
FLVTVIHTL

SEQ ID NO: 7805 - protein, 9 aa, Homo Sapiens
FLYPFLHTV

SEQ ID NO: 7806 - protein, 9 aa, Homo Sapiens
FLYPFPLAL

SEQ ID NO: 7807 - protein, 9 aa, Homo Sapiens
FLYQILRGL

SEQ ID NO: 7808 - protein, 9 aa, Homo Sapiens
FLYWHLEDL

SEQ ID NO: 7809 - protein, 9 aa, Homo Sapiens
FMAEIRQYI

SEQ ID NO: 7810 - protein, 9 aa, Homo Sapiens
FMASQMLKV

SEQ ID NO: 7811 - protein, 9 aa, Homo Sapiens
FMKKYIHVA

SEQ ID NO: 7812 - protein, 9 aa, Homo Sapiens
FMKPGTLYV

SEQ ID NO: 7813 - protein, 9 aa, Homo Sapiens
FMMPRIVNV

SEQ ID NO: 7814 - protein, 9 aa, Homo Sapiens
FMNDAIEKA

SEQ ID NO: 7815 - protein, 9 aa, Homo Sapiens
FMNPHLISV

SEQ ID NO: 7816 - protein, 9 aa, Homo Sapiens
FMNSVIQSL

SEQ ID NO: 7817 - protein, 9 aa, Homo Sapiens
FMSSHIKSV

SEQ ID NO: 7818 - protein, 9 aa, Homo Sapiens
FMTTNVPNV

SEQ ID NO: 7819 - protein, 9 aa, Homo Sapiens
FMVDRVVDL

SEQ ID NO: 7820 - protein, 9 aa, Homo Sapiens
FQHGVIAAV

SEQ ID NO: 7821 - protein, 9 aa, Homo Sapiens
FQIGKMRYV

SEQ ID NO: 7822 - protein, 9 aa, Homo Sapiens
FQIGPVAGV

SEQ ID NO: 7823 - protein, 9 aa, Homo Sapiens
FQKIQVRLV

SEQ ID NO: 7824 - protein, 9 aa, Homo Sapiens
FQRPNALAV

SEQ ID NO: 7825 - protein, 9 aa, Homo Sapiens
FQRPTIYYV

SEQ ID NO: 7826 - protein, 9 aa, Homo Sapiens
FSPFHASVL

SEQ ID NO: 7827 - protein, 9 aa, Homo Sapiens
FSSPHLVQV

SEQ ID NO: 7828 - protein, 9 aa, Homo Sapiens
FTAAIISRV

SEQ ID NO: 7829 - protein, 9 aa, Homo Sapiens
FTHDWMVFV

SEQ ID NO: 7830 - protein, 9 aa, Homo Sapiens
FTIFRTISV

SEQ ID NO: 7831 - protein, 9 aa, Homo Sapiens
FTNVVKTTV

SEQ ID NO: 7832 - protein, 9 aa, Homo Sapiens
FTSPFCLQV

SEQ ID NO: 7833 - protein, 9 aa, Homo Sapiens
FTVPRVVAV

SEQ ID NO: 7834 - protein, 9 aa, Homo Sapiens
FVADRLRAV

SEQ ID NO: 7835 - protein, 9 aa, Homo Sapiens
FVAKHLKTI

SEQ ID NO: 7836 - protein, 9 aa, Homo Sapiens
FVFKEPQQV

SEQ ID NO: 7837 - protein, 9 aa, Homo Sapiens
FVIAELVNV

SEQ ID NO: 7838 - protein, 9 aa, Homo Sapiens
FVIGHLKGA

SEQ ID NO: 7839 - protein, 9 aa, Homo Sapiens
FVIRNIVEA

SEQ ID NO: 7840 - protein, 9 aa, Homo Sapiens
FVKDSIRLV

SEQ ID NO: 7841 - protein, 9 aa, Homo Sapiens
FVKPAVVTV

SEQ ID NO: 7842 - protein, 9 aa, Homo Sapiens
FVNEIISRI

SEQ ID NO: 7843 - protein, 9 aa, Homo Sapiens
FVRDMIREV

SEQ ID NO: 7844 - protein, 9 aa, Homo Sapiens
FVYFIVREV

SEQ ID NO: 7845 - protein, 9 aa, Homo Sapiens
FVYNLPHTV

SEQ ID NO: 7846 - protein, 9 aa, Homo Sapiens
GFTIILSGL

SEQ ID NO: 7847 - protein, 9 aa, Homo Sapiens
GITDHIVQV

SEQ ID NO: 7848 - protein, 9 aa, Homo Sapiens
GLAAFLKAI

SEQ ID NO: 7849 - protein, 9 aa, Homo Sapiens
GLAAFRAFL

SEQ ID NO: 7850 - protein, 9 aa, Homo Sapiens
GLAAKLMEL

SEQ ID NO: 7851 - protein, 9 aa, Homo Sapiens
GLAARMSQV

SEQ ID NO: 7852 - protein, 9 aa, Homo Sapiens
GLADITQQL

SEQ ID NO: 7853 - protein, 9 aa, Homo Sapiens
GLAEFQSPL

SEQ ID NO: 7854 - protein, 9 aa, Homo Sapiens
GLAEKIRAC

SEQ ID NO: 7855 - protein, 9 aa, Homo Sapiens
GLAERISVL

SEQ ID NO: 7856 - protein, 9 aa, Homo Sapiens
GLAESVSTL

SEQ ID NO: 7857 - protein, 9 aa, Homo Sapiens
GLAFSLNGV

SEQ ID NO: 7858 - protein, 9 aa, Homo Sapiens
GLAGFFASV

SEQ ID NO: 7859 - protein, 9 aa, Homo Sapiens
GLAGPVRGV

SEQ ID NO: 7860 - protein, 9 aa, Homo Sapiens
GLAGSVRGL

SEQ ID NO: 7861 - protein, 9 aa, Homo Sapiens
GLAKAVASV

SEQ ID NO: 7862 - protein, 9 aa, Homo Sapiens
GLAKLIADV

SEQ ID NO: 7863 - protein, 9 aa, Homo Sapiens
GLALLYSGV

SEQ ID NO: 7864 - protein, 9 aa, Homo Sapiens
GLAPGGLAV

SEQ ID NO: 7865 - protein, 9 aa, Homo Sapiens
GLAPHLEQI

SEQ ID NO: 7866 - protein, 9 aa, Homo Sapiens
GLAPKPVQV

SEQ ID NO: 7867 - protein, 9 aa, Homo Sapiens
GLAPLHIQL

SEQ ID NO: 7868 - protein, 9 aa, Homo Sapiens
GLAQFVREI

SEQ ID NO: 7869 - protein, 9 aa, Homo Sapiens
GLAQVITAV

SEQ ID NO: 7870 - protein, 9 aa, Homo Sapiens
GLATDVQTV

SEQ ID NO: 7871 - protein, 9 aa, Homo Sapiens
GLAWIVGRV

SEQ ID NO: 7872 - protein, 9 aa, Homo Sapiens
GLFAGPCKV

SEQ ID NO: 7873 - protein, 9 aa, Homo Sapiens
GLFHFPTPL

SEQ ID NO: 7874 - protein, 9 aa, Homo Sapiens
GLFHHISKL

SEQ ID NO: 7875 - protein, 9 aa, Homo Sapiens
GLFPAPIHV

SEQ ID NO: 7876 - protein, 9 aa, Homo Sapiens
GLFQHICTA

SEQ ID NO: 7877 - protein, 9 aa, Homo Sapiens
GLGPNLVGV

SEQ ID NO: 7878 - protein, 9 aa, Homo Sapiens
GLGPPGRSV

SEQ ID NO: 7879 - protein, 9 aa, Homo Sapiens
GLHANIAVA

SEQ ID NO: 7880 - protein, 9 aa, Homo Sapiens
GLHFKIKPI

SEQ ID NO: 7881 - protein, 9 aa, Homo Sapiens
GLIDHQTYL

SEQ ID NO: 7882 - protein, 9 aa, Homo Sapiens
GLIDKVNEL

SEQ ID NO: 7883 - protein, 9 aa, Homo Sapiens
GLIDRQVTV

SEQ ID NO: 7884 - protein, 9 aa, Homo Sapiens
GLIEIISNA

SEQ ID NO: 7885 - protein, 9 aa, Homo Sapiens
GLIEILKKV

SEQ ID NO: 7886 - protein, 9 aa, Homo Sapiens
GLIENPALL

SEQ ID NO: 7887 - protein, 9 aa, Homo Sapiens
GLIPQLIGV

SEQ ID NO: 7888 - protein, 9 aa, Homo Sapiens
GLIQGVKSV

SEQ ID NO: 7889 - protein, 9 aa, Homo Sapiens
GLISGILRV

SEQ ID NO: 7890 - protein, 9 aa, Homo Sapiens
GLKAFYKGV

SEQ ID NO: 7891 - protein, 9 aa, Homo Sapiens
GLKDAVYFL

SEQ ID NO: 7892 - protein, 9 aa, Homo Sapiens
GLKDGVALL

SEQ ID NO: 7893 - protein, 9 aa, Homo Sapiens
GLKDHIKEI

SEQ ID NO: 7894 - protein, 9 aa, Homo Sapiens
GLKEGIPAL

SEQ ID NO: 7895 - protein, 9 aa, Homo Sapiens
GLKEILPNL

SEQ ID NO: 7896 - protein, 9 aa, Homo Sapiens
GLKELSEYV

SEQ ID NO: 7897 - protein, 9 aa, Homo Sapiens
GLKGRVFEV

SEQ ID NO: 7898 - protein, 9 aa, Homo Sapiens
GLKHDIARV

SEQ ID NO: 7899 - protein, 9 aa, Homo Sapiens
GLKKVIQKV

SEQ ID NO: 7900 - protein, 9 aa, Homo Sapiens
GLKLTLDTI

SEQ ID NO: 7901 - protein, 9 aa, Homo Sapiens
GLKNGVPAV

SEQ ID NO: 7902 - protein, 9 aa, Homo Sapiens
GLKYDVKKV

SEQ ID NO: 7903 - protein, 9 aa, Homo Sapiens
GLLGNVAEV

SEQ ID NO: 7904 - protein, 9 aa, Homo Sapiens
GLLTRLLQV

SEQ ID NO: 7905 - protein, 9 aa, Homo Sapiens
GLMADPMKV

SEQ ID NO: 7906 - protein, 9 aa, Homo Sapiens
GLMDTVKKV

SEQ ID NO: 7907 - protein, 9 aa, Homo Sapiens
GLMRKVPRV

SEQ ID NO: 7908 - protein, 9 aa, Homo Sapiens
GLMTTVHAI

SEQ ID NO: 7909 - protein, 9 aa, Homo Sapiens
GLNEEIARV

SEQ ID NO: 7910 - protein, 9 aa, Homo Sapiens
GLNGHLTKL

SEQ ID NO: 7911 - protein, 9 aa, Homo Sapiens
GLNHWVRAL

SEQ ID NO: 7912 - protein, 9 aa, Homo Sapiens
GLPSFLTEV

SEQ ID NO: 7913 - protein, 9 aa, Homo Sapiens
GLQEYVEAV

SEQ ID NO: 7914 - protein, 9 aa, Homo Sapiens
GLQFPVGRV

SEQ ID NO: 7915 - protein, 9 aa, Homo Sapiens
GLQGRVTTV

SEQ ID NO: 7916 - protein, 9 aa, Homo Sapiens
GLREFVVIA

SEQ ID NO: 7917 - protein, 9 aa, Homo Sapiens
GLRESISKV

SEQ ID NO: 7918 - protein, 9 aa, Homo Sapiens
GLSDLRLEL

SEQ ID NO: 7919 - protein, 9 aa, Homo Sapiens
GLSETILAV

SEQ ID NO: 7920 - protein, 9 aa, Homo Sapiens
GLSFHIASL

SEQ ID NO: 7921 - protein, 9 aa, Homo Sapiens
GLSNFINFI

SEQ ID NO: 7922 - protein, 9 aa, Homo Sapiens
GLSNHIAAL

SEQ ID NO: 7923 - protein, 9 aa, Homo Sapiens
GLSSHVEVV

SEQ ID NO: 7924 - protein, 9 aa, Homo Sapiens
GLSSVVRNV

SEQ ID NO: 7925 - protein, 9 aa, Homo Sapiens
GLTDIRTLV

SEQ ID NO: 7926 - protein, 9 aa, Homo Sapiens
GLTDKVGRV

SEQ ID NO: 7927 - protein, 9 aa, Homo Sapiens
GLTEALHFV

SEQ ID NO: 7928 - protein, 9 aa, Homo Sapiens
GLTEVLKEI

SEQ ID NO: 7929 - protein, 9 aa, Homo Sapiens
GLTPHLTMV

SEQ ID NO: 7930 - protein, 9 aa, Homo Sapiens
GLTSAIQAV

SEQ ID NO: 7931 - protein, 9 aa, Homo Sapiens
GLVGALMHV

SEQ ID NO: 7932 - protein, 9 aa, Homo Sapiens
GLVGSLQEV

SEQ ID NO: 7933 - protein, 9 aa, Homo Sapiens
GLVPFLVSV

SEQ ID NO: 7934 - protein, 9 aa, Homo Sapiens
GLYEGLTWL

SEQ ID NO: 7935 - protein, 9 aa, Homo Sapiens
GLYGLIVAL

SEQ ID NO: 7936 - protein, 9 aa, Homo Sapiens
GLYPAPLKI

SEQ ID NO: 7937 - protein, 9 aa, Homo Sapiens
GLYPKVAKI

SEQ ID NO: 7938 - protein, 9 aa, Homo Sapiens
GLYPNLIQV

SEQ ID NO: 7939 - protein, 9 aa, Homo Sapiens
GLYPSISLL

SEQ ID NO: 7940 - protein, 9 aa, Homo Sapiens
GLYSGVTTV

SEQ ID NO: 7941 - protein, 9 aa, Homo Sapiens
GMAFRVPTA

SEQ ID NO: 7942 - protein, 9 aa, Homo Sapiens
GMASVISRL

SEQ ID NO: 7943 - protein, 9 aa, Homo Sapiens
GMIGLLTFI

SEQ ID NO: 7944 - protein, 9 aa, Homo Sapiens
GMKSIVGEI

SEQ ID NO: 7945 - protein, 9 aa, Homo Sapiens
GMMEALLKV

SEQ ID NO: 7946 - protein, 9 aa, Homo Sapiens
GMYIFLHTV

SEQ ID NO: 7947 - protein, 9 aa, Homo Sapiens
GMYPNLVHV

SEQ ID NO: 7948 - protein, 9 aa, Homo Sapiens
GMYVFLHAV

SEQ ID NO: 7949 - protein, 9 aa, Homo Sapiens
GQIEVVPEV

SEQ ID NO: 7950 - protein, 9 aa, Homo Sapiens
GQISEVVVV

SEQ ID NO: 7951 - protein, 9 aa, Homo Sapiens
GTIGLIHAV

SEQ ID NO: 7952 - protein, 9 aa, Homo Sapiens
GVISKVSTL

SEQ ID NO: 7953 - protein, 9 aa, Homo Sapiens
GVKDKVTLV

SEQ ID NO: 7954 - protein, 9 aa, Homo Sapiens
GVKFNVTTV

SEQ ID NO: 7955 - protein, 9 aa, Homo Sapiens
GVKQLIVGV

SEQ ID NO: 7956 - protein, 9 aa, Homo Sapiens
HIIENIVAV

SEQ ID NO: 7957 - protein, 9 aa, Homo Sapiens
HLAEHSLQV

SEQ ID NO: 7958 - protein, 9 aa, Homo Sapiens
HLAEIFGKV

SEQ ID NO: 7959 - protein, 9 aa, Homo Sapiens
HLAELIAEL

SEQ ID NO: 7960 - protein, 9 aa, Homo Sapiens
HLAGEVLAV

SEQ ID NO: 7961 - protein, 9 aa, Homo Sapiens
HLAIKLEQV

SEQ ID NO: 7962 - protein, 9 aa, Homo Sapiens
HLAKLVSLV

SEQ ID NO: 7963 - protein, 9 aa, Homo Sapiens
HLANIVERV

SEQ ID NO: 7964 - protein, 9 aa, Homo Sapiens
HLAPGLASC

SEQ ID NO: 7965 - protein, 9 aa, Homo Sapiens
HLAPRTPEV

SEQ ID NO: 7966 - protein, 9 aa, Homo Sapiens
HLASIHGYL

SEQ ID NO: 7967 - protein, 9 aa, Homo Sapiens
HLIDFMSEI

SEQ ID NO: 7968 - protein, 9 aa, Homo Sapiens
HLIGDFSKV

SEQ ID NO: 7969 - protein, 9 aa, Homo Sapiens
HLIHEVTKV

SEQ ID NO: 7970 - protein, 9 aa, Homo Sapiens
HLISTINTV

SEQ ID NO: 7971 - protein, 9 aa, Homo Sapiens
HLKDGIMNL

SEQ ID NO: 7972 - protein, 9 aa, Homo Sapiens
HLKDGVPGL

SEQ ID NO: 7973 - protein, 9 aa, Homo Sapiens
HLKDILTSV

SEQ ID NO: 7974 - protein, 9 aa, Homo Sapiens
HLKLFVTRI

SEQ ID NO: 7975 - protein, 9 aa, Homo Sapiens
HLKQQVSGL

SEQ ID NO: 7976 - protein, 9 aa, Homo Sapiens
HLKVHIERV

SEQ ID NO: 7977 - protein, 9 aa, Homo Sapiens
HLRAAVLYV

SEQ ID NO: 7978 - protein, 9 aa, Homo Sapiens
HLRDFLVQI

SEQ ID NO: 7979 - protein, 9 aa, Homo Sapiens
HLRQDLERV

SEQ ID NO: 7980 - protein, 9 aa, Homo Sapiens
HLRRFILSV

SEQ ID NO: 7981 - protein, 9 aa, Homo Sapiens
HLSDAIVEV

SEQ ID NO: 7982 - protein, 9 aa, Homo Sapiens
HLSDHLSEL

SEQ ID NO: 7983 - protein, 9 aa, Homo Sapiens
HLSELNTKL

SEQ ID NO: 7984 - protein, 9 aa, Homo Sapiens
HLSNILSEV

SEQ ID NO: 7985 - protein, 9 aa, Homo Sapiens
HLVDRTTVV

SEQ ID NO: 7986 - protein, 9 aa, Homo Sapiens
HLVPFVGKV

SEQ ID NO: 7987 - protein, 9 aa, Homo Sapiens
HMHIHISTV

SEQ ID NO: 7988 - protein, 9 aa, Homo Sapiens
HMKNFVTKV

SEQ ID NO: 7989 - protein, 9 aa, Homo Sapiens
HMKSFVTRV

SEQ ID NO: 7990 - protein, 9 aa, Homo Sapiens
HQIQNVVTV

SEQ ID NO: 7991 - protein, 9 aa, Homo Sapiens
HQRTFVLEV

SEQ ID NO: 7992 - protein, 9 aa, Homo Sapiens
HQVPAVSSV

SEQ ID NO: 7993 - protein, 9 aa, Homo Sapiens
IASLLLAKL

SEQ ID NO: 7994 - protein, 9 aa, Homo Sapiens
IAVSHVGAV

SEQ ID NO: 7995 - protein, 9 aa, Homo Sapiens
IIFETPLRV

SEQ ID NO: 7996 - protein, 9 aa, Homo Sapiens
IIIDSVPEV

SEQ ID NO: 7997 - protein, 9 aa, Homo Sapiens
IIIGGVATV

SEQ ID NO: 7998 - protein, 9 aa, Homo Sapiens
IIIPEIQKV

SEQ ID NO: 7999 - protein, 9 aa, Homo Sapiens
IIKEVLLEA

SEQ ID NO: 8000 - protein, 9 aa, Homo Sapiens
IIRDILQDV

SEQ ID NO: 8001 - protein, 9 aa, Homo Sapiens
IITDLLRSV

SEQ ID NO: 8002 - protein, 9 aa, Homo Sapiens
IIYPTPKVV

SEQ ID NO: 8003 - protein, 9 aa, Homo Sapiens
ILAAHVPTL

SEQ ID NO: 8004 - protein, 9 aa, Homo Sapiens
ILAAIVNHL

SEQ ID NO: 8005 - protein, 9 aa, Homo Sapiens
ILAAVETRL

SEQ ID NO: 8006 - protein, 9 aa, Homo Sapiens
ILADIQSHM

SEQ ID NO: 8007 - protein, 9 aa, Homo Sapiens
ILADIVISA

SEQ ID NO: 8008 - protein, 9 aa, Homo Sapiens
ILADKTRQL

SEQ ID NO: 8009 - protein, 9 aa, Homo Sapiens
ILADRILLM

SEQ ID NO: 8010 - protein, 9 aa, Homo Sapiens
ILAEGITIV

SEQ ID NO: 8011 - protein, 9 aa, Homo Sapiens
ILAELLLRV

SEQ ID NO: 8012 - protein, 9 aa, Homo Sapiens
ILAFLVPFV

SEQ ID NO: 8013 - protein, 9 aa, Homo Sapiens
ILAFVQGTV

SEQ ID NO: 8014 - protein, 9 aa, Homo Sapiens
ILAMHLIDV

SEQ ID NO: 8015 - protein, 9 aa, Homo Sapiens
ILANIVNAL

SEQ ID NO: 8016 - protein, 9 aa, Homo Sapiens
ILAPVVKEI

SEQ ID NO: 8017 - protein, 9 aa, Homo Sapiens
ILAQQPLSV

SEQ ID NO: 8018 - protein, 9 aa, Homo Sapiens
ILARDILEI

SEQ ID NO: 8019 - protein, 9 aa, Homo Sapiens
ILASLLRNL

SEQ ID NO: 8020 - protein, 9 aa, Homo Sapiens
ILATNTQKV

SEQ ID NO: 8021 - protein, 9 aa, Homo Sapiens
ILFNRVLGV

SEQ ID NO: 8022 - protein, 9 aa, Homo Sapiens
ILGPKPQGV

SEQ ID NO: 8023 - protein, 9 aa, Homo Sapiens
ILHGLVAAV

SEQ ID NO: 8024 - protein, 9 aa, Homo Sapiens
ILHSVTTNL

SEQ ID NO: 8025 - protein, 9 aa, Homo Sapiens
ILIDKTSFV

SEQ ID NO: 8026 - protein, 9 aa, Homo Sapiens
ILIDPIRVV

SEQ ID NO: 8027 - protein, 9 aa, Homo Sapiens
ILIGRIKNV

SEQ ID NO: 8028 - protein, 9 aa, Homo Sapiens
ILINDVLTA

SEQ ID NO: 8029 - protein, 9 aa, Homo Sapiens
ILIPNVETI

SEQ ID NO: 8030 - protein, 9 aa, Homo Sapiens
ILISKLLGA

SEQ ID NO: 8031 - protein, 9 aa, Homo Sapiens
ILITNVVCV

SEQ ID NO: 8032 - protein, 9 aa, Homo Sapiens
ILKAPGTNV

SEQ ID NO: 8033 - protein, 9 aa, Homo Sapiens
ILKDNIKLL

SEQ ID NO: 8034 - protein, 9 aa, Homo Sapiens
ILKEHITQL

SEQ ID NO: 8035 - protein, 9 aa, Homo Sapiens
ILKEISPLL

SEQ ID NO: 8036 - protein, 9 aa, Homo Sapiens
ILKEIVEML

SEQ ID NO: 8037 - protein, 9 aa, Homo Sapiens
ILKEKLRQL

SEQ ID NO: 8038 - protein, 9 aa, Homo Sapiens
ILKEQIREL

SEQ ID NO: 8039 - protein, 9 aa, Homo Sapiens
ILKERIYRL

SEQ ID NO: 8040 - protein, 9 aa, Homo Sapiens
ILKETVRQI

SEQ ID NO: 8041 - protein, 9 aa, Homo Sapiens
ILKKSIRNL

SEQ ID NO: 8042 - protein, 9 aa, Homo Sapiens
ILKKVLEAL

SEQ ID NO: 8043 - protein, 9 aa, Homo Sapiens
ILKNFLYDI

SEQ ID NO: 8044 - protein, 9 aa, Homo Sapiens
ILKQVVNQV

SEQ ID NO: 8045 - protein, 9 aa, Homo Sapiens
ILKSHVEKL

SEQ ID NO: 8046 - protein, 9 aa, Homo Sapiens
ILMEHIHKL

SEQ ID NO: 8047 - protein, 9 aa, Homo Sapiens
ILMGVLKEV

SEQ ID NO: 8048 - protein, 9 aa, Homo Sapiens
ILNDNINLL

SEQ ID NO: 8049 - protein, 9 aa, Homo Sapiens
ILNEIVNFV

SEQ ID NO: 8050 - protein, 9 aa, Homo Sapiens
ILNEVDISV

SEQ ID NO: 8051 - protein, 9 aa, Homo Sapiens
ILNEVQVGV

SEQ ID NO: 8052 - protein, 9 aa, Homo Sapiens
ILNGIVAAL

SEQ ID NO: 8053 - protein, 9 aa, Homo Sapiens
ILNNNLNTL

SEQ ID NO: 8054 - protein, 9 aa, Homo Sapiens
ILNPEVVTV

SEQ ID NO: 8055 - protein, 9 aa, Homo Sapiens
ILNPHGIPL

SEQ ID NO: 8056 - protein, 9 aa, Homo Sapiens
ILNYVLVRV

SEQ ID NO: 8057 - protein, 9 aa, Homo Sapiens
ILPEKVARV

SEQ ID NO: 8058 - protein, 9 aa, Homo Sapiens
ILPERFLAV

SEQ ID NO: 8059 - protein, 9 aa, Homo Sapiens
ILPGFQRTV

SEQ ID NO: 8060 - protein, 9 aa, Homo Sapiens
ILPSNLLTV

SEQ ID NO: 8061 - protein, 9 aa, Homo Sapiens
ILQDRLNQV

SEQ ID NO: 8062 - protein, 9 aa, Homo Sapiens
ILQQHIATV

SEQ ID NO: 8063 - protein, 9 aa, Homo Sapiens
ILRAILLSL

SEQ ID NO: 8064 - protein, 9 aa, Homo Sapiens
ILRDALSDL

SEQ ID NO: 8065 - protein, 9 aa, Homo Sapiens
ILRDLINEA

SEQ ID NO: 8066 - protein, 9 aa, Homo Sapiens
ILRLQVTNV

SEQ ID NO: 8067 - protein, 9 aa, Homo Sapiens
ILRTGLEEV

SEQ ID NO: 8068 - protein, 9 aa, Homo Sapiens
ILSDNLRQV

SEQ ID NO: 8069 - protein, 9 aa, Homo Sapiens
ILSDVASRL

SEQ ID NO: 8070 - protein, 9 aa, Homo Sapiens
ILSEFSSKL

SEQ ID NO: 8071 - protein, 9 aa, Homo Sapiens
ILSEVQQAV

SEQ ID NO: 8072 - protein, 9 aa, Homo Sapiens
ILSGVIRSV

SEQ ID NO: 8073 - protein, 9 aa, Homo Sapiens
ILSHLSSEL

SEQ ID NO: 8074 - protein, 9 aa, Homo Sapiens
ILSPWGAEV

SEQ ID NO: 8075 - protein, 9 aa, Homo Sapiens
ILTDHILET

SEQ ID NO: 8076 - protein, 9 aa, Homo Sapiens
ILTDITKGV

SEQ ID NO: 8077 - protein, 9 aa, Homo Sapiens
ILTETINTV

SEQ ID NO: 8078 - protein, 9 aa, Homo Sapiens
ILTGHTQSV

SEQ ID NO: 8079 - protein, 9 aa, Homo Sapiens
ILTNGLVSV

SEQ ID NO: 8080 - protein, 9 aa, Homo Sapiens
ILVDWLVEV

SEQ ID NO: 8081 - protein, 9 aa, Homo Sapiens
ILVDWLVQV

SEQ ID NO: 8082 - protein, 9 aa, Homo Sapiens
ILVEHISGV

SEQ ID NO: 8083 - protein, 9 aa, Homo Sapiens
ILVGLLHMV

SEQ ID NO: 8084 - protein, 9 aa, Homo Sapiens
ILYDKLEKI

SEQ ID NO: 8085 - protein, 9 aa, Homo Sapiens
ILYGKIIHL

SEQ ID NO: 8086 - protein, 9 aa, Homo Sapiens
ILYPKPKAC

SEQ ID NO: 8087 - protein, 9 aa, Homo Sapiens
IMEGLSAFL

SEQ ID NO: 8088 - protein, 9 aa, Homo Sapiens
IMFQKPVEV

SEQ ID NO: 8089 - protein, 9 aa, Homo Sapiens
IMKEVIPFL

SEQ ID NO: 8090 - protein, 9 aa, Homo Sapiens
IMKGKIKSI

SEQ ID NO: 8091 - protein, 9 aa, Homo Sapiens
IQAERVRGV

SEQ ID NO: 8092 - protein, 9 aa, Homo Sapiens
IQILKTSEV

SEQ ID NO: 8093 - protein, 9 aa, Homo Sapiens
IQIMKVEEI

SEQ ID NO: 8094 - protein, 9 aa, Homo Sapiens
IQVTKVTQV

SEQ ID NO: 8095 - protein, 9 aa, Homo Sapiens
ISISKRSIL

SEQ ID NO: 8096 - protein, 9 aa, Homo Sapiens
ITFSNPKEV

SEQ ID NO: 8097 - protein, 9 aa, Homo Sapiens
ITNEKLAMV

SEQ ID NO: 8098 - protein, 9 aa, Homo Sapiens
IVATKPLYV

SEQ ID NO: 8099 - protein, 9 aa, Homo Sapiens
IVIDGLREL

SEQ ID NO: 8100 - protein, 9 aa, Homo Sapiens
IVIGIIKTV

SEQ ID NO: 8101 - protein, 9 aa, Homo Sapiens
IVKEELALL

SEQ ID NO: 8102 - protein, 9 aa, Homo Sapiens
IVVGRITEV

SEQ ID NO: 8103 - protein, 9 aa, Homo Sapiens
KIADFGWSV

SEQ ID NO: 8104 - protein, 9 aa, Homo Sapiens
KIKEIAVTV

SEQ ID NO: 8105 - protein, 9 aa, Homo Sapiens
KIKIYISQV

SEQ ID NO: 8106 - protein, 9 aa, Homo Sapiens
KINNEIRSV

SEQ ID NO: 8107 - protein, 9 aa, Homo Sapiens
KLAAVVNNL

SEQ ID NO: 8108 - protein, 9 aa, Homo Sapiens
KLAEALPSL

SEQ ID NO: 8109 - protein, 9 aa, Homo Sapiens
KLAEFIDFL

SEQ ID NO: 8110 - protein, 9 aa, Homo Sapiens
KLAEGVLDV

SEQ ID NO: 8111 - protein, 9 aa, Homo Sapiens
KLAEGVQLL

SEQ ID NO: 8112 - protein, 9 aa, Homo Sapiens
KLAEIVKQV

SEQ ID NO: 8113 - protein, 9 aa, Homo Sapiens
KLAEKLTIL

SEQ ID NO: 8114 - protein, 9 aa, Homo Sapiens
KLAEVSQNI

SEQ ID NO: 8115 - protein, 9 aa, Homo Sapiens
KLAKLQAQV

SEQ ID NO: 8116 - protein, 9 aa, Homo Sapiens
KLASKYLHV

SEQ ID NO: 8117 - protein, 9 aa, Homo Sapiens
KLAVRPLSV

SEQ ID NO: 8118 - protein, 9 aa, Homo Sapiens
KLFDAPLSI

SEQ ID NO: 8119 - protein, 9 aa, Homo Sapiens
KLFDRPQEL

SEQ ID NO: 8120 - protein, 9 aa, Homo Sapiens
KLFEKVKEV

SEQ ID NO: 8121 - protein, 9 aa, Homo Sapiens
KLFGHLTSA

SEQ ID NO: 8122 - protein, 9 aa, Homo Sapiens
KLFGMIITI

SEQ ID NO: 8123 - protein, 9 aa, Homo Sapiens
KLFIGGLNV

SEQ ID NO: 8124 - protein, 9 aa, Homo Sapiens
KLFSILSTV

SEQ ID NO: 8125 - protein, 9 aa, Homo Sapiens
KLGEIVTTI

SEQ ID NO: 8126 - protein, 9 aa, Homo Sapiens
KLGLKPLEV

SEQ ID NO: 8127 - protein, 9 aa, Homo Sapiens
KLGPAPKTL

SEQ ID NO: 8128 - protein, 9 aa, Homo Sapiens
KLGPVAVSI

SEQ ID NO: 8129 - protein, 9 aa, Homo Sapiens
KLHGVNINV

SEQ ID NO: 8130 - protein, 9 aa, Homo Sapiens
KLHYVVTEV

SEQ ID NO: 8131 - protein, 9 aa, Homo Sapiens
KLIANLNML

SEQ ID NO: 8132 - protein, 9 aa, Homo Sapiens
KLIANNTTV

SEQ ID NO: 8133 - protein, 9 aa, Homo Sapiens
KLIEELETL

SEQ ID NO: 8134 - protein, 9 aa, Homo Sapiens
KLIFSVEAV

SEQ ID NO: 8135 - protein, 9 aa, Homo Sapiens
KLIGNMALL

SEQ ID NO: 8136 - protein, 9 aa, Homo Sapiens
KLIKSLEAA

SEQ ID NO: 8137 - protein, 9 aa, Homo Sapiens
KLILLITQV

SEQ ID NO: 8138 - protein, 9 aa, Homo Sapiens
KLINQVNTI

SEQ ID NO: 8139 - protein, 9 aa, Homo Sapiens
KLIPQLPTL

SEQ ID NO: 8140 - protein, 9 aa, Homo Sapiens
KLISDINKA

SEQ ID NO: 8141 - protein, 9 aa, Homo Sapiens
KLKDDIRGL

SEQ ID NO: 8142 - protein, 9 aa, Homo Sapiens
KLKDSLRQL

SEQ ID NO: 8143 - protein, 9 aa, Homo Sapiens
KLKGEIAHL

SEQ ID NO: 8144 - protein, 9 aa, Homo Sapiens
KLKKELTGL

SEQ ID NO: 8145 - protein, 9 aa, Homo Sapiens
KLKTALLDI

SEQ ID NO: 8146 - protein, 9 aa, Homo Sapiens
KLMDEVAGI

SEQ ID NO: 8147 - protein, 9 aa, Homo Sapiens
KLMDHIYAV

SEQ ID NO: 8148 - protein, 9 aa, Homo Sapiens
KLMDKVVRL

SEQ ID NO: 8149 - protein, 9 aa, Homo Sapiens
KLMDQLEAL

SEQ ID NO: 8150 - protein, 9 aa, Homo Sapiens
KLMELLEEI

SEQ ID NO: 8151 - protein, 9 aa, Homo Sapiens
KLNAKLAEL

SEQ ID NO: 8152 - protein, 9 aa, Homo Sapiens
KLNFIVTGL

SEQ ID NO: 8153 - protein, 9 aa, Homo Sapiens
KLNPGIAYV

SEQ ID NO: 8154 - protein, 9 aa, Homo Sapiens
KLNTAVRQV

SEQ ID NO: 8155 - protein, 9 aa, Homo Sapiens
KLQEFLQTL

SEQ ID NO: 8156 - protein, 9 aa, Homo Sapiens
KLREDLERL

SEQ ID NO: 8157 - protein, 9 aa, Homo Sapiens
KLREMLIRV

SEQ ID NO: 8158 - protein, 9 aa, Homo Sapiens
KLSFIIRTV

SEQ ID NO: 8159 - protein, 9 aa, Homo Sapiens
KLSSKLSAV

SEQ ID NO: 8160 - protein, 9 aa, Homo Sapiens
KLTAFVNTL

SEQ ID NO: 8161 - protein, 9 aa, Homo Sapiens
KLVDCIIEV

SEQ ID NO: 8162 - protein, 9 aa, Homo Sapiens
KLVGEFLEV

SEQ ID NO: 8163 - protein, 9 aa, Homo Sapiens
KLVPFLKKV

SEQ ID NO: 8164 - protein, 9 aa, Homo Sapiens
KLVTTVTEI

SEQ ID NO: 8165 - protein, 9 aa, Homo Sapiens
KLYNWLRVA

SEQ ID NO: 8166 - protein, 9 aa, Homo Sapiens
KLYPQLSSV

SEQ ID NO: 8167 - protein, 9 aa, Homo Sapiens
KLYTGLREV

SEQ ID NO: 8168 - protein, 9 aa, Homo Sapiens
KMAEMLVEL

SEQ ID NO: 8169 - protein, 9 aa, Homo Sapiens
KMAPALRKV

SEQ ID NO: 8170 - protein, 9 aa, Homo Sapiens
KMKEAVRLV

SEQ ID NO: 8171 - protein, 9 aa, Homo Sapiens
KMKPEVTAL

SEQ ID NO: 8172 - protein, 9 aa, Homo Sapiens
KMMDVTVTI

SEQ ID NO: 8173 - protein, 9 aa, Homo Sapiens
KMNEKIASL

SEQ ID NO: 8174 - protein, 9 aa, Homo Sapiens
KMNEKLYTV

SEQ ID NO: 8175 - protein, 9 aa, Homo Sapiens
KQAFTVAAV

SEQ ID NO: 8176 - protein, 9 aa, Homo Sapiens
KQIDQFLVV

SEQ ID NO: 8177 - protein, 9 aa, Homo Sapiens
KQISTLESV

SEQ ID NO: 8178 - protein, 9 aa, Homo Sapiens
KSIARVLTV

SEQ ID NO: 8179 - protein, 9 aa, Homo Sapiens
KVADLVLML

SEQ ID NO: 8180 - protein, 9 aa, Homo Sapiens
KVAPAPAVV

SEQ ID NO: 8181 - protein, 9 aa, Homo Sapiens
KVASLLHQV

SEQ ID NO: 8182 - protein, 9 aa, Homo Sapiens
KVGPVPVLV

SEQ ID NO: 8183 - protein, 9 aa, Homo Sapiens
KVIDYVPGI

SEQ ID NO: 8184 - protein, 9 aa, Homo Sapiens
KVKDGQLTV

SEQ ID NO: 8185 - protein, 9 aa, Homo Sapiens
KVKDILSKV

SEQ ID NO: 8186 - protein, 9 aa, Homo Sapiens
KVMGTFSTV

SEQ ID NO: 8187 - protein, 9 aa, Homo Sapiens
LAKALHLLK

SEQ ID NO: 8188 - protein, 9 aa, Homo Sapiens
LFNKQLESI

SEQ ID NO: 8189 - protein, 9 aa, Homo Sapiens
LGNISKLDI

SEQ ID NO: 8190 - protein, 9 aa, Homo Sapiens
LIAGTAVVG

SEQ ID NO: 8191 - protein, 9 aa, Homo Sapiens
LIKDIISQV

SEQ ID NO: 8192 - protein, 9 aa, Homo Sapiens
LINPNIATV

SEQ ID NO: 8193 - protein, 9 aa, Homo Sapiens
LISESFLTV

SEQ ID NO: 8194 - protein, 9 aa, Homo Sapiens
LIYGTPRAA

SEQ ID NO: 8195 - protein, 9 aa, Homo Sapiens
LLAAWTARA

SEQ ID NO: 8196 - protein, 9 aa, Homo Sapiens
LLADKVLKL

SEQ ID NO: 8197 - protein, 9 aa, Homo Sapiens
LLADLKTMV

SEQ ID NO: 8198 - protein, 9 aa, Homo Sapiens
LLADLLHNV

SEQ ID NO: 8199 - protein, 9 aa, Homo Sapiens
LLADVETFV

SEQ ID NO: 8200 - protein, 9 aa, Homo Sapiens
LLAEALNQV

SEQ ID NO: 8201 - protein, 9 aa, Homo Sapiens
LLAEGITWV

SEQ ID NO: 8202 - protein, 9 aa, Homo Sapiens
LLAEHIKSL

SEQ ID NO: 8203 - protein, 9 aa, Homo Sapiens
LLAEKVEQL

SEQ ID NO: 8204 - protein, 9 aa, Homo Sapiens
LLAELLTHL

SEQ ID NO: 8205 - protein, 9 aa, Homo Sapiens
LLAELPASV

SEQ ID NO: 8206 - protein, 9 aa, Homo Sapiens
LLAFVVRSV

SEQ ID NO: 8207 - protein, 9 aa, Homo Sapiens
LLAGLLTGL

SEQ ID NO: 8208 - protein, 9 aa, Homo Sapiens
LLAGPLRPA

SEQ ID NO: 8209 - protein, 9 aa, Homo Sapiens
LLAKKISQL

SEQ ID NO: 8210 - protein, 9 aa, Homo Sapiens
LLAKLLSQL

SEQ ID NO: 8211 - protein, 9 aa, Homo Sapiens
LLALHVLEA

SEQ ID NO: 8212 - protein, 9 aa, Homo Sapiens
LLANKVPAA

SEQ ID NO: 8213 - protein, 9 aa, Homo Sapiens
LLAPAPAQA

SEQ ID NO: 8214 - protein, 9 aa, Homo Sapiens
LLAPKLNEA

SEQ ID NO: 8215 - protein, 9 aa, Homo Sapiens
LLAPLAQTV

SEQ ID NO: 8216 - protein, 9 aa, Homo Sapiens
LLASEVPQL

SEQ ID NO: 8217 - protein, 9 aa, Homo Sapiens
LLASINSTV

SEQ ID NO: 8218 - protein, 9 aa, Homo Sapiens
LLATEVVTV

SEQ ID NO: 8219 - protein, 9 aa, Homo Sapiens
LLATVLQAV

SEQ ID NO: 8220 - protein, 9 aa, Homo Sapiens
LLFDRPMHV

SEQ ID NO: 8221 - protein, 9 aa, Homo Sapiens
LLFEGIARI

SEQ ID NO: 8222 - protein, 9 aa, Homo Sapiens
LLFKILSSV

SEQ ID NO: 8223 - protein, 9 aa, Homo Sapiens
LLFPSVMVV

SEQ ID NO: 8224 - protein, 9 aa, Homo Sapiens
LLGPKPFPL

SEQ ID NO: 8225 - protein, 9 aa, Homo Sapiens
LLGPPPVGV

SEQ ID NO: 8226 - protein, 9 aa, Homo Sapiens
LLGPRGIGV

SEQ ID NO: 8227 - protein, 9 aa, Homo Sapiens
LLGPRLVLA

SEQ ID NO: 8228 - protein, 9 aa, Homo Sapiens
LLHDGIPVV

SEQ ID NO: 8229 - protein, 9 aa, Homo Sapiens
LLHFIALTV

SEQ ID NO: 8230 - protein, 9 aa, Homo Sapiens
LLHFSIVSV

SEQ ID NO: 8231 - protein, 9 aa, Homo Sapiens
LLHGHIVEL

SEQ ID NO: 8232 - protein, 9 aa, Homo Sapiens
LLHKGILAV

SEQ ID NO: 8233 - protein, 9 aa, Homo Sapiens
LLHQGGLSV

SEQ ID NO: 8234 - protein, 9 aa, Homo Sapiens
LLHSFVDSV

SEQ ID NO: 8235 - protein, 9 aa, Homo Sapiens
LLHVQPSMV

SEQ ID NO: 8236 - protein, 9 aa, Homo Sapiens
LLIGATMQV

SEQ ID NO: 8237 - protein, 9 aa, Homo Sapiens
LLIGHLERV

SEQ ID NO: 8238 - protein, 9 aa, Homo Sapiens
LLIKQVVEV

SEQ ID NO: 8239 - protein, 9 aa, Homo Sapiens
LLIPGLATA

SEQ ID NO: 8240 - protein, 9 aa, Homo Sapiens
LLIQGVPAV

SEQ ID NO: 8241 - protein, 9 aa, Homo Sapiens
LLKAFIANL

SEQ ID NO: 8242 - protein, 9 aa, Homo Sapiens
LLKDFLRNL

SEQ ID NO: 8243 - protein, 9 aa, Homo Sapiens
LLKDSIVQL

SEQ ID NO: 8244 - protein, 9 aa, Homo Sapiens
LLKDVKISV

SEQ ID NO: 8245 - protein, 9 aa, Homo Sapiens
LLKELRHGV

SEQ ID NO: 8246 - protein, 9 aa, Homo Sapiens
LLKEYIQKL

SEQ ID NO: 8247 - protein, 9 aa, Homo Sapiens
LLKEYLVTL

SEQ ID NO: 8248 - protein, 9 aa, Homo Sapiens
LLKNELLGA

SEQ ID NO: 8249 - protein, 9 aa, Homo Sapiens
LLKNFVELI

SEQ ID NO: 8250 - protein, 9 aa, Homo Sapiens
LLKNPFLSV

SEQ ID NO: 8251 - protein, 9 aa, Homo Sapiens
LLKPELLRA

SEQ ID NO: 8252 - protein, 9 aa, Homo Sapiens
LLKPGLNVV

SEQ ID NO: 8253 - protein, 9 aa, Homo Sapiens
LLKPGLRAV

SEQ ID NO: 8254 - protein, 9 aa, Homo Sapiens
LLKPTLSEI

SEQ ID NO: 8255 - protein, 9 aa, Homo Sapiens
LLKSKLLVL

SEQ ID NO: 8256 - protein, 9 aa, Homo Sapiens
LLKVFVVEA

SEQ ID NO: 8257 - protein, 9 aa, Homo Sapiens
LLKVGILYI

SEQ ID NO: 8258 - protein, 9 aa, Homo Sapiens
LLKYIVIQV

SEQ ID NO: 8259 - protein, 9 aa, Homo Sapiens
LLMEHIQEI

SEQ ID NO: 8260 - protein, 9 aa, Homo Sapiens
LLNDHIYVV

SEQ ID NO: 8261 - protein, 9 aa, Homo Sapiens
LLNDRKVFV

SEQ ID NO: 8262 - protein, 9 aa, Homo Sapiens
LLNKSIIRV

SEQ ID NO: 8263 - protein, 9 aa, Homo Sapiens
LLNPHLRQL

SEQ ID NO: 8264 - protein, 9 aa, Homo Sapiens
LLNPSLQKV

SEQ ID NO: 8265 - protein, 9 aa, Homo Sapiens
LLNQKPLSL

SEQ ID NO: 8266 - protein, 9 aa, Homo Sapiens
LLPDIISRL

SEQ ID NO: 8267 - protein, 9 aa, Homo Sapiens
LLPDIVTCV

SEQ ID NO: 8268 - protein, 9 aa, Homo Sapiens
LLPHPGLQV

SEQ ID NO: 8269 - protein, 9 aa, Homo Sapiens
LLPIKTVGV

SEQ ID NO: 8270 - protein, 9 aa, Homo Sapiens
LLPPPPCPA

SEQ ID NO: 8271 - protein, 9 aa, Homo Sapiens
LLQDAIREV

SEQ ID NO: 8272 - protein, 9 aa, Homo Sapiens
LLQEPPRTV

SEQ ID NO: 8273 - protein, 9 aa, Homo Sapiens
LLQESLAQA

SEQ ID NO: 8274 - protein, 9 aa, Homo Sapiens
LLQPHLERV

SEQ ID NO: 8275 - protein, 9 aa, Homo Sapiens
LLRDQVLGV

SEQ ID NO: 8276 - protein, 9 aa, Homo Sapiens
LLREELQLL

SEQ ID NO: 8277 - protein, 9 aa, Homo Sapiens
LLREKVEFL

SEQ ID NO: 8278 - protein, 9 aa, Homo Sapiens
LLRQEVVAV

SEQ ID NO: 8279 - protein, 9 aa, Homo Sapiens
LLRQGVLGI

SEQ ID NO: 8280 - protein, 9 aa, Homo Sapiens
LLRSIVKQV

SEQ ID NO: 8281 - protein, 9 aa, Homo Sapiens
LLSAEPVPA

SEQ ID NO: 8282 - protein, 9 aa, Homo Sapiens
LLSEHVIAI

SEQ ID NO: 8283 - protein, 9 aa, Homo Sapiens
LLSERFINV

SEQ ID NO: 8284 - protein, 9 aa, Homo Sapiens
LLSERVSNL

SEQ ID NO: 8285 - protein, 9 aa, Homo Sapiens
LLSNLFTTL

SEQ ID NO: 8286 - protein, 9 aa, Homo Sapiens
LLSPHSQVL

SEQ ID NO: 8287 - protein, 9 aa, Homo Sapiens
LLSPVVPQI

SEQ ID NO: 8288 - protein, 9 aa, Homo Sapiens
LLSSHVRGV

SEQ ID NO: 8289 - protein, 9 aa, Homo Sapiens
LLTDGIMRV

SEQ ID NO: 8290 - protein, 9 aa, Homo Sapiens
LLTEIRAVV

SEQ ID NO: 8291 - protein, 9 aa, Homo Sapiens
LLYDQPLQV

SEQ ID NO: 8292 - protein, 9 aa, Homo Sapiens
LLYGKYVSV

SEQ ID NO: 8293 - protein, 9 aa, Homo Sapiens
LLYNRPGTV

SEQ ID NO: 8294 - protein, 9 aa, Homo Sapiens
LMAHAMEEV

SEQ ID NO: 8295 - protein, 9 aa, Homo Sapiens
LMKNTIIAA

SEQ ID NO: 8296 - protein, 9 aa, Homo Sapiens
LMKQYIEFV

SEQ ID NO: 8297 - protein, 9 aa, Homo Sapiens
LMNAVVQTV

SEQ ID NO: 8298 - protein, 9 aa, Homo Sapiens
LMNGLIQGV

SEQ ID NO: 8299 - protein, 9 aa, Homo Sapiens
LMRANITAI

SEQ ID NO: 8300 - protein, 9 aa, Homo Sapiens
LMRPLVVTA

SEQ ID NO: 8301 - protein, 9 aa, Homo Sapiens
LMTKEISSV

SEQ ID NO: 8302 - protein, 9 aa, Homo Sapiens
LMVDHVTEV

SEQ ID NO: 8303 - protein, 9 aa, Homo Sapiens
LMYPYIFHV

SEQ ID NO: 8304 - protein, 9 aa, Homo Sapiens
LQARIAHQI

SEQ ID NO: 8305 - protein, 9 aa, Homo Sapiens
LQFDGIHVV

SEQ ID NO: 8306 - protein, 9 aa, Homo Sapiens
LQIPAILGI

SEQ ID NO: 8307 - protein, 9 aa, Homo Sapiens
LQKEGVIGV

SEQ ID NO: 8308 - protein, 9 aa, Homo Sapiens
LQKPDVVGI

SEQ ID NO: 8309 - protein, 9 aa, Homo Sapiens
LQKYIEIYV

SEQ ID NO: 8310 - protein, 9 aa, Homo Sapiens
LTKDMLLEV

SEQ ID NO: 8311 - protein, 9 aa, Homo Sapiens
LTMEVIRQV

SEQ ID NO: 8312 - protein, 9 aa, Homo Sapiens
LVIDAVREI

SEQ ID NO: 8313 - protein, 9 aa, Homo Sapiens
LVKEGLVMV

SEQ ID NO: 8314 - protein, 9 aa, Homo Sapiens
LVKLRILEL

SEQ ID NO: 8315 - protein, 9 aa, Homo Sapiens
LVVEKPLVS

SEQ ID NO: 8316 - protein, 9 aa, Homo Sapiens
MEIERILGV

SEQ ID NO: 8317 - protein, 9 aa, Homo Sapiens
MIAGKVAVV

SEQ ID NO: 8318 - protein, 9 aa, Homo Sapiens
MIAQTVTAV

SEQ ID NO: 8319 - protein, 9 aa, Homo Sapiens
MIKEKLCYV

SEQ ID NO: 8320 - protein, 9 aa, Homo Sapiens
MLADTVATL

SEQ ID NO: 8321 - protein, 9 aa, Homo Sapiens
MLAEKLPNL

SEQ ID NO: 8322 - protein, 9 aa, Homo Sapiens
MLAGFITTL

SEQ ID NO: 8323 - protein, 9 aa, Homo Sapiens
MLAILLTEV

SEQ ID NO: 8324 - protein, 9 aa, Homo Sapiens
MLAKHVITL

SEQ ID NO: 8325 - protein, 9 aa, Homo Sapiens
MLANDIARL

SEQ ID NO: 8326 - protein, 9 aa, Homo Sapiens
MLFGHPLLV

SEQ ID NO: 8327 - protein, 9 aa, Homo Sapiens
MLIERIVRL

SEQ ID NO: 8328 - protein, 9 aa, Homo Sapiens
MLKDEVRTL

SEQ ID NO: 8329 - protein, 9 aa, Homo Sapiens
MLKPSVTSA

SEQ ID NO: 8330 - protein, 9 aa, Homo Sapiens
MLKSNIVTV

SEQ ID NO: 8331 - protein, 9 aa, Homo Sapiens
MLNVLVRAV

SEQ ID NO: 8332 - protein, 9 aa, Homo Sapiens
MLPVRLATA

SEQ ID NO: 8333 - protein, 9 aa, Homo Sapiens
MLREQVAQL

SEQ ID NO: 8334 - protein, 9 aa, Homo Sapiens
MLRQIIGQA

SEQ ID NO: 8335 - protein, 9 aa, Homo Sapiens
MLRSHVREL

SEQ ID NO: 8336 - protein, 9 aa, Homo Sapiens
MLSAIQSEV

SEQ ID NO: 8337 - protein, 9 aa, Homo Sapiens
MLSDRLTFL

SEQ ID NO: 8338 - protein, 9 aa, Homo Sapiens
MLSEHTSKL

SEQ ID NO: 8339 - protein, 9 aa, Homo Sapiens
MLSPFISSV

SEQ ID NO: 8340 - protein, 9 aa, Homo Sapiens
MLYPKLISL

SEQ ID NO: 8341 - protein, 9 aa, Homo Sapiens
MMKLIINSL

SEQ ID NO: 8342 - protein, 9 aa, Homo Sapiens
MMMALLVPL

SEQ ID NO: 8343 - protein, 9 aa, Homo Sapiens
MMPKYLNFV

SEQ ID NO: 8344 - protein, 9 aa, Homo Sapiens
MMVGDLLEV

SEQ ID NO: 8345 - protein, 9 aa, Homo Sapiens
MQKSVVITL

SEQ ID NO: 8346 - protein, 9 aa, Homo Sapiens
MTYWHLLNA

SEQ ID NO: 8347 - protein, 9 aa, Homo Sapiens
MVAPAVASV

SEQ ID NO: 8348 - protein, 9 aa, Homo Sapiens
NIFPSPNSV

SEQ ID NO: 8349 - protein, 9 aa, Homo Sapiens
NIFPYPVGV

SEQ ID NO: 8350 - protein, 9 aa, Homo Sapiens
NIICGITSV

SEQ ID NO: 8351 - protein, 9 aa, Homo Sapiens
NIKPDIMAV

SEQ ID NO: 8352 - protein, 9 aa, Homo Sapiens
NIKPEIVSV

SEQ ID NO: 8353 - protein, 9 aa, Homo Sapiens
NIRDFLVEI

SEQ ID NO: 8354 - protein, 9 aa, Homo Sapiens
NIVEKLREV

SEQ ID NO: 8355 - protein, 9 aa, Homo Sapiens
NIVERVKEV

SEQ ID NO: 8356 - protein, 9 aa, Homo Sapiens
NLAEKLIGV

SEQ ID NO: 8357 - protein, 9 aa, Homo Sapiens
NLAEKPKTV

SEQ ID NO: 8358 - protein, 9 aa, Homo Sapiens
NLAEKYQTV

SEQ ID NO: 8359 - protein, 9 aa, Homo Sapiens
NLAENISRV

SEQ ID NO: 8360 - protein, 9 aa, Homo Sapiens
NLAEVVERV

SEQ ID NO: 8361 - protein, 9 aa, Homo Sapiens
NLALKLLSV

SEQ ID NO: 8362 - protein, 9 aa, Homo Sapiens
NLARALQQV

SEQ ID NO: 8363 - protein, 9 aa, Homo Sapiens
NLASFIEQV

SEQ ID NO: 8364 - protein, 9 aa, Homo Sapiens
NLFHYLTEV

SEQ ID NO: 8365 - protein, 9 aa, Homo Sapiens
NLFKHLAKA

SEQ ID NO: 8366 - protein, 9 aa, Homo Sapiens
NLIPILKTV

SEQ ID NO: 8367 - protein, 9 aa, Homo Sapiens
NLIPQITSI

SEQ ID NO: 8368 - protein, 9 aa, Homo Sapiens
NLIRSVRTV

SEQ ID NO: 8369 - protein, 9 aa, Homo Sapiens
NLISALEEA

SEQ ID NO: 8370 - protein, 9 aa, Homo Sapiens
NLISQVGRV

SEQ ID NO: 8371 - protein, 9 aa, Homo Sapiens
NLKAHVVAV

SEQ ID NO: 8372 - protein, 9 aa, Homo Sapiens
NLKEAIETI

SEQ ID NO: 8373 - protein, 9 aa, Homo Sapiens
NLKEKIKEL

SEQ ID NO: 8374 - protein, 9 aa, Homo Sapiens
NLKEVLNAV

SEQ ID NO: 8375 - protein, 9 aa, Homo Sapiens
NLKIAVSNI

SEQ ID NO: 8376 - protein, 9 aa, Homo Sapiens
NLKKIFREV

SEQ ID NO: 8377 - protein, 9 aa, Homo Sapiens
NLKLKLTAV

SEQ ID NO: 8378 - protein, 9 aa, Homo Sapiens
NLKPHIQGI

SEQ ID NO: 8379 - protein, 9 aa, Homo Sapiens
NLKPWVLEV

SEQ ID NO: 8380 - protein, 9 aa, Homo Sapiens
NLKQAILQA

SEQ ID NO: 8381 - protein, 9 aa, Homo Sapiens
NLKSCLDNV

SEQ ID NO: 8382 - protein, 9 aa, Homo Sapiens
NLKTTVEGL

SEQ ID NO: 8383 - protein, 9 aa, Homo Sapiens
NLNSHITGL

SEQ ID NO: 8384 - protein, 9 aa, Homo Sapiens
NLNSIVPSV

SEQ ID NO: 8385 - protein, 9 aa, Homo Sapiens
NLPDIVSKV

SEQ ID NO: 8386 - protein, 9 aa, Homo Sapiens
NLQGKILSV

SEQ ID NO: 8387 - protein, 9 aa, Homo Sapiens
NLRDGPITI

SEQ ID NO: 8388 - protein, 9 aa, Homo Sapiens
NLRDIVRVV

SEQ ID NO: 8389 - protein, 9 aa, Homo Sapiens
NLRDWLRVV

SEQ ID NO: 8390 - protein, 9 aa, Homo Sapiens
NLRNAVELA

SEQ ID NO: 8391 - protein, 9 aa, Homo Sapiens
NLSAHIESL

SEQ ID NO: 8392 - protein, 9 aa, Homo Sapiens
NLSGHLLSA

SEQ ID NO: 8393 - protein, 9 aa, Homo Sapiens
NLTENLQYV

SEQ ID NO: 8394 - protein, 9 aa, Homo Sapiens
NLVLSVREV

SEQ ID NO: 8395 - protein, 9 aa, Homo Sapiens
NLVSFLETV

SEQ ID NO: 8396 - protein, 9 aa, Homo Sapiens
NLYPFVKTV

SEQ ID NO: 8397 - protein, 9 aa, Homo Sapiens
NMAELFAVV

SEQ ID NO: 8398 - protein, 9 aa, Homo Sapiens
NMARAVFGV

SEQ ID NO: 8399 - protein, 9 aa, Homo Sapiens
NMKEKINAV

SEQ ID NO: 8400 - protein, 9 aa, Homo Sapiens
NMKTVYVSV

SEQ ID NO: 8401 - protein, 9 aa, Homo Sapiens
NMMSGISSV

SEQ ID NO: 8402 - protein, 9 aa, Homo Sapiens
NMVAKVDEV

SEQ ID NO: 8403 - protein, 9 aa, Homo Sapiens
NMYGKVVTV

SEQ ID NO: 8404 - protein, 9 aa, Homo Sapiens
NVAPIISKV

SEQ ID NO: 8405 - protein, 9 aa, Homo Sapiens
NVIPNVANV

SEQ ID NO: 8406 - protein, 9 aa, Homo Sapiens
PLTGHLLEV

SEQ ID NO: 8407 - protein, 9 aa, Homo Sapiens
QIADIVTSV

SEQ ID NO: 8408 - protein, 9 aa, Homo Sapiens
QIITSVVSV

SEQ ID NO: 8409 - protein, 9 aa, Homo Sapiens
QIKDNLREV

SEQ ID NO: 8410 - protein, 9 aa, Homo Sapiens
QLADGLQYI

SEQ ID NO: 8411 - protein, 9 aa, Homo Sapiens
QLDNSILTV

SEQ ID NO: 8412 - protein, 9 aa, Homo Sapiens
QLFKKPRQV

SEQ ID NO: 8413 - protein, 9 aa, Homo Sapiens
QLIDGILYA

SEQ ID NO: 8414 - protein, 9 aa, Homo Sapiens
QLIDIIHTA

SEQ ID NO: 8415 - protein, 9 aa, Homo Sapiens
QLISKIPHI

SEQ ID NO: 8416 - protein, 9 aa, Homo Sapiens
QLKDFITKL

SEQ ID NO: 8417 - protein, 9 aa, Homo Sapiens
QLKEEIAFL

SEQ ID NO: 8418 - protein, 9 aa, Homo Sapiens
QLKHKLEQL

SEQ ID NO: 8419 - protein, 9 aa, Homo Sapiens
QLMEQVAQL

SEQ ID NO: 8420 - protein, 9 aa, Homo Sapiens
QLMNLIRSV

SEQ ID NO: 8421 - protein, 9 aa, Homo Sapiens
QLNDSIITV

SEQ ID NO: 8422 - protein, 9 aa, Homo Sapiens
QLNEKVAQL

SEQ ID NO: 8423 - protein, 9 aa, Homo Sapiens
QLQGYLRSV

SEQ ID NO: 8424 - protein, 9 aa, Homo Sapiens
QLQNYLRSV

SEQ ID NO: 8425 - protein, 9 aa, Homo Sapiens
QLRPYQMEV

SEQ ID NO: 8426 - protein, 9 aa, Homo Sapiens
QLSPRLLEV

SEQ ID NO: 8427 - protein, 9 aa, Homo Sapiens
QLSTIRSFL

SEQ ID NO: 8428 - protein, 9 aa, Homo Sapiens
QLSTVITQV

SEQ ID NO: 8429 - protein, 9 aa, Homo Sapiens
QLTSNLAQV

SEQ ID NO: 8430 - protein, 9 aa, Homo Sapiens
QLVDIIEKV

SEQ ID NO: 8431 - protein, 9 aa, Homo Sapiens
QLVPALAKV

SEQ ID NO: 8432 - protein, 9 aa, Homo Sapiens
QLVQRVASV

SEQ ID NO: 8433 - protein, 9 aa, Homo Sapiens
QLVRDLLEV

SEQ ID NO: 8434 - protein, 9 aa, Homo Sapiens
QLYQDPRNV

SEQ ID NO: 8435 - protein, 9 aa, Homo Sapiens
QMFEGPLAL

SEQ ID NO: 8436 - protein, 9 aa, Homo Sapiens
QMFSAIAAV

SEQ ID NO: 8437 - protein, 9 aa, Homo Sapiens
QMISRIEYI

SEQ ID NO: 8438 - protein, 9 aa, Homo Sapiens
QMISRIEYV

SEQ ID NO: 8439 - protein, 9 aa, Homo Sapiens
QMREFLEQL

SEQ ID NO: 8440 - protein, 9 aa, Homo Sapiens
QQIDRVVEV

SEQ ID NO: 8441 - protein, 9 aa, Homo Sapiens
QQIGKVVQV

SEQ ID NO: 8442 - protein, 9 aa, Homo Sapiens
QQRLVVVSV

SEQ ID NO: 8443 - protein, 9 aa, Homo Sapiens
QVHGTITGV

SEQ ID NO: 8444 - protein, 9 aa, Homo Sapiens
QVIPQLQTV

SEQ ID NO: 8445 - protein, 9 aa, Homo Sapiens
QVLSRLSTL

SEQ ID NO: 8446 - protein, 9 aa, Homo Sapiens
RIFQTLLEV

SEQ ID NO: 8447 - protein, 9 aa, Homo Sapiens
RIIDTVAQV

SEQ ID NO: 8448 - protein, 9 aa, Homo Sapiens
RIKATVMDV

SEQ ID NO: 8449 - protein, 9 aa, Homo Sapiens
RIKDTVQKL

SEQ ID NO: 8450 - protein, 9 aa, Homo Sapiens
RIKLGIKSL

SEQ ID NO: 8451 - protein, 9 aa, Homo Sapiens
RIRDQLSAV

SEQ ID NO: 8452 - protein, 9 aa, Homo Sapiens
RLAAFYSQV

SEQ ID NO: 8453 - protein, 9 aa, Homo Sapiens
RLAALGRQV

SEQ ID NO: 8454 - protein, 9 aa, Homo Sapiens
RLAEVVHEL

SEQ ID NO: 8455 - protein, 9 aa, Homo Sapiens
RLAHHLVAL

SEQ ID NO: 8456 - protein, 9 aa, Homo Sapiens
RLAHYIDRV

SEQ ID NO: 8457 - protein, 9 aa, Homo Sapiens
RLALVISEL

SEQ ID NO: 8458 - protein, 9 aa, Homo Sapiens
RLANVVRQV

SEQ ID NO: 8459 - protein, 9 aa, Homo Sapiens
RLAPTLSQL

SEQ ID NO: 8460 - protein, 9 aa, Homo Sapiens
RLAQHITYV

SEQ ID NO: 8461 - protein, 9 aa, Homo Sapiens
RLAQLITQA

SEQ ID NO: 8462 - protein, 9 aa, Homo Sapiens
RLASSVLRC

SEQ ID NO: 8463 - protein, 9 aa, Homo Sapiens
RLAVYIDKV

SEQ ID NO: 8464 - protein, 9 aa, Homo Sapiens
RLAVYIDRV

SEQ ID NO: 8465 - protein, 9 aa, Homo Sapiens
RLFDDVPQV

SEQ ID NO: 8466 - protein, 9 aa, Homo Sapiens
RLFDEPQLA

SEQ ID NO: 8467 - protein, 9 aa, Homo Sapiens
RLFEGNALL

SEQ ID NO: 8468 - protein, 9 aa, Homo Sapiens
RLFENLRML

SEQ ID NO: 8469 - protein, 9 aa, Homo Sapiens
RLFEVPHEL

SEQ ID NO: 8470 - protein, 9 aa, Homo Sapiens
RLFFQPHQA

SEQ ID NO: 8471 - protein, 9 aa, Homo Sapiens
RLGPVPPGL

SEQ ID NO: 8472 - protein, 9 aa, Homo Sapiens
RLGPVPSGL

SEQ ID NO: 8473 - protein, 9 aa, Homo Sapiens
RLHEKVNII

SEQ ID NO: 8474 - protein, 9 aa, Homo Sapiens
RLIESLFTI

SEQ ID NO: 8475 - protein, 9 aa, Homo Sapiens
RLINQVLEL

SEQ ID NO: 8476 - protein, 9 aa, Homo Sapiens
RLIPTLVSI

SEQ ID NO: 8477 - protein, 9 aa, Homo Sapiens
RLISETTSV

SEQ ID NO: 8478 - protein, 9 aa, Homo Sapiens
RLKAELARL

SEQ ID NO: 8479 - protein, 9 aa, Homo Sapiens
RLKDIIFDV

SEQ ID NO: 8480 - protein, 9 aa, Homo Sapiens
RLKDYIQQL

SEQ ID NO: 8481 - protein, 9 aa, Homo Sapiens
RLKELLTML

SEQ ID NO: 8482 - protein, 9 aa, Homo Sapiens
RLKENQISV

SEQ ID NO: 8483 - protein, 9 aa, Homo Sapiens
RLKNEITRL

SEQ ID NO: 8484 - protein, 9 aa, Homo Sapiens
RLKPALETL

SEQ ID NO: 8485 - protein, 9 aa, Homo Sapiens
RLLDYVATV

SEQ ID NO: 8486 - protein, 9 aa, Homo Sapiens
RLMNDMTAV

SEQ ID NO: 8487 - protein, 9 aa, Homo Sapiens
RLMNETTAV

SEQ ID NO: 8488 - protein, 9 aa, Homo Sapiens
RLNEAAVTV

SEQ ID NO: 8489 - protein, 9 aa, Homo Sapiens
RLNKVIKSV

SEQ ID NO: 8490 - protein, 9 aa, Homo Sapiens
RLNLVEAFV

SEQ ID NO: 8491 - protein, 9 aa, Homo Sapiens
RLPEAIEEV

SEQ ID NO: 8492 - protein, 9 aa, Homo Sapiens
RLPEIYIQL

SEQ ID NO: 8493 - protein, 9 aa, Homo Sapiens
RLQDAIAKV

SEQ ID NO: 8494 - protein, 9 aa, Homo Sapiens
RLQEEINEV

SEQ ID NO: 8495 - protein, 9 aa, Homo Sapiens
RLQESVMEA

SEQ ID NO: 8496 - protein, 9 aa, Homo Sapiens
RLQEVTHSV

SEQ ID NO: 8497 - protein, 9 aa, Homo Sapiens
RLQGELQAV

SEQ ID NO: 8498 - protein, 9 aa, Homo Sapiens
RLSDVQIYV

SEQ ID NO: 8499 - protein, 9 aa, Homo Sapiens
RLSPIENFL

SEQ ID NO: 8500 - protein, 9 aa, Homo Sapiens
RLSSVNAEV

SEQ ID NO: 8501 - protein, 9 aa, Homo Sapiens
RLTDFLDCV

SEQ ID NO: 8502 - protein, 9 aa, Homo Sapiens
RLTDYISKV

SEQ ID NO: 8503 - protein, 9 aa, Homo Sapiens
RLTDYVAFL

SEQ ID NO: 8504 - protein, 9 aa, Homo Sapiens
RLTPKLMEV

SEQ ID NO: 8505 - protein, 9 aa, Homo Sapiens
RLVPSVNGV

SEQ ID NO: 8506 - protein, 9 aa, Homo Sapiens
RLYGLGTGV

SEQ ID NO: 8507 - protein, 9 aa, Homo Sapiens
RMITAMNTI

SEQ ID NO: 8508 - protein, 9 aa, Homo Sapiens
RMKANIKLV

SEQ ID NO: 8509 - protein, 9 aa, Homo Sapiens
RMKLSLTKV

SEQ ID NO: 8510 - protein, 9 aa, Homo Sapiens
RMVAEIQNV

SEQ ID NO: 8511 - protein, 9 aa, Homo Sapiens
RMVHILTSV

SEQ ID NO: 8512 - protein, 9 aa, Homo Sapiens
RMYSYPARV

SEQ ID NO: 8513 - protein, 9 aa, Homo Sapiens
RQIDQFLVV

SEQ ID NO: 8514 - protein, 9 aa, Homo Sapiens
RVIGTLEEV

SEQ ID NO: 8515 - protein, 9 aa, Homo Sapiens
SIAAVLPKV

SEQ ID NO: 8516 - protein, 9 aa, Homo Sapiens
SIAECLTYL

SEQ ID NO: 8517 - protein, 9 aa, Homo Sapiens
SIAEMGAYV

SEQ ID NO: 8518 - protein, 9 aa, Homo Sapiens
SIAGIFKEV

SEQ ID NO: 8519 - protein, 9 aa, Homo Sapiens
SIAPRMMSV

SEQ ID NO: 8520 - protein, 9 aa, Homo Sapiens
SIAQIISSV

SEQ ID NO: 8521 - protein, 9 aa, Homo Sapiens
SIFASPESV

SEQ ID NO: 8522 - protein, 9 aa, Homo Sapiens
SIFTAPKEI

SEQ ID NO: 8523 - protein, 9 aa, Homo Sapiens
SIHETIPLV

SEQ ID NO: 8524 - protein, 9 aa, Homo Sapiens
SIIDKLVNI

SEQ ID NO: 8525 - protein, 9 aa, Homo Sapiens
SIIDWLNSV

SEQ ID NO: 8526 - protein, 9 aa, Homo Sapiens
SIIGRLLEV

SEQ ID NO: 8527 - protein, 9 aa, Homo Sapiens
SIKAYVSTL

SEQ ID NO: 8528 - protein, 9 aa, Homo Sapiens
SIKDGVMVL

SEQ ID NO: 8529 - protein, 9 aa, Homo Sapiens
SIMDRILQI

SEQ ID NO: 8530 - protein, 9 aa, Homo Sapiens
SIMKNLRRV

SEQ ID NO: 8531 - protein, 9 aa, Homo Sapiens
SINSRLQLV

SEQ ID NO: 8532 - protein, 9 aa, Homo Sapiens
SIRDSVVEI

SEQ ID NO: 8533 - protein, 9 aa, Homo Sapiens
SIRNFLIYV

SEQ ID NO: 8534 - protein, 9 aa, Homo Sapiens
SIYDAIKEV

SEQ ID NO: 8535 - protein, 9 aa, Homo Sapiens
SIYPSPTGV

SEQ ID NO: 8536 - protein, 9 aa, Homo Sapiens
SIYQFLIAV

SEQ ID NO: 8537 - protein, 9 aa, Homo Sapiens
SLAARAIAV

SEQ ID NO: 8538 - protein, 9 aa, Homo Sapiens
SLADCIPLL

SEQ ID NO: 8539 - protein, 9 aa, Homo Sapiens
SLADFMQEV

SEQ ID NO: 8540 - protein, 9 aa, Homo Sapiens
SLADIAQKL

SEQ ID NO: 8541 - protein, 9 aa, Homo Sapiens
SLADVHIEV

SEQ ID NO: 8542 - protein, 9 aa, Homo Sapiens
SLADYITAA

SEQ ID NO: 8543 - protein, 9 aa, Homo Sapiens
SLAEFVQSL

SEQ ID NO: 8544 - protein, 9 aa, Homo Sapiens
SLAEGRLYL

SEQ ID NO: 8545 - protein, 9 aa, Homo Sapiens
SLAEKIQAL

SEQ ID NO: 8546 - protein, 9 aa, Homo Sapiens
SLAELVHAV

SEQ ID NO: 8547 - protein, 9 aa, Homo Sapiens
SLAEPRVSV

SEQ ID NO: 8548 - protein, 9 aa, Homo Sapiens
SLAERSSLL

SEQ ID NO: 8549 - protein, 9 aa, Homo Sapiens
SLAERVDRL

SEQ ID NO: 8550 - protein, 9 aa, Homo Sapiens
SLAEVLQQL

SEQ ID NO: 8551 - protein, 9 aa, Homo Sapiens
SLAEVNTQL

SEQ ID NO: 8552 - protein, 9 aa, Homo Sapiens
SLAGIFTRL

SEQ ID NO: 8553 - protein, 9 aa, Homo Sapiens
SLAGSLRSV

SEQ ID NO: 8554 - protein, 9 aa, Homo Sapiens
SLAKIYTEA

SEQ ID NO: 8555 - protein, 9 aa, Homo Sapiens
SLALLLNYL

SEQ ID NO: 8556 - protein, 9 aa, Homo Sapiens
SLANIIRQL

SEQ ID NO: 8557 - protein, 9 aa, Homo Sapiens
SLAPIIVHV

SEQ ID NO: 8558 - protein, 9 aa, Homo Sapiens
SLAPVLCGI

SEQ ID NO: 8559 - protein, 9 aa, Homo Sapiens
SLAQLLGKI

SEQ ID NO: 8560 - protein, 9 aa, Homo Sapiens
SLAQMVSGL

SEQ ID NO: 8561 - protein, 9 aa, Homo Sapiens
SLAQSIAKI

SEQ ID NO: 8562 - protein, 9 aa, Homo Sapiens
SLAQYLINA

SEQ ID NO: 8563 - protein, 9 aa, Homo Sapiens
SLAQYLINV

SEQ ID NO: 8564 - protein, 9 aa, Homo Sapiens
SLAQYNPKL

SEQ ID NO: 8565 - protein, 9 aa, Homo Sapiens
SLARHLMTL

SEQ ID NO: 8566 - protein, 9 aa, Homo Sapiens
SLARIFTSI

SEQ ID NO: 8567 - protein, 9 aa, Homo Sapiens
SLARILSLL

SEQ ID NO: 8568 - protein, 9 aa, Homo Sapiens
SLASFIPAV

SEQ ID NO: 8569 - protein, 9 aa, Homo Sapiens
SLASHIQSL

SEQ ID NO: 8570 - protein, 9 aa, Homo Sapiens
SLASHVKNL

SEQ ID NO: 8571 - protein, 9 aa, Homo Sapiens
SLASLLAKV

SEQ ID NO: 8572 - protein, 9 aa, Homo Sapiens
SLASLLVSV

SEQ ID NO: 8573 - protein, 9 aa, Homo Sapiens
SLATHLQEL

SEQ ID NO: 8574 - protein, 9 aa, Homo Sapiens
SLATKIQAA

SEQ ID NO: 8575 - protein, 9 aa, Homo Sapiens
SLATRISTL

SEQ ID NO: 8576 - protein, 9 aa, Homo Sapiens
SLATTLTKI

SEQ ID NO: 8577 - protein, 9 aa, Homo Sapiens
SLAVSSPRL

SEQ ID NO: 8578 - protein, 9 aa, Homo Sapiens
SLAWDVPAA

SEQ ID NO: 8579 - protein, 9 aa, Homo Sapiens
SLAWKPLSA

SEQ ID NO: 8580 - protein, 9 aa, Homo Sapiens
SLEKISIAL

SEQ ID NO: 8581 - protein, 9 aa, Homo Sapiens
SLFDAVSSL

SEQ ID NO: 8582 - protein, 9 aa, Homo Sapiens
SLFDIISKI

SEQ ID NO: 8583 - protein, 9 aa, Homo Sapiens
SLFERLVKV

SEQ ID NO: 8584 - protein, 9 aa, Homo Sapiens
SLFGNIKGA

SEQ ID NO: 8585 - protein, 9 aa, Homo Sapiens
SLFHTPKFV

SEQ ID NO: 8586 - protein, 9 aa, Homo Sapiens
SLFIVPSVV

SEQ ID NO: 8587 - protein, 9 aa, Homo Sapiens
SLFLGILSV

SEQ ID NO: 8588 - protein, 9 aa, Homo Sapiens
SLFRHPKQV

SEQ ID NO: 8589 - protein, 9 aa, Homo Sapiens
SLFRVITEV

SEQ ID NO: 8590 - protein, 9 aa, Homo Sapiens
SLFSHLLEI

SEQ ID NO: 8591 - protein, 9 aa, Homo Sapiens
SLFVKLHNV

SEQ ID NO: 8592 - protein, 9 aa, Homo Sapiens
SLGPQPLVA

SEQ ID NO: 8593 - protein, 9 aa, Homo Sapiens
SLGQKISTV

SEQ ID NO: 8594 - protein, 9 aa, Homo Sapiens
SLGRHISQV

SEQ ID NO: 8595 - protein, 9 aa, Homo Sapiens
SLHDAIMIV

SEQ ID NO: 8596 - protein, 9 aa, Homo Sapiens
SLHDALCVV

SEQ ID NO: 8597 - protein, 9 aa, Homo Sapiens
SLHDTVTTL

SEQ ID NO: 8598 - protein, 9 aa, Homo Sapiens
SLHLRIPEI

SEQ ID NO: 8599 - protein, 9 aa, Homo Sapiens
SLHTELNSV

SEQ ID NO: 8600 - protein, 9 aa, Homo Sapiens
SLHVFVLAV

SEQ ID NO: 8601 - protein, 9 aa, Homo Sapiens
SLIAGVIRV

SEQ ID NO: 8602 - protein, 9 aa, Homo Sapiens
SLIAKVATA

SEQ ID NO: 8603 - protein, 9 aa, Homo Sapiens
SLIARLERL

SEQ ID NO: 8604 - protein, 9 aa, Homo Sapiens
SLIDFLRVV

SEQ ID NO: 8605 - protein, 9 aa, Homo Sapiens
SLIDGIKRA

SEQ ID NO: 8606 - protein, 9 aa, Homo Sapiens
SLIDIVTEI

SEQ ID NO: 8607 - protein, 9 aa, Homo Sapiens
SLIDKPTNL

SEQ ID NO: 8608 - protein, 9 aa, Homo Sapiens
SLIDQFFGV

SEQ ID NO: 8609 - protein, 9 aa, Homo Sapiens
SLIEHLQGL

SEQ ID NO: 8610 - protein, 9 aa, Homo Sapiens
SLIEKIPTA

SEQ ID NO: 8611 - protein, 9 aa, Homo Sapiens
SLIEKLWQT

SEQ ID NO: 8612 - protein, 9 aa, Homo Sapiens
SLIEKVTQL

SEQ ID NO: 8613 - protein, 9 aa, Homo Sapiens
SLIEQTTAL

SEQ ID NO: 8614 - protein, 9 aa, Homo Sapiens
SLIFKLEEL

SEQ ID NO: 8615 - protein, 9 aa, Homo Sapiens
SLIGHLQTL

SEQ ID NO: 8616 - protein, 9 aa, Homo Sapiens
SLIGIVCGV

SEQ ID NO: 8617 - protein, 9 aa, Homo Sapiens
SLIGNLHLA

SEQ ID NO: 8618 - protein, 9 aa, Homo Sapiens
SLIKKIKDV

SEQ ID NO: 8619 - protein, 9 aa, Homo Sapiens
SLIKQIPRI

SEQ ID NO: 8620 - protein, 9 aa, Homo Sapiens
SLINNPAFI

SEQ ID NO: 8621 - protein, 9 aa, Homo Sapiens
SLIPIISGV

SEQ ID NO: 8622 - protein, 9 aa, Homo Sapiens
SLIRAMLQV

SEQ ID NO: 8623 - protein, 9 aa, Homo Sapiens
SLIRIVPVV

SEQ ID NO: 8624 - protein, 9 aa, Homo Sapiens
SLIRNLEQL

SEQ ID NO: 8625 - protein, 9 aa, Homo Sapiens
SLISGIIRA

SEQ ID NO: 8626 - protein, 9 aa, Homo Sapiens
SLISVIHLI

SEQ ID NO: 8627 - protein, 9 aa, Homo Sapiens
SLITLIEKV

SEQ ID NO: 8628 - protein, 9 aa, Homo Sapiens
SLITPLQAV

SEQ ID NO: 8629 - protein, 9 aa, Homo Sapiens
SLITRLLEV

SEQ ID NO: 8630 - protein, 9 aa, Homo Sapiens
SLKADLQKL

SEQ ID NO: 8631 - protein, 9 aa, Homo Sapiens
SLKAHVQEV

SEQ ID NO: 8632 - protein, 9 aa, Homo Sapiens
SLKDDLTKL

SEQ ID NO: 8633 - protein, 9 aa, Homo Sapiens
SLKDEVLKI

SEQ ID NO: 8634 - protein, 9 aa, Homo Sapiens
SLKDQLTDL

SEQ ID NO: 8635 - protein, 9 aa, Homo Sapiens
SLKEALQKA

SEQ ID NO: 8636 - protein, 9 aa, Homo Sapiens
SLKEDIQKA

SEQ ID NO: 8637 - protein, 9 aa, Homo Sapiens
SLKEIISSA

SEQ ID NO: 8638 - protein, 9 aa, Homo Sapiens
SLKEIVINV

SEQ ID NO: 8639 - protein, 9 aa, Homo Sapiens
SLKELITEA

SEQ ID NO: 8640 - protein, 9 aa, Homo Sapiens
SLKEMVSKL

SEQ ID NO: 8641 - protein, 9 aa, Homo Sapiens
SLKEQVESI

SEQ ID NO: 8642 - protein, 9 aa, Homo Sapiens
SLKETIEEL

SEQ ID NO: 8643 - protein, 9 aa, Homo Sapiens
SLKEVMTHI

SEQ ID NO: 8644 - protein, 9 aa, Homo Sapiens
SLKGDIVEL

SEQ ID NO: 8645 - protein, 9 aa, Homo Sapiens
SLKGLVKNI

SEQ ID NO: 8646 - protein, 9 aa, Homo Sapiens
SLKGTLDNL

SEQ ID NO: 8647 - protein, 9 aa, Homo Sapiens
SLKHTLLSL

SEQ ID NO: 8648 - protein, 9 aa, Homo Sapiens
SLKISIGNV

SEQ ID NO: 8649 - protein, 9 aa, Homo Sapiens
SLKKAIRQI

SEQ ID NO: 8650 - protein, 9 aa, Homo Sapiens
SLKKLILEV

SEQ ID NO: 8651 - protein, 9 aa, Homo Sapiens
SLKKQLTRV

SEQ ID NO: 8652 - protein, 9 aa, Homo Sapiens
SLKKTISQI

SEQ ID NO: 8653 - protein, 9 aa, Homo Sapiens
SLKLFAKEV

SEQ ID NO: 8654 - protein, 9 aa, Homo Sapiens
SLKMKVVEV

SEQ ID NO: 8655 - protein, 9 aa, Homo Sapiens
SLKNRIESV

SEQ ID NO: 8656 - protein, 9 aa, Homo Sapiens
SLKPEVAQV

SEQ ID NO: 8657 - protein, 9 aa, Homo Sapiens
SLKPKLIEA

SEQ ID NO: 8658 - protein, 9 aa, Homo Sapiens
SLKPLLFEI

SEQ ID NO: 8659 - protein, 9 aa, Homo Sapiens
SLKQELEQL

SEQ ID NO: 8660 - protein, 9 aa, Homo Sapiens
SLKQKILKV

SEQ ID NO: 8661 - protein, 9 aa, Homo Sapiens
SLKQTVVTL

SEQ ID NO: 8662 - protein, 9 aa, Homo Sapiens
SLKQVLTAL

SEQ ID NO: 8663 - protein, 9 aa, Homo Sapiens
SLKRQLQQL

SEQ ID NO: 8664 - protein, 9 aa, Homo Sapiens
SLKSKVLSV

SEQ ID NO: 8665 - protein, 9 aa, Homo Sapiens
SLKSLILTA

SEQ ID NO: 8666 - protein, 9 aa, Homo Sapiens
SLKSNVLNV

SEQ ID NO: 8667 - protein, 9 aa, Homo Sapiens
SLKSNVTSL

SEQ ID NO: 8668 - protein, 9 aa, Homo Sapiens
SLKSSLHTL

SEQ ID NO: 8669 - protein, 9 aa, Homo Sapiens
SLKTAIYRI

SEQ ID NO: 8670 - protein, 9 aa, Homo Sapiens
SLKTFVHTV

SEQ ID NO: 8671 - protein, 9 aa, Homo Sapiens
SLKTLLECV

SEQ ID NO: 8672 - protein, 9 aa, Homo Sapiens
SLKTLLVQL

SEQ ID NO: 8673 - protein, 9 aa, Homo Sapiens
SLKVDVEAL

SEQ ID NO: 8674 - protein, 9 aa, Homo Sapiens
SLKYPYVAV

SEQ ID NO: 8675 - protein, 9 aa, Homo Sapiens
SLKYQTRCI

SEQ ID NO: 8676 - protein, 9 aa, Homo Sapiens
SLLEHLSHV

SEQ ID NO: 8677 - protein, 9 aa, Homo Sapiens
SLLEKLSAL

SEQ ID NO: 8678 - protein, 9 aa, Homo Sapiens
SLLGHLMIV

SEQ ID NO: 8679 - protein, 9 aa, Homo Sapiens
SLLNQPKAV

SEQ ID NO: 8680 - protein, 9 aa, Homo Sapiens
SLMEKISKL

SEQ ID NO: 8681 - protein, 9 aa, Homo Sapiens
SLMGTLSKL

SEQ ID NO: 8682 - protein, 9 aa, Homo Sapiens
SLNEHLQAL

SEQ ID NO: 8683 - protein, 9 aa, Homo Sapiens
SLNKQIAQL

SEQ ID NO: 8684 - protein, 9 aa, Homo Sapiens
SLNKQIETV

SEQ ID NO: 8685 - protein, 9 aa, Homo Sapiens
SLNTGIITV

SEQ ID NO: 8686 - protein, 9 aa, Homo Sapiens
SLNTLTLNV

SEQ ID NO: 8687 - protein, 9 aa, Homo Sapiens
SLPCLLLLV

SEQ ID NO: 8688 - protein, 9 aa, Homo Sapiens
SLPDHLPSV

SEQ ID NO: 8689 - protein, 9 aa, Homo Sapiens
SLPPHILEV

SEQ ID NO: 8690 - protein, 9 aa, Homo Sapiens
SLPTKISRC

SEQ ID NO: 8691 - protein, 9 aa, Homo Sapiens
SLQDEIQRV

SEQ ID NO: 8692 - protein, 9 aa, Homo Sapiens
SLQEKPMEI

SEQ ID NO: 8693 - protein, 9 aa, Homo Sapiens
SLQQRLEYI

SEQ ID NO: 8694 - protein, 9 aa, Homo Sapiens
SLQSTILGV

SEQ ID NO: 8695 - protein, 9 aa, Homo Sapiens
SLQVLLTTV

SEQ ID NO: 8696 - protein, 9 aa, Homo Sapiens
SLRDFTVTV

SEQ ID NO: 8697 - protein, 9 aa, Homo Sapiens
SLRDKVLQL

SEQ ID NO: 8698 - protein, 9 aa, Homo Sapiens
SLRDLIQGL

SEQ ID NO: 8699 - protein, 9 aa, Homo Sapiens
SLRDSVPSL

SEQ ID NO: 8700 - protein, 9 aa, Homo Sapiens
SLREALSFV

SEQ ID NO: 8701 - protein, 9 aa, Homo Sapiens
SLREKIQFI

SEQ ID NO: 8702 - protein, 9 aa, Homo Sapiens
SLREQLEGV

SEQ ID NO: 8703 - protein, 9 aa, Homo Sapiens
SLRGVVQEL

SEQ ID NO: 8704 - protein, 9 aa, Homo Sapiens
SLRNLVVSL

SEQ ID NO: 8705 - protein, 9 aa, Homo Sapiens
SLRPDLLTV

SEQ ID NO: 8706 - protein, 9 aa, Homo Sapiens
SLRPILNTL

SEQ ID NO: 8707 - protein, 9 aa, Homo Sapiens
SLRPTVAEL

SEQ ID NO: 8708 - protein, 9 aa, Homo Sapiens
SLRQSLMKL

SEQ ID NO: 8709 - protein, 9 aa, Homo Sapiens
SLRSIVKSL

SEQ ID NO: 8710 - protein, 9 aa, Homo Sapiens
SLRSSLEVL

SEQ ID NO: 8711 - protein, 9 aa, Homo Sapiens
SLRTSIIEA

SEQ ID NO: 8712 - protein, 9 aa, Homo Sapiens
SLSAIFNNV

SEQ ID NO: 8713 - protein, 9 aa, Homo Sapiens
SLSDHLLRA

SEQ ID NO: 8714 - protein, 9 aa, Homo Sapiens
SLSDHSLGI

SEQ ID NO: 8715 - protein, 9 aa, Homo Sapiens
SLSEILSNI

SEQ ID NO: 8716 - protein, 9 aa, Homo Sapiens
SLSEKTVLL

SEQ ID NO: 8717 - protein, 9 aa, Homo Sapiens
SLSERIMQL

SEQ ID NO: 8718 - protein, 9 aa, Homo Sapiens
SLSEYVSRM

SEQ ID NO: 8719 - protein, 9 aa, Homo Sapiens
SLSGELREV

SEQ ID NO: 8720 - protein, 9 aa, Homo Sapiens
SLSGYINYL

SEQ ID NO: 8721 - protein, 9 aa, Homo Sapiens
SLSHSLLAV

SEQ ID NO: 8722 - protein, 9 aa, Homo Sapiens
SLSKITTTV

SEQ ID NO: 8723 - protein, 9 aa, Homo Sapiens
SLSLHNNLL

SEQ ID NO: 8724 - protein, 9 aa, Homo Sapiens
SLSQHINWV

SEQ ID NO: 8725 - protein, 9 aa, Homo Sapiens
SLSQHNDFL

SEQ ID NO: 8726 - protein, 9 aa, Homo Sapiens
SLSSFLHGV

SEQ ID NO: 8727 - protein, 9 aa, Homo Sapiens
SLSSHMSLL

SEQ ID NO: 8728 - protein, 9 aa, Homo Sapiens
SLSSHVTEL

SEQ ID NO: 8729 - protein, 9 aa, Homo Sapiens
SLSSLELFL

SEQ ID NO: 8730 - protein, 9 aa, Homo Sapiens
SLSSVLSHV

SEQ ID NO: 8731 - protein, 9 aa, Homo Sapiens
SLTAHLRSL

SEQ ID NO: 8732 - protein, 9 aa, Homo Sapiens
SLTGHISTV

SEQ ID NO: 8733 - protein, 9 aa, Homo Sapiens
SLVAILQSV

SEQ ID NO: 8734 - protein, 9 aa, Homo Sapiens
SLVDIYSQL

SEQ ID NO: 8735 - protein, 9 aa, Homo Sapiens
SLVDKTKQV

SEQ ID NO: 8736 - protein, 9 aa, Homo Sapiens
SLVEIILHV

SEQ ID NO: 8737 - protein, 9 aa, Homo Sapiens
SLVELLNQI

SEQ ID NO: 8738 - protein, 9 aa, Homo Sapiens
SLVEQLTMV

SEQ ID NO: 8739 - protein, 9 aa, Homo Sapiens
SLVQRVETI

SEQ ID NO: 8740 - protein, 9 aa, Homo Sapiens
SLVSSLYKV

SEQ ID NO: 8741 - protein, 9 aa, Homo Sapiens
SLVTKINNV

SEQ ID NO: 8742 - protein, 9 aa, Homo Sapiens
SLYEMVSRV

SEQ ID NO: 8743 - protein, 9 aa, Homo Sapiens
SLYGGTITI

SEQ ID NO: 8744 - protein, 9 aa, Homo Sapiens
SLYGYLRGA

SEQ ID NO: 8745 - protein, 9 aa, Homo Sapiens
SLYIRPTFI

SEQ ID NO: 8746 - protein, 9 aa, Homo Sapiens
SLYKGLLSV

SEQ ID NO: 8747 - protein, 9 aa, Homo Sapiens
SLYPKPEAL

SEQ ID NO: 8748 - protein, 9 aa, Homo Sapiens
SLYPSIMMA

SEQ ID NO: 8749 - protein, 9 aa, Homo Sapiens
SLYRDLLRA

SEQ ID NO: 8750 - protein, 9 aa, Homo Sapiens
SMAAIITLL

SEQ ID NO: 8751 - protein, 9 aa, Homo Sapiens
SMAEILRSL

SEQ ID NO: 8752 - protein, 9 aa, Homo Sapiens
SMAKAITGV

SEQ ID NO: 8753 - protein, 9 aa, Homo Sapiens
SMAPSLKEL

SEQ ID NO: 8754 - protein, 9 aa, Homo Sapiens
SMAPYVLNV

SEQ ID NO: 8755 - protein, 9 aa, Homo Sapiens
SMAVVIPEA

SEQ ID NO: 8756 - protein, 9 aa, Homo Sapiens
SMFGAGLTV

SEQ ID NO: 8757 - protein, 9 aa, Homo Sapiens
SMIPALREL

SEQ ID NO: 8758 - protein, 9 aa, Homo Sapiens
SMISKLKQA

SEQ ID NO: 8759 - protein, 9 aa, Homo Sapiens
SMKAFISKV

SEQ ID NO: 8760 - protein, 9 aa, Homo Sapiens
SMKDDLERV

SEQ ID NO: 8761 - protein, 9 aa, Homo Sapiens
SMKENISKL

SEQ ID NO: 8762 - protein, 9 aa, Homo Sapiens
SMKSELSYL

SEQ ID NO: 8763 - protein, 9 aa, Homo Sapiens
SMMQTLLTV

SEQ ID NO: 8764 - protein, 9 aa, Homo Sapiens
SMNTHLKAV

SEQ ID NO: 8765 - protein, 9 aa, Homo Sapiens
SMSADVPLV

SEQ ID NO: 8766 - protein, 9 aa, Homo Sapiens
SMSETVRLV

SEQ ID NO: 8767 - protein, 9 aa, Homo Sapiens
SMYDGLLQA

SEQ ID NO: 8768 - protein, 9 aa, Homo Sapiens
SQISRLQNI

SEQ ID NO: 8769 - protein, 9 aa, Homo Sapiens
SQRTITVGV

SEQ ID NO: 8770 - protein, 9 aa, Homo Sapiens
SQSFQPMTV

SEQ ID NO: 8771 - protein, 9 aa, Homo Sapiens
SSYSRFSSS

SEQ ID NO: 8772 - protein, 9 aa, Homo Sapiens
STAAKIMGV

SEQ ID NO: 8773 - protein, 9 aa, Homo Sapiens
STIAILNSV

SEQ ID NO: 8774 - protein, 9 aa, Homo Sapiens
SVAESLLQV

SEQ ID NO: 8775 - protein, 9 aa, Homo Sapiens
SVAESLNYV

SEQ ID NO: 8776 - protein, 9 aa, Homo Sapiens
SVANHNSFL

SEQ ID NO: 8777 - protein, 9 aa, Homo Sapiens
SVASSVKGV

SEQ ID NO: 8778 - protein, 9 aa, Homo Sapiens
SVASTITGV

SEQ ID NO: 8779 - protein, 9 aa, Homo Sapiens
SVATKLTAV

SEQ ID NO: 8780 - protein, 9 aa, Homo Sapiens
SVFAGVVGV

SEQ ID NO: 8781 - protein, 9 aa, Homo Sapiens
SVHKGFAFV

SEQ ID NO: 8782 - protein, 9 aa, Homo Sapiens
SVILKLSNV

SEQ ID NO: 8783 - protein, 9 aa, Homo Sapiens
SVIPQIQKV

SEQ ID NO: 8784 - protein, 9 aa, Homo Sapiens
SVIQNLRTV

SEQ ID NO: 8785 - protein, 9 aa, Homo Sapiens
SVISHLLRV

SEQ ID NO: 8786 - protein, 9 aa, Homo Sapiens
SVISIMKPV

SEQ ID NO: 8787 - protein, 9 aa, Homo Sapiens
SVISKVNSV

SEQ ID NO: 8788 - protein, 9 aa, Homo Sapiens
SVKEVISAV

SEQ ID NO: 8789 - protein, 9 aa, Homo Sapiens
SVKNGILTI

SEQ ID NO: 8790 - protein, 9 aa, Homo Sapiens
SVKPQILSV

SEQ ID NO: 8791 - protein, 9 aa, Homo Sapiens
SVMELLQGV

SEQ ID NO: 8792 - protein, 9 aa, Homo Sapiens
SVMEYVTAV

SEQ ID NO: 8793 - protein, 9 aa, Homo Sapiens
SVRPAVLQV

SEQ ID NO: 8794 - protein, 9 aa, Homo Sapiens
SVTSHIYQV

SEQ ID NO: 8795 - protein, 9 aa, Homo Sapiens
SVTYDLSKL

SEQ ID NO: 8796 - protein, 9 aa, Homo Sapiens
SVYGKLRKV

SEQ ID NO: 8797 - protein, 9 aa, Homo Sapiens
SVYGSLASV

SEQ ID NO: 8798 - protein, 9 aa, Homo Sapiens
SVYSRVIQV

SEQ ID NO: 8799 - protein, 9 aa, Homo Sapiens
TIDDIVLTI

SEQ ID NO: 8800 - protein, 9 aa, Homo Sapiens
TIFSAPNYC

SEQ ID NO: 8801 - protein, 9 aa, Homo Sapiens
TIIEQVGKV

SEQ ID NO: 8802 - protein, 9 aa, Homo Sapiens
TIKEILGTA

SEQ ID NO: 8803 - protein, 9 aa, Homo Sapiens
TLAAAVPKI

SEQ ID NO: 8804 - protein, 9 aa, Homo Sapiens
TLADIYREL

SEQ ID NO: 8805 - protein, 9 aa, Homo Sapiens
TLADLVHHV

SEQ ID NO: 8806 - protein, 9 aa, Homo Sapiens
TLADMATRL

SEQ ID NO: 8807 - protein, 9 aa, Homo Sapiens
TLADRLLEL

SEQ ID NO: 8808 - protein, 9 aa, Homo Sapiens
TLADVLYHV

SEQ ID NO: 8809 - protein, 9 aa, Homo Sapiens
TLAEHQQLI

SEQ ID NO: 8810 - protein, 9 aa, Homo Sapiens
TLAEKIQTI

SEQ ID NO: 8811 - protein, 9 aa, Homo Sapiens
TLAELHISL

SEQ ID NO: 8812 - protein, 9 aa, Homo Sapiens
TLAELLVLL

SEQ ID NO: 8813 - protein, 9 aa, Homo Sapiens
TLAETLVNL

SEQ ID NO: 8814 - protein, 9 aa, Homo Sapiens
TLAGDVHIV

SEQ ID NO: 8815 - protein, 9 aa, Homo Sapiens
TLAGLIPFV

SEQ ID NO: 8816 - protein, 9 aa, Homo Sapiens
TLAKPPSVV

SEQ ID NO: 8817 - protein, 9 aa, Homo Sapiens
TLAKYLMEL

SEQ ID NO: 8818 - protein, 9 aa, Homo Sapiens
TLANVVTSL

SEQ ID NO: 8819 - protein, 9 aa, Homo Sapiens
TLAPKTLSV

SEQ ID NO: 8820 - protein, 9 aa, Homo Sapiens
TLAQHLSQL

SEQ ID NO: 8821 - protein, 9 aa, Homo Sapiens
TLAQLLTLL

SEQ ID NO: 8822 - protein, 9 aa, Homo Sapiens
TLAQRVKEV

SEQ ID NO: 8823 - protein, 9 aa, Homo Sapiens
TLASIIKEV

SEQ ID NO: 8824 - protein, 9 aa, Homo Sapiens
TLASSLHTL

SEQ ID NO: 8825 - protein, 9 aa, Homo Sapiens
TLFGMITAV

SEQ ID NO: 8826 - protein, 9 aa, Homo Sapiens
TLFNVIKSV

SEQ ID NO: 8827 - protein, 9 aa, Homo Sapiens
TLFQGIKTV

SEQ ID NO: 8828 - protein, 9 aa, Homo Sapiens
TLFYSLREV

SEQ ID NO: 8829 - protein, 9 aa, Homo Sapiens
TLGNVLVTV

SEQ ID NO: 8830 - protein, 9 aa, Homo Sapiens
TLHPQVATI

SEQ ID NO: 8831 - protein, 9 aa, Homo Sapiens
TLHSLISEL

SEQ ID NO: 8832 - protein, 9 aa, Homo Sapiens
TLIALLAHA

SEQ ID NO: 8833 - protein, 9 aa, Homo Sapiens
TLIEDILGV

SEQ ID NO: 8834 - protein, 9 aa, Homo Sapiens
TLIEELKAL

SEQ ID NO: 8835 - protein, 9 aa, Homo Sapiens
TLIEELKTL

SEQ ID NO: 8836 - protein, 9 aa, Homo Sapiens
TLIEKVQEA

SEQ ID NO: 8837 - protein, 9 aa, Homo Sapiens
TLIHQVLEA

SEQ ID NO: 8838 - protein, 9 aa, Homo Sapiens
TLINLLLKV

SEQ ID NO: 8839 - protein, 9 aa, Homo Sapiens
TLIPSVSQV

SEQ ID NO: 8840 - protein, 9 aa, Homo Sapiens
TLISELVQA

SEQ ID NO: 8841 - protein, 9 aa, Homo Sapiens
TLISRLPAV

SEQ ID NO: 8842 - protein, 9 aa, Homo Sapiens
TLKDFVTVL

SEQ ID NO: 8843 - protein, 9 aa, Homo Sapiens
TLKDGIIMI

SEQ ID NO: 8844 - protein, 9 aa, Homo Sapiens
TLKDLLFGV

SEQ ID NO: 8845 - protein, 9 aa, Homo Sapiens
TLKDPIVSI

SEQ ID NO: 8846 - protein, 9 aa, Homo Sapiens
TLKDTITSV

SEQ ID NO: 8847 - protein, 9 aa, Homo Sapiens
TLKEDPGKV

SEQ ID NO: 8848 - protein, 9 aa, Homo Sapiens
TLKEEVQKL

SEQ ID NO: 8849 - protein, 9 aa, Homo Sapiens
TLKEILRYL

SEQ ID NO: 8850 - protein, 9 aa, Homo Sapiens
TLKELTSLV

SEQ ID NO: 8851 - protein, 9 aa, Homo Sapiens
TLKEWTLQV

SEQ ID NO: 8852 - protein, 9 aa, Homo Sapiens
TLKEYLESL

SEQ ID NO: 8853 - protein, 9 aa, Homo Sapiens
TLKKVSVTV

SEQ ID NO: 8854 - protein, 9 aa, Homo Sapiens
TLKMEVISL

SEQ ID NO: 8855 - protein, 9 aa, Homo Sapiens
TLKNWVKEL

SEQ ID NO: 8856 - protein, 9 aa, Homo Sapiens
TLKPAIEEI

SEQ ID NO: 8857 - protein, 9 aa, Homo Sapiens
TLKPGTMSV

SEQ ID NO: 8858 - protein, 9 aa, Homo Sapiens
TLKQGIERV

SEQ ID NO: 8859 - protein, 9 aa, Homo Sapiens
TLKRTIEAL

SEQ ID NO: 8860 - protein, 9 aa, Homo Sapiens
TLKSTVEAL

SEQ ID NO: 8861 - protein, 9 aa, Homo Sapiens
TLKVQELKV

SEQ ID NO: 8862 - protein, 9 aa, Homo Sapiens
TLNEKLTAL

SEQ ID NO: 8863 - protein, 9 aa, Homo Sapiens
TLNFPGRTV

SEQ ID NO: 8864 - protein, 9 aa, Homo Sapiens
TLNNWLATV

SEQ ID NO: 8865 - protein, 9 aa, Homo Sapiens
TLNSKLLKV

SEQ ID NO: 8866 - protein, 9 aa, Homo Sapiens
TLPDTILTV

SEQ ID NO: 8867 - protein, 9 aa, Homo Sapiens
TLQEVVTGV

SEQ ID NO: 8868 - protein, 9 aa, Homo Sapiens
TLQNAVRNV

SEQ ID NO: 8869 - protein, 9 aa, Homo Sapiens
TLREHLERL

SEQ ID NO: 8870 - protein, 9 aa, Homo Sapiens
TLRGHLAKI

SEQ ID NO: 8871 - protein, 9 aa, Homo Sapiens
TLRPALVGV

SEQ ID NO: 8872 - protein, 9 aa, Homo Sapiens
TLSDIMVSL

SEQ ID NO: 8873 - protein, 9 aa, Homo Sapiens
TLSDIVVTL

SEQ ID NO: 8874 - protein, 9 aa, Homo Sapiens
TLSDLRVYL

SEQ ID NO: 8875 - protein, 9 aa, Homo Sapiens
TLSELKTVL

SEQ ID NO: 8876 - protein, 9 aa, Homo Sapiens
TLSEVTNQL

SEQ ID NO: 8877 - protein, 9 aa, Homo Sapiens
TLSPHIQAI

SEQ ID NO: 8878 - protein, 9 aa, Homo Sapiens
TLSPLLLFL

SEQ ID NO: 8879 - protein, 9 aa, Homo Sapiens
TLSSFITKI

SEQ ID NO: 8880 - protein, 9 aa, Homo Sapiens
TLSSIPTAL

SEQ ID NO: 8881 - protein, 9 aa, Homo Sapiens
TLSSQISRL

SEQ ID NO: 8882 - protein, 9 aa, Homo Sapiens
TLSTVISKV

SEQ ID NO: 8883 - protein, 9 aa, Homo Sapiens
TLTAHLSQA

SEQ ID NO: 8884 - protein, 9 aa, Homo Sapiens
TLTERLLGI

SEQ ID NO: 8885 - protein, 9 aa, Homo Sapiens
TLVEAIKQV

SEQ ID NO: 8886 - protein, 9 aa, Homo Sapiens
TLVTWLQCV

SEQ ID NO: 8887 - protein, 9 aa, Homo Sapiens
TLVYHVVGV

SEQ ID NO: 8888 - protein, 9 aa, Homo Sapiens
TLYDMLASI

SEQ ID NO: 8889 - protein, 9 aa, Homo Sapiens
TLYEALKTI

SEQ ID NO: 8890 - protein, 9 aa, Homo Sapiens
TLYEAVREV

SEQ ID NO: 8891 - protein, 9 aa, Homo Sapiens
TLYPAVKSL

SEQ ID NO: 8892 - protein, 9 aa, Homo Sapiens
TMADQIVTV

SEQ ID NO: 8893 - protein, 9 aa, Homo Sapiens
TMAYNITPL

SEQ ID NO: 8894 - protein, 9 aa, Homo Sapiens
TMIGEIAAA

SEQ ID NO: 8895 - protein, 9 aa, Homo Sapiens
TMINAIPVA

SEQ ID NO: 8896 - protein, 9 aa, Homo Sapiens
TMIVSLAAV

SEQ ID NO: 8897 - protein, 9 aa, Homo Sapiens
TMKDHLVRV

SEQ ID NO: 8898 - protein, 9 aa, Homo Sapiens
TMKEVLFYL

SEQ ID NO: 8899 - protein, 9 aa, Homo Sapiens
TMKTNLESL

SEQ ID NO: 8900 - protein, 9 aa, Homo Sapiens
TMKTYVEKV

SEQ ID NO: 8901 - protein, 9 aa, Homo Sapiens
TMVDRIEEV

SEQ ID NO: 8902 - protein, 9 aa, Homo Sapiens
TQILSVPKV

SEQ ID NO: 8903 - protein, 9 aa, Homo Sapiens
TTFPRPVTV

SEQ ID NO: 8904 - protein, 9 aa, Homo Sapiens
TTISKVSQV

SEQ ID NO: 8905 - protein, 9 aa, Homo Sapiens
TVADHIQKV

SEQ ID NO: 8906 - protein, 9 aa, Homo Sapiens
TVFTNPTQV

SEQ ID NO: 8907 - protein, 9 aa, Homo Sapiens
TVIAKVNNV

SEQ ID NO: 8908 - protein, 9 aa, Homo Sapiens
TVKDFVAKV

SEQ ID NO: 8909 - protein, 9 aa, Homo Sapiens
TVMGRIATL

SEQ ID NO: 8910 - protein, 9 aa, Homo Sapiens
VAGLALVGV

SEQ ID NO: 8911 - protein, 9 aa, Homo Sapiens
VIAEILRGV

SEQ ID NO: 8912 - protein, 9 aa, Homo Sapiens
VIAPKITSV

SEQ ID NO: 8913 - protein, 9 aa, Homo Sapiens
VIFDLPTTV

SEQ ID NO: 8914 - protein, 9 aa, Homo Sapiens
VIIPLLHTV

SEQ ID NO: 8915 - protein, 9 aa, Homo Sapiens
VIIPLLSSV

SEQ ID NO: 8916 - protein, 9 aa, Homo Sapiens
VIKALLEVV

SEQ ID NO: 8917 - protein, 9 aa, Homo Sapiens
VIKEDVSEL

SEQ ID NO: 8918 - protein, 9 aa, Homo Sapiens
VIKESVVSI

SEQ ID NO: 8919 - protein, 9 aa, Homo Sapiens
VIKQQLESV

SEQ ID NO: 8920 - protein, 9 aa, Homo Sapiens
VINGNIKTV

SEQ ID NO: 8921 - protein, 9 aa, Homo Sapiens
VIRQITATV

SEQ ID NO: 8922 - protein, 9 aa, Homo Sapiens
VIVEKPLSV

SEQ ID NO: 8923 - protein, 9 aa, Homo Sapiens
VIVHRLLAV

SEQ ID NO: 8924 - protein, 9 aa, Homo Sapiens
VLAAKVLNL

SEQ ID NO: 8925 - protein, 9 aa, Homo Sapiens
VLADALKSI

SEQ ID NO: 8926 - protein, 9 aa, Homo Sapiens
VLADLKVQL

SEQ ID NO: 8927 - protein, 9 aa, Homo Sapiens
VLAEIPQQV

SEQ ID NO: 8928 - protein, 9 aa, Homo Sapiens
VLAERMSTI

SEQ ID NO: 8929 - protein, 9 aa, Homo Sapiens
VLAEVPTQL

SEQ ID NO: 8930 - protein, 9 aa, Homo Sapiens
VLAHTILGV

SEQ ID NO: 8931 - protein, 9 aa, Homo Sapiens
VLAPHLTRA

SEQ ID NO: 8932 - protein, 9 aa, Homo Sapiens
VLAPLIALV

SEQ ID NO: 8933 - protein, 9 aa, Homo Sapiens
VLAPRVLRA

SEQ ID NO: 8934 - protein, 9 aa, Homo Sapiens
VLASLIIRL

SEQ ID NO: 8935 - protein, 9 aa, Homo Sapiens
VLASPWLIL

SEQ ID NO: 8936 - protein, 9 aa, Homo Sapiens
VLATTVGKV

SEQ ID NO: 8937 - protein, 9 aa, Homo Sapiens
VLAVHLNTL

SEQ ID NO: 8938 - protein, 9 aa, Homo Sapiens
VLAVRVVTL

SEQ ID NO: 8939 - protein, 9 aa, Homo Sapiens
VLAWGLLNV

SEQ ID NO: 8940 - protein, 9 aa, Homo Sapiens
VLAWVKEKV

SEQ ID NO: 8941 - protein, 9 aa, Homo Sapiens
VLAYFLPEA

SEQ ID NO: 8942 - protein, 9 aa, Homo Sapiens
VLFDHVGCL

SEQ ID NO: 8943 - protein, 9 aa, Homo Sapiens
VLFDVTGQV

SEQ ID NO: 8944 - protein, 9 aa, Homo Sapiens
VLFGKPMVV

SEQ ID NO: 8945 - protein, 9 aa, Homo Sapiens
VLFGLLREV

SEQ ID NO: 8946 - protein, 9 aa, Homo Sapiens
VLFHNLPSL

SEQ ID NO: 8947 - protein, 9 aa, Homo Sapiens
VLFHQLQEI

SEQ ID NO: 8948 - protein, 9 aa, Homo Sapiens
VLFPLPTPL

SEQ ID NO: 8949 - protein, 9 aa, Homo Sapiens
VLFTGVKEV

SEQ ID NO: 8950 - protein, 9 aa, Homo Sapiens
VLFYAITTL

SEQ ID NO: 8951 - protein, 9 aa, Homo Sapiens
VLHDRIVSV

SEQ ID NO: 8952 - protein, 9 aa, Homo Sapiens
VLHEGTNFV

SEQ ID NO: 8953 - protein, 9 aa, Homo Sapiens
VLHEHIQRL

SEQ ID NO: 8954 - protein, 9 aa, Homo Sapiens
VLHSPGMSV

SEQ ID NO: 8955 - protein, 9 aa, Homo Sapiens
VLHSSPLNV

SEQ ID NO: 8956 - protein, 9 aa, Homo Sapiens
VLIAKVARL

SEQ ID NO: 8957 - protein, 9 aa, Homo Sapiens
VLIANLEKL

SEQ ID NO: 8958 - protein, 9 aa, Homo Sapiens
VLIDYQRNV

SEQ ID NO: 8959 - protein, 9 aa, Homo Sapiens
VLIEILQKA

SEQ ID NO: 8960 - protein, 9 aa, Homo Sapiens
VLIETLVTL

SEQ ID NO: 8961 - protein, 9 aa, Homo Sapiens
VLIPALKTI

SEQ ID NO: 8962 - protein, 9 aa, Homo Sapiens
VLIPKLPQL

SEQ ID NO: 8963 - protein, 9 aa, Homo Sapiens
VLITTLITA

SEQ ID NO: 8964 - protein, 9 aa, Homo Sapiens
VLKDCIVHL

SEQ ID NO: 8965 - protein, 9 aa, Homo Sapiens
VLKDDILEI

SEQ ID NO: 8966 - protein, 9 aa, Homo Sapiens
VLKDFLSGI

SEQ ID NO: 8967 - protein, 9 aa, Homo Sapiens
VLKDLVKVI

SEQ ID NO: 8968 - protein, 9 aa, Homo Sapiens
VLKDYIAYA

SEQ ID NO: 8969 - protein, 9 aa, Homo Sapiens
VLKEIVERV

SEQ ID NO: 8970 - protein, 9 aa, Homo Sapiens
VLKEQIREL

SEQ ID NO: 8971 - protein, 9 aa, Homo Sapiens
VLKEYLDNV

SEQ ID NO: 8972 - protein, 9 aa, Homo Sapiens
VLKGDVEKL

SEQ ID NO: 8973 - protein, 9 aa, Homo Sapiens
VLKPDLIDV

SEQ ID NO: 8974 - protein, 9 aa, Homo Sapiens
VLKPELQTA

SEQ ID NO: 8975 - protein, 9 aa, Homo Sapiens
VLKPVVELL

SEQ ID NO: 8976 - protein, 9 aa, Homo Sapiens
VLKVFLENV

SEQ ID NO: 8977 - protein, 9 aa, Homo Sapiens
VLMDRLPSL

SEQ ID NO: 8978 - protein, 9 aa, Homo Sapiens
VLMEIIAKV

SEQ ID NO: 8979 - protein, 9 aa, Homo Sapiens
VLMEKPDVV

SEQ ID NO: 8980 - protein, 9 aa, Homo Sapiens
VLMENIVYL

SEQ ID NO: 8981 - protein, 9 aa, Homo Sapiens
VLMEYIRSL

SEQ ID NO: 8982 - protein, 9 aa, Homo Sapiens
VLMPNVGEI

SEQ ID NO: 8983 - protein, 9 aa, Homo Sapiens
VLNEYFHNV

SEQ ID NO: 8984 - protein, 9 aa, Homo Sapiens
VLNGKLLLV

SEQ ID NO: 8985 - protein, 9 aa, Homo Sapiens
VLNPLITAV

SEQ ID NO: 8986 - protein, 9 aa, Homo Sapiens
VLQEKIEVV

SEQ ID NO: 8987 - protein, 9 aa, Homo Sapiens
VLQGKLAEV

SEQ ID NO: 8988 - protein, 9 aa, Homo Sapiens
VLRDNIQGI

SEQ ID NO: 8989 - protein, 9 aa, Homo Sapiens
VLREILTTL

SEQ ID NO: 8990 - protein, 9 aa, Homo Sapiens
VLREWLVAV

SEQ ID NO: 8991 - protein, 9 aa, Homo Sapiens
VLRGALEMV

SEQ ID NO: 8992 - protein, 9 aa, Homo Sapiens
VLRGEVAYI

SEQ ID NO: 8993 - protein, 9 aa, Homo Sapiens
VLRGKLQLV

SEQ ID NO: 8994 - protein, 9 aa, Homo Sapiens
VLRPAVLQA

SEQ ID NO: 8995 - protein, 9 aa, Homo Sapiens
VLRPQVTAV

SEQ ID NO: 8996 - protein, 9 aa, Homo Sapiens
VLRVVIPEV

SEQ ID NO: 8997 - protein, 9 aa, Homo Sapiens
VLSDIIQNL

SEQ ID NO: 8998 - protein, 9 aa, Homo Sapiens
VLSDRIAFL

SEQ ID NO: 8999 - protein, 9 aa, Homo Sapiens
VLSEKVSQL

SEQ ID NO: 9000 - protein, 9 aa, Homo Sapiens
VLSELAARL

SEQ ID NO: 9001 - protein, 9 aa, Homo Sapiens
VLSELLWQV

SEQ ID NO: 9002 - protein, 9 aa, Homo Sapiens
VLSGNIKTV

SEQ ID NO: 9003 - protein, 9 aa, Homo Sapiens
VLSQHFQTV

SEQ ID NO: 9004 - protein, 9 aa, Homo Sapiens
VLSSNLRHV

SEQ ID NO: 9005 - protein, 9 aa, Homo Sapiens
VLSTGVPTV

SEQ ID NO: 9006 - protein, 9 aa, Homo Sapiens
VLSTRVTNV

SEQ ID NO: 9007 - protein, 9 aa, Homo Sapiens
VLSWQFSSV

SEQ ID NO: 9008 - protein, 9 aa, Homo Sapiens
VLTEFTREV

SEQ ID NO: 9009 - protein, 9 aa, Homo Sapiens
VLTEHVAAA

SEQ ID NO: 9010 - protein, 9 aa, Homo Sapiens
VLTNKLLTV

SEQ ID NO: 9011 - protein, 9 aa, Homo Sapiens
VLVDRTIYI

SEQ ID NO: 9012 - protein, 9 aa, Homo Sapiens
VLVEHVKNV

SEQ ID NO: 9013 - protein, 9 aa, Homo Sapiens
VLYDPLKRV

SEQ ID NO: 9014 - protein, 9 aa, Homo Sapiens
VLYDQPRHV

SEQ ID NO: 9015 - protein, 9 aa, Homo Sapiens
VLYDRIQAA

SEQ ID NO: 9016 - protein, 9 aa, Homo Sapiens
VLYDRPLKI

SEQ ID NO: 9017 - protein, 9 aa, Homo Sapiens
VLYELLQHI

SEQ ID NO: 9018 - protein, 9 aa, Homo Sapiens
VLYPHPPLA

SEQ ID NO: 9019 - protein, 9 aa, Homo Sapiens
VLYPSLKEI

SEQ ID NO: 9020 - protein, 9 aa, Homo Sapiens
VLYSALISL

SEQ ID NO: 9021 - protein, 9 aa, Homo Sapiens
VLYTGVVRV

SEQ ID NO: 9022 - protein, 9 aa, Homo Sapiens
VMAPRTLVL

SEQ ID NO: 9023 - protein, 9 aa, Homo Sapiens
VMIPVPAGV

SEQ ID NO: 9024 - protein, 9 aa, Homo Sapiens
VMKKIIETV

SEQ ID NO: 9025 - protein, 9 aa, Homo Sapiens
VMKLDLITV

SEQ ID NO: 9026 - protein, 9 aa, Homo Sapiens
VMRAYLQQL

SEQ ID NO: 9027 - protein, 9 aa, Homo Sapiens
VMSERVSGL

SEQ ID NO: 9028 - protein, 9 aa, Homo Sapiens
VMYDLITEL

SEQ ID NO: 9029 - protein, 9 aa, Homo Sapiens
VQIEEVRQV

SEQ ID NO: 9030 - protein, 9 aa, Homo Sapiens
VQIEHISSL

SEQ ID NO: 9031 - protein, 9 aa, Homo Sapiens
VQIGDIVTV

SEQ ID NO: 9032 - protein, 9 aa, Homo Sapiens
VQSNRILGV

SEQ ID NO: 9033 - protein, 9 aa, Homo Sapiens
VQVQQVRSV

SEQ ID NO: 9034 - protein, 9 aa, Homo Sapiens
VQYNEPLKV

SEQ ID NO: 9035 - protein, 9 aa, Homo Sapiens
VSKVKTLTV

SEQ ID NO: 9036 - protein, 9 aa, Homo Sapiens
VVFQKPSGV

SEQ ID NO: 9037 - protein, 9 aa, Homo Sapiens
VVKGTVLTI

SEQ ID NO: 9038 - protein, 9 aa, Homo Sapiens
WIKDKLLHI

SEQ ID NO: 9039 - protein, 9 aa, Homo Sapiens
WLSTSIPEA

SEQ ID NO: 9040 - protein, 9 aa, Homo Sapiens
WMNINLREV

SEQ ID NO: 9041 - protein, 9 aa, Homo Sapiens
WMVPFVNVV

SEQ ID NO: 9042 - protein, 9 aa, Homo Sapiens
YAFAHILTV

SEQ ID NO: 9043 - protein, 9 aa, Homo Sapiens
YAFNMKATV

SEQ ID NO: 9044 - protein, 9 aa, Homo Sapiens
YAIHGVLEV

SEQ ID NO: 9045 - protein, 9 aa, Homo Sapiens
YAIKNIHGV

SEQ ID NO: 9046 - protein, 9 aa, Homo Sapiens
YIAGHPAFV

SEQ ID NO: 9047 - protein, 9 aa, Homo Sapiens
YIALKLVAV

SEQ ID NO: 9048 - protein, 9 aa, Homo Sapiens
YIAPLKALV

SEQ ID NO: 9049 - protein, 9 aa, Homo Sapiens
YIFAHVGQL

SEQ ID NO: 9050 - protein, 9 aa, Homo Sapiens
YIFTTPKSV

SEQ ID NO: 9051 - protein, 9 aa, Homo Sapiens
YIGEVLVSV

SEQ ID NO: 9052 - protein, 9 aa, Homo Sapiens
YIIDVSQSV

SEQ ID NO: 9053 - protein, 9 aa, Homo Sapiens
YIKAAVKNV

SEQ ID NO: 9054 - protein, 9 aa, Homo Sapiens
YIKDYMKSI

SEQ ID NO: 9055 - protein, 9 aa, Homo Sapiens
YIKTELISV

SEQ ID NO: 9056 - protein, 9 aa, Homo Sapiens
YIMSYISRV

SEQ ID NO: 9057 - protein, 9 aa, Homo Sapiens
YIPDFLTLL

SEQ ID NO: 9058 - protein, 9 aa, Homo Sapiens
YIPTFICSV

SEQ ID NO: 9059 - protein, 9 aa, Homo Sapiens
YITGHVLVV

SEQ ID NO: 9060 - protein, 9 aa, Homo Sapiens
YLADIFTKL

SEQ ID NO: 9061 - protein, 9 aa, Homo Sapiens
YLADLYHFV

SEQ ID NO: 9062 - protein, 9 aa, Homo Sapiens
YLADVTNAL

SEQ ID NO: 9063 - protein, 9 aa, Homo Sapiens
YLAFLGNLV

SEQ ID NO: 9064 - protein, 9 aa, Homo Sapiens
YLAKVKSLL

SEQ ID NO: 9065 - protein, 9 aa, Homo Sapiens
YLAPENGYL

SEQ ID NO: 9066 - protein, 9 aa, Homo Sapiens
YLAPFLRNV

SEQ ID NO: 9067 - protein, 9 aa, Homo Sapiens
YLAPHVRTL

SEQ ID NO: 9068 - protein, 9 aa, Homo Sapiens
YLFEEIAKI

SEQ ID NO: 9069 - protein, 9 aa, Homo Sapiens
YLFERIKEL

SEQ ID NO: 9070 - protein, 9 aa, Homo Sapiens
YLFKCPQSV

SEQ ID NO: 9071 - protein, 9 aa, Homo Sapiens
YLFKGLEDL

SEQ ID NO: 9072 - protein, 9 aa, Homo Sapiens
YLFNSVVNV

SEQ ID NO: 9073 - protein, 9 aa, Homo Sapiens
YLGAKPRSL

SEQ ID NO: 9074 - protein, 9 aa, Homo Sapiens
YLGEGPRMV

SEQ ID NO: 9075 - protein, 9 aa, Homo Sapiens
YLGIVELLV

SEQ ID NO: 9076 - protein, 9 aa, Homo Sapiens
YLHDFLKYL

SEQ ID NO: 9077 - protein, 9 aa, Homo Sapiens
YLHHILRQL

SEQ ID NO: 9078 - protein, 9 aa, Homo Sapiens
YLHNQGIGV

SEQ ID NO: 9079 - protein, 9 aa, Homo Sapiens
YLHSQVVSV

SEQ ID NO: 9080 - protein, 9 aa, Homo Sapiens
YLHSYLTYI

SEQ ID NO: 9081 - protein, 9 aa, Homo Sapiens
YLIARVMLL

SEQ ID NO: 9082 - protein, 9 aa, Homo Sapiens
YLIELIDRV

SEQ ID NO: 9083 - protein, 9 aa, Homo Sapiens
YLIKDIRFL

SEQ ID NO: 9084 - protein, 9 aa, Homo Sapiens
YLIKYIAIV

SEQ ID NO: 9085 - protein, 9 aa, Homo Sapiens
YLINEIDRI

SEQ ID NO: 9086 - protein, 9 aa, Homo Sapiens
YLIPNIKHL

SEQ ID NO: 9087 - protein, 9 aa, Homo Sapiens
YLIQLVQVL

SEQ ID NO: 9088 - protein, 9 aa, Homo Sapiens
YLISELEAA

SEQ ID NO: 9089 - protein, 9 aa, Homo Sapiens
YLITHPLAV

SEQ ID NO: 9090 - protein, 9 aa, Homo Sapiens
YLITSVELL

SEQ ID NO: 9091 - protein, 9 aa, Homo Sapiens
YLKDFFSNV

SEQ ID NO: 9092 - protein, 9 aa, Homo Sapiens
YLKDLIEEV

SEQ ID NO: 9093 - protein, 9 aa, Homo Sapiens
YLKEAVTTL

SEQ ID NO: 9094 - protein, 9 aa, Homo Sapiens
YLKEFIHIL

SEQ ID NO: 9095 - protein, 9 aa, Homo Sapiens
YLKEILEQL

SEQ ID NO: 9096 - protein, 9 aa, Homo Sapiens
YLKEILQDL

SEQ ID NO: 9097 - protein, 9 aa, Homo Sapiens
YLKGFLEDL

SEQ ID NO: 9098 - protein, 9 aa, Homo Sapiens
YLKHRLIVV

SEQ ID NO: 9099 - protein, 9 aa, Homo Sapiens
YLKIQLEDI

SEQ ID NO: 9100 - protein, 9 aa, Homo Sapiens
YLKNVVKQI

SEQ ID NO: 9101 - protein, 9 aa, Homo Sapiens
YLKPIQRTI

SEQ ID NO: 9102 - protein, 9 aa, Homo Sapiens
YLKPYFLEA

SEQ ID NO: 9103 - protein, 9 aa, Homo Sapiens
YLLDLHSYL

SEQ ID NO: 9104 - protein, 9 aa, Homo Sapiens
YLLENIAWV

SEQ ID NO: 9105 - protein, 9 aa, Homo Sapiens
YLLESVNKL

SEQ ID NO: 9106 - protein, 9 aa, Homo Sapiens
YLLPAIVHI

SEQ ID NO: 9107 - protein, 9 aa, Homo Sapiens
YLMEVTHDL

SEQ ID NO: 9108 - protein, 9 aa, Homo Sapiens
YLMGERLGV

SEQ ID NO: 9109 - protein, 9 aa, Homo Sapiens
YLNALVHLI

SEQ ID NO: 9110 - protein, 9 aa, Homo Sapiens
YLNENPLRA

SEQ ID NO: 9111 - protein, 9 aa, Homo Sapiens
YLNIKLTDI

SEQ ID NO: 9112 - protein, 9 aa, Homo Sapiens
YLNQHVNRI

SEQ ID NO: 9113 - protein, 9 aa, Homo Sapiens
YLNSILQHA

SEQ ID NO: 9114 - protein, 9 aa, Homo Sapiens
YLNVQVKEL

SEQ ID NO: 9115 - protein, 9 aa, Homo Sapiens
YLPPATQVV

SEQ ID NO: 9116 - protein, 9 aa, Homo Sapiens
YLPSQVSRV

SEQ ID NO: 9117 - protein, 9 aa, Homo Sapiens
YLPTRVTAI

SEQ ID NO: 9118 - protein, 9 aa, Homo Sapiens
YLPVKIEQV

SEQ ID NO: 9119 - protein, 9 aa, Homo Sapiens
YLPYPIHQV

SEQ ID NO: 9120 - protein, 9 aa, Homo Sapiens
YLQPKLLGI

SEQ ID NO: 9121 - protein, 9 aa, Homo Sapiens
YLQSEPCYV

SEQ ID NO: 9122 - protein, 9 aa, Homo Sapiens
YLQTILKEL

SEQ ID NO: 9123 - protein, 9 aa, Homo Sapiens
YLRDLLIRT

SEQ ID NO: 9124 - protein, 9 aa, Homo Sapiens
YLRDYSRTI

SEQ ID NO: 9125 - protein, 9 aa, Homo Sapiens
YLRELLTTM

SEQ ID NO: 9126 - protein, 9 aa, Homo Sapiens
YLRIDLERL

SEQ ID NO: 9127 - protein, 9 aa, Homo Sapiens
YLRSMIPHL

SEQ ID NO: 9128 - protein, 9 aa, Homo Sapiens
YLRTLINEL

SEQ ID NO: 9129 - protein, 9 aa, Homo Sapiens
YLSAKVEAL

SEQ ID NO: 9130 - protein, 9 aa, Homo Sapiens
YLSDNVHLV

SEQ ID NO: 9131 - protein, 9 aa, Homo Sapiens
YLSDSLRNL

SEQ ID NO: 9132 - protein, 9 aa, Homo Sapiens
YLSEATIGL

SEQ ID NO: 9133 - protein, 9 aa, Homo Sapiens
YLSEEVQAV

SEQ ID NO: 9134 - protein, 9 aa, Homo Sapiens
YLSEKVLAA

SEQ ID NO: 9135 - protein, 9 aa, Homo Sapiens
YLSKIIPAL

SEQ ID NO: 9136 - protein, 9 aa, Homo Sapiens
YLSLLNQQL

SEQ ID NO: 9137 - protein, 9 aa, Homo Sapiens
YLSNVDVYL

SEQ ID NO: 9138 - protein, 9 aa, Homo Sapiens
YLSPDLSKI

SEQ ID NO: 9139 - protein, 9 aa, Homo Sapiens
YLSPDLSKV

SEQ ID NO: 9140 - protein, 9 aa, Homo Sapiens
YLSPKLWAL

SEQ ID NO: 9141 - protein, 9 aa, Homo Sapiens
YLSSVITTI

SEQ ID NO: 9142 - protein, 9 aa, Homo Sapiens
YLTAEILEL

SEQ ID NO: 9143 - protein, 9 aa, Homo Sapiens
YLTAEVLEL

SEQ ID NO: 9144 - protein, 9 aa, Homo Sapiens
YLTDRVMTV

SEQ ID NO: 9145 - protein, 9 aa, Homo Sapiens
YLTEVFLHV

SEQ ID NO: 9146 - protein, 9 aa, Homo Sapiens
YLTFLPAEV

SEQ ID NO: 9147 - protein, 9 aa, Homo Sapiens
YLVDSVAKT

SEQ ID NO: 9148 - protein, 9 aa, Homo Sapiens
YLVEDIQHI

SEQ ID NO: 9149 - protein, 9 aa, Homo Sapiens
YLVELSSLL

SEQ ID NO: 9150 - protein, 9 aa, Homo Sapiens
YLVPELDGV

SEQ ID NO: 9151 - protein, 9 aa, Homo Sapiens
YLVSHPNEV

SEQ ID NO: 9152 - protein, 9 aa, Homo Sapiens
YLVTSIAKA

SEQ ID NO: 9153 - protein, 9 aa, Homo Sapiens
YLVVKIEKV

SEQ ID NO: 9154 - protein, 9 aa, Homo Sapiens
YLVYILNEL

SEQ ID NO: 9155 - protein, 9 aa, Homo Sapiens
YLWLKLNQV

SEQ ID NO: 9156 - protein, 9 aa, Homo Sapiens
YLYDRLLRI

SEQ ID NO: 9157 - protein, 9 aa, Homo Sapiens
YLYPDITRL

SEQ ID NO: 9158 - protein, 9 aa, Homo Sapiens
YLYTKEQLL

SEQ ID NO: 9159 - protein, 9 aa, Homo Sapiens
YMADRLLGV

SEQ ID NO: 9160 - protein, 9 aa, Homo Sapiens
YMAELIERL

SEQ ID NO: 9161 - protein, 9 aa, Homo Sapiens
YMAPEVVEA

SEQ ID NO: 9162 - protein, 9 aa, Homo Sapiens
YMIAHITGL

SEQ ID NO: 9163 - protein, 9 aa, Homo Sapiens
YMKDLISYL

SEQ ID NO: 9164 - protein, 9 aa, Homo Sapiens
YMLEHVITL

SEQ ID NO: 9165 - protein, 9 aa, Homo Sapiens
YMNHIMVSV

SEQ ID NO: 9166 - protein, 9 aa, Homo Sapiens
YMSDSFINV

SEQ ID NO: 9167 - protein, 9 aa, Homo Sapiens
YMSEHLLKA

SEQ ID NO: 9168 - protein, 9 aa, Homo Sapiens
YMSPHPSPL

SEQ ID NO: 9169 - protein, 9 aa, Homo Sapiens
YQFGEIRTI

SEQ ID NO: 9170 - protein, 9 aa, Homo Sapiens
YQVGQLYSV

SEQ ID NO: 9171 - protein, 9 aa, Homo Sapiens
YTTDRVMTV

SEQ ID NO: 9172 - protein, 9 aa, Homo Sapiens
YVFPGVTRL

SEQ ID NO: 9173 - protein, 9 aa, Homo Sapiens
YVINDLTAV

SEQ ID NO: 9174 - protein, 9 aa, Homo Sapiens
YVSKYINYI

SEQ ID NO: 9175 - protein, 9 aa, Homo Sapiens
YVSPRILTA

SEQ ID NO: 9176 - protein, 9 aa, Homo Sapiens
YVVPFVAKV

SEQ ID NO: 9177 - protein, 9 aa, Homo Sapiens
YVYEYLLHV

SEQ ID NO: 9178 - protein, 9 aa, Homo Sapiens
YVYKVLKQV

SEQ ID NO: 9179 - protein, 10 aa, Homo Sapiens
AAFEFDIHQV

SEQ ID NO: 9180 - protein, 10 aa, Homo Sapiens
AAFGGNPKSV

SEQ ID NO: 9181 - protein, 10 aa, Homo Sapiens
AAYEGSVAKV

SEQ ID NO: 9182 - protein, 10 aa, Homo Sapiens
AIFDRVLTEL

SEQ ID NO: 9183 - protein, 10 aa, Homo Sapiens
AIFQQPPVGV

SEQ ID NO: 9184 - protein, 10 aa, Homo Sapiens
AIIDGKIFCV

SEQ ID NO: 9185 - protein, 10 aa, Homo Sapiens
AIIEARGVSV

SEQ ID NO: 9186 - protein, 10 aa, Homo Sapiens
AIPGFTINRV

SEQ ID NO: 9187 - protein, 10 aa, Homo Sapiens
ALAARLLQPA

SEQ ID NO: 9188 - protein, 10 aa, Homo Sapiens
ALADWPLWYA

SEQ ID NO: 9189 - protein, 10 aa, Homo Sapiens
ALAEFHVQRV

SEQ ID NO: 9190 - protein, 10 aa, Homo Sapiens
ALAEFLQRKL

SEQ ID NO: 9191 - protein, 10 aa, Homo Sapiens
ALAEIAKAEL

SEQ ID NO: 9192 - protein, 10 aa, Homo Sapiens
ALANLKVSQI

SEQ ID NO: 9193 - protein, 10 aa, Homo Sapiens
ALAPMEAAKV

SEQ ID NO: 9194 - protein, 10 aa, Homo Sapiens
ALAPSPVSGV

SEQ ID NO: 9195 - protein, 10 aa, Homo Sapiens
ALAPWGPVKV

SEQ ID NO: 9196 - protein, 10 aa, Homo Sapiens
ALAPWPIVGL

SEQ ID NO: 9197 - protein, 10 aa, Homo Sapiens
ALASHILTAL

SEQ ID NO: 9198 - protein, 10 aa, Homo Sapiens
ALATIRLLDV

SEQ ID NO: 9199 - protein, 10 aa, Homo Sapiens
ALATWTIQGA

SEQ ID NO: 9200 - protein, 10 aa, Homo Sapiens
ALAVIVPEGV

SEQ ID NO: 9201 - protein, 10 aa, Homo Sapiens
ALCEENMRGV

SEQ ID NO: 9202 - protein, 10 aa, Homo Sapiens
ALFDSGLHPA

SEQ ID NO: 9203 - protein, 10 aa, Homo Sapiens
ALFGAGPASI

SEQ ID NO: 9204 - protein, 10 aa, Homo Sapiens
ALFGIPMALI

SEQ ID NO: 9205 - protein, 10 aa, Homo Sapiens
ALFKNSVSGI

SEQ ID NO: 9206 - protein, 10 aa, Homo Sapiens
ALFMYKPKKV

SEQ ID NO: 9207 - protein, 10 aa, Homo Sapiens
ALFNLDIRRA

SEQ ID NO: 9208 - protein, 10 aa, Homo Sapiens
ALFNRLVPSV

SEQ ID NO: 9209 - protein, 10 aa, Homo Sapiens
ALFPAPLAQI

SEQ ID NO: 9210 - protein, 10 aa, Homo Sapiens
ALFPEFLKEL

SEQ ID NO: 9211 - protein, 10 aa, Homo Sapiens
ALFPHLLQPV

SEQ ID NO: 9212 - protein, 10 aa, Homo Sapiens
ALFQPHLINV

SEQ ID NO: 9213 - protein, 10 aa, Homo Sapiens
ALFQRPPLIA

SEQ ID NO: 9214 - protein, 10 aa, Homo Sapiens
ALFRHEVGYV

SEQ ID NO: 9215 - protein, 10 aa, Homo Sapiens
ALFSDILSGL

SEQ ID NO: 9216 - protein, 10 aa, Homo Sapiens
ALFSDTPANA

SEQ ID NO: 9217 - protein, 10 aa, Homo Sapiens
ALFSGPLVQA

SEQ ID NO: 9218 - protein, 10 aa, Homo Sapiens
ALFTFSPLTV

SEQ ID NO: 9219 - protein, 10 aa, Homo Sapiens
ALFTPQLNNV

SEQ ID NO: 9220 - protein, 10 aa, Homo Sapiens
ALIDEQILCV

SEQ ID NO: 9221 - protein, 10 aa, Homo Sapiens
ALIHRMIEFV

SEQ ID NO: 9222 - protein, 10 aa, Homo Sapiens
ALIPIPLAVI

SEQ ID NO: 9223 - protein, 10 aa, Homo Sapiens
ALKGDGILIV

SEQ ID NO: 9224 - protein, 10 aa, Homo Sapiens
ALKNDLVEAL

SEQ ID NO: 9225 - protein, 10 aa, Homo Sapiens
ALKPQVSSIF

SEQ ID NO: 9226 - protein, 10 aa, Homo Sapiens
ALKSGKLVTA

SEQ ID NO: 9227 - protein, 10 aa, Homo Sapiens
ALLAGPLRPA

SEQ ID NO: 9228 - protein, 10 aa, Homo Sapiens
ALLDVTPKAV

SEQ ID NO: 9229 - protein, 10 aa, Homo Sapiens
ALMAGCIQEA

SEQ ID NO: 9230 - protein, 10 aa, Homo Sapiens
ALMAHAMEEV

SEQ ID NO: 9231 - protein, 10 aa, Homo Sapiens
ALNPNEIQRA

SEQ ID NO: 9232 - protein, 10 aa, Homo Sapiens
ALPHHRVIEV

SEQ ID NO: 9233 - protein, 10 aa, Homo Sapiens
ALREVSIHTV

SEQ ID NO: 9234 - protein, 10 aa, Homo Sapiens
ALRNLPPLRA

SEQ ID NO: 9235 - protein, 10 aa, Homo Sapiens
ALSPITKLSV

SEQ ID NO: 9236 - protein, 10 aa, Homo Sapiens
ALSSNVILHV

SEQ ID NO: 9237 - protein, 10 aa, Homo Sapiens
ALVANIIQNV

SEQ ID NO: 9238 - protein, 10 aa, Homo Sapiens
ALVDGPCTQV

SEQ ID NO: 9239 - protein, 10 aa, Homo Sapiens
ALVDHLNVGV

SEQ ID NO: 9240 - protein, 10 aa, Homo Sapiens
ALVPFSIKPL

SEQ ID NO: 9241 - protein, 10 aa, Homo Sapiens
ALWKGRPLSV

SEQ ID NO: 9242 - protein, 10 aa, Homo Sapiens
ALYASNVRRV

SEQ ID NO: 9243 - protein, 10 aa, Homo Sapiens
ALYCEFINRV

SEQ ID NO: 9244 - protein, 10 aa, Homo Sapiens
ALYDYMPMNA

SEQ ID NO: 9245 - protein, 10 aa, Homo Sapiens
ALYEYQPLQI

SEQ ID NO: 9246 - protein, 10 aa, Homo Sapiens
ALYFFPILTV

SEQ ID NO: 9247 - protein, 10 aa, Homo Sapiens
ALYGYDIRSA

SEQ ID NO: 9248 - protein, 10 aa, Homo Sapiens
ALYNKEMECL

SEQ ID NO: 9249 - protein, 10 aa, Homo Sapiens
ALYPGQLVQL

SEQ ID NO: 9250 - protein, 10 aa, Homo Sapiens
ALYPHFPAHS

SEQ ID NO: 9251 - protein, 10 aa, Homo Sapiens
AMFDHIPVGV

SEQ ID NO: 9252 - protein, 10 aa, Homo Sapiens
AMFLGELSLI

SEQ ID NO: 9253 - protein, 10 aa, Homo Sapiens
AMFPDTIPRV

SEQ ID NO: 9254 - protein, 10 aa, Homo Sapiens
AMFQEQLMTL

SEQ ID NO: 9255 - protein, 10 aa, Homo Sapiens
AMIAVVPGYI

SEQ ID NO: 9256 - protein, 10 aa, Homo Sapiens
AMYGTKLETI

SEQ ID NO: 9257 - protein, 10 aa, Homo Sapiens
AMYPDQVQLL

SEQ ID NO: 9258 - protein, 10 aa, Homo Sapiens
AQAGIKISSV

SEQ ID NO: 9259 - protein, 10 aa, Homo Sapiens
AQAPGVITGV

SEQ ID NO: 9260 - protein, 10 aa, Homo Sapiens
AQFPLQPGKV

SEQ ID NO: 9261 - protein, 10 aa, Homo Sapiens
AQYEHDLEVA

SEQ ID NO: 9262 - protein, 10 aa, Homo Sapiens
AQYGNILKHV

SEQ ID NO: 9263 - protein, 10 aa, Homo Sapiens
AQYVFTIQSI

SEQ ID NO: 9264 - protein, 10 aa, Homo Sapiens
ATFPVAPRYA

SEQ ID NO: 9265 - protein, 10 aa, Homo Sapiens
AVFDKTLAEL

SEQ ID NO: 9266 - protein, 10 aa, Homo Sapiens
AVFERVLSAV

SEQ ID NO: 9267 - protein, 10 aa, Homo Sapiens
AVFPFQPGSV

SEQ ID NO: 9268 - protein, 10 aa, Homo Sapiens
AVFVKPPAGV

SEQ ID NO: 9269 - protein, 10 aa, Homo Sapiens
AVIDVGINRV

SEQ ID NO: 9270 - protein, 10 aa, Homo Sapiens
AVLQGKLAEV

SEQ ID NO: 9271 - protein, 10 aa, Homo Sapiens
AVYEGHVSCV

SEQ ID NO: 9272 - protein, 10 aa, Homo Sapiens
AVYGFKLQSL

SEQ ID NO: 9273 - protein, 10 aa, Homo Sapiens
AVYGFMPAKA

SEQ ID NO: 9274 - protein, 10 aa, Homo Sapiens
CLMGKGMKRV

SEQ ID NO: 9275 - protein, 10 aa, Homo Sapiens
ELFEGIVRQV

SEQ ID NO: 9276 - protein, 10 aa, Homo Sapiens
ELFPHSLLSV

SEQ ID NO: 9277 - protein, 10 aa, Homo Sapiens
EQYEQILAFV

SEQ ID NO: 9278 - protein, 10 aa, Homo Sapiens
FAFALTPQQV

SEQ ID NO: 9279 - protein, 10 aa, Homo Sapiens
FAFTNKITSV

SEQ ID NO: 9280 - protein, 10 aa, Homo Sapiens
FGYDHLILNV

SEQ ID NO: 9281 - protein, 10 aa, Homo Sapiens
FGYPFRLNEA

SEQ ID NO: 9282 - protein, 10 aa, Homo Sapiens
FIFDVHVHEV

SEQ ID NO: 9283 - protein, 10 aa, Homo Sapiens
FIFEKKLAQA

SEQ ID NO: 9284 - protein, 10 aa, Homo Sapiens
FIFPGKLGTL

SEQ ID NO: 9285 - protein, 10 aa, Homo Sapiens
FIFSEKPVFV

SEQ ID NO: 9286 - protein, 10 aa, Homo Sapiens
FIIEKQPPQV

SEQ ID NO: 9287 - protein, 10 aa, Homo Sapiens
FIKDLPIRKV

SEQ ID NO: 9288 - protein, 10 aa, Homo Sapiens
FIKDYPVVSI

SEQ ID NO: 9289 - protein, 10 aa, Homo Sapiens
FIKPPVYVTV

SEQ ID NO: 9290 - protein, 10 aa, Homo Sapiens
FIMEGPLTRI

SEQ ID NO: 9291 - protein, 10 aa, Homo Sapiens
FIMEGTLTRV

SEQ ID NO: 9292 - protein, 10 aa, Homo Sapiens
FIYHGEVPQA

SEQ ID NO: 9293 - protein, 10 aa, Homo Sapiens
FIYPSNMQTM

SEQ ID NO: 9294 - protein, 10 aa, Homo Sapiens
FLAAHIPLFL

SEQ ID NO: 9295 - protein, 10 aa, Homo Sapiens
FLAEAELLNL

SEQ ID NO: 9296 - protein, 10 aa, Homo Sapiens
FLAEDALNTV

SEQ ID NO: 9297 - protein, 10 aa, Homo Sapiens
FLAEHPNVTL

SEQ ID NO: 9298 - protein, 10 aa, Homo Sapiens
FLAERLYAEV

SEQ ID NO: 9299 - protein, 10 aa, Homo Sapiens
FLAQHTMLTL

SEQ ID NO: 9300 - protein, 10 aa, Homo Sapiens
FLFASTILHL

SEQ ID NO: 9301 - protein, 10 aa, Homo Sapiens
FLFDGSPTYV

SEQ ID NO: 9302 - protein, 10 aa, Homo Sapiens
FLFGEEPSKL

SEQ ID NO: 9303 - protein, 10 aa, Homo Sapiens
FLFGYKFSGL

SEQ ID NO: 9304 - protein, 10 aa, Homo Sapiens
FLFPNKESLI

SEQ ID NO: 9305 - protein, 10 aa, Homo Sapiens
FLFPSGPGSL

SEQ ID NO: 9306 - protein, 10 aa, Homo Sapiens
FLHDHVDLQV

SEQ ID NO: 9307 - protein, 10 aa, Homo Sapiens
FLHETGGAMV

SEQ ID NO: 9308 - protein, 10 aa, Homo Sapiens
FLHETGLAMI

SEQ ID NO: 9309 - protein, 10 aa, Homo Sapiens
FLHQRIPQSV

SEQ ID NO: 9310 - protein, 10 aa, Homo Sapiens
FLHWYTGEGM

SEQ ID NO: 9311 - protein, 10 aa, Homo Sapiens
FLIGILLREV

SEQ ID NO: 9312 - protein, 10 aa, Homo Sapiens
FLIGPKLYEA

SEQ ID NO: 9313 - protein, 10 aa, Homo Sapiens
FLIPFETRQL

SEQ ID NO: 9314 - protein, 10 aa, Homo Sapiens
FLITHNPTNA

SEQ ID NO: 9315 - protein, 10 aa, Homo Sapiens
FLKEELVAAV

SEQ ID NO: 9316 - protein, 10 aa, Homo Sapiens
FLKEFENPEV

SEQ ID NO: 9317 - protein, 10 aa, Homo Sapiens
FLKPEKFTKV

SEQ ID NO: 9318 - protein, 10 aa, Homo Sapiens
FLKPLLIGEL

SEQ ID NO: 9319 - protein, 10 aa, Homo Sapiens
FLKSPELVQA

SEQ ID NO: 9320 - protein, 10 aa, Homo Sapiens
FLLDGFPRTV

SEQ ID NO: 9321 - protein, 10 aa, Homo Sapiens
FLLDSAPLNV

SEQ ID NO: 9322 - protein, 10 aa, Homo Sapiens
FLLERKPCTI

SEQ ID NO: 9323 - protein, 10 aa, Homo Sapiens
FLLGHEIAHA

SEQ ID NO: 9324 - protein, 10 aa, Homo Sapiens
FLLPHPGLQV

SEQ ID NO: 9325 - protein, 10 aa, Homo Sapiens
FLLPIKTVGV

SEQ ID NO: 9326 - protein, 10 aa, Homo Sapiens
FLLPLLIEKV

SEQ ID NO: 9327 - protein, 10 aa, Homo Sapiens
FLMEFQVKNV

SEQ ID NO: 9328 - protein, 10 aa, Homo Sapiens
FLMPFPVNYV

SEQ ID NO: 9329 - protein, 10 aa, Homo Sapiens
FLNDSYLKYV

SEQ ID NO: 9330 - protein, 10 aa, Homo Sapiens
FLNQFVVHTV

SEQ ID NO: 9331 - protein, 10 aa, Homo Sapiens
FLPEFAGTQL

SEQ ID NO: 9332 - protein, 10 aa, Homo Sapiens
FLPEFPSCSL

SEQ ID NO: 9333 - protein, 10 aa, Homo Sapiens
FLPQPVPLSV

SEQ ID NO: 9334 - protein, 10 aa, Homo Sapiens
FLPSHSLDTV

SEQ ID NO: 9335 - protein, 10 aa, Homo Sapiens
FLQEGDLISA

SEQ ID NO: 9336 - protein, 10 aa, Homo Sapiens
FLQPIYLKSV

SEQ ID NO: 9337 - protein, 10 aa, Homo Sapiens
FLRDNQLSEV

SEQ ID NO: 9338 - protein, 10 aa, Homo Sapiens
FLRDYTQINV

SEQ ID NO: 9339 - protein, 10 aa, Homo Sapiens
FLRTPEILTV

SEQ ID NO: 9340 - protein, 10 aa, Homo Sapiens
FLSDGTIISV

SEQ ID NO: 9341 - protein, 10 aa, Homo Sapiens
FLSYCPGMGV

SEQ ID NO: 9342 - protein, 10 aa, Homo Sapiens
FLVEHVLTLI

SEQ ID NO: 9343 - protein, 10 aa, Homo Sapiens
FLVEKQPPQV

SEQ ID NO: 9344 - protein, 10 aa, Homo Sapiens
FLWERPTLLV

SEQ ID NO: 9345 - protein, 10 aa, Homo Sapiens
FLWPGLNVPL

SEQ ID NO: 9346 - protein, 10 aa, Homo Sapiens
FLYAAQPELL

SEQ ID NO: 9347 - protein, 10 aa, Homo Sapiens
FLYEKLDRKV

SEQ ID NO: 9348 - protein, 10 aa, Homo Sapiens
FLYIGDIVSL

SEQ ID NO: 9349 - protein, 10 aa, Homo Sapiens
FLYKEKLVSV

SEQ ID NO: 9350 - protein, 10 aa, Homo Sapiens
FLYNEALYSL

SEQ ID NO: 9351 - protein, 10 aa, Homo Sapiens
FLYNHGIGTL

SEQ ID NO: 9352 - protein, 10 aa, Homo Sapiens
FLYPFPLALF

SEQ ID NO: 9353 - protein, 10 aa, Homo Sapiens
FLYQRLVVGA

SEQ ID NO: 9354 - protein, 10 aa, Homo Sapiens
FMAQIRPGES

SEQ ID NO: 9355 - protein, 10 aa, Homo Sapiens
FMFDEKLVTV

SEQ ID NO: 9356 - protein, 10 aa, Homo Sapiens
FMFQRVLVSL

SEQ ID NO: 9357 - protein, 10 aa, Homo Sapiens
FMKPGKVVLV

SEQ ID NO: 9358 - protein, 10 aa, Homo Sapiens
FMTYWHLLNA

SEQ ID NO: 9359 - protein, 10 aa, Homo Sapiens
FMYNFQLVTL

SEQ ID NO: 9360 - protein, 10 aa, Homo Sapiens
FQFPSHVTDV

SEQ ID NO: 9361 - protein, 10 aa, Homo Sapiens
FTFPNRLLTT

SEQ ID NO: 9362 - protein, 10 aa, Homo Sapiens
FTYVGGPRSV

SEQ ID NO: 9363 - protein, 10 aa, Homo Sapiens
FVFDRPLPVS

SEQ ID NO: 9364 - protein, 10 aa, Homo Sapiens
GAAGFALSQV

SEQ ID NO: 9365 - protein, 10 aa, Homo Sapiens
GAFGFQLKEV

SEQ ID NO: 9366 - protein, 10 aa, Homo Sapiens
GIFGGHIRSV

SEQ ID NO: 9367 - protein, 10 aa, Homo Sapiens
GIKDDVFLSV

SEQ ID NO: 9368 - protein, 10 aa, Homo Sapiens
GISPLKPGTV

SEQ ID NO: 9369 - protein, 10 aa, Homo Sapiens
GIYIFIPQNV

SEQ ID NO: 9370 - protein, 10 aa, Homo Sapiens
GIYKDDIAQV

SEQ ID NO: 9371 - protein, 10 aa, Homo Sapiens
GLAAGGIVAV

SEQ ID NO: 9372 - protein, 10 aa, Homo Sapiens
GLAALKMLAV

SEQ ID NO: 9373 - protein, 10 aa, Homo Sapiens
GLAEWVLMEL

SEQ ID NO: 9374 - protein, 10 aa, Homo Sapiens
GLAKRPGALL

SEQ ID NO: 9375 - protein, 10 aa, Homo Sapiens
GLAPAAPLQV

SEQ ID NO: 9376 - protein, 10 aa, Homo Sapiens
GLAPFLLNAV

SEQ ID NO: 9377 - protein, 10 aa, Homo Sapiens
GLAPGGLAVV

SEQ ID NO: 9378 - protein, 10 aa, Homo Sapiens
GLAPNTPGKA

SEQ ID NO: 9379 - protein, 10 aa, Homo Sapiens
GLASIQPSKV

SEQ ID NO: 9380 - protein, 10 aa, Homo Sapiens
GLFGETLRAA

SEQ ID NO: 9381 - protein, 10 aa, Homo Sapiens
GLFGKELHKV

SEQ ID NO: 9382 - protein, 10 aa, Homo Sapiens
GLFGTIISGI

SEQ ID NO: 9383 - protein, 10 aa, Homo Sapiens
GLFNRIIRKV

SEQ ID NO: 9384 - protein, 10 aa, Homo Sapiens
GLFPGAPKGA

SEQ ID NO: 9385 - protein, 10 aa, Homo Sapiens
GLFPGSNATF

SEQ ID NO: 9386 - protein, 10 aa, Homo Sapiens
GLFSNDIPHV

SEQ ID NO: 9387 - protein, 10 aa, Homo Sapiens
GLFWANIRAA

SEQ ID NO: 9388 - protein, 10 aa, Homo Sapiens
GLHSGNFSRV

SEQ ID NO: 9389 - protein, 10 aa, Homo Sapiens
GLIDVKPLGV

SEQ ID NO: 9390 - protein, 10 aa, Homo Sapiens
GLIGVGLINV

SEQ ID NO: 9391 - protein, 10 aa, Homo Sapiens
GLIIRKPVTV

SEQ ID NO: 9392 - protein, 10 aa, Homo Sapiens
GLINTGVLSV

SEQ ID NO: 9393 - protein, 10 aa, Homo Sapiens
GLIRFPLMTI

SEQ ID NO: 9394 - protein, 10 aa, Homo Sapiens
GLIVKEWNSV

SEQ ID NO: 9395 - protein, 10 aa, Homo Sapiens
GLMGAGIAQV

SEQ ID NO: 9396 - protein, 10 aa, Homo Sapiens
GLREDLLRGI

SEQ ID NO: 9397 - protein, 10 aa, Homo Sapiens
GLREQELQVV

SEQ ID NO: 9398 - protein, 10 aa, Homo Sapiens
GLREQGMEVV

SEQ ID NO: 9399 - protein, 10 aa, Homo Sapiens
GLSEEKPLSV

SEQ ID NO: 9400 - protein, 10 aa, Homo Sapiens
GLSEKLLAYV

SEQ ID NO: 9401 - protein, 10 aa, Homo Sapiens
GLSPLRPPSV

SEQ ID NO: 9402 - protein, 10 aa, Homo Sapiens
GLTGQRLLGV

SEQ ID NO: 9403 - protein, 10 aa, Homo Sapiens
GLTGQRVLGV

SEQ ID NO: 9404 - protein, 10 aa, Homo Sapiens
GLTKQYLRYV

SEQ ID NO: 9405 - protein, 10 aa, Homo Sapiens
GLVAFEPHAL

SEQ ID NO: 9406 - protein, 10 aa, Homo Sapiens
GLVDIQPHWV

SEQ ID NO: 9407 - protein, 10 aa, Homo Sapiens
GLVGIIVGTV

SEQ ID NO: 9408 - protein, 10 aa, Homo Sapiens
GLVGIVVGTV

SEQ ID NO: 9409 - protein, 10 aa, Homo Sapiens
GLVPFLVSVL

SEQ ID NO: 9410 - protein, 10 aa, Homo Sapiens
GLWGHPVLAV

SEQ ID NO: 9411 - protein, 10 aa, Homo Sapiens
GLWHGMFANV

SEQ ID NO: 9412 - protein, 10 aa, Homo Sapiens
GLYDGPVCEV

SEQ ID NO: 9413 - protein, 10 aa, Homo Sapiens
GLYEFPLNKV

SEQ ID NO: 9414 - protein, 10 aa, Homo Sapiens
GLYGLIVALI

SEQ ID NO: 9415 - protein, 10 aa, Homo Sapiens
GLYHYYIMEL

SEQ ID NO: 9416 - protein, 10 aa, Homo Sapiens
GLYPFRVNSA

SEQ ID NO: 9417 - protein, 10 aa, Homo Sapiens
GLYQGQVLVI

SEQ ID NO: 9418 - protein, 10 aa, Homo Sapiens
GLYSDRISEL

SEQ ID NO: 9419 - protein, 10 aa, Homo Sapiens
GLYSRQLYVL

SEQ ID NO: 9420 - protein, 10 aa, Homo Sapiens
GLYTGEVTEI

SEQ ID NO: 9421 - protein, 10 aa, Homo Sapiens
GLYYGDVIWV

SEQ ID NO: 9422 - protein, 10 aa, Homo Sapiens
GMAPHSMAVV

SEQ ID NO: 9423 - protein, 10 aa, Homo Sapiens
GMASLNLPAV

SEQ ID NO: 9424 - protein, 10 aa, Homo Sapiens
GMFKNLLKEV

SEQ ID NO: 9425 - protein, 10 aa, Homo Sapiens
GMPLIVPCTV

SEQ ID NO: 9426 - protein, 10 aa, Homo Sapiens
GQFPSYLETV

SEQ ID NO: 9427 - protein, 10 aa, Homo Sapiens
GQYDQPVLAV

SEQ ID NO: 9428 - protein, 10 aa, Homo Sapiens
GTIQVMLLTI

SEQ ID NO: 9429 - protein, 10 aa, Homo Sapiens
GTKDVPITSV

SEQ ID NO: 9430 - protein, 10 aa, Homo Sapiens
GTVAFALTKV

SEQ ID NO: 9431 - protein, 10 aa, Homo Sapiens
GVFGVKIAVV

SEQ ID NO: 9432 - protein, 10 aa, Homo Sapiens
GVFGVKISVV

SEQ ID NO: 9433 - protein, 10 aa, Homo Sapiens
GVIAEILRGV

SEQ ID NO: 9434 - protein, 10 aa, Homo Sapiens
GVIDILPNCV

SEQ ID NO: 9435 - protein, 10 aa, Homo Sapiens
GVYAGRPLSV

SEQ ID NO: 9436 - protein, 10 aa, Homo Sapiens
GVYQGRVSAV

SEQ ID NO: 9437 - protein, 10 aa, Homo Sapiens
HITDFNIATV

SEQ ID NO: 9438 - protein, 10 aa, Homo Sapiens
HLFDHVVNRV

SEQ ID NO: 9439 - protein, 10 aa, Homo Sapiens
HLFDTLPLEV

SEQ ID NO: 9440 - protein, 10 aa, Homo Sapiens
HLFGSTLLGI

SEQ ID NO: 9441 - protein, 10 aa, Homo Sapiens
HLFPGENCTL

SEQ ID NO: 9442 - protein, 10 aa, Homo Sapiens
HLFPKLELSV

SEQ ID NO: 9443 - protein, 10 aa, Homo Sapiens
HLFSGHLSTL

SEQ ID NO: 9444 - protein, 10 aa, Homo Sapiens
HLFSWIPLSA

SEQ ID NO: 9445 - protein, 10 aa, Homo Sapiens
HLLPTAPTTV

SEQ ID NO: 9446 - protein, 10 aa, Homo Sapiens
HLNPMQLMTV

SEQ ID NO: 9447 - protein, 10 aa, Homo Sapiens
HLNPSLLQNV

SEQ ID NO: 9448 - protein, 10 aa, Homo Sapiens
HLYGQNVTMV

SEQ ID NO: 9449 - protein, 10 aa, Homo Sapiens
HLYQQGMLSV

SEQ ID NO: 9450 - protein, 10 aa, Homo Sapiens
HLYSRIPGLL

SEQ ID NO: 9451 - protein, 10 aa, Homo Sapiens
HQYGLPIKSV

SEQ ID NO: 9452 - protein, 10 aa, Homo Sapiens
HVYPAQVQYV

SEQ ID NO: 9453 - protein, 10 aa, Homo Sapiens
IAYDRYIKEV

SEQ ID NO: 9454 - protein, 10 aa, Homo Sapiens
IIKPDPPEGV

SEQ ID NO: 9455 - protein, 10 aa, Homo Sapiens
ILANGALRAV

SEQ ID NO: 9456 - protein, 10 aa, Homo Sapiens
ILAPCKLETV

SEQ ID NO: 9457 - protein, 10 aa, Homo Sapiens
ILFDHMVPLV

SEQ ID NO: 9458 - protein, 10 aa, Homo Sapiens
ILFDYILSQI

SEQ ID NO: 9459 - protein, 10 aa, Homo Sapiens
ILFLGPLMQL

SEQ ID NO: 9460 - protein, 10 aa, Homo Sapiens
ILFPDIIARA

SEQ ID NO: 9461 - protein, 10 aa, Homo Sapiens
ILFPNDPLYA

SEQ ID NO: 9462 - protein, 10 aa, Homo Sapiens
ILFPYIEENV

SEQ ID NO: 9463 - protein, 10 aa, Homo Sapiens
ILFSEGLIKA

SEQ ID NO: 9464 - protein, 10 aa, Homo Sapiens
ILKDVIPPLE

SEQ ID NO: 9465 - protein, 10 aa, Homo Sapiens
ILKEGDLVKI

SEQ ID NO: 9466 - protein, 10 aa, Homo Sapiens
ILKPSTIIGV

SEQ ID NO: 9467 - protein, 10 aa, Homo Sapiens
ILNKALLLGA

SEQ ID NO: 9468 - protein, 10 aa, Homo Sapiens
ILNVDGLIGV

SEQ ID NO: 9469 - protein, 10 aa, Homo Sapiens
ILPGLSVMGV

SEQ ID NO: 9470 - protein, 10 aa, Homo Sapiens
ILRSQKPVMV

SEQ ID NO: 9471 - protein, 10 aa, Homo Sapiens
ILYEHQLGQA

SEQ ID NO: 9472 - protein, 10 aa, Homo Sapiens
ILYKLKLGEI

SEQ ID NO: 9473 - protein, 10 aa, Homo Sapiens
ILYNGLIEEL

SEQ ID NO: 9474 - protein, 10 aa, Homo Sapiens
ILYPEIPRKL

SEQ ID NO: 9475 - protein, 10 aa, Homo Sapiens
ILYPKTLFLL

SEQ ID NO: 9476 - protein, 10 aa, Homo Sapiens
ILYPSTLFLL

SEQ ID NO: 9477 - protein, 10 aa, Homo Sapiens
ILYPYELFQS

SEQ ID NO: 9478 - protein, 10 aa, Homo Sapiens
IMIDPVLGTV

SEQ ID NO: 9479 - protein, 10 aa, Homo Sapiens
IMPAFIFEHI

SEQ ID NO: 9480 - protein, 10 aa, Homo Sapiens
IMTEKELLAV

SEQ ID NO: 9481 - protein, 10 aa, Homo Sapiens
KAYQELLATV

SEQ ID NO: 9482 - protein, 10 aa, Homo Sapiens
KIADFGLARI

SEQ ID NO: 9483 - protein, 10 aa, Homo Sapiens
KIADFGLARV

SEQ ID NO: 9484 - protein, 10 aa, Homo Sapiens
KIFDEILVNA

SEQ ID NO: 9485 - protein, 10 aa, Homo Sapiens
KIGDFGLATV

SEQ ID NO: 9486 - protein, 10 aa, Homo Sapiens
KISDFGLATV

SEQ ID NO: 9487 - protein, 10 aa, Homo Sapiens
KLADFGLARA

SEQ ID NO: 9488 - protein, 10 aa, Homo Sapiens
KLADISINYV

SEQ ID NO: 9489 - protein, 10 aa, Homo Sapiens
KLFDDKLQNC

SEQ ID NO: 9490 - protein, 10 aa, Homo Sapiens
KLFENFLVDI

SEQ ID NO: 9491 - protein, 10 aa, Homo Sapiens
KLFEPYVVHV

SEQ ID NO: 9492 - protein, 10 aa, Homo Sapiens
KLFGHLERGV

SEQ ID NO: 9493 - protein, 10 aa, Homo Sapiens
KLFNGCPLRI

SEQ ID NO: 9494 - protein, 10 aa, Homo Sapiens
KLFPDTPLAL

SEQ ID NO: 9495 - protein, 10 aa, Homo Sapiens
KLFSGVLMDL

SEQ ID NO: 9496 - protein, 10 aa, Homo Sapiens
KLFVEALGQI

SEQ ID NO: 9497 - protein, 10 aa, Homo Sapiens
KLHDFGYRGV

SEQ ID NO: 9498 - protein, 10 aa, Homo Sapiens
KLHDVELHQV

SEQ ID NO: 9499 - protein, 10 aa, Homo Sapiens
KLKETSPLTA

SEQ ID NO: 9500 - protein, 10 aa, Homo Sapiens
KLKPGDLVGV

SEQ ID NO: 9501 - protein, 10 aa, Homo Sapiens
KLREGEITHL

SEQ ID NO: 9502 - protein, 10 aa, Homo Sapiens
KLVEFDFLGA

SEQ ID NO: 9503 - protein, 10 aa, Homo Sapiens
KLVSFTLSDL

SEQ ID NO: 9504 - protein, 10 aa, Homo Sapiens
KLYDIDVAKV

SEQ ID NO: 9505 - protein, 10 aa, Homo Sapiens
KLYEAAVKKV

SEQ ID NO: 9506 - protein, 10 aa, Homo Sapiens
KLYEKKLLKL

SEQ ID NO: 9507 - protein, 10 aa, Homo Sapiens
KLYESLLPFA

SEQ ID NO: 9508 - protein, 10 aa, Homo Sapiens
KLYFPELHMV

SEQ ID NO: 9509 - protein, 10 aa, Homo Sapiens
KLYHQWLSTV

SEQ ID NO: 9510 - protein, 10 aa, Homo Sapiens
KLYPQLPAEI

SEQ ID NO: 9511 - protein, 10 aa, Homo Sapiens
KMFESFIESV

SEQ ID NO: 9512 - protein, 10 aa, Homo Sapiens
KMLEIDPQKV

SEQ ID NO: 9513 - protein, 10 aa, Homo Sapiens
KMPDFGQVTV

SEQ ID NO: 9514 - protein, 10 aa, Homo Sapiens
KMREDVISSI

SEQ ID NO: 9515 - protein, 10 aa, Homo Sapiens
KMYEEFLSKV

SEQ ID NO: 9516 - protein, 10 aa, Homo Sapiens
KQFPLIISSV

SEQ ID NO: 9517 - protein, 10 aa, Homo Sapiens
KQIGYLFISV

SEQ ID NO: 9518 - protein, 10 aa, Homo Sapiens
KTMEDTLMTV

SEQ ID NO: 9519 - protein, 10 aa, Homo Sapiens
KVFDPVPVGV

SEQ ID NO: 9520 - protein, 10 aa, Homo Sapiens
KVFDQYLNFI

SEQ ID NO: 9521 - protein, 10 aa, Homo Sapiens
KVFSGALQEA

SEQ ID NO: 9522 - protein, 10 aa, Homo Sapiens
KVKEPPILRV

SEQ ID NO: 9523 - protein, 10 aa, Homo Sapiens
LIFPAEPAQA

SEQ ID NO: 9524 - protein, 10 aa, Homo Sapiens
LIFSHMLAEI

SEQ ID NO: 9525 - protein, 10 aa, Homo Sapiens
LIKSGQLLGV

SEQ ID NO: 9526 - protein, 10 aa, Homo Sapiens
LILEKQPAYV

SEQ ID NO: 9527 - protein, 10 aa, Homo Sapiens
LINEIKPQSV

SEQ ID NO: 9528 - protein, 10 aa, Homo Sapiens
LLAWFPLQEA

SEQ ID NO: 9529 - protein, 10 aa, Homo Sapiens
LLFEGEKITI

SEQ ID NO: 9530 - protein, 10 aa, Homo Sapiens
LLFERELHSV

SEQ ID NO: 9531 - protein, 10 aa, Homo Sapiens
LLFPHPVNQV

SEQ ID NO: 9532 - protein, 10 aa, Homo Sapiens
LLFPSDVQTL

SEQ ID NO: 9533 - protein, 10 aa, Homo Sapiens
LLFRNAFTSV

SEQ ID NO: 9534 - protein, 10 aa, Homo Sapiens
LLFSKQPSQA

SEQ ID NO: 9535 - protein, 10 aa, Homo Sapiens
LLHAGGLARA

SEQ ID NO: 9536 - protein, 10 aa, Homo Sapiens
LLIDIQPNTL

SEQ ID NO: 9537 - protein, 10 aa, Homo Sapiens
LLLPGVIKTV

SEQ ID NO: 9538 - protein, 10 aa, Homo Sapiens
LLNDASLISV

SEQ ID NO: 9539 - protein, 10 aa, Homo Sapiens
LLNPAVLSTA

SEQ ID NO: 9540 - protein, 10 aa, Homo Sapiens
LLPAHPGAEV

SEQ ID NO: 9541 - protein, 10 aa, Homo Sapiens
LLPGNFTVGV

SEQ ID NO: 9542 - protein, 10 aa, Homo Sapiens
LLRPEGLTSV

SEQ ID NO: 9543 - protein, 10 aa, Homo Sapiens
LLRPGGILAV

SEQ ID NO: 9544 - protein, 10 aa, Homo Sapiens
LLSPHNPALA

SEQ ID NO: 9545 - protein, 10 aa, Homo Sapiens
LLYDDKGVGL

SEQ ID NO: 9546 - protein, 10 aa, Homo Sapiens
LLYDEFVKSV

SEQ ID NO: 9547 - protein, 10 aa, Homo Sapiens
LLYEDALYTV

SEQ ID NO: 9548 - protein, 10 aa, Homo Sapiens
LLYEDIPDKV

SEQ ID NO: 9549 - protein, 10 aa, Homo Sapiens
LLYGSIPKAA

SEQ ID NO: 9550 - protein, 10 aa, Homo Sapiens
LLYPREILIL

SEQ ID NO: 9551 - protein, 10 aa, Homo Sapiens
LLYQEKIRYA

SEQ ID NO: 9552 - protein, 10 aa, Homo Sapiens
LLYQGPHNTL

SEQ ID NO: 9553 - protein, 10 aa, Homo Sapiens
LLYSEIPKKV

SEQ ID NO: 9554 - protein, 10 aa, Homo Sapiens
LMPYFLLTQA

SEQ ID NO: 9555 - protein, 10 aa, Homo Sapiens
LQFDKELRSL

SEQ ID NO: 9556 - protein, 10 aa, Homo Sapiens
LQFNSSLQKV

SEQ ID NO: 9557 - protein, 10 aa, Homo Sapiens
LVKDGFLVEV

SEQ ID NO: 9558 - protein, 10 aa, Homo Sapiens
MLFDKLITNT

SEQ ID NO: 9559 - protein, 10 aa, Homo Sapiens
MLFGGVPKTT

SEQ ID NO: 9560 - protein, 10 aa, Homo Sapiens
MLFPKFLKGL

SEQ ID NO: 9561 - protein, 10 aa, Homo Sapiens
MLYPEVIQQV

SEQ ID NO: 9562 - protein, 10 aa, Homo Sapiens
MQIEHIIENI

SEQ ID NO: 9563 - protein, 10 aa, Homo Sapiens
NLFEHELGAL

SEQ ID NO: 9564 - protein, 10 aa, Homo Sapiens
NLMAPAPSTV

SEQ ID NO: 9565 - protein, 10 aa, Homo Sapiens
NLMNAVVQTV

SEQ ID NO: 9566 - protein, 10 aa, Homo Sapiens
NLVEKTPALV

SEQ ID NO: 9567 - protein, 10 aa, Homo Sapiens
NLYGNIVNNV

SEQ ID NO: 9568 - protein, 10 aa, Homo Sapiens
NLYNLPLKTL

SEQ ID NO: 9569 - protein, 10 aa, Homo Sapiens
QLFQDEVAKA

SEQ ID NO: 9570 - protein, 10 aa, Homo Sapiens
QLHAGSLVSV

SEQ ID NO: 9571 - protein, 10 aa, Homo Sapiens
QLIDYKILGL

SEQ ID NO: 9572 - protein, 10 aa, Homo Sapiens
QLREYQLEGV

SEQ ID NO: 9573 - protein, 10 aa, Homo Sapiens
QLYGPFLIVV

SEQ ID NO: 9574 - protein, 10 aa, Homo Sapiens
QLYIHQMISV

SEQ ID NO: 9575 - protein, 10 aa, Homo Sapiens
QLYKEQLAKL

SEQ ID NO: 9576 - protein, 10 aa, Homo Sapiens
QLYPFAISLI

SEQ ID NO: 9577 - protein, 10 aa, Homo Sapiens
QLYYKEITEA

SEQ ID NO: 9578 - protein, 10 aa, Homo Sapiens
QLYYQVLNFA

SEQ ID NO: 9579 - protein, 10 aa, Homo Sapiens
QMIPFQPRHL

SEQ ID NO: 9580 - protein, 10 aa, Homo Sapiens
QQFPDIPESV

SEQ ID NO: 9581 - protein, 10 aa, Homo Sapiens
QQVDRQLPSL

SEQ ID NO: 9582 - protein, 10 aa, Homo Sapiens
QVFPGLLERV

SEQ ID NO: 9583 - protein, 10 aa, Homo Sapiens
QVYRGALQKV

SEQ ID NO: 9584 - protein, 10 aa, Homo Sapiens
RFFDGELTKV

SEQ ID NO: 9585 - protein, 10 aa, Homo Sapiens
RILAQQPLSV

SEQ ID NO: 9586 - protein, 10 aa, Homo Sapiens
RIYPFLLMVV

SEQ ID NO: 9587 - protein, 10 aa, Homo Sapiens
RLADFNIYQV

SEQ ID NO: 9588 - protein, 10 aa, Homo Sapiens
RLFADILNDV

SEQ ID NO: 9589 - protein, 10 aa, Homo Sapiens
RLFDPDPQKV

SEQ ID NO: 9590 - protein, 10 aa, Homo Sapiens
RLFEWVVNRI

SEQ ID NO: 9591 - protein, 10 aa, Homo Sapiens
RLFHKDLTSL

SEQ ID NO: 9592 - protein, 10 aa, Homo Sapiens
RLFNDPVAMV

SEQ ID NO: 9593 - protein, 10 aa, Homo Sapiens
RLFPGAPPTA

SEQ ID NO: 9594 - protein, 10 aa, Homo Sapiens
RLFQENLGLL

SEQ ID NO: 9595 - protein, 10 aa, Homo Sapiens
RLFTDVIICV

SEQ ID NO: 9596 - protein, 10 aa, Homo Sapiens
RLFYSNIQTV

SEQ ID NO: 9597 - protein, 10 aa, Homo Sapiens
RLIDDMVAQV

SEQ ID NO: 9598 - protein, 10 aa, Homo Sapiens
RLLDEEISRV

SEQ ID NO: 9599 - protein, 10 aa, Homo Sapiens
RLMNLPLHSV

SEQ ID NO: 9600 - protein, 10 aa, Homo Sapiens
RLPDIPLRQV

SEQ ID NO: 9601 - protein, 10 aa, Homo Sapiens
RLPSFAIPYA

SEQ ID NO: 9602 - protein, 10 aa, Homo Sapiens
RLRELQLQEV

SEQ ID NO: 9603 - protein, 10 aa, Homo Sapiens
RLVEFNITGA

SEQ ID NO: 9604 - protein, 10 aa, Homo Sapiens
RLYDGLFKVI

SEQ ID NO: 9605 - protein, 10 aa, Homo Sapiens
RLYEALTPVH

SEQ ID NO: 9606 - protein, 10 aa, Homo Sapiens
RLYPAFMEGI

SEQ ID NO: 9607 - protein, 10 aa, Homo Sapiens
RLYPEGLAQL

SEQ ID NO: 9608 - protein, 10 aa, Homo Sapiens
RLYPELPSQL

SEQ ID NO: 9609 - protein, 10 aa, Homo Sapiens
RLYPEVPEVL

SEQ ID NO: 9610 - protein, 10 aa, Homo Sapiens
RLYPWGVVEV

SEQ ID NO: 9611 - protein, 10 aa, Homo Sapiens
RLYSNDIHAI

SEQ ID NO: 9612 - protein, 10 aa, Homo Sapiens
RLYTVVPRLV

SEQ ID NO: 9613 - protein, 10 aa, Homo Sapiens
RMFDGKFVVA

SEQ ID NO: 9614 - protein, 10 aa, Homo Sapiens
RMFDRIFGQA

SEQ ID NO: 9615 - protein, 10 aa, Homo Sapiens
RMIKEKLCYV

SEQ ID NO: 9616 - protein, 10 aa, Homo Sapiens
RMYPFQIHSI

SEQ ID NO: 9617 - protein, 10 aa, Homo Sapiens
RQYPWGTVQV

SEQ ID NO: 9618 - protein, 10 aa, Homo Sapiens
RQYPWGVAEV

SEQ ID NO: 9619 - protein, 10 aa, Homo Sapiens
RQYPWGVVQV

SEQ ID NO: 9620 - protein, 10 aa, Homo Sapiens
RVFIGNLNTL

SEQ ID NO: 9621 - protein, 10 aa, Homo Sapiens
RVFTGIVTSL

SEQ ID NO: 9622 - protein, 10 aa, Homo Sapiens
RVLDFDPMAV

SEQ ID NO: 9623 - protein, 10 aa, Homo Sapiens
SAAGFPLSGA

SEQ ID NO: 9624 - protein, 10 aa, Homo Sapiens
SGYPGLLNGV

SEQ ID NO: 9625 - protein, 10 aa, Homo Sapiens
SIFDSKVTEI

SEQ ID NO: 9626 - protein, 10 aa, Homo Sapiens
SIFELDPTTL

SEQ ID NO: 9627 - protein, 10 aa, Homo Sapiens
SIPDFPMHLA

SEQ ID NO: 9628 - protein, 10 aa, Homo Sapiens
SISDQSIASV

SEQ ID NO: 9629 - protein, 10 aa, Homo Sapiens
SIYGGFLLGV

SEQ ID NO: 9630 - protein, 10 aa, Homo Sapiens
SIYNGDMEKI

SEQ ID NO: 9631 - protein, 10 aa, Homo Sapiens
SLAEFISERV

SEQ ID NO: 9632 - protein, 10 aa, Homo Sapiens
SLAELKGFEV

SEQ ID NO: 9633 - protein, 10 aa, Homo Sapiens
SLAEVAGLQV

SEQ ID NO: 9634 - protein, 10 aa, Homo Sapiens
SLAHAQLSEV

SEQ ID NO: 9635 - protein, 10 aa, Homo Sapiens
SLAPNIISQL

SEQ ID NO: 9636 - protein, 10 aa, Homo Sapiens
SLASFCFSHI

SEQ ID NO: 9637 - protein, 10 aa, Homo Sapiens
SLASLPPLHV

SEQ ID NO: 9638 - protein, 10 aa, Homo Sapiens
SLFAGGMLRV

SEQ ID NO: 9639 - protein, 10 aa, Homo Sapiens
SLFAGQPLTI

SEQ ID NO: 9640 - protein, 10 aa, Homo Sapiens
SLFAQRLKTL

SEQ ID NO: 9641 - protein, 10 aa, Homo Sapiens
SLFDGFFLTA

SEQ ID NO: 9642 - protein, 10 aa, Homo Sapiens
SLFDQPLSII

SEQ ID NO: 9643 - protein, 10 aa, Homo Sapiens
SLFEGKALGL

SEQ ID NO: 9644 - protein, 10 aa, Homo Sapiens
SLFEKGLKNV

SEQ ID NO: 9645 - protein, 10 aa, Homo Sapiens
SLFEVLPQQV

SEQ ID NO: 9646 - protein, 10 aa, Homo Sapiens
SLFFHVPAGL

SEQ ID NO: 9647 - protein, 10 aa, Homo Sapiens
SLFGGKIAVL

SEQ ID NO: 9648 - protein, 10 aa, Homo Sapiens
SLFGGSVKLA

SEQ ID NO: 9649 - protein, 10 aa, Homo Sapiens
SLFGKNLTTI

SEQ ID NO: 9650 - protein, 10 aa, Homo Sapiens
SLFGQDVKAV

SEQ ID NO: 9651 - protein, 10 aa, Homo Sapiens
SLFGYSPAAA

SEQ ID NO: 9652 - protein, 10 aa, Homo Sapiens
SLFLGRILSL

SEQ ID NO: 9653 - protein, 10 aa, Homo Sapiens
SLFLQTPKIV

SEQ ID NO: 9654 - protein, 10 aa, Homo Sapiens
SLFLRTPKIV

SEQ ID NO: 9655 - protein, 10 aa, Homo Sapiens
SLFPGKLEVV

SEQ ID NO: 9656 - protein, 10 aa, Homo Sapiens
SLFPHNPQFI

SEQ ID NO: 9657 - protein, 10 aa, Homo Sapiens
SLFPLLPQDV

SEQ ID NO: 9658 - protein, 10 aa, Homo Sapiens
SLFSGILKEM

SEQ ID NO: 9659 - protein, 10 aa, Homo Sapiens
SLFSHSLISI

SEQ ID NO: 9660 - protein, 10 aa, Homo Sapiens
SLFTCEPITV

SEQ ID NO: 9661 - protein, 10 aa, Homo Sapiens
SLFVFIPMVV

SEQ ID NO: 9662 - protein, 10 aa, Homo Sapiens
SLFYRDIISI

SEQ ID NO: 9663 - protein, 10 aa, Homo Sapiens
SLIGVSFNSV

SEQ ID NO: 9664 - protein, 10 aa, Homo Sapiens
SLINVGLISV

SEQ ID NO: 9665 - protein, 10 aa, Homo Sapiens
SLIRFPLMTI

SEQ ID NO: 9666 - protein, 10 aa, Homo Sapiens
SLISNPPAMI

SEQ ID NO: 9667 - protein, 10 aa, Homo Sapiens
SLKAPSIATI

SEQ ID NO: 9668 - protein, 10 aa, Homo Sapiens
SLKSIIGIGV

SEQ ID NO: 9669 - protein, 10 aa, Homo Sapiens
SLKTPEIQKV

SEQ ID NO: 9670 - protein, 10 aa, Homo Sapiens
SLLDRFLATV

SEQ ID NO: 9671 - protein, 10 aa, Homo Sapiens
SLLGGDVVSV

SEQ ID NO: 9672 - protein, 10 aa, Homo Sapiens
SLMDHTIPEV

SEQ ID NO: 9673 - protein, 10 aa, Homo Sapiens
SLMTKEISSV

SEQ ID NO: 9674 - protein, 10 aa, Homo Sapiens
SLNPRKLIEV

SEQ ID NO: 9675 - protein, 10 aa, Homo Sapiens
SLPDFGISYV

SEQ ID NO: 9676 - protein, 10 aa, Homo Sapiens
SLQESILAQV

SEQ ID NO: 9677 - protein, 10 aa, Homo Sapiens
SLRPAVLTGV

SEQ ID NO: 9678 - protein, 10 aa, Homo Sapiens
SLRPSVLTSV

SEQ ID NO: 9679 - protein, 10 aa, Homo Sapiens
SLSELQISYV

SEQ ID NO: 9680 - protein, 10 aa, Homo Sapiens
SLVGQHILSV

SEQ ID NO: 9681 - protein, 10 aa, Homo Sapiens
SLVSFIPLNI

SEQ ID NO: 9682 - protein, 10 aa, Homo Sapiens
SLWSSILSEV

SEQ ID NO: 9683 - protein, 10 aa, Homo Sapiens
SLYALHVKAA

SEQ ID NO: 9684 - protein, 10 aa, Homo Sapiens
SLYDNKIQSL

SEQ ID NO: 9685 - protein, 10 aa, Homo Sapiens
SLYDYNPNLA

SEQ ID NO: 9686 - protein, 10 aa, Homo Sapiens
SLYKDAMQYA

SEQ ID NO: 9687 - protein, 10 aa, Homo Sapiens
SLYQGLMRTA

SEQ ID NO: 9688 - protein, 10 aa, Homo Sapiens
SLYSNFLDTL

SEQ ID NO: 9689 - protein, 10 aa, Homo Sapiens
SMIDPPRAAV

SEQ ID NO: 9690 - protein, 10 aa, Homo Sapiens
SMLPATPWGV

SEQ ID NO: 9691 - protein, 10 aa, Homo Sapiens
SMYGVDLHHA

SEQ ID NO: 9692 - protein, 10 aa, Homo Sapiens
SMYGVDLHKA

SEQ ID NO: 9693 - protein, 10 aa, Homo Sapiens
SMYPIALTRA

SEQ ID NO: 9694 - protein, 10 aa, Homo Sapiens
SMYPPHPLTA

SEQ ID NO: 9695 - protein, 10 aa, Homo Sapiens
SMYPTRIEGA

SEQ ID NO: 9696 - protein, 10 aa, Homo Sapiens
SQYDYILPQV

SEQ ID NO: 9697 - protein, 10 aa, Homo Sapiens
SVFDYSINSV

SEQ ID NO: 9698 - protein, 10 aa, Homo Sapiens
SVFERALSSV

SEQ ID NO: 9699 - protein, 10 aa, Homo Sapiens
SVFPNNVVFV

SEQ ID NO: 9700 - protein, 10 aa, Homo Sapiens
SVKDDSILSV

SEQ ID NO: 9701 - protein, 10 aa, Homo Sapiens
SVKDGTILKV

SEQ ID NO: 9702 - protein, 10 aa, Homo Sapiens
SVYKNVILQV

SEQ ID NO: 9703 - protein, 10 aa, Homo Sapiens
TIKSGDLEYV

SEQ ID NO: 9704 - protein, 10 aa, Homo Sapiens
TIPDFIFANV

SEQ ID NO: 9705 - protein, 10 aa, Homo Sapiens
TLATDILMGV

SEQ ID NO: 9706 - protein, 10 aa, Homo Sapiens
TLFGKAILRI

SEQ ID NO: 9707 - protein, 10 aa, Homo Sapiens
TLFPGKVHSL

SEQ ID NO: 9708 - protein, 10 aa, Homo Sapiens
TLFPKDVQLA

SEQ ID NO: 9709 - protein, 10 aa, Homo Sapiens
TLFPVRLLVA

SEQ ID NO: 9710 - protein, 10 aa, Homo Sapiens
TLFSGLLLGL

SEQ ID NO: 9711 - protein, 10 aa, Homo Sapiens
TLHSRFLEGV

SEQ ID NO: 9712 - protein, 10 aa, Homo Sapiens
TLIEDEIATI

SEQ ID NO: 9713 - protein, 10 aa, Homo Sapiens
TLIEKTMQNV

SEQ ID NO: 9714 - protein, 10 aa, Homo Sapiens
TLIGEIFNSV

SEQ ID NO: 9715 - protein, 10 aa, Homo Sapiens
TLIGGLLLHV

SEQ ID NO: 9716 - protein, 10 aa, Homo Sapiens
TLIQYIRPVF

SEQ ID NO: 9717 - protein, 10 aa, Homo Sapiens
TLKEDPVLQV

SEQ ID NO: 9718 - protein, 10 aa, Homo Sapiens
TLKEDWIAYI

SEQ ID NO: 9719 - protein, 10 aa, Homo Sapiens
TLKEEWIAYI

SEQ ID NO: 9720 - protein, 10 aa, Homo Sapiens
TLKGGTILGT

SEQ ID NO: 9721 - protein, 10 aa, Homo Sapiens
TLMDMRLSQV

SEQ ID NO: 9722 - protein, 10 aa, Homo Sapiens
TLNEKLTALE

SEQ ID NO: 9723 - protein, 10 aa, Homo Sapiens
TLPERPLTEV

SEQ ID NO: 9724 - protein, 10 aa, Homo Sapiens
TLPSFSPSAA

SEQ ID NO: 9725 - protein, 10 aa, Homo Sapiens
TLRDAVPATL

SEQ ID NO: 9726 - protein, 10 aa, Homo Sapiens
TLRPSLLPLH

SEQ ID NO: 9727 - protein, 10 aa, Homo Sapiens
TLYKDLKPVL

SEQ ID NO: 9728 - protein, 10 aa, Homo Sapiens
TLYKEILTRA

SEQ ID NO: 9729 - protein, 10 aa, Homo Sapiens
TLYPLHILFV

SEQ ID NO: 9730 - protein, 10 aa, Homo Sapiens
TMITKRLAQV

SEQ ID NO: 9731 - protein, 10 aa, Homo Sapiens
TMKNPSIVGV

SEQ ID NO: 9732 - protein, 10 aa, Homo Sapiens
TMYPGLPSRL

SEQ ID NO: 9733 - protein, 10 aa, Homo Sapiens
TVAPFNPTVC

SEQ ID NO: 9734 - protein, 10 aa, Homo Sapiens
TVFGTALNYV

SEQ ID NO: 9735 - protein, 10 aa, Homo Sapiens
TVFPAGLANV

SEQ ID NO: 9736 - protein, 10 aa, Homo Sapiens
TVFTDHMLTV

SEQ ID NO: 9737 - protein, 10 aa, Homo Sapiens
TVLPVPPLSV

SEQ ID NO: 9738 - protein, 10 aa, Homo Sapiens
TVRPGELLAV

SEQ ID NO: 9739 - protein, 10 aa, Homo Sapiens
TVYGGYLCSV

SEQ ID NO: 9740 - protein, 10 aa, Homo Sapiens
VAATSLLDTL

SEQ ID NO: 9741 - protein, 10 aa, Homo Sapiens
VAPGKDLTKT

SEQ ID NO: 9742 - protein, 10 aa, Homo Sapiens
VLFDDELLMV

SEQ ID NO: 9743 - protein, 10 aa, Homo Sapiens
VLFDVSIMAV

SEQ ID NO: 9744 - protein, 10 aa, Homo Sapiens
VLFEGRTVQL

SEQ ID NO: 9745 - protein, 10 aa, Homo Sapiens
VLFEHAVGYA

SEQ ID NO: 9746 - protein, 10 aa, Homo Sapiens
VLFEKEVNEV

SEQ ID NO: 9747 - protein, 10 aa, Homo Sapiens
VLFENQLLQI

SEQ ID NO: 9748 - protein, 10 aa, Homo Sapiens
VLFGAVITGA

SEQ ID NO: 9749 - protein, 10 aa, Homo Sapiens
VLFGGLIGSA

SEQ ID NO: 9750 - protein, 10 aa, Homo Sapiens
VLFGQVVRGL

SEQ ID NO: 9751 - protein, 10 aa, Homo Sapiens
VLFLDAVREV

SEQ ID NO: 9752 - protein, 10 aa, Homo Sapiens
VLFMKILSGL

SEQ ID NO: 9753 - protein, 10 aa, Homo Sapiens
VLFQEALWHV

SEQ ID NO: 9754 - protein, 10 aa, Homo Sapiens
VLFSCHVRKV

SEQ ID NO: 9755 - protein, 10 aa, Homo Sapiens
VLFSGSLKAI

SEQ ID NO: 9756 - protein, 10 aa, Homo Sapiens
VLFSSHVRKV

SEQ ID NO: 9757 - protein, 10 aa, Homo Sapiens
VLIEGSINSV

SEQ ID NO: 9758 - protein, 10 aa, Homo Sapiens
VLIKNLLVSV

SEQ ID NO: 9759 - protein, 10 aa, Homo Sapiens
VLKPGGLLKV

SEQ ID NO: 9760 - protein, 10 aa, Homo Sapiens
VLKSGNPRGL

SEQ ID NO: 9761 - protein, 10 aa, Homo Sapiens
VLNNAPILCV

SEQ ID NO: 9762 - protein, 10 aa, Homo Sapiens
VLPNFLPYNV

SEQ ID NO: 9763 - protein, 10 aa, Homo Sapiens
VLPRFQPRVL

SEQ ID NO: 9764 - protein, 10 aa, Homo Sapiens
VLRDNIQGIT

SEQ ID NO: 9765 - protein, 10 aa, Homo Sapiens
VLRESGLKYV

SEQ ID NO: 9766 - protein, 10 aa, Homo Sapiens
VLRSLPLVQV

SEQ ID NO: 9767 - protein, 10 aa, Homo Sapiens
VLSSLTPAKV

SEQ ID NO: 9768 - protein, 10 aa, Homo Sapiens
VLYEPPPLSA

SEQ ID NO: 9769 - protein, 10 aa, Homo Sapiens
VLYNQRVEEI

SEQ ID NO: 9770 - protein, 10 aa, Homo Sapiens
VLYPASPHGV

SEQ ID NO: 9771 - protein, 10 aa, Homo Sapiens
VLYPHEPTAV

SEQ ID NO: 9772 - protein, 10 aa, Homo Sapiens
VLYSPGPKQA

SEQ ID NO: 9773 - protein, 10 aa, Homo Sapiens
VMAGFAFSCL

SEQ ID NO: 9774 - protein, 10 aa, Homo Sapiens
VMAPHEPLVV

SEQ ID NO: 9775 - protein, 10 aa, Homo Sapiens
VMFGGKQVVV

SEQ ID NO: 9776 - protein, 10 aa, Homo Sapiens
VMFRTPLASV

SEQ ID NO: 9777 - protein, 10 aa, Homo Sapiens
VMIAGKVAVV

SEQ ID NO: 9778 - protein, 10 aa, Homo Sapiens
VMLESPPKGV

SEQ ID NO: 9779 - protein, 10 aa, Homo Sapiens
VMMENKPMTL

SEQ ID NO: 9780 - protein, 10 aa, Homo Sapiens
VQADFKPATL

SEQ ID NO: 9781 - protein, 10 aa, Homo Sapiens
WITDKELENV

SEQ ID NO: 9782 - protein, 10 aa, Homo Sapiens
WLKEHVEPVF

SEQ ID NO: 9783 - protein, 10 aa, Homo Sapiens
WLKGEFVTTV

SEQ ID NO: 9784 - protein, 10 aa, Homo Sapiens
WLRLQPLTSA

SEQ ID NO: 9785 - protein, 10 aa, Homo Sapiens
YIFGGYNARL

SEQ ID NO: 9786 - protein, 10 aa, Homo Sapiens
YIFNKSVASL

SEQ ID NO: 9787 - protein, 10 aa, Homo Sapiens
YIMDNKLAQI

SEQ ID NO: 9788 - protein, 10 aa, Homo Sapiens
YIMEGVKATI

SEQ ID NO: 9789 - protein, 10 aa, Homo Sapiens
YIRGGIVSQV

SEQ ID NO: 9790 - protein, 10 aa, Homo Sapiens
YISDINPRSV

SEQ ID NO: 9791 - protein, 10 aa, Homo Sapiens
YIYDKDMEII

SEQ ID NO: 9792 - protein, 10 aa, Homo Sapiens
YIYSSKIVRV

SEQ ID NO: 9793 - protein, 10 aa, Homo Sapiens
YLAEFFVNEA

SEQ ID NO: 9794 - protein, 10 aa, Homo Sapiens
YLAELVTPIL

SEQ ID NO: 9795 - protein, 10 aa, Homo Sapiens
YLAPHVRTLY

SEQ ID NO: 9796 - protein, 10 aa, Homo Sapiens
YLATVTGIAV

SEQ ID NO: 9797 - protein, 10 aa, Homo Sapiens
YLDGHLITTV

SEQ ID NO: 9798 - protein, 10 aa, Homo Sapiens
YLEERRVKEV

SEQ ID NO: 9799 - protein, 10 aa, Homo Sapiens
YLFAKNVRSL

SEQ ID NO: 9800 - protein, 10 aa, Homo Sapiens
YLFDIQLPNI

SEQ ID NO: 9801 - protein, 10 aa, Homo Sapiens
YLFDLPLKVL

SEQ ID NO: 9802 - protein, 10 aa, Homo Sapiens
YLFDRNGVCL

SEQ ID NO: 9803 - protein, 10 aa, Homo Sapiens
YLFGERLLEC

SEQ ID NO: 9804 - protein, 10 aa, Homo Sapiens
YLFGKEMYQV

SEQ ID NO: 9805 - protein, 10 aa, Homo Sapiens
YLFITPPKTV

SEQ ID NO: 9806 - protein, 10 aa, Homo Sapiens
YLFPGIPELL

SEQ ID NO: 9807 - protein, 10 aa, Homo Sapiens
YLIDVKFNGT

SEQ ID NO: 9808 - protein, 10 aa, Homo Sapiens
YLILHLISTV

SEQ ID NO: 9809 - protein, 10 aa, Homo Sapiens
YLINFEIRSL

SEQ ID NO: 9810 - protein, 10 aa, Homo Sapiens
YLIQSVPAEL

SEQ ID NO: 9811 - protein, 10 aa, Homo Sapiens
YLKDGPYITA

SEQ ID NO: 9812 - protein, 10 aa, Homo Sapiens
YLKELIEPVL

SEQ ID NO: 9813 - protein, 10 aa, Homo Sapiens
YLKGRTIIGV

SEQ ID NO: 9814 - protein, 10 aa, Homo Sapiens
YLKKEIGQHV

SEQ ID NO: 9815 - protein, 10 aa, Homo Sapiens
YLLECPSAEV

SEQ ID NO: 9816 - protein, 10 aa, Homo Sapiens
YLLGRELMAL

SEQ ID NO: 9817 - protein, 10 aa, Homo Sapiens
YLLPERPATL

SEQ ID NO: 9818 - protein, 10 aa, Homo Sapiens
YLLPERPSYL

SEQ ID NO: 9819 - protein, 10 aa, Homo Sapiens
YLLPGAPADL

SEQ ID NO: 9820 - protein, 10 aa, Homo Sapiens
YLLQEPPRTV

SEQ ID NO: 9821 - protein, 10 aa, Homo Sapiens
YLMEGSYNKV

SEQ ID NO: 9822 - protein, 10 aa, Homo Sapiens
YLNEIKDSVV

SEQ ID NO: 9823 - protein, 10 aa, Homo Sapiens
YLNHIEPLKI

SEQ ID NO: 9824 - protein, 10 aa, Homo Sapiens
YLNKNALTTL

SEQ ID NO: 9825 - protein, 10 aa, Homo Sapiens
YLPDFRFTPF

SEQ ID NO: 9826 - protein, 10 aa, Homo Sapiens
YLRLPEVQGV

SEQ ID NO: 9827 - protein, 10 aa, Homo Sapiens
YLSDIPLHDA

SEQ ID NO: 9828 - protein, 10 aa, Homo Sapiens
YLSFLPLQTV

SEQ ID NO: 9829 - protein, 10 aa, Homo Sapiens
YLTEVFLHVV

SEQ ID NO: 9830 - protein, 10 aa, Homo Sapiens
YLVSKELMSL

SEQ ID NO: 9831 - protein, 10 aa, Homo Sapiens
YLYGQTTTYL

SEQ ID NO: 9832 - protein, 10 aa, Homo Sapiens
YLYPIKNLEM

SEQ ID NO: 9833 - protein, 10 aa, Homo Sapiens
YLYPSTLVRT

SEQ ID NO: 9834 - protein, 10 aa, Homo Sapiens
YLYSNKLQSL

SEQ ID NO: 9835 - protein, 10 aa, Homo Sapiens
YMFCELVTGV

SEQ ID NO: 9836 - protein, 10 aa, Homo Sapiens
YMFEEVPIVI

SEQ ID NO: 9837 - protein, 10 aa, Homo Sapiens
YMFPDTMLQA

SEQ ID NO: 9838 - protein, 10 aa, Homo Sapiens
YMIDNVILLI

SEQ ID NO: 9839 - protein, 10 aa, Homo Sapiens
YMKSEDPLFV

SEQ ID NO: 9840 - protein, 10 aa, Homo Sapiens
YMVSKELRNV

SEQ ID NO: 9841 - protein, 10 aa, Homo Sapiens
YQPDWRFMES

SEQ ID NO: 9842 - protein, 10 aa, Homo Sapiens
YQYMHETITV

SEQ ID NO: 9843 - protein, 10 aa, Homo Sapiens
YTYEELLNRV

SEQ ID NO: 9844 - protein, 10 aa, Homo Sapiens
YTYEFDFSKV

SEQ ID NO: 9845 - protein, 10 aa, Homo Sapiens
YTYESKMAFL

SEQ ID NO: 9846 - protein, 10 aa, Homo Sapiens
YVAGIIPLAV

SEQ ID NO: 9847 - protein, 10 aa, Homo Sapiens
YVFDGKPPQL

SEQ ID NO: 9848 - protein, 10 aa, Homo Sapiens
YVFEGKMLEA

SEQ ID NO: 9849 - protein, 10 aa, Homo Sapiens
YVFENTVATV

SEQ ID NO: 9850 - protein, 10 aa, Homo Sapiens
YVYPQRLNFV

SEQ ID NO: 9851 - protein, 11 aa, Homo Sapiens
ALAPLAIPSAA

SEQ ID NO: 9852 - protein, 11 aa, Homo Sapiens
ALFPHLLQPVL

SEQ ID NO: 9853 - protein, 11 aa, Homo Sapiens
ALGEEALLRYV

SEQ ID NO: 9854 - protein, 11 aa, Homo Sapiens
ALIEAEKVAQV

SEQ ID NO: 9855 - protein, 11 aa, Homo Sapiens
ALKDKIEKAVV

SEQ ID NO: 9856 - protein, 11 aa, Homo Sapiens
ALKEFNEDGAL

SEQ ID NO: 9857 - protein, 11 aa, Homo Sapiens
ALNEITESGRI

SEQ ID NO: 9858 - protein, 11 aa, Homo Sapiens
AMASLGALALL

SEQ ID NO: 9859 - protein, 11 aa, Homo Sapiens
AQADGTLITCV

SEQ ID NO: 9860 - protein, 11 aa, Homo Sapiens
CLYPHIDKQYL

SEQ ID NO: 9861 - protein, 11 aa, Homo Sapiens
FAYDGKDYLTL

SEQ ID NO: 9862 - protein, 11 aa, Homo Sapiens
FIIQGLRSVGA

SEQ ID NO: 9863 - protein, 11 aa, Homo Sapiens
FISAVREGSLV

SEQ ID NO: 9864 - protein, 11 aa, Homo Sapiens
FLAEEKHLHVL

SEQ ID NO: 9865 - protein, 11 aa, Homo Sapiens
FLAPDNSLLLA

SEQ ID NO: 9866 - protein, 11 aa, Homo Sapiens
FLASESLIKQI

SEQ ID NO: 9867 - protein, 11 aa, Homo Sapiens
FLFDGSPTYVL

SEQ ID NO: 9868 - protein, 11 aa, Homo Sapiens
FLIEPEHVNTV

SEQ ID NO: 9869 - protein, 11 aa, Homo Sapiens
FLPETRIMTSV

SEQ ID NO: 9870 - protein, 11 aa, Homo Sapiens
FLPPEHTIVYI

SEQ ID NO: 9871 - protein, 11 aa, Homo Sapiens
FLSEEGGHVAV

SEQ ID NO: 9872 - protein, 11 aa, Homo Sapiens
FLTDSNNIKEV

SEQ ID NO: 9873 - protein, 11 aa, Homo Sapiens
FVRDGQLQPVL

SEQ ID NO: 9874 - protein, 11 aa, Homo Sapiens
GLADASLLKKV

SEQ ID NO: 9875 - protein, 11 aa, Homo Sapiens
GLADNTVIAKV

SEQ ID NO: 9876 - protein, 11 aa, Homo Sapiens
GLFAHPSLWQL

SEQ ID NO: 9877 - protein, 11 aa, Homo Sapiens
GLFGKTVPKTV

SEQ ID NO: 9878 - protein, 11 aa, Homo Sapiens
GLIDIENPNRV

SEQ ID NO: 9879 - protein, 11 aa, Homo Sapiens
GLQIGDKIMQV

SEQ ID NO: 9880 - protein, 11 aa, Homo Sapiens
GMIDRQGLLHV

SEQ ID NO: 9881 - protein, 11 aa, Homo Sapiens
GVAESIHLWEV

SEQ ID NO: 9882 - protein, 11 aa, Homo Sapiens
HVYDGKFLARV

SEQ ID NO: 9883 - protein, 11 aa, Homo Sapiens
ILVGGGALATV

SEQ ID NO: 9884 - protein, 11 aa, Homo Sapiens
ITQIEHEVSSS

SEQ ID NO: 9885 - protein, 11 aa, Homo Sapiens
KLFPGFEIETV

SEQ ID NO: 9886 - protein, 11 aa, Homo Sapiens
KLNDMEPSKAV

SEQ ID NO: 9887 - protein, 11 aa, Homo Sapiens
KLPMSIIIVGV

SEQ ID NO: 9888 - protein, 11 aa, Homo Sapiens
KLYQEVEIASV

SEQ ID NO: 9889 - protein, 11 aa, Homo Sapiens
KMFDLNGDGEV

SEQ ID NO: 9890 - protein, 11 aa, Homo Sapiens
KVAGFNLLMTL

SEQ ID NO: 9891 - protein, 11 aa, Homo Sapiens
LLIDLSRASTL

SEQ ID NO: 9892 - protein, 11 aa, Homo Sapiens
LLLPDYYLVTV

SEQ ID NO: 9893 - protein, 11 aa, Homo Sapiens
LLYEDIGTSRV

SEQ ID NO: 9894 - protein, 11 aa, Homo Sapiens
LLYLGPHIASV

SEQ ID NO: 9895 - protein, 11 aa, Homo Sapiens
LLYPHQVPLVL

SEQ ID NO: 9896 - protein, 11 aa, Homo Sapiens
LMRFLPTEAEV

SEQ ID NO: 9897 - protein, 11 aa, Homo Sapiens
LQENLSEVSQV

SEQ ID NO: 9898 - protein, 11 aa, Homo Sapiens
LVYPEELKPVL

SEQ ID NO: 9899 - protein, 11 aa, Homo Sapiens
MLFENMGAYTV

SEQ ID NO: 9900 - protein, 11 aa, Homo Sapiens
MLYGTGPLCSV

SEQ ID NO: 9901 - protein, 11 aa, Homo Sapiens
NLAGENILNPL

SEQ ID NO: 9902 - protein, 11 aa, Homo Sapiens
NLFDISQSAQT

SEQ ID NO: 9903 - protein, 11 aa, Homo Sapiens
NLFNPSSKSSV

SEQ ID NO: 9904 - protein, 11 aa, Homo Sapiens
QLKEFDGKSLV

SEQ ID NO: 9905 - protein, 11 aa, Homo Sapiens
RIFGESIMIGV

SEQ ID NO: 9906 - protein, 11 aa, Homo Sapiens
RLAELEGREQV

SEQ ID NO: 9907 - protein, 11 aa, Homo Sapiens
RLAPAVLLTGL

SEQ ID NO: 9908 - protein, 11 aa, Homo Sapiens
RLFEMGFAEQL

SEQ ID NO: 9909 - protein, 11 aa, Homo Sapiens
RLPPDTLLQQV

SEQ ID NO: 9910 - protein, 11 aa, Homo Sapiens
RLPPEGILHNV

SEQ ID NO: 9911 - protein, 11 aa, Homo Sapiens
RLQETEGMVAV

SEQ ID NO: 9912 - protein, 11 aa, Homo Sapiens
RMANRDLLSSV

SEQ ID NO: 9913 - protein, 11 aa, Homo Sapiens
RMFDMGFEYQV

SEQ ID NO: 9914 - protein, 11 aa, Homo Sapiens
RVFGSQNLTTV

SEQ ID NO: 9915 - protein, 11 aa, Homo Sapiens
SLAEEKLQASV

SEQ ID NO: 9916 - protein, 11 aa, Homo Sapiens
SLFGSSRVQYV

SEQ ID NO: 9917 - protein, 11 aa, Homo Sapiens
SLFPHNPQFIG

SEQ ID NO: 9918 - protein, 11 aa, Homo Sapiens
SLFQGVEFHYV

SEQ ID NO: 9919 - protein, 11 aa, Homo Sapiens
SLIDMRGIETV

SEQ ID NO: 9920 - protein, 11 aa, Homo Sapiens
SLINLPANSTI

SEQ ID NO: 9921 - protein, 11 aa, Homo Sapiens
SLIPGPALLLV

SEQ ID NO: 9922 - protein, 11 aa, Homo Sapiens
SLMEESGICKV

SEQ ID NO: 9923 - protein, 11 aa, Homo Sapiens
SLRDGSVLQTV

SEQ ID NO: 9924 - protein, 11 aa, Homo Sapiens
SLVENIERLKV

SEQ ID NO: 9925 - protein, 11 aa, Homo Sapiens
SMAPGLVIQAV

SEQ ID NO: 9926 - protein, 11 aa, Homo Sapiens
SVAEGRALMSV

SEQ ID NO: 9927 - protein, 11 aa, Homo Sapiens
SVFTETPSPVL

SEQ ID NO: 9928 - protein, 11 aa, Homo Sapiens
TIIDLPGITRV

SEQ ID NO: 9929 - protein, 11 aa, Homo Sapiens
TLFPAIEKNIV

SEQ ID NO: 9930 - protein, 11 aa, Homo Sapiens
TLFPEEVIATI

SEQ ID NO: 9931 - protein, 11 aa, Homo Sapiens
TLGVKQLIVGV

SEQ ID NO: 9932 - protein, 11 aa, Homo Sapiens
TLIDLPGITKV

SEQ ID NO: 9933 - protein, 11 aa, Homo Sapiens
TLIGFLRSIDQ

SEQ ID NO: 9934 - protein, 11 aa, Homo Sapiens
TLLLTQLSLLQ

SEQ ID NO: 9935 - protein, 11 aa, Homo Sapiens
TLVDLSKMQNV

SEQ ID NO: 9936 - protein, 11 aa, Homo Sapiens
TLYDIAHTPGV

SEQ ID NO: 9937 - protein, 11 aa, Homo Sapiens
TMAKESSIIGV

SEQ ID NO: 9938 - protein, 11 aa, Homo Sapiens
TMFPGVLLPLL

SEQ ID NO: 9939 - protein, 11 aa, Homo Sapiens
VLYENPNLKGV

SEQ ID NO: 9940 - protein, 11 aa, Homo Sapiens
VLYPHEPTAVF

SEQ ID NO: 9941 - protein, 11 aa, Homo Sapiens
VMQDPEFLQSV

SEQ ID NO: 9942 - protein, 11 aa, Homo Sapiens
WLANEGLITRL

SEQ ID NO: 9943 - protein, 11 aa, Homo Sapiens
WLIEDGKVVTV

SEQ ID NO: 9944 - protein, 11 aa, Homo Sapiens
YAFDEAFVREV

SEQ ID NO: 9945 - protein, 11 aa, Homo Sapiens
YIFPLDDKAAV

SEQ ID NO: 9946 - protein, 11 aa, Homo Sapiens
YIMDLRTESLI

SEQ ID NO: 9947 - protein, 11 aa, Homo Sapiens
YLFITPPKTVL

SEQ ID NO: 9948 - protein, 11 aa, Homo Sapiens
YLFNVSDSSAL

SEQ ID NO: 9949 - protein, 11 aa, Homo Sapiens
YLLNDASLISV

SEQ ID NO: 9950 - protein, 11 aa, Homo Sapiens
YLTELLTTQRV

SEQ ID NO: 9951 - protein, 11 aa, Homo Sapiens
YMGEEKLIASV

SEQ ID NO: 9952 - protein, 11 aa, Homo Sapiens
YQFDSALLPAV

SEQ ID NO: 9953 - protein, 11 aa, Homo Sapiens
YVFENTVATVM

SEQ ID NO: 9954 - protein, 8 aa, Homo Sapiens
ALFKAWAL

SEQ ID NO: 9955 - protein, 8 aa, Homo Sapiens
ALGFVYKL

SEQ ID NO: 9956 - protein, 8 aa, Homo Sapiens
EKSPLQTI

SEQ ID NO: 9957 - protein, 8 aa, Homo Sapiens
FLFRPWDV

SEQ ID NO: 9958 - protein, 8 aa, Homo Sapiens
FLGAIFQL

SEQ ID NO: 9959 - protein, 8 aa, Homo Sapiens
FLGKIDEL

SEQ ID NO: 9960 - protein, 8 aa, Homo Sapiens
FLGKIYQI

SEQ ID NO: 9961 - protein, 8 aa, Homo Sapiens
GLFRLWAL

SEQ ID NO: 9962 - protein, 8 aa, Homo Sapiens
GLGPTFKL

SEQ ID NO: 9963 - protein, 8 aa, Homo Sapiens
GLGRIIEL

SEQ ID NO: 9964 - protein, 8 aa, Homo Sapiens
ILGPTFTL

SEQ ID NO: 9965 - protein, 8 aa, Homo Sapiens
ILGSVTFL

SEQ ID NO: 9966 - protein, 8 aa, Homo Sapiens
LMEHIHKL

SEQ ID NO: 9967 - protein, 8 aa, Homo Sapiens
LSEKLARL

SEQ ID NO: 9968 - protein, 8 aa, Homo Sapiens
QLAKEVLI

SEQ ID NO: 9969 - protein, 8 aa, Homo Sapiens
SIAVKFLA

SEQ ID NO: 9970 - protein, 8 aa, Homo Sapiens
SIFKAWAV

SEQ ID NO: 9971 - protein, 8 aa, Homo Sapiens
SLFKIWLV

SEQ ID NO: 9972 - protein, 8 aa, Homo Sapiens
SLGKIFAL

SEQ ID NO: 9973 - protein, 8 aa, Homo Sapiens
SLGKVFGV

SEQ ID NO: 9974 - protein, 8 aa, Homo Sapiens
TLGQIYYL

SEQ ID NO: 9975 - protein, 8 aa, Homo Sapiens
VLGKIWKL

SEQ ID NO: 9976 - protein, 8 aa, Homo Sapiens
VLPRLHQL

SEQ ID NO: 9977 - protein, 8 aa, Homo Sapiens
VMGKIFAV

SEQ ID NO: 9978 - protein, 8 aa, Homo Sapiens
YLGKVLEL

SEQ ID NO: 9979 - protein, 8 aa, Homo Sapiens
YLNFIRGV

SEQ ID NO: 9980 - protein, 9 aa, Homo Sapiens
AAKSWVFGV

SEQ ID NO: 9981 - protein, 9 aa, Homo Sapiens
AALFKAWAL

SEQ ID NO: 9982 - protein, 9 aa, Homo Sapiens
AALPNVYEV

SEQ ID NO: 9983 - protein, 9 aa, Homo Sapiens
AALSKFIAV

SEQ ID NO: 9984 - protein, 9 aa, Homo Sapiens
AALSKIFAV

SEQ ID NO: 9985 - protein, 9 aa, Homo Sapiens
AALSWQYLT

SEQ ID NO: 9986 - protein, 9 aa, Homo Sapiens
AAMPRIYEL

SEQ ID NO: 9987 - protein, 9 aa, Homo Sapiens
AASDFIFLV

SEQ ID NO: 9988 - protein, 9 aa, Homo Sapiens
ADASLLKKV

SEQ ID NO: 9989 - protein, 9 aa, Homo Sapiens
AGHWLGLLL

SEQ ID NO: 9990 - protein, 9 aa, Homo Sapiens
AGLSWYHGV

SEQ ID NO: 9991 - protein, 9 aa, Homo Sapiens
AIIEYMPLL

SEQ ID NO: 9992 - protein, 9 aa, Homo Sapiens
AIIPYIPTL

SEQ ID NO: 9993 - protein, 9 aa, Homo Sapiens
AILKYIETL

SEQ ID NO: 9994 - protein, 9 aa, Homo Sapiens
AILLEIPRL

SEQ ID NO: 9995 - protein, 9 aa, Homo Sapiens
AILPQLFMV

SEQ ID NO: 9996 - protein, 9 aa, Homo Sapiens
AILPSIFCL

SEQ ID NO: 9997 - protein, 9 aa, Homo Sapiens
AILTTLIHL

SEQ ID NO: 9998 - protein, 9 aa, Homo Sapiens
AIMATIPLL

SEQ ID NO: 9999 - protein, 9 aa, Homo Sapiens
AIMDIVIKV

SEQ ID NO: 10000 - protein, 9 aa, Homo Sapiens
AIMDLLLRL

SEQ ID NO: 10001 - protein, 9 aa, Homo Sapiens
AIMKIISAL

SEQ ID NO: 10002 - protein, 9 aa, Homo Sapiens
AIMNVLAEL

SEQ ID NO: 10003 - protein, 9 aa, Homo Sapiens
AIMPTIFNL

SEQ ID NO: 10004 - protein, 9 aa, Homo Sapiens
AIQDKLFQV

SEQ ID NO: 10005 - protein, 9 aa, Homo Sapiens
AIQEQITRV

SEQ ID NO: 10006 - protein, 9 aa, Homo Sapiens
ALAAALAHI

SEQ ID NO: 10007 - protein, 9 aa, Homo Sapiens
ALACWEWLL

SEQ ID NO: 10008 - protein, 9 aa, Homo Sapiens
ALADFAELI

SEQ ID NO: 10009 - protein, 9 aa, Homo Sapiens
ALADFLPVM

SEQ ID NO: 10010 - protein, 9 aa, Homo Sapiens
ALADLLLAL

SEQ ID NO: 10011 - protein, 9 aa, Homo Sapiens
ALALWKELL

SEQ ID NO: 10012 - protein, 9 aa, Homo Sapiens
ALANQIPTV

SEQ ID NO: 10013 - protein, 9 aa, Homo Sapiens
ALAPAPPQV

SEQ ID NO: 10014 - protein, 9 aa, Homo Sapiens
ALAPLLSSL

SEQ ID NO: 10015 - protein, 9 aa, Homo Sapiens
ALAPYLDLL

SEQ ID NO: 10016 - protein, 9 aa, Homo Sapiens
ALAQRLLEV

SEQ ID NO: 10017 - protein, 9 aa, Homo Sapiens
ALARLVLRL

SEQ ID NO: 10018 - protein, 9 aa, Homo Sapiens
ALASVIKEL

SEQ ID NO: 10019 - protein, 9 aa, Homo Sapiens
ALASVIMGL

SEQ ID NO: 10020 - protein, 9 aa, Homo Sapiens
ALATHILSL

SEQ ID NO: 10021 - protein, 9 aa, Homo Sapiens
ALATKLLSL

SEQ ID NO: 10022 - protein, 9 aa, Homo Sapiens
ALATLIHQV

SEQ ID NO: 10023 - protein, 9 aa, Homo Sapiens
ALFDAQAQV

SEQ ID NO: 10024 - protein, 9 aa, Homo Sapiens
ALFEEVPEL

SEQ ID NO: 10025 - protein, 9 aa, Homo Sapiens
ALFEGKVQL

SEQ ID NO: 10026 - protein, 9 aa, Homo Sapiens
ALFETLIQL

SEQ ID NO: 10027 - protein, 9 aa, Homo Sapiens
ALFGIPMAL

SEQ ID NO: 10028 - protein, 9 aa, Homo Sapiens
ALFIRPFML

SEQ ID NO: 10029 - protein, 9 aa, Homo Sapiens
ALFISPALI

SEQ ID NO: 10030 - protein, 9 aa, Homo Sapiens
ALFPGVALL

SEQ ID NO: 10031 - protein, 9 aa, Homo Sapiens
ALFPRLPSI

SEQ ID NO: 10032 - protein, 9 aa, Homo Sapiens
ALFQHITAL

SEQ ID NO: 10033 - protein, 9 aa, Homo Sapiens
ALFQRPPLI

SEQ ID NO: 10034 - protein, 9 aa, Homo Sapiens
ALFSFLYHL

SEQ ID NO: 10035 - protein, 9 aa, Homo Sapiens
ALGEQVIAL

SEQ ID NO: 10036 - protein, 9 aa, Homo Sapiens
ALGGCVFYL

SEQ ID NO: 10037 - protein, 9 aa, Homo Sapiens
ALGKSPFQL

SEQ ID NO: 10038 - protein, 9 aa, Homo Sapiens
ALGNIVHGL

SEQ ID NO: 10039 - protein, 9 aa, Homo Sapiens
ALGPGVPHI

SEQ ID NO: 10040 - protein, 9 aa, Homo Sapiens
ALGQILPQL

SEQ ID NO: 10041 - protein, 9 aa, Homo Sapiens
ALHDILTEI

SEQ ID NO: 10042 - protein, 9 aa, Homo Sapiens
ALHDQLFYL

SEQ ID NO: 10043 - protein, 9 aa, Homo Sapiens
ALHSWFQTL

SEQ ID NO: 10044 - protein, 9 aa, Homo Sapiens
ALHWFLNQV

SEQ ID NO: 10045 - protein, 9 aa, Homo Sapiens
ALIEKLVEL

SEQ ID NO: 10046 - protein, 9 aa, Homo Sapiens
ALINNIVEI

SEQ ID NO: 10047 - protein, 9 aa, Homo Sapiens
ALINVLNAL

SEQ ID NO: 10048 - protein, 9 aa, Homo Sapiens
ALIPVINKL

SEQ ID NO: 10049 - protein, 9 aa, Homo Sapiens
ALIQQATTV

SEQ ID NO: 10050 - protein, 9 aa, Homo Sapiens
ALIRYLETM

SEQ ID NO: 10051 - protein, 9 aa, Homo Sapiens
ALITRIFGV

SEQ ID NO: 10052 - protein, 9 aa, Homo Sapiens
ALIVLIHLL

SEQ ID NO: 10053 - protein, 9 aa, Homo Sapiens
ALKDFVASI

SEQ ID NO: 10054 - protein, 9 aa, Homo Sapiens
ALKPDLVNV

SEQ ID NO: 10055 - protein, 9 aa, Homo Sapiens
ALLAELEKI

SEQ ID NO: 10056 - protein, 9 aa, Homo Sapiens
ALLAKILQI

SEQ ID NO: 10057 - protein, 9 aa, Homo Sapiens
ALLALLPEL

SEQ ID NO: 10058 - protein, 9 aa, Homo Sapiens
ALLARFPNL

SEQ ID NO: 10059 - protein, 9 aa, Homo Sapiens
ALLAYTLGV

SEQ ID NO: 10060 - protein, 9 aa, Homo Sapiens
ALLDIIRSL

SEQ ID NO: 10061 - protein, 9 aa, Homo Sapiens
ALLDKLYAL

SEQ ID NO: 10062 - protein, 9 aa, Homo Sapiens
ALLDQLHTL

SEQ ID NO: 10063 - protein, 9 aa, Homo Sapiens
ALLDRIVSV

SEQ ID NO: 10064 - protein, 9 aa, Homo Sapiens
ALLDSAHLL

SEQ ID NO: 10065 - protein, 9 aa, Homo Sapiens
ALLDWVTSV

SEQ ID NO: 10066 - protein, 9 aa, Homo Sapiens
ALLELLERL

SEQ ID NO: 10067 - protein, 9 aa, Homo Sapiens
ALLELLHEL

SEQ ID NO: 10068 - protein, 9 aa, Homo Sapiens
ALLEQVNAL

SEQ ID NO: 10069 - protein, 9 aa, Homo Sapiens
ALLERGYSL

SEQ ID NO: 10070 - protein, 9 aa, Homo Sapiens
ALLESRVNL

SEQ ID NO: 10071 - protein, 9 aa, Homo Sapiens
ALLETVNRL

SEQ ID NO: 10072 - protein, 9 aa, Homo Sapiens
ALLGILQHV

SEQ ID NO: 10073 - protein, 9 aa, Homo Sapiens
ALLGKLDAI

SEQ ID NO: 10074 - protein, 9 aa, Homo Sapiens
ALLGRLAEL

SEQ ID NO: 10075 - protein, 9 aa, Homo Sapiens
ALLKVNQEL

SEQ ID NO: 10076 - protein, 9 aa, Homo Sapiens
ALLNILSEV

SEQ ID NO: 10077 - protein, 9 aa, Homo Sapiens
ALLNLLPML

SEQ ID NO: 10078 - protein, 9 aa, Homo Sapiens
ALLNTINYL

SEQ ID NO: 10079 - protein, 9 aa, Homo Sapiens
ALLPDLPAL

SEQ ID NO: 10080 - protein, 9 aa, Homo Sapiens
ALLPELSVL

SEQ ID NO: 10081 - protein, 9 aa, Homo Sapiens
ALLPLLERV

SEQ ID NO: 10082 - protein, 9 aa, Homo Sapiens
ALLPSSPTL

SEQ ID NO: 10083 - protein, 9 aa, Homo Sapiens
ALLPWTCAS

SEQ ID NO: 10084 - protein, 9 aa, Homo Sapiens
ALLPYFVYV

SEQ ID NO: 10085 - protein, 9 aa, Homo Sapiens
ALLQALMEL

SEQ ID NO: 10086 - protein, 9 aa, Homo Sapiens
ALLQEIVNI

SEQ ID NO: 10087 - protein, 9 aa, Homo Sapiens
ALLQRLEAL

SEQ ID NO: 10088 - protein, 9 aa, Homo Sapiens
ALLRLLPGL

SEQ ID NO: 10089 - protein, 9 aa, Homo Sapiens
ALLRSLVGL

SEQ ID NO: 10090 - protein, 9 aa, Homo Sapiens
ALLSALHWL

SEQ ID NO: 10091 - protein, 9 aa, Homo Sapiens
ALLSAPWYL

SEQ ID NO: 10092 - protein, 9 aa, Homo Sapiens
ALLSAVTRL

SEQ ID NO: 10093 - protein, 9 aa, Homo Sapiens
ALLSDLHAF

SEQ ID NO: 10094 - protein, 9 aa, Homo Sapiens
ALLSKNLSV

SEQ ID NO: 10095 - protein, 9 aa, Homo Sapiens
ALLSRLEQI

SEQ ID NO: 10096 - protein, 9 aa, Homo Sapiens
ALLSWVNSL

SEQ ID NO: 10097 - protein, 9 aa, Homo Sapiens
ALLTYLEQV

SEQ ID NO: 10098 - protein, 9 aa, Homo Sapiens
ALMEALVLI

SEQ ID NO: 10099 - protein, 9 aa, Homo Sapiens
ALMEEILKL

SEQ ID NO: 10100 - protein, 9 aa, Homo Sapiens
ALMELFPKL

SEQ ID NO: 10101 - protein, 9 aa, Homo Sapiens
ALMHALTDL

SEQ ID NO: 10102 - protein, 9 aa, Homo Sapiens
ALMNLIQYI

SEQ ID NO: 10103 - protein, 9 aa, Homo Sapiens
ALMPQLVQL

SEQ ID NO: 10104 - protein, 9 aa, Homo Sapiens
ALMPTLEAL

SEQ ID NO: 10105 - protein, 9 aa, Homo Sapiens
ALMPVLNQV

SEQ ID NO: 10106 - protein, 9 aa, Homo Sapiens
ALNAVRLLV

SEQ ID NO: 10107 - protein, 9 aa, Homo Sapiens
ALNDCIYSV

SEQ ID NO: 10108 - protein, 9 aa, Homo Sapiens
ALNDEIRQL

SEQ ID NO: 10109 - protein, 9 aa, Homo Sapiens
ALNEKLVNL

SEQ ID NO: 10110 - protein, 9 aa, Homo Sapiens
ALNEQIARL

SEQ ID NO: 10111 - protein, 9 aa, Homo Sapiens
ALNFIISYL

SEQ ID NO: 10112 - protein, 9 aa, Homo Sapiens
ALNGKLYIV

SEQ ID NO: 10113 - protein, 9 aa, Homo Sapiens
ALNIATHVL

SEQ ID NO: 10114 - protein, 9 aa, Homo Sapiens
ALNNLLHSL

SEQ ID NO: 10115 - protein, 9 aa, Homo Sapiens
ALNSKILSV

SEQ ID NO: 10116 - protein, 9 aa, Homo Sapiens
ALPEAIAAL

SEQ ID NO: 10117 - protein, 9 aa, Homo Sapiens
ALQAAIQQL

SEQ ID NO: 10118 - protein, 9 aa, Homo Sapiens
ALQADIDQL

SEQ ID NO: 10119 - protein, 9 aa, Homo Sapiens
ALQAEIAAL

SEQ ID NO: 10120 - protein, 9 aa, Homo Sapiens
ALQALVVTL

SEQ ID NO: 10121 - protein, 9 aa, Homo Sapiens
ALQAQITAL

SEQ ID NO: 10122 - protein, 9 aa, Homo Sapiens
ALQASIVKL

SEQ ID NO: 10123 - protein, 9 aa, Homo Sapiens
ALQDFLLSV

SEQ ID NO: 10124 - protein, 9 aa, Homo Sapiens
ALQDQLLKL

SEQ ID NO: 10125 - protein, 9 aa, Homo Sapiens
ALQEKLWNV

SEQ ID NO: 10126 - protein, 9 aa, Homo Sapiens
ALQELISEL

SEQ ID NO: 10127 - protein, 9 aa, Homo Sapiens
ALQERLDGL

SEQ ID NO: 10128 - protein, 9 aa, Homo Sapiens
ALQGSAWQV

SEQ ID NO: 10129 - protein, 9 aa, Homo Sapiens
ALQIIINCV

SEQ ID NO: 10130 - protein, 9 aa, Homo Sapiens
ALQPSIKFV

SEQ ID NO: 10131 - protein, 9 aa, Homo Sapiens
ALQRIISTL

SEQ ID NO: 10132 - protein, 9 aa, Homo Sapiens
ALQSLLHLL

SEQ ID NO: 10133 - protein, 9 aa, Homo Sapiens
ALQWVVVEV

SEQ ID NO: 10134 - protein, 9 aa, Homo Sapiens
ALRSFLQAL

SEQ ID NO: 10135 - protein, 9 aa, Homo Sapiens
ALSDIFQAV

SEQ ID NO: 10136 - protein, 9 aa, Homo Sapiens
ALSDILINF

SEQ ID NO: 10137 - protein, 9 aa, Homo Sapiens
ALSDLEITL

SEQ ID NO: 10138 - protein, 9 aa, Homo Sapiens
ALSEELVQL

SEQ ID NO: 10139 - protein, 9 aa, Homo Sapiens
ALSEKIVSV

SEQ ID NO: 10140 - protein, 9 aa, Homo Sapiens
ALSEKLARL

SEQ ID NO: 10141 - protein, 9 aa, Homo Sapiens
ALSELTTCL

SEQ ID NO: 10142 - protein, 9 aa, Homo Sapiens
ALSGLAVRL

SEQ ID NO: 10143 - protein, 9 aa, Homo Sapiens
ALSHILTAL

SEQ ID NO: 10144 - protein, 9 aa, Homo Sapiens
ALSIQNYHL

SEQ ID NO: 10145 - protein, 9 aa, Homo Sapiens
ALSLYLFKL

SEQ ID NO: 10146 - protein, 9 aa, Homo Sapiens
ALSMIIKSL

SEQ ID NO: 10147 - protein, 9 aa, Homo Sapiens
ALSNFISQL

SEQ ID NO: 10148 - protein, 9 aa, Homo Sapiens
ALSNLEVKL

SEQ ID NO: 10149 - protein, 9 aa, Homo Sapiens
ALSPHNILL

SEQ ID NO: 10150 - protein, 9 aa, Homo Sapiens
ALSPINIQL

SEQ ID NO: 10151 - protein, 9 aa, Homo Sapiens
ALSPQLQQL

SEQ ID NO: 10152 - protein, 9 aa, Homo Sapiens
ALSSLAVVV

SEQ ID NO: 10153 - protein, 9 aa, Homo Sapiens
ALSSLIHAL

SEQ ID NO: 10154 - protein, 9 aa, Homo Sapiens
ALSSLLQQL

SEQ ID NO: 10155 - protein, 9 aa, Homo Sapiens
ALSSVIKEL

SEQ ID NO: 10156 - protein, 9 aa, Homo Sapiens
ALSYILPYL

SEQ ID NO: 10157 - protein, 9 aa, Homo Sapiens
ALTDVILCV

SEQ ID NO: 10158 - protein, 9 aa, Homo Sapiens
ALTDYITRL

SEQ ID NO: 10159 - protein, 9 aa, Homo Sapiens
ALTELLAKI

SEQ ID NO: 10160 - protein, 9 aa, Homo Sapiens
ALTGYLHTI

SEQ ID NO: 10161 - protein, 9 aa, Homo Sapiens
ALTPVVVTL

SEQ ID NO: 10162 - protein, 9 aa, Homo Sapiens
ALTPVWVLI

SEQ ID NO: 10163 - protein, 9 aa, Homo Sapiens
ALTRVIYNL

SEQ ID NO: 10164 - protein, 9 aa, Homo Sapiens
ALTSEIALL

SEQ ID NO: 10165 - protein, 9 aa, Homo Sapiens
ALTSVVVTL

SEQ ID NO: 10166 - protein, 9 aa, Homo Sapiens
ALTVNLHLL

SEQ ID NO: 10167 - protein, 9 aa, Homo Sapiens
ALTWLIPTL

SEQ ID NO: 10168 - protein, 9 aa, Homo Sapiens
ALVDHVAEL

SEQ ID NO: 10169 - protein, 9 aa, Homo Sapiens
ALVDLIYNM

SEQ ID NO: 10170 - protein, 9 aa, Homo Sapiens
ALVDQLWKL

SEQ ID NO: 10171 - protein, 9 aa, Homo Sapiens
ALVEDIINL

SEQ ID NO: 10172 - protein, 9 aa, Homo Sapiens
ALVNELYSL

SEQ ID NO: 10173 - protein, 9 aa, Homo Sapiens
ALVSSLHLL

SEQ ID NO: 10174 - protein, 9 aa, Homo Sapiens
ALWAGLLTL

SEQ ID NO: 10175 - protein, 9 aa, Homo Sapiens
ALWDKLFNL

SEQ ID NO: 10176 - protein, 9 aa, Homo Sapiens
ALWGFFPVL

SEQ ID NO: 10177 - protein, 9 aa, Homo Sapiens
ALYDNVEKL

SEQ ID NO: 10178 - protein, 9 aa, Homo Sapiens
ALYNWLIQV

SEQ ID NO: 10179 - protein, 9 aa, Homo Sapiens
ALYPNVVQV

SEQ ID NO: 10180 - protein, 9 aa, Homo Sapiens
ALYQSLPTL

SEQ ID NO: 10181 - protein, 9 aa, Homo Sapiens
ALYSELLAV

SEQ ID NO: 10182 - protein, 9 aa, Homo Sapiens
ALYVAVVNV

SEQ ID NO: 10183 - protein, 9 aa, Homo Sapiens
AMASIINRL

SEQ ID NO: 10184 - protein, 9 aa, Homo Sapiens
AMFGKLMTI

SEQ ID NO: 10185 - protein, 9 aa, Homo Sapiens
AMIELVERL

SEQ ID NO: 10186 - protein, 9 aa, Homo Sapiens
AMIERITFI

SEQ ID NO: 10187 - protein, 9 aa, Homo Sapiens
AMLAVLHTV

SEQ ID NO: 10188 - protein, 9 aa, Homo Sapiens
AMLERLLSL

SEQ ID NO: 10189 - protein, 9 aa, Homo Sapiens
AMLGVNPRF

SEQ ID NO: 10190 - protein, 9 aa, Homo Sapiens
AMLLEIPYM

SEQ ID NO: 10191 - protein, 9 aa, Homo Sapiens
AMLPSITNV

SEQ ID NO: 10192 - protein, 9 aa, Homo Sapiens
AMLRLIPSL

SEQ ID NO: 10193 - protein, 9 aa, Homo Sapiens
AMLTVLHEI

SEQ ID NO: 10194 - protein, 9 aa, Homo Sapiens
AMNISVPQV

SEQ ID NO: 10195 - protein, 9 aa, Homo Sapiens
AMQEFLTRL

SEQ ID NO: 10196 - protein, 9 aa, Homo Sapiens
AMQEYIAVV

SEQ ID NO: 10197 - protein, 9 aa, Homo Sapiens
AQAQEVFFL

SEQ ID NO: 10198 - protein, 9 aa, Homo Sapiens
AQFGYYFRV

SEQ ID NO: 10199 - protein, 9 aa, Homo Sapiens
AQIDSIVEL

SEQ ID NO: 10200 - protein, 9 aa, Homo Sapiens
AQIFAIYQL

SEQ ID NO: 10201 - protein, 9 aa, Homo Sapiens
AQIPVVFRL

SEQ ID NO: 10202 - protein, 9 aa, Homo Sapiens
AQQLQIFNL

SEQ ID NO: 10203 - protein, 9 aa, Homo Sapiens
AQRDIIFEL

SEQ ID NO: 10204 - protein, 9 aa, Homo Sapiens
AQVEEIWSL

SEQ ID NO: 10205 - protein, 9 aa, Homo Sapiens
ATFARIWYL

SEQ ID NO: 10206 - protein, 9 aa, Homo Sapiens
ATIGELAQV

SEQ ID NO: 10207 - protein, 9 aa, Homo Sapiens
ATLSVVPQL

SEQ ID NO: 10208 - protein, 9 aa, Homo Sapiens
ATMPDLYHL

SEQ ID NO: 10209 - protein, 9 aa, Homo Sapiens
ATYVFLHTV

SEQ ID NO: 10210 - protein, 9 aa, Homo Sapiens
AVADHLFKL

SEQ ID NO: 10211 - protein, 9 aa, Homo Sapiens
AVADILFLL

SEQ ID NO: 10212 - protein, 9 aa, Homo Sapiens
AVAEQIPLL

SEQ ID NO: 10213 - protein, 9 aa, Homo Sapiens
AVANIVNSV

SEQ ID NO: 10214 - protein, 9 aa, Homo Sapiens
AVAPQVPAL

SEQ ID NO: 10215 - protein, 9 aa, Homo Sapiens
AVASFVTQL

SEQ ID NO: 10216 - protein, 9 aa, Homo Sapiens
AVAVSVPFL

SEQ ID NO: 10217 - protein, 9 aa, Homo Sapiens
AVIEHLERL

SEQ ID NO: 10218 - protein, 9 aa, Homo Sapiens
AVLAVLPRL

SEQ ID NO: 10219 - protein, 9 aa, Homo Sapiens
AVLEEIYLL

SEQ ID NO: 10220 - protein, 9 aa, Homo Sapiens
AVLESIERL

SEQ ID NO: 10221 - protein, 9 aa, Homo Sapiens
AVLHAIYSL

SEQ ID NO: 10222 - protein, 9 aa, Homo Sapiens
AVLPRLHQL

SEQ ID NO: 10223 - protein, 9 aa, Homo Sapiens
AVMEQIPEI

SEQ ID NO: 10224 - protein, 9 aa, Homo Sapiens
AVNPHLFSL

SEQ ID NO: 10225 - protein, 9 aa, Homo Sapiens
AVQEKVFEL

SEQ ID NO: 10226 - protein, 9 aa, Homo Sapiens
AVSNHVFHL

SEQ ID NO: 10227 - protein, 9 aa, Homo Sapiens
AVSNHVFQL

SEQ ID NO: 10228 - protein, 9 aa, Homo Sapiens
DMFHWQATI

SEQ ID NO: 10229 - protein, 9 aa, Homo Sapiens
DQILKLLSL

SEQ ID NO: 10230 - protein, 9 aa, Homo Sapiens
ELIERIPEL

SEQ ID NO: 10231 - protein, 9 aa, Homo Sapiens
ELIPTLPQL

SEQ ID NO: 10232 - protein, 9 aa, Homo Sapiens
ELNPSIPLL

SEQ ID NO: 10233 - protein, 9 aa, Homo Sapiens
ELSDVLIYL

SEQ ID NO: 10234 - protein, 9 aa, Homo Sapiens
ELSEKNFQL

SEQ ID NO: 10235 - protein, 9 aa, Homo Sapiens
ETVLWVVHV

SEQ ID NO: 10236 - protein, 9 aa, Homo Sapiens
FAIPMIHAV

SEQ ID NO: 10237 - protein, 9 aa, Homo Sapiens
FIFSYITAV

SEQ ID NO: 10238 - protein, 9 aa, Homo Sapiens
FIINGIEKV

SEQ ID NO: 10239 - protein, 9 aa, Homo Sapiens
FIIQGLRSV

SEQ ID NO: 10240 - protein, 9 aa, Homo Sapiens
FILEKIEYL

SEQ ID NO: 10241 - protein, 9 aa, Homo Sapiens
FILTHVDQL

SEQ ID NO: 10242 - protein, 9 aa, Homo Sapiens
FINARNWTL

SEQ ID NO: 10243 - protein, 9 aa, Homo Sapiens
FINELITEL

SEQ ID NO: 10244 - protein, 9 aa, Homo Sapiens
FINGDISSL

SEQ ID NO: 10245 - protein, 9 aa, Homo Sapiens
FINIVVHSV

SEQ ID NO: 10246 - protein, 9 aa, Homo Sapiens
FINTVITSL

SEQ ID NO: 10247 - protein, 9 aa, Homo Sapiens
FIQSIISTV

SEQ ID NO: 10248 - protein, 9 aa, Homo Sapiens
FISEFEHRV

SEQ ID NO: 10249 - protein, 9 aa, Homo Sapiens
FIWENIHTL

SEQ ID NO: 10250 - protein, 9 aa, Homo Sapiens
FLADPVSNM

SEQ ID NO: 10251 - protein, 9 aa, Homo Sapiens
FLANVSTVL

SEQ ID NO: 10252 - protein, 9 aa, Homo Sapiens
FLAPWATIA

SEQ ID NO: 10253 - protein, 9 aa, Homo Sapiens
FLAQRAVEL

SEQ ID NO: 10254 - protein, 9 aa, Homo Sapiens
FLDDVVHSL

SEQ ID NO: 10255 - protein, 9 aa, Homo Sapiens
FLEKLLPPV

SEQ ID NO: 10256 - protein, 9 aa, Homo Sapiens
FLETNVPLL

SEQ ID NO: 10257 - protein, 9 aa, Homo Sapiens
FLFDHLLTL

SEQ ID NO: 10258 - protein, 9 aa, Homo Sapiens
FLFELPSRL

SEQ ID NO: 10259 - protein, 9 aa, Homo Sapiens
FLFNAIETM

SEQ ID NO: 10260 - protein, 9 aa, Homo Sapiens
FLFQEPRSI

SEQ ID NO: 10261 - protein, 9 aa, Homo Sapiens
FLFTTPCRL

SEQ ID NO: 10262 - protein, 9 aa, Homo Sapiens
FLGADLPNL

SEQ ID NO: 10263 - protein, 9 aa, Homo Sapiens
FLGDPPPGL

SEQ ID NO: 10264 - protein, 9 aa, Homo Sapiens
FLGIHVFLV

SEQ ID NO: 10265 - protein, 9 aa, Homo Sapiens
FLGTFILKV

SEQ ID NO: 10266 - protein, 9 aa, Homo Sapiens
FLHEATVRL

SEQ ID NO: 10267 - protein, 9 aa, Homo Sapiens
FLINFIHTL

SEQ ID NO: 10268 - protein, 9 aa, Homo Sapiens
FLIPFVITV

SEQ ID NO: 10269 - protein, 9 aa, Homo Sapiens
FLIPKFFEL

SEQ ID NO: 10270 - protein, 9 aa, Homo Sapiens
FLIQNVLRL

SEQ ID NO: 10271 - protein, 9 aa, Homo Sapiens
FLITILDHL

SEQ ID NO: 10272 - protein, 9 aa, Homo Sapiens
FLKDLVASV

SEQ ID NO: 10273 - protein, 9 aa, Homo Sapiens
FLKLSLGLP

SEQ ID NO: 10274 - protein, 9 aa, Homo Sapiens
FLLDKALLI

SEQ ID NO: 10275 - protein, 9 aa, Homo Sapiens
FLLDKKIGV

SEQ ID NO: 10276 - protein, 9 aa, Homo Sapiens
FLLDKPQDL

SEQ ID NO: 10277 - protein, 9 aa, Homo Sapiens
FLLEGIRSL

SEQ ID NO: 10278 - protein, 9 aa, Homo Sapiens
FLLFINHRL

SEQ ID NO: 10279 - protein, 9 aa, Homo Sapiens
FLLHIQQQV

SEQ ID NO: 10280 - protein, 9 aa, Homo Sapiens
FLLKDLSSL

SEQ ID NO: 10281 - protein, 9 aa, Homo Sapiens
FLLPILSQI

SEQ ID NO: 10282 - protein, 9 aa, Homo Sapiens
FLLPKVQSI

SEQ ID NO: 10283 - protein, 9 aa, Homo Sapiens
FLLPLIIVL

SEQ ID NO: 10284 - protein, 9 aa, Homo Sapiens
FLLPLRIAL

SEQ ID NO: 10285 - protein, 9 aa, Homo Sapiens
FLLPVINEM

SEQ ID NO: 10286 - protein, 9 aa, Homo Sapiens
FLMDFIHQV

SEQ ID NO: 10287 - protein, 9 aa, Homo Sapiens
FLMNEVIKL

SEQ ID NO: 10288 - protein, 9 aa, Homo Sapiens
FLNDEVWNL

SEQ ID NO: 10289 - protein, 9 aa, Homo Sapiens
FLNEDLNQL

SEQ ID NO: 10290 - protein, 9 aa, Homo Sapiens
FLNELIKVL

SEQ ID NO: 10291 - protein, 9 aa, Homo Sapiens
FLNGEVIRL

SEQ ID NO: 10292 - protein, 9 aa, Homo Sapiens
FLNKEILEL

SEQ ID NO: 10293 - protein, 9 aa, Homo Sapiens
FLNKLIPVL

SEQ ID NO: 10294 - protein, 9 aa, Homo Sapiens
FLPEAPAEL

SEQ ID NO: 10295 - protein, 9 aa, Homo Sapiens
FLPPYTFQI

SEQ ID NO: 10296 - protein, 9 aa, Homo Sapiens
FLQDYTLLI

SEQ ID NO: 10297 - protein, 9 aa, Homo Sapiens
FLQEYGLSV

SEQ ID NO: 10298 - protein, 9 aa, Homo Sapiens
FLQKLISQL

SEQ ID NO: 10299 - protein, 9 aa, Homo Sapiens
FLQPELVKL

SEQ ID NO: 10300 - protein, 9 aa, Homo Sapiens
FLRDNLEWL

SEQ ID NO: 10301 - protein, 9 aa, Homo Sapiens
FLRELVITI

SEQ ID NO: 10302 - protein, 9 aa, Homo Sapiens
FLREWVESM

SEQ ID NO: 10303 - protein, 9 aa, Homo Sapiens
FLREYFERL

SEQ ID NO: 10304 - protein, 9 aa, Homo Sapiens
FLRNINEYL

SEQ ID NO: 10305 - protein, 9 aa, Homo Sapiens
FLSELTQQL

SEQ ID NO: 10306 - protein, 9 aa, Homo Sapiens
FLSEVFHQA

SEQ ID NO: 10307 - protein, 9 aa, Homo Sapiens
FLSNDTVQL

SEQ ID NO: 10308 - protein, 9 aa, Homo Sapiens
FLSSVIQNL

SEQ ID NO: 10309 - protein, 9 aa, Homo Sapiens
FLTEFINYI

SEQ ID NO: 10310 - protein, 9 aa, Homo Sapiens
FLVDGVCTV

SEQ ID NO: 10311 - protein, 9 aa, Homo Sapiens
FLVDIMEHL

SEQ ID NO: 10312 - protein, 9 aa, Homo Sapiens
FLVEHVLTL

SEQ ID NO: 10313 - protein, 9 aa, Homo Sapiens
FLVPTFEQL

SEQ ID NO: 10314 - protein, 9 aa, Homo Sapiens
FLVPVLEAL

SEQ ID NO: 10315 - protein, 9 aa, Homo Sapiens
FLVTVIHTL

SEQ ID NO: 10316 - protein, 9 aa, Homo Sapiens
FLWERPTLL

SEQ ID NO: 10317 - protein, 9 aa, Homo Sapiens
FLWKEPATM

SEQ ID NO: 10318 - protein, 9 aa, Homo Sapiens
FLYAGHIFL

SEQ ID NO: 10319 - protein, 9 aa, Homo Sapiens
FLYDDNQRV

SEQ ID NO: 10320 - protein, 9 aa, Homo Sapiens
FLYDTHQNL

SEQ ID NO: 10321 - protein, 9 aa, Homo Sapiens
FLYPFPLAL

SEQ ID NO: 10322 - protein, 9 aa, Homo Sapiens
FLYQYSTRL

SEQ ID NO: 10323 - protein, 9 aa, Homo Sapiens
FMIKFPWKL

SEQ ID NO: 10324 - protein, 9 aa, Homo Sapiens
FMLPDPQNI

SEQ ID NO: 10325 - protein, 9 aa, Homo Sapiens
FMNPHLISV

SEQ ID NO: 10326 - protein, 9 aa, Homo Sapiens
FMNSVIQSL

SEQ ID NO: 10327 - protein, 9 aa, Homo Sapiens
FMVDRVVDL

SEQ ID NO: 10328 - protein, 9 aa, Homo Sapiens
FQIRNLPSL

SEQ ID NO: 10329 - protein, 9 aa, Homo Sapiens
FQLEHIMDL

SEQ ID NO: 10330 - protein, 9 aa, Homo Sapiens
FQLPIRFNL

SEQ ID NO: 10331 - protein, 9 aa, Homo Sapiens
FQNPFRSEL

SEQ ID NO: 10332 - protein, 9 aa, Homo Sapiens
FQRPTIYYV

SEQ ID NO: 10333 - protein, 9 aa, Homo Sapiens
FQTDLIYNL

SEQ ID NO: 10334 - protein, 9 aa, Homo Sapiens
FSLENNFLL

SEQ ID NO: 10335 - protein, 9 aa, Homo Sapiens
FTLGDIAQL

SEQ ID NO: 10336 - protein, 9 aa, Homo Sapiens
FTLQDLVCL

SEQ ID NO: 10337 - protein, 9 aa, Homo Sapiens
FTLSHITQL

SEQ ID NO: 10338 - protein, 9 aa, Homo Sapiens
FTNDKIINL

SEQ ID NO: 10339 - protein, 9 aa, Homo Sapiens
FTNHFIPTL

SEQ ID NO: 10340 - protein, 9 aa, Homo Sapiens
FVDDYTVRV

SEQ ID NO: 10341 - protein, 9 aa, Homo Sapiens
FVFPGELLL

SEQ ID NO: 10342 - protein, 9 aa, Homo Sapiens
FVHDLVLYL

SEQ ID NO: 10343 - protein, 9 aa, Homo Sapiens
FVIDLQTRL

SEQ ID NO: 10344 - protein, 9 aa, Homo Sapiens
FVIPVVQAL

SEQ ID NO: 10345 - protein, 9 aa, Homo Sapiens
FVLDKVPFL

SEQ ID NO: 10346 - protein, 9 aa, Homo Sapiens
FVLPELPSV

SEQ ID NO: 10347 - protein, 9 aa, Homo Sapiens
FVLPILQKL

SEQ ID NO: 10348 - protein, 9 aa, Homo Sapiens
FVLQRLVFL

SEQ ID NO: 10349 - protein, 9 aa, Homo Sapiens
FVMEGVKNL

SEQ ID NO: 10350 - protein, 9 aa, Homo Sapiens
FVMETFVHL

SEQ ID NO: 10351 - protein, 9 aa, Homo Sapiens
FVNDIFERI

SEQ ID NO: 10352 - protein, 9 aa, Homo Sapiens
FVNEIISRI

SEQ ID NO: 10353 - protein, 9 aa, Homo Sapiens
FVNFRLYQL

SEQ ID NO: 10354 - protein, 9 aa, Homo Sapiens
GIAPQIQDL

SEQ ID NO: 10355 - protein, 9 aa, Homo Sapiens
GILLRLPQV

SEQ ID NO: 10356 - protein, 9 aa, Homo Sapiens
GILSFLPVL

SEQ ID NO: 10357 - protein, 9 aa, Homo Sapiens
GIMKKAYEL

SEQ ID NO: 10358 - protein, 9 aa, Homo Sapiens
GLAAFRAFL

SEQ ID NO: 10359 - protein, 9 aa, Homo Sapiens
GLAAKLMEL

SEQ ID NO: 10360 - protein, 9 aa, Homo Sapiens
GLAATLYSL

SEQ ID NO: 10361 - protein, 9 aa, Homo Sapiens
GLADKVYFL

SEQ ID NO: 10362 - protein, 9 aa, Homo Sapiens
GLAELYVMV

SEQ ID NO: 10363 - protein, 9 aa, Homo Sapiens
GLAERISVL

SEQ ID NO: 10364 - protein, 9 aa, Homo Sapiens
GLAKLIADV

SEQ ID NO: 10365 - protein, 9 aa, Homo Sapiens
GLAPHLEQI

SEQ ID NO: 10366 - protein, 9 aa, Homo Sapiens
GLAPKPVQV

SEQ ID NO: 10367 - protein, 9 aa, Homo Sapiens
GLAPQIHDL

SEQ ID NO: 10368 - protein, 9 aa, Homo Sapiens
GLAQTLEKL

SEQ ID NO: 10369 - protein, 9 aa, Homo Sapiens
GLATDVQTV

SEQ ID NO: 10370 - protein, 9 aa, Homo Sapiens
GLEEKLPSL

SEQ ID NO: 10371 - protein, 9 aa, Homo Sapiens
GLFAGPCKV

SEQ ID NO: 10372 - protein, 9 aa, Homo Sapiens
GLFDQHFRL

SEQ ID NO: 10373 - protein, 9 aa, Homo Sapiens
GLFPWTPKL

SEQ ID NO: 10374 - protein, 9 aa, Homo Sapiens
GLGSNIFRL

SEQ ID NO: 10375 - protein, 9 aa, Homo Sapiens
GLHGWAFTL

SEQ ID NO: 10376 - protein, 9 aa, Homo Sapiens
GLHSYFITV

SEQ ID NO: 10377 - protein, 9 aa, Homo Sapiens
GLIDEIYGI

SEQ ID NO: 10378 - protein, 9 aa, Homo Sapiens
GLIDENPGL

SEQ ID NO: 10379 - protein, 9 aa, Homo Sapiens
GLIDFAIQL

SEQ ID NO: 10380 - protein, 9 aa, Homo Sapiens
GLIDKVNEL

SEQ ID NO: 10381 - protein, 9 aa, Homo Sapiens
GLIEILKKV

SEQ ID NO: 10382 - protein, 9 aa, Homo Sapiens
GLIENPALL

SEQ ID NO: 10383 - protein, 9 aa, Homo Sapiens
GLIRYISGI

SEQ ID NO: 10384 - protein, 9 aa, Homo Sapiens
GLKDAVYFL

SEQ ID NO: 10385 - protein, 9 aa, Homo Sapiens
GLKDGVALL

SEQ ID NO: 10386 - protein, 9 aa, Homo Sapiens
GLKEGIPAL

SEQ ID NO: 10387 - protein, 9 aa, Homo Sapiens
GLKEILPNL

SEQ ID NO: 10388 - protein, 9 aa, Homo Sapiens
GLLAKIFEL

SEQ ID NO: 10389 - protein, 9 aa, Homo Sapiens
GLLDLPFRV

SEQ ID NO: 10390 - protein, 9 aa, Homo Sapiens
GLLDRIMQL

SEQ ID NO: 10391 - protein, 9 aa, Homo Sapiens
GLLEIVTSV

SEQ ID NO: 10392 - protein, 9 aa, Homo Sapiens
GLLEKLTAI

SEQ ID NO: 10393 - protein, 9 aa, Homo Sapiens
GLLERPVLL

SEQ ID NO: 10394 - protein, 9 aa, Homo Sapiens
GLLERVKEL

SEQ ID NO: 10395 - protein, 9 aa, Homo Sapiens
GLLGYLHFV

SEQ ID NO: 10396 - protein, 9 aa, Homo Sapiens
GLLKTLQKL

SEQ ID NO: 10397 - protein, 9 aa, Homo Sapiens
GLLNVLSQL

SEQ ID NO: 10398 - protein, 9 aa, Homo Sapiens
GLLPDVPSL

SEQ ID NO: 10399 - protein, 9 aa, Homo Sapiens
GLLPKLTAL

SEQ ID NO: 10400 - protein, 9 aa, Homo Sapiens
GLLQNLQHL

SEQ ID NO: 10401 - protein, 9 aa, Homo Sapiens
GLLQQPPAL

SEQ ID NO: 10402 - protein, 9 aa, Homo Sapiens
GLLQQPSAL

SEQ ID NO: 10403 - protein, 9 aa, Homo Sapiens
GLLRELRYL

SEQ ID NO: 10404 - protein, 9 aa, Homo Sapiens
GLLRIIPYL

SEQ ID NO: 10405 - protein, 9 aa, Homo Sapiens
GLLSILRKL

SEQ ID NO: 10406 - protein, 9 aa, Homo Sapiens
GLLTEIRAV

SEQ ID NO: 10407 - protein, 9 aa, Homo Sapiens
GLLTRLLQV

SEQ ID NO: 10408 - protein, 9 aa, Homo Sapiens
GLLTSLFML

SEQ ID NO: 10409 - protein, 9 aa, Homo Sapiens
GLMEDLLKL

SEQ ID NO: 10410 - protein, 9 aa, Homo Sapiens
GLMTSPLNL

SEQ ID NO: 10411 - protein, 9 aa, Homo Sapiens
GLNDFIQKI

SEQ ID NO: 10412 - protein, 9 aa, Homo Sapiens
GLNEEIARV

SEQ ID NO: 10413 - protein, 9 aa, Homo Sapiens
GLNEEITKL

SEQ ID NO: 10414 - protein, 9 aa, Homo Sapiens
GLNEFVVKF

SEQ ID NO: 10415 - protein, 9 aa, Homo Sapiens
GLPEAPPFL

SEQ ID NO: 10416 - protein, 9 aa, Homo Sapiens
GLQDLLFSL

SEQ ID NO: 10417 - protein, 9 aa, Homo Sapiens
GLQEAQYRL

SEQ ID NO: 10418 - protein, 9 aa, Homo Sapiens
GLQKMVALL

SEQ ID NO: 10419 - protein, 9 aa, Homo Sapiens
GLQNDLFSL

SEQ ID NO: 10420 - protein, 9 aa, Homo Sapiens
GLQVKIQRL

SEQ ID NO: 10421 - protein, 9 aa, Homo Sapiens
GLQVYIRQL

SEQ ID NO: 10422 - protein, 9 aa, Homo Sapiens
GLSAFLHAI

SEQ ID NO: 10423 - protein, 9 aa, Homo Sapiens
GLSDLRLEL

SEQ ID NO: 10424 - protein, 9 aa, Homo Sapiens
GLSEPIFQL

SEQ ID NO: 10425 - protein, 9 aa, Homo Sapiens
GLSEQIREL

SEQ ID NO: 10426 - protein, 9 aa, Homo Sapiens
GLSETILAV

SEQ ID NO: 10427 - protein, 9 aa, Homo Sapiens
GLSGIIPTL

SEQ ID NO: 10428 - protein, 9 aa, Homo Sapiens
GLSIFIYRL

SEQ ID NO: 10429 - protein, 9 aa, Homo Sapiens
GLSNHIAAL

SEQ ID NO: 10430 - protein, 9 aa, Homo Sapiens
GLSPEIHTL

SEQ ID NO: 10431 - protein, 9 aa, Homo Sapiens
GLSQVAVTV

SEQ ID NO: 10432 - protein, 9 aa, Homo Sapiens
GLTEALHFV

SEQ ID NO: 10433 - protein, 9 aa, Homo Sapiens
GLTPFVFRL

SEQ ID NO: 10434 - protein, 9 aa, Homo Sapiens
GLVPFLVSV

SEQ ID NO: 10435 - protein, 9 aa, Homo Sapiens
GLWEEAYRV

SEQ ID NO: 10436 - protein, 9 aa, Homo Sapiens
GLWGHALLL

SEQ ID NO: 10437 - protein, 9 aa, Homo Sapiens
GLWGPVHEL

SEQ ID NO: 10438 - protein, 9 aa, Homo Sapiens
GLYEGLTWL

SEQ ID NO: 10439 - protein, 9 aa, Homo Sapiens
GLYELVWRV

SEQ ID NO: 10440 - protein, 9 aa, Homo Sapiens
GLYGAIFRL

SEQ ID NO: 10441 - protein, 9 aa, Homo Sapiens
GLYPNLIQV

SEQ ID NO: 10442 - protein, 9 aa, Homo Sapiens
GMASVISRL

SEQ ID NO: 10443 - protein, 9 aa, Homo Sapiens
GMQIRIHQI

SEQ ID NO: 10444 - protein, 9 aa, Homo Sapiens
GMSEFLRAL

SEQ ID NO: 10445 - protein, 9 aa, Homo Sapiens
GMYIFLHTV

SEQ ID NO: 10446 - protein, 9 aa, Homo Sapiens
GMYPNLVHV

SEQ ID NO: 10447 - protein, 9 aa, Homo Sapiens
GMYVFLHAV

SEQ ID NO: 10448 - protein, 9 aa, Homo Sapiens
GQIEVVPEV

SEQ ID NO: 10449 - protein, 9 aa, Homo Sapiens
GQIGMIQAL

SEQ ID NO: 10450 - protein, 9 aa, Homo Sapiens
GSLNWGYRV

SEQ ID NO: 10451 - protein, 9 aa, Homo Sapiens
GTIGLIHAV

SEQ ID NO: 10452 - protein, 9 aa, Homo Sapiens
GVIATIAFL

SEQ ID NO: 10453 - protein, 9 aa, Homo Sapiens
GVISGLFEL

SEQ ID NO: 10454 - protein, 9 aa, Homo Sapiens
GVLENIFGV

SEQ ID NO: 10455 - protein, 9 aa, Homo Sapiens
GVLPNIQAV

SEQ ID NO: 10456 - protein, 9 aa, Homo Sapiens
GVMESVIAL

SEQ ID NO: 10457 - protein, 9 aa, Homo Sapiens
GVTAIIFCV

SEQ ID NO: 10458 - protein, 9 aa, Homo Sapiens
GVVDGIYRL

SEQ ID NO: 10459 - protein, 9 aa, Homo Sapiens
HIHLWISYI

SEQ ID NO: 10460 - protein, 9 aa, Homo Sapiens
HIIENIVAV

SEQ ID NO: 10461 - protein, 9 aa, Homo Sapiens
HILDILPRL

SEQ ID NO: 10462 - protein, 9 aa, Homo Sapiens
HLAELIAEL

SEQ ID NO: 10463 - protein, 9 aa, Homo Sapiens
HLFDAFVSV

SEQ ID NO: 10464 - protein, 9 aa, Homo Sapiens
HLFLDLPKL

SEQ ID NO: 10465 - protein, 9 aa, Homo Sapiens
HLFSTIPEL

SEQ ID NO: 10466 - protein, 9 aa, Homo Sapiens
HLGDFLVFL

SEQ ID NO: 10467 - protein, 9 aa, Homo Sapiens
HLINYIIFL

SEQ ID NO: 10468 - protein, 9 aa, Homo Sapiens
HLISTINTV

SEQ ID NO: 10469 - protein, 9 aa, Homo Sapiens
HLLDIYIQL

SEQ ID NO: 10470 - protein, 9 aa, Homo Sapiens
HLLDLLARL

SEQ ID NO: 10471 - protein, 9 aa, Homo Sapiens
HLLDQIQTL

SEQ ID NO: 10472 - protein, 9 aa, Homo Sapiens
HLLFWGVLA

SEQ ID NO: 10473 - protein, 9 aa, Homo Sapiens
HLLHEPPAL

SEQ ID NO: 10474 - protein, 9 aa, Homo Sapiens
HLLLFLQQL

SEQ ID NO: 10475 - protein, 9 aa, Homo Sapiens
HLLMELREL

SEQ ID NO: 10476 - protein, 9 aa, Homo Sapiens
HLLPDLHAL

SEQ ID NO: 10477 - protein, 9 aa, Homo Sapiens
HLLPKIENL

SEQ ID NO: 10478 - protein, 9 aa, Homo Sapiens
HLNEHLYNM

SEQ ID NO: 10479 - protein, 9 aa, Homo Sapiens
HLNMFIQNL

SEQ ID NO: 10480 - protein, 9 aa, Homo Sapiens
HLQGQLQTL

SEQ ID NO: 10481 - protein, 9 aa, Homo Sapiens
HLSDHLSEL

SEQ ID NO: 10482 - protein, 9 aa, Homo Sapiens
HLSDMLQQL

SEQ ID NO: 10483 - protein, 9 aa, Homo Sapiens
HLSIINEYL

SEQ ID NO: 10484 - protein, 9 aa, Homo Sapiens
HLSSLIAQL

SEQ ID NO: 10485 - protein, 9 aa, Homo Sapiens
HLSVVSVTV

SEQ ID NO: 10486 - protein, 9 aa, Homo Sapiens
HLTDITLKV

SEQ ID NO: 10487 - protein, 9 aa, Homo Sapiens
HLWNSIHGL

SEQ ID NO: 10488 - protein, 9 aa, Homo Sapiens
HLYDIHVTV

SEQ ID NO: 10489 - protein, 9 aa, Homo Sapiens
HVLSVIWQL

SEQ ID NO: 10490 - protein, 9 aa, Homo Sapiens
HVNPFLPYI

SEQ ID NO: 10491 - protein, 9 aa, Homo Sapiens
HVQDIVFQL

SEQ ID NO: 10492 - protein, 9 aa, Homo Sapiens
IAQEILKVV

SEQ ID NO: 10493 - protein, 9 aa, Homo Sapiens
IIAAWTVRV

SEQ ID NO: 10494 - protein, 9 aa, Homo Sapiens
IIADNIIFL

SEQ ID NO: 10495 - protein, 9 aa, Homo Sapiens
IIEENIPEL

SEQ ID NO: 10496 - protein, 9 aa, Homo Sapiens
IIFVPVPQL

SEQ ID NO: 10497 - protein, 9 aa, Homo Sapiens
IILDALPQL

SEQ ID NO: 10498 - protein, 9 aa, Homo Sapiens
IILDEIHLL

SEQ ID NO: 10499 - protein, 9 aa, Homo Sapiens
IILGKIWDL

SEQ ID NO: 10500 - protein, 9 aa, Homo Sapiens
IIMETVPQL

SEQ ID NO: 10501 - protein, 9 aa, Homo Sapiens
IIQEFLSKV

SEQ ID NO: 10502 - protein, 9 aa, Homo Sapiens
ILAAHVPTL

SEQ ID NO: 10503 - protein, 9 aa, Homo Sapiens
ILAAIVNHL

SEQ ID NO: 10504 - protein, 9 aa, Homo Sapiens
ILADLLPSL

SEQ ID NO: 10505 - protein, 9 aa, Homo Sapiens
ILAELLLRV

SEQ ID NO: 10506 - protein, 9 aa, Homo Sapiens
ILAETQPEL

SEQ ID NO: 10507 - protein, 9 aa, Homo Sapiens
ILAPTVQEL

SEQ ID NO: 10508 - protein, 9 aa, Homo Sapiens
ILAPVVKEI

SEQ ID NO: 10509 - protein, 9 aa, Homo Sapiens
ILASLLRNL

SEQ ID NO: 10510 - protein, 9 aa, Homo Sapiens
ILDEVIFKL

SEQ ID NO: 10511 - protein, 9 aa, Homo Sapiens
ILDQKINEV

SEQ ID NO: 10512 - protein, 9 aa, Homo Sapiens
ILEENIPVL

SEQ ID NO: 10513 - protein, 9 aa, Homo Sapiens
ILEPSLYTV

SEQ ID NO: 10514 - protein, 9 aa, Homo Sapiens
ILFGHENRV

SEQ ID NO: 10515 - protein, 9 aa, Homo Sapiens
ILGIQPPSV

SEQ ID NO: 10516 - protein, 9 aa, Homo Sapiens
ILGVLVPRL

SEQ ID NO: 10517 - protein, 9 aa, Homo Sapiens
ILHGLVAAV

SEQ ID NO: 10518 - protein, 9 aa, Homo Sapiens
ILHSVTTNL

SEQ ID NO: 10519 - protein, 9 aa, Homo Sapiens
ILIHDVPLL

SEQ ID NO: 10520 - protein, 9 aa, Homo Sapiens
ILIKGLAKL

SEQ ID NO: 10521 - protein, 9 aa, Homo Sapiens
ILISTLPSV

SEQ ID NO: 10522 - protein, 9 aa, Homo Sapiens
ILLAELEQL

SEQ ID NO: 10523 - protein, 9 aa, Homo Sapiens
ILLAEVPTM

SEQ ID NO: 10524 - protein, 9 aa, Homo Sapiens
ILLDRLLYL

SEQ ID NO: 10525 - protein, 9 aa, Homo Sapiens
ILLEKILSL

SEQ ID NO: 10526 - protein, 9 aa, Homo Sapiens
ILLGKVQQL

SEQ ID NO: 10527 - protein, 9 aa, Homo Sapiens
ILLGYLDQL

SEQ ID NO: 10528 - protein, 9 aa, Homo Sapiens
ILLKALTNL

SEQ ID NO: 10529 - protein, 9 aa, Homo Sapiens
ILLKDILSV

SEQ ID NO: 10530 - protein, 9 aa, Homo Sapiens
ILLNIIERL

SEQ ID NO: 10531 - protein, 9 aa, Homo Sapiens
ILLPLINQL

SEQ ID NO: 10532 - protein, 9 aa, Homo Sapiens
ILLPYVSKV

SEQ ID NO: 10533 - protein, 9 aa, Homo Sapiens
ILLSGIYNV

SEQ ID NO: 10534 - protein, 9 aa, Homo Sapiens
ILMEHIHKL

SEQ ID NO: 10535 - protein, 9 aa, Homo Sapiens
ILMEQIKLL

SEQ ID NO: 10536 - protein, 9 aa, Homo Sapiens
ILMGVLKEV

SEQ ID NO: 10537 - protein, 9 aa, Homo Sapiens
ILNDNINLL

SEQ ID NO: 10538 - protein, 9 aa, Homo Sapiens
ILNEIVNFV

SEQ ID NO: 10539 - protein, 9 aa, Homo Sapiens
ILNERVELL

SEQ ID NO: 10540 - protein, 9 aa, Homo Sapiens
ILNGIVAAL

SEQ ID NO: 10541 - protein, 9 aa, Homo Sapiens
ILNNNLNTL

SEQ ID NO: 10542 - protein, 9 aa, Homo Sapiens
ILNPEVVTV

SEQ ID NO: 10543 - protein, 9 aa, Homo Sapiens
ILNPVTTKL

SEQ ID NO: 10544 - protein, 9 aa, Homo Sapiens
ILNYVLVRV

SEQ ID NO: 10545 - protein, 9 aa, Homo Sapiens
ILQAELPSL

SEQ ID NO: 10546 - protein, 9 aa, Homo Sapiens
ILQDGRIFI

SEQ ID NO: 10547 - protein, 9 aa, Homo Sapiens
ILQDLVKNL

SEQ ID NO: 10548 - protein, 9 aa, Homo Sapiens
ILQDRLNQV

SEQ ID NO: 10549 - protein, 9 aa, Homo Sapiens
ILQKELSQL

SEQ ID NO: 10550 - protein, 9 aa, Homo Sapiens
ILQNKIDLV

SEQ ID NO: 10551 - protein, 9 aa, Homo Sapiens
ILQRVIDYI

SEQ ID NO: 10552 - protein, 9 aa, Homo Sapiens
ILQSLLETL

SEQ ID NO: 10553 - protein, 9 aa, Homo Sapiens
ILQTLIQRV

SEQ ID NO: 10554 - protein, 9 aa, Homo Sapiens
ILQVGLREL

SEQ ID NO: 10555 - protein, 9 aa, Homo Sapiens
ILRAELEAL

SEQ ID NO: 10556 - protein, 9 aa, Homo Sapiens
ILSESLHSL

SEQ ID NO: 10557 - protein, 9 aa, Homo Sapiens
ILSEVQQAV

SEQ ID NO: 10558 - protein, 9 aa, Homo Sapiens
ILSGVVTKM

SEQ ID NO: 10559 - protein, 9 aa, Homo Sapiens
ILSPNLFQL

SEQ ID NO: 10560 - protein, 9 aa, Homo Sapiens
ILSPWGAEV

SEQ ID NO: 10561 - protein, 9 aa, Homo Sapiens
ILSQYITFV

SEQ ID NO: 10562 - protein, 9 aa, Homo Sapiens
ILSVFIPSL

SEQ ID NO: 10563 - protein, 9 aa, Homo Sapiens
ILTDITKGV

SEQ ID NO: 10564 - protein, 9 aa, Homo Sapiens
ILTNVVPKM

SEQ ID NO: 10565 - protein, 9 aa, Homo Sapiens
ILVDWLVQV

SEQ ID NO: 10566 - protein, 9 aa, Homo Sapiens
ILVSWLPRL

SEQ ID NO: 10567 - protein, 9 aa, Homo Sapiens
ILWEHLEIL

SEQ ID NO: 10568 - protein, 9 aa, Homo Sapiens
ILWESASLL

SEQ ID NO: 10569 - protein, 9 aa, Homo Sapiens
ILWSEAIFL

SEQ ID NO: 10570 - protein, 9 aa, Homo Sapiens
ILYDLQQNL

SEQ ID NO: 10571 - protein, 9 aa, Homo Sapiens
ILYGEVEKL

SEQ ID NO: 10572 - protein, 9 aa, Homo Sapiens
ILYGKIIHL

SEQ ID NO: 10573 - protein, 9 aa, Homo Sapiens
IMEDIILTL

SEQ ID NO: 10574 - protein, 9 aa, Homo Sapiens
IMISVISML

SEQ ID NO: 10575 - protein, 9 aa, Homo Sapiens
IMKEVIPFL

SEQ ID NO: 10576 - protein, 9 aa, Homo Sapiens
IMLEALERV

SEQ ID NO: 10577 - protein, 9 aa, Homo Sapiens
IMTVPPPSV

SEQ ID NO: 10578 - protein, 9 aa, Homo Sapiens
IQHDLIFSL

SEQ ID NO: 10579 - protein, 9 aa, Homo Sapiens
IQIMKVEEI

SEQ ID NO: 10580 - protein, 9 aa, Homo Sapiens
IQQDKIYLL

SEQ ID NO: 10581 - protein, 9 aa, Homo Sapiens
IQVTKVTQV

SEQ ID NO: 10582 - protein, 9 aa, Homo Sapiens
IRQQELENL

SEQ ID NO: 10583 - protein, 9 aa, Homo Sapiens
ISLQHLKQL

SEQ ID NO: 10584 - protein, 9 aa, Homo Sapiens
ISNIVFTSL

SEQ ID NO: 10585 - protein, 9 aa, Homo Sapiens
ITLLWDREV

SEQ ID NO: 10586 - protein, 9 aa, Homo Sapiens
ITQERIVFL

SEQ ID NO: 10587 - protein, 9 aa, Homo Sapiens
IVAPGTFEV

SEQ ID NO: 10588 - protein, 9 aa, Homo Sapiens
IVIEVIPFL

SEQ ID NO: 10589 - protein, 9 aa, Homo Sapiens
IVIGVLHQL

SEQ ID NO: 10590 - protein, 9 aa, Homo Sapiens
IVLDRLIEL

SEQ ID NO: 10591 - protein, 9 aa, Homo Sapiens
KAMELIREL

SEQ ID NO: 10592 - protein, 9 aa, Homo Sapiens
KASPLTFTV

SEQ ID NO: 10593 - protein, 9 aa, Homo Sapiens
KGFKWGFAA

SEQ ID NO: 10594 - protein, 9 aa, Homo Sapiens
KIADFGWSV

SEQ ID NO: 10595 - protein, 9 aa, Homo Sapiens
KIAPNTPQL

SEQ ID NO: 10596 - protein, 9 aa, Homo Sapiens
KIISALPQL

SEQ ID NO: 10597 - protein, 9 aa, Homo Sapiens
KILDVLEEI

SEQ ID NO: 10598 - protein, 9 aa, Homo Sapiens
KILEDVVGV

SEQ ID NO: 10599 - protein, 9 aa, Homo Sapiens
KILETLYTL

SEQ ID NO: 10600 - protein, 9 aa, Homo Sapiens
KILGNLQQL

SEQ ID NO: 10601 - protein, 9 aa, Homo Sapiens
KILPTLEAV

SEQ ID NO: 10602 - protein, 9 aa, Homo Sapiens
KILQELPSV

SEQ ID NO: 10603 - protein, 9 aa, Homo Sapiens
KILSELFTV

SEQ ID NO: 10604 - protein, 9 aa, Homo Sapiens
KINEAIVAV

SEQ ID NO: 10605 - protein, 9 aa, Homo Sapiens
KINEWLTLV

SEQ ID NO: 10606 - protein, 9 aa, Homo Sapiens
KIQAKIPGL

SEQ ID NO: 10607 - protein, 9 aa, Homo Sapiens
KITSCIFQL

SEQ ID NO: 10608 - protein, 9 aa, Homo Sapiens
KIVDFSYSV

SEQ ID NO: 10609 - protein, 9 aa, Homo Sapiens
KIYQWINEL

SEQ ID NO: 10610 - protein, 9 aa, Homo Sapiens
KLAAVVNNL

SEQ ID NO: 10611 - protein, 9 aa, Homo Sapiens
KLAEFIDFL

SEQ ID NO: 10612 - protein, 9 aa, Homo Sapiens
KLAEGVQLL

SEQ ID NO: 10613 - protein, 9 aa, Homo Sapiens
KLFDTQQFL

SEQ ID NO: 10614 - protein, 9 aa, Homo Sapiens
KLFGMIITI

SEQ ID NO: 10615 - protein, 9 aa, Homo Sapiens
KLFIGGLNV

SEQ ID NO: 10616 - protein, 9 aa, Homo Sapiens
KLFVALGPI

SEQ ID NO: 10617 - protein, 9 aa, Homo Sapiens
KLIEELETL

SEQ ID NO: 10618 - protein, 9 aa, Homo Sapiens
KLILLITQV

SEQ ID NO: 10619 - protein, 9 aa, Homo Sapiens
KLIPFLEKL

SEQ ID NO: 10620 - protein, 9 aa, Homo Sapiens
KLIPGLNNL

SEQ ID NO: 10621 - protein, 9 aa, Homo Sapiens
KLIPQLPTL

SEQ ID NO: 10622 - protein, 9 aa, Homo Sapiens
KLIQNVFEI

SEQ ID NO: 10623 - protein, 9 aa, Homo Sapiens
KLISELQKL

SEQ ID NO: 10624 - protein, 9 aa, Homo Sapiens
KLLAVIHEL

SEQ ID NO: 10625 - protein, 9 aa, Homo Sapiens
KLLDILSYL

SEQ ID NO: 10626 - protein, 9 aa, Homo Sapiens
KLLDLIEDL

SEQ ID NO: 10627 - protein, 9 aa, Homo Sapiens
KLLDLMPRL

SEQ ID NO: 10628 - protein, 9 aa, Homo Sapiens
KLLEAISSL

SEQ ID NO: 10629 - protein, 9 aa, Homo Sapiens
KLLEEICNL

SEQ ID NO: 10630 - protein, 9 aa, Homo Sapiens
KLLEEIEFL

SEQ ID NO: 10631 - protein, 9 aa, Homo Sapiens
KLLEPVLLL

SEQ ID NO: 10632 - protein, 9 aa, Homo Sapiens
KLLEYIEEI

SEQ ID NO: 10633 - protein, 9 aa, Homo Sapiens
KLLFWVTEV

SEQ ID NO: 10634 - protein, 9 aa, Homo Sapiens
KLLGELHTL

SEQ ID NO: 10635 - protein, 9 aa, Homo Sapiens
KLLKDLPEL

SEQ ID NO: 10636 - protein, 9 aa, Homo Sapiens
KLLKQVDFL

SEQ ID NO: 10637 - protein, 9 aa, Homo Sapiens
KLLNAINTL

SEQ ID NO: 10638 - protein, 9 aa, Homo Sapiens
KLLNLISKL

SEQ ID NO: 10639 - protein, 9 aa, Homo Sapiens
KLLPGIEVL

SEQ ID NO: 10640 - protein, 9 aa, Homo Sapiens
KLLPQLTYL

SEQ ID NO: 10641 - protein, 9 aa, Homo Sapiens
KLLPSVTEL

SEQ ID NO: 10642 - protein, 9 aa, Homo Sapiens
KLLSEIEFL

SEQ ID NO: 10643 - protein, 9 aa, Homo Sapiens
KLMELLEEI

SEQ ID NO: 10644 - protein, 9 aa, Homo Sapiens
KLNAKLAEL

SEQ ID NO: 10645 - protein, 9 aa, Homo Sapiens
KLNDLIQRL

SEQ ID NO: 10646 - protein, 9 aa, Homo Sapiens
KLNFIVTGL

SEQ ID NO: 10647 - protein, 9 aa, Homo Sapiens
KLNPGIAYV

SEQ ID NO: 10648 - protein, 9 aa, Homo Sapiens
KLNPQQFEV

SEQ ID NO: 10649 - protein, 9 aa, Homo Sapiens
KLQDQIFNL

SEQ ID NO: 10650 - protein, 9 aa, Homo Sapiens
KLQEFLQTL

SEQ ID NO: 10651 - protein, 9 aa, Homo Sapiens
KLQELNYNL

SEQ ID NO: 10652 - protein, 9 aa, Homo Sapiens
KLQEQIFHL

SEQ ID NO: 10653 - protein, 9 aa, Homo Sapiens
KLQEVLDYL

SEQ ID NO: 10654 - protein, 9 aa, Homo Sapiens
KLQNILSQL

SEQ ID NO: 10655 - protein, 9 aa, Homo Sapiens
KLQQELEFL

SEQ ID NO: 10656 - protein, 9 aa, Homo Sapiens
KLQQLFIQL

SEQ ID NO: 10657 - protein, 9 aa, Homo Sapiens
KLREDLERL

SEQ ID NO: 10658 - protein, 9 aa, Homo Sapiens
KLSDLQTQL

SEQ ID NO: 10659 - protein, 9 aa, Homo Sapiens
KLSQYLIQL

SEQ ID NO: 10660 - protein, 9 aa, Homo Sapiens
KLTAFVNTL

SEQ ID NO: 10661 - protein, 9 aa, Homo Sapiens
KLVDCIIEV

SEQ ID NO: 10662 - protein, 9 aa, Homo Sapiens
KLVELPYTV

SEQ ID NO: 10663 - protein, 9 aa, Homo Sapiens
KLWSETFDV

SEQ ID NO: 10664 - protein, 9 aa, Homo Sapiens
KLYPWIHQF

SEQ ID NO: 10665 - protein, 9 aa, Homo Sapiens
KMAEMLVEL

SEQ ID NO: 10666 - protein, 9 aa, Homo Sapiens
KMQETLVGL

SEQ ID NO: 10667 - protein, 9 aa, Homo Sapiens
KMSEKILLL

SEQ ID NO: 10668 - protein, 9 aa, Homo Sapiens
KMWEEAISL

SEQ ID NO: 10669 - protein, 9 aa, Homo Sapiens
KQVEEIFNL

SEQ ID NO: 10670 - protein, 9 aa, Homo Sapiens
KSLDWQIDV

SEQ ID NO: 10671 - protein, 9 aa, Homo Sapiens
KTIDYIQFL

SEQ ID NO: 10672 - protein, 9 aa, Homo Sapiens
KTLGKLWRL

SEQ ID NO: 10673 - protein, 9 aa, Homo Sapiens
KVADLVLML

SEQ ID NO: 10674 - protein, 9 aa, Homo Sapiens
KVLDLKINL

SEQ ID NO: 10675 - protein, 9 aa, Homo Sapiens
KVPEWVDTV

SEQ ID NO: 10676 - protein, 9 aa, Homo Sapiens
KVQEQIFNL

SEQ ID NO: 10677 - protein, 9 aa, Homo Sapiens
KVQEVIFGL

SEQ ID NO: 10678 - protein, 9 aa, Homo Sapiens
LARVILSKI

SEQ ID NO: 10679 - protein, 9 aa, Homo Sapiens
LEAILLQEL

SEQ ID NO: 10680 - protein, 9 aa, Homo Sapiens
LENLIKGRK

SEQ ID NO: 10681 - protein, 9 aa, Homo Sapiens
LGDLKLPEI

SEQ ID NO: 10682 - protein, 9 aa, Homo Sapiens
LGLYRSIFR

SEQ ID NO: 10683 - protein, 9 aa, Homo Sapiens
LIGSLIPTI

SEQ ID NO: 10684 - protein, 9 aa, Homo Sapiens
LILDEVHLL

SEQ ID NO: 10685 - protein, 9 aa, Homo Sapiens
LILPVLPRL

SEQ ID NO: 10686 - protein, 9 aa, Homo Sapiens
LIMELINNV

SEQ ID NO: 10687 - protein, 9 aa, Homo Sapiens
LINELLQVT

SEQ ID NO: 10688 - protein, 9 aa, Homo Sapiens
LINPNIATV

SEQ ID NO: 10689 - protein, 9 aa, Homo Sapiens
LINVPPPFL

SEQ ID NO: 10690 - protein, 9 aa, Homo Sapiens
LIQELIHNL

SEQ ID NO: 10691 - protein, 9 aa, Homo Sapiens
LISKIFPGL

SEQ ID NO: 10692 - protein, 9 aa, Homo Sapiens
LLAAWTARA

SEQ ID NO: 10693 - protein, 9 aa, Homo Sapiens
LLAEKIYKI

SEQ ID NO: 10694 - protein, 9 aa, Homo Sapiens
LLAEKVEQL

SEQ ID NO: 10695 - protein, 9 aa, Homo Sapiens
LLAELLTHL

SEQ ID NO: 10696 - protein, 9 aa, Homo Sapiens
LLAENLPGL

SEQ ID NO: 10697 - protein, 9 aa, Homo Sapiens
LLAEPVPGI

SEQ ID NO: 10698 - protein, 9 aa, Homo Sapiens
LLAETHYQL

SEQ ID NO: 10699 - protein, 9 aa, Homo Sapiens
LLAEVIENL

SEQ ID NO: 10700 - protein, 9 aa, Homo Sapiens
LLAPIVFVL

SEQ ID NO: 10701 - protein, 9 aa, Homo Sapiens
LLASEVPQL

SEQ ID NO: 10702 - protein, 9 aa, Homo Sapiens
LLATEIERL

SEQ ID NO: 10703 - protein, 9 aa, Homo Sapiens
LLATVLQAV

SEQ ID NO: 10704 - protein, 9 aa, Homo Sapiens
LLDVTPLSL

SEQ ID NO: 10705 - protein, 9 aa, Homo Sapiens
LLEESIANL

SEQ ID NO: 10706 - protein, 9 aa, Homo Sapiens
LLELENVPI

SEQ ID NO: 10707 - protein, 9 aa, Homo Sapiens
LLEPEVFHL

SEQ ID NO: 10708 - protein, 9 aa, Homo Sapiens
LLFDRPMHV

SEQ ID NO: 10709 - protein, 9 aa, Homo Sapiens
LLFLQLPLL

SEQ ID NO: 10710 - protein, 9 aa, Homo Sapiens
LLFSFAQAV

SEQ ID NO: 10711 - protein, 9 aa, Homo Sapiens
LLFTWEELI

SEQ ID NO: 10712 - protein, 9 aa, Homo Sapiens
LLGDLLFHI

SEQ ID NO: 10713 - protein, 9 aa, Homo Sapiens
LLGPPPVGV

SEQ ID NO: 10714 - protein, 9 aa, Homo Sapiens
LLHDGIPVV

SEQ ID NO: 10715 - protein, 9 aa, Homo Sapiens
LLIDELNKL

SEQ ID NO: 10716 - protein, 9 aa, Homo Sapiens
LLIERILLL

SEQ ID NO: 10717 - protein, 9 aa, Homo Sapiens
LLIGHLERV

SEQ ID NO: 10718 - protein, 9 aa, Homo Sapiens
LLINQLWQL

SEQ ID NO: 10719 - protein, 9 aa, Homo Sapiens
LLKDSIVQL

SEQ ID NO: 10720 - protein, 9 aa, Homo Sapiens
LLLAAPAQA

SEQ ID NO: 10721 - protein, 9 aa, Homo Sapiens
LLLAHIIAL

SEQ ID NO: 10722 - protein, 9 aa, Homo Sapiens
LLLDILEKL

SEQ ID NO: 10723 - protein, 9 aa, Homo Sapiens
LLLDIMPGL

SEQ ID NO: 10724 - protein, 9 aa, Homo Sapiens
LLLDMQNRL

SEQ ID NO: 10725 - protein, 9 aa, Homo Sapiens
LLLEAVWHL

SEQ ID NO: 10726 - protein, 9 aa, Homo Sapiens
LLLEILHEI

SEQ ID NO: 10727 - protein, 9 aa, Homo Sapiens
LLLNELPSV

SEQ ID NO: 10728 - protein, 9 aa, Homo Sapiens
LLLSLLPAL

SEQ ID NO: 10729 - protein, 9 aa, Homo Sapiens
LLLSVLPQL

SEQ ID NO: 10730 - protein, 9 aa, Homo Sapiens
LLLTLLPQL

SEQ ID NO: 10731 - protein, 9 aa, Homo Sapiens
LLLVGIHLL

SEQ ID NO: 10732 - protein, 9 aa, Homo Sapiens
LLMEHIQEI

SEQ ID NO: 10733 - protein, 9 aa, Homo Sapiens
LLMPSPSHL

SEQ ID NO: 10734 - protein, 9 aa, Homo Sapiens
LLMRLLQQL

SEQ ID NO: 10735 - protein, 9 aa, Homo Sapiens
LLNDRIWLA

SEQ ID NO: 10736 - protein, 9 aa, Homo Sapiens
LLNEILEQV

SEQ ID NO: 10737 - protein, 9 aa, Homo Sapiens
LLNKAPEYL

SEQ ID NO: 10738 - protein, 9 aa, Homo Sapiens
LLNKSIIRV

SEQ ID NO: 10739 - protein, 9 aa, Homo Sapiens
LLNPHLRQL

SEQ ID NO: 10740 - protein, 9 aa, Homo Sapiens
LLNPSLQKV

SEQ ID NO: 10741 - protein, 9 aa, Homo Sapiens
LLNQAPDML

SEQ ID NO: 10742 - protein, 9 aa, Homo Sapiens
LLNSEVHML

SEQ ID NO: 10743 - protein, 9 aa, Homo Sapiens
LLNSGVVHL

SEQ ID NO: 10744 - protein, 9 aa, Homo Sapiens
LLPDNVHYV

SEQ ID NO: 10745 - protein, 9 aa, Homo Sapiens
LLPESIPFL

SEQ ID NO: 10746 - protein, 9 aa, Homo Sapiens
LLPLKLLQL

SEQ ID NO: 10747 - protein, 9 aa, Homo Sapiens
LLPPPPCPA

SEQ ID NO: 10748 - protein, 9 aa, Homo Sapiens
LLQAFISQL

SEQ ID NO: 10749 - protein, 9 aa, Homo Sapiens
LLQAQIQRL

SEQ ID NO: 10750 - protein, 9 aa, Homo Sapiens
LLQDFSRNL

SEQ ID NO: 10751 - protein, 9 aa, Homo Sapiens
LLQDHPWLL

SEQ ID NO: 10752 - protein, 9 aa, Homo Sapiens
LLQDIILQV

SEQ ID NO: 10753 - protein, 9 aa, Homo Sapiens
LLQKVISNL

SEQ ID NO: 10754 - protein, 9 aa, Homo Sapiens
LLQLDVPLL

SEQ ID NO: 10755 - protein, 9 aa, Homo Sapiens
LLQMGLHVL

SEQ ID NO: 10756 - protein, 9 aa, Homo Sapiens
LLQNNLPAV

SEQ ID NO: 10757 - protein, 9 aa, Homo Sapiens
LLQRIIVEL

SEQ ID NO: 10758 - protein, 9 aa, Homo Sapiens
LLQVVLPAL

SEQ ID NO: 10759 - protein, 9 aa, Homo Sapiens
LLRDAIEKL

SEQ ID NO: 10760 - protein, 9 aa, Homo Sapiens
LLRDTINGL

SEQ ID NO: 10761 - protein, 9 aa, Homo Sapiens
LLREELQLL

SEQ ID NO: 10762 - protein, 9 aa, Homo Sapiens
LLREKVEFL

SEQ ID NO: 10763 - protein, 9 aa, Homo Sapiens
LLREQVAQL

SEQ ID NO: 10764 - protein, 9 aa, Homo Sapiens
LLRLQVEEL

SEQ ID NO: 10765 - protein, 9 aa, Homo Sapiens
LLSDVRFVL

SEQ ID NO: 10766 - protein, 9 aa, Homo Sapiens
LLSDYGYHL

SEQ ID NO: 10767 - protein, 9 aa, Homo Sapiens
LLSEHVIAI

SEQ ID NO: 10768 - protein, 9 aa, Homo Sapiens
LLSEILHLL

SEQ ID NO: 10769 - protein, 9 aa, Homo Sapiens
LLSELLEHL

SEQ ID NO: 10770 - protein, 9 aa, Homo Sapiens
LLSHVIVAL

SEQ ID NO: 10771 - protein, 9 aa, Homo Sapiens
LLSPHNPAL

SEQ ID NO: 10772 - protein, 9 aa, Homo Sapiens
LLSPVVPQI

SEQ ID NO: 10773 - protein, 9 aa, Homo Sapiens
LLSQSVHYL

SEQ ID NO: 10774 - protein, 9 aa, Homo Sapiens
LLSRVLFAL

SEQ ID NO: 10775 - protein, 9 aa, Homo Sapiens
LLTEIRAVV

SEQ ID NO: 10776 - protein, 9 aa, Homo Sapiens
LLTEQIHSL

SEQ ID NO: 10777 - protein, 9 aa, Homo Sapiens
LLTNVLETL

SEQ ID NO: 10778 - protein, 9 aa, Homo Sapiens
LLVEEIHRL

SEQ ID NO: 10779 - protein, 9 aa, Homo Sapiens
LLVGFVHYL

SEQ ID NO: 10780 - protein, 9 aa, Homo Sapiens
LLVSLLEHL

SEQ ID NO: 10781 - protein, 9 aa, Homo Sapiens
LLWDYVYQL

SEQ ID NO: 10782 - protein, 9 aa, Homo Sapiens
LLWGNLPEI

SEQ ID NO: 10783 - protein, 9 aa, Homo Sapiens
LLWWLQPRL

SEQ ID NO: 10784 - protein, 9 aa, Homo Sapiens
LMKQYIEFV

SEQ ID NO: 10785 - protein, 9 aa, Homo Sapiens
LMMDPLTGL

SEQ ID NO: 10786 - protein, 9 aa, Homo Sapiens
LMNAVVQTV

SEQ ID NO: 10787 - protein, 9 aa, Homo Sapiens
LMNPMVPGL

SEQ ID NO: 10788 - protein, 9 aa, Homo Sapiens
LMVDHVTEV

SEQ ID NO: 10789 - protein, 9 aa, Homo Sapiens
LMYPYIFHV

SEQ ID NO: 10790 - protein, 9 aa, Homo Sapiens
LQALLPEPL

SEQ ID NO: 10791 - protein, 9 aa, Homo Sapiens
LQKIIQFVE

SEQ ID NO: 10792 - protein, 9 aa, Homo Sapiens
LQLHEIPSL

SEQ ID NO: 10793 - protein, 9 aa, Homo Sapiens
LQLPGLWSV

SEQ ID NO: 10794 - protein, 9 aa, Homo Sapiens
LQNPIIVQL

SEQ ID NO: 10795 - protein, 9 aa, Homo Sapiens
LQVEEVHQL

SEQ ID NO: 10796 - protein, 9 aa, Homo Sapiens
LQWDKVLRL

SEQ ID NO: 10797 - protein, 9 aa, Homo Sapiens
LRINAIYEV

SEQ ID NO: 10798 - protein, 9 aa, Homo Sapiens
LRLLHIEEL

SEQ ID NO: 10799 - protein, 9 aa, Homo Sapiens
LSFSWLFHT

SEQ ID NO: 10800 - protein, 9 aa, Homo Sapiens
LSIKDILEP

SEQ ID NO: 10801 - protein, 9 aa, Homo Sapiens
LSLENLEKI

SEQ ID NO: 10802 - protein, 9 aa, Homo Sapiens
LSLGALVAL

SEQ ID NO: 10803 - protein, 9 aa, Homo Sapiens
LSLPYLQTK

SEQ ID NO: 10804 - protein, 9 aa, Homo Sapiens
LSNHAVAAL

SEQ ID NO: 10805 - protein, 9 aa, Homo Sapiens
LTAEEIFSL

SEQ ID NO: 10806 - protein, 9 aa, Homo Sapiens
LTMEVIRQV

SEQ ID NO: 10807 - protein, 9 aa, Homo Sapiens
LTMPDTPRL

SEQ ID NO: 10808 - protein, 9 aa, Homo Sapiens
LTNDWEDHL

SEQ ID NO: 10809 - protein, 9 aa, Homo Sapiens
LTQEQLHQL

SEQ ID NO: 10810 - protein, 9 aa, Homo Sapiens
LVELALPQL

SEQ ID NO: 10811 - protein, 9 aa, Homo Sapiens
LVLDKLFQL

SEQ ID NO: 10812 - protein, 9 aa, Homo Sapiens
LVLESLLHL

SEQ ID NO: 10813 - protein, 9 aa, Homo Sapiens
LVLRALDTL

SEQ ID NO: 10814 - protein, 9 aa, Homo Sapiens
LVVDWLESI

SEQ ID NO: 10815 - protein, 9 aa, Homo Sapiens
MLAEKLPNL

SEQ ID NO: 10816 - protein, 9 aa, Homo Sapiens
MLANDIARL

SEQ ID NO: 10817 - protein, 9 aa, Homo Sapiens
MLAQLLAEL

SEQ ID NO: 10818 - protein, 9 aa, Homo Sapiens
MLATRVFSL

SEQ ID NO: 10819 - protein, 9 aa, Homo Sapiens
MLFDYKDQL

SEQ ID NO: 10820 - protein, 9 aa, Homo Sapiens
MLHSVTLFL

SEQ ID NO: 10821 - protein, 9 aa, Homo Sapiens
MLIEVIEKL

SEQ ID NO: 10822 - protein, 9 aa, Homo Sapiens
MLIGEIFEL

SEQ ID NO: 10823 - protein, 9 aa, Homo Sapiens
MLLDFIQHI

SEQ ID NO: 10824 - protein, 9 aa, Homo Sapiens
MLLEGLREL

SEQ ID NO: 10825 - protein, 9 aa, Homo Sapiens
MLLSKINSL

SEQ ID NO: 10826 - protein, 9 aa, Homo Sapiens
MLLSSLVSL

SEQ ID NO: 10827 - protein, 9 aa, Homo Sapiens
MLLSVPLLL

SEQ ID NO: 10828 - protein, 9 aa, Homo Sapiens
MLLTKLPTI

SEQ ID NO: 10829 - protein, 9 aa, Homo Sapiens
MLQFYIPEV

SEQ ID NO: 10830 - protein, 9 aa, Homo Sapiens
MLSPFISSV

SEQ ID NO: 10831 - protein, 9 aa, Homo Sapiens
MMLDDLLQL

SEQ ID NO: 10832 - protein, 9 aa, Homo Sapiens
MMMALLVPL

SEQ ID NO: 10833 - protein, 9 aa, Homo Sapiens
MQISFIHQL

SEQ ID NO: 10834 - protein, 9 aa, Homo Sapiens
MTLPNLPRL

SEQ ID NO: 10835 - protein, 9 aa, Homo Sapiens
MVLPVIYEL

SEQ ID NO: 10836 - protein, 9 aa, Homo Sapiens
NIFRWETTI

SEQ ID NO: 10837 - protein, 9 aa, Homo Sapiens
NILELLHRL

SEQ ID NO: 10838 - protein, 9 aa, Homo Sapiens
NILQLGSKL

SEQ ID NO: 10839 - protein, 9 aa, Homo Sapiens
NIVEKLREV

SEQ ID NO: 10840 - protein, 9 aa, Homo Sapiens
NLAAYVPLL

SEQ ID NO: 10841 - protein, 9 aa, Homo Sapiens
NLANVVLLL

SEQ ID NO: 10842 - protein, 9 aa, Homo Sapiens
NLAPVILQL

SEQ ID NO: 10843 - protein, 9 aa, Homo Sapiens
NLASFIEQV

SEQ ID NO: 10844 - protein, 9 aa, Homo Sapiens
NLFEWHFTV

SEQ ID NO: 10845 - protein, 9 aa, Homo Sapiens
NLFHYLTEV

SEQ ID NO: 10846 - protein, 9 aa, Homo Sapiens
NLFKWVGTI

SEQ ID NO: 10847 - protein, 9 aa, Homo Sapiens
NLHHWIDLI

SEQ ID NO: 10848 - protein, 9 aa, Homo Sapiens
NLIGKIEKL

SEQ ID NO: 10849 - protein, 9 aa, Homo Sapiens
NLINNIFEL

SEQ ID NO: 10850 - protein, 9 aa, Homo Sapiens
NLIRWSDQV

SEQ ID NO: 10851 - protein, 9 aa, Homo Sapiens
NLLEEVFHL

SEQ ID NO: 10852 - protein, 9 aa, Homo Sapiens
NLLESLSGL

SEQ ID NO: 10853 - protein, 9 aa, Homo Sapiens
NLLGMIFSM

SEQ ID NO: 10854 - protein, 9 aa, Homo Sapiens
NLLKLIAEV

SEQ ID NO: 10855 - protein, 9 aa, Homo Sapiens
NLLPKLHIV

SEQ ID NO: 10856 - protein, 9 aa, Homo Sapiens
NLLSNIQKL

SEQ ID NO: 10857 - protein, 9 aa, Homo Sapiens
NLLTHVESL

SEQ ID NO: 10858 - protein, 9 aa, Homo Sapiens
NLNEKINHL

SEQ ID NO: 10859 - protein, 9 aa, Homo Sapiens
NLNQFLPEL

SEQ ID NO: 10860 - protein, 9 aa, Homo Sapiens
NLNSIVPSV

SEQ ID NO: 10861 - protein, 9 aa, Homo Sapiens
NLQAVINEV

SEQ ID NO: 10862 - protein, 9 aa, Homo Sapiens
NLSNFLIHL

SEQ ID NO: 10863 - protein, 9 aa, Homo Sapiens
NLYPFVKTV

SEQ ID NO: 10864 - protein, 9 aa, Homo Sapiens
NMVDIIHSV

SEQ ID NO: 10865 - protein, 9 aa, Homo Sapiens
NQNPEVFFL

SEQ ID NO: 10866 - protein, 9 aa, Homo Sapiens
NVFDWGAKA

SEQ ID NO: 10867 - protein, 9 aa, Homo Sapiens
NVQVVIPFL

SEQ ID NO: 10868 - protein, 9 aa, Homo Sapiens
PIRLLAAAA

SEQ ID NO: 10869 - protein, 9 aa, Homo Sapiens
PLSKPLPEL

SEQ ID NO: 10870 - protein, 9 aa, Homo Sapiens
QILDGIHYL

SEQ ID NO: 10871 - protein, 9 aa, Homo Sapiens
QILDGVHYL

SEQ ID NO: 10872 - protein, 9 aa, Homo Sapiens
QILEGVHFL

SEQ ID NO: 10873 - protein, 9 aa, Homo Sapiens
QILFWIQEI

SEQ ID NO: 10874 - protein, 9 aa, Homo Sapiens
QILPTLVRL

SEQ ID NO: 10875 - protein, 9 aa, Homo Sapiens
QIMDYLLCL

SEQ ID NO: 10876 - protein, 9 aa, Homo Sapiens
QLAQFVHEV

SEQ ID NO: 10877 - protein, 9 aa, Homo Sapiens
QLFDQIPEL

SEQ ID NO: 10878 - protein, 9 aa, Homo Sapiens
QLFEDLVYL

SEQ ID NO: 10879 - protein, 9 aa, Homo Sapiens
QLIDKVWQL

SEQ ID NO: 10880 - protein, 9 aa, Homo Sapiens
QLIHEISNL

SEQ ID NO: 10881 - protein, 9 aa, Homo Sapiens
QLIPKLIFL

SEQ ID NO: 10882 - protein, 9 aa, Homo Sapiens
QLIPNVQQL

SEQ ID NO: 10883 - protein, 9 aa, Homo Sapiens
QLITDIPLL

SEQ ID NO: 10884 - protein, 9 aa, Homo Sapiens
QLLANLARL

SEQ ID NO: 10885 - protein, 9 aa, Homo Sapiens
QLLDLMHTL

SEQ ID NO: 10886 - protein, 9 aa, Homo Sapiens
QLLDQIWRT

SEQ ID NO: 10887 - protein, 9 aa, Homo Sapiens
QLLDTIRSL

SEQ ID NO: 10888 - protein, 9 aa, Homo Sapiens
QLLDVLARL

SEQ ID NO: 10889 - protein, 9 aa, Homo Sapiens
QLLEALVAL

SEQ ID NO: 10890 - protein, 9 aa, Homo Sapiens
QLLEFLDRL

SEQ ID NO: 10891 - protein, 9 aa, Homo Sapiens
QLLEKVIEL

SEQ ID NO: 10892 - protein, 9 aa, Homo Sapiens
QLLEKVPTL

SEQ ID NO: 10893 - protein, 9 aa, Homo Sapiens
QLLETLNQL

SEQ ID NO: 10894 - protein, 9 aa, Homo Sapiens
QLLFSLPKL

SEQ ID NO: 10895 - protein, 9 aa, Homo Sapiens
QLLIWIPRL

SEQ ID NO: 10896 - protein, 9 aa, Homo Sapiens
QLLLEPPKL

SEQ ID NO: 10897 - protein, 9 aa, Homo Sapiens
QLLPLIVNL

SEQ ID NO: 10898 - protein, 9 aa, Homo Sapiens
QLLPLLEKV

SEQ ID NO: 10899 - protein, 9 aa, Homo Sapiens
QLLPSIPQL

SEQ ID NO: 10900 - protein, 9 aa, Homo Sapiens
QLLQILQSL

SEQ ID NO: 10901 - protein, 9 aa, Homo Sapiens
QLLQYVYNL

SEQ ID NO: 10902 - protein, 9 aa, Homo Sapiens
QLLRKIQLL

SEQ ID NO: 10903 - protein, 9 aa, Homo Sapiens
QLLSEITRV

SEQ ID NO: 10904 - protein, 9 aa, Homo Sapiens
QLLSYIDRL

SEQ ID NO: 10905 - protein, 9 aa, Homo Sapiens
QLLTAIVKL

SEQ ID NO: 10906 - protein, 9 aa, Homo Sapiens
QLLTQIHLL

SEQ ID NO: 10907 - protein, 9 aa, Homo Sapiens
QLMEQVAQL

SEQ ID NO: 10908 - protein, 9 aa, Homo Sapiens
QLMNLIRSV

SEQ ID NO: 10909 - protein, 9 aa, Homo Sapiens
QLNEKVAQL

SEQ ID NO: 10910 - protein, 9 aa, Homo Sapiens
QLNELQAQL

SEQ ID NO: 10911 - protein, 9 aa, Homo Sapiens
QLNEQLVTL

SEQ ID NO: 10912 - protein, 9 aa, Homo Sapiens
QLNVVIHQL

SEQ ID NO: 10913 - protein, 9 aa, Homo Sapiens
QLPNFAFSV

SEQ ID NO: 10914 - protein, 9 aa, Homo Sapiens
QLQDIVYKL

SEQ ID NO: 10915 - protein, 9 aa, Homo Sapiens
QLQDTLIHL

SEQ ID NO: 10916 - protein, 9 aa, Homo Sapiens
QLQDYIQLL

SEQ ID NO: 10917 - protein, 9 aa, Homo Sapiens
QLQEIIARL

SEQ ID NO: 10918 - protein, 9 aa, Homo Sapiens
QLQGYLRSV

SEQ ID NO: 10919 - protein, 9 aa, Homo Sapiens
QLQNWFTIV

SEQ ID NO: 10920 - protein, 9 aa, Homo Sapiens
QLRDFYFSV

SEQ ID NO: 10921 - protein, 9 aa, Homo Sapiens
QLRNVIERL

SEQ ID NO: 10922 - protein, 9 aa, Homo Sapiens
QLSEVFIQL

SEQ ID NO: 10923 - protein, 9 aa, Homo Sapiens
QLSPVLLYL

SEQ ID NO: 10924 - protein, 9 aa, Homo Sapiens
QLTNVILHL

SEQ ID NO: 10925 - protein, 9 aa, Homo Sapiens
QLVDIIEKV

SEQ ID NO: 10926 - protein, 9 aa, Homo Sapiens
QMISRIEYI

SEQ ID NO: 10927 - protein, 9 aa, Homo Sapiens
QMLELITRL

SEQ ID NO: 10928 - protein, 9 aa, Homo Sapiens
QMREFLEQL

SEQ ID NO: 10929 - protein, 9 aa, Homo Sapiens
QQVQRLPFL

SEQ ID NO: 10930 - protein, 9 aa, Homo Sapiens
QQYQWLEKV

SEQ ID NO: 10931 - protein, 9 aa, Homo Sapiens
RAHEWMFPV

SEQ ID NO: 10932 - protein, 9 aa, Homo Sapiens
RFTEWLHEV

SEQ ID NO: 10933 - protein, 9 aa, Homo Sapiens
RIAEFTTNL

SEQ ID NO: 10934 - protein, 9 aa, Homo Sapiens
RIAEYAFKL

SEQ ID NO: 10935 - protein, 9 aa, Homo Sapiens
RIIDVVYNA

SEQ ID NO: 10936 - protein, 9 aa, Homo Sapiens
RILDILEYI

SEQ ID NO: 10937 - protein, 9 aa, Homo Sapiens
RILDYVINL

SEQ ID NO: 10938 - protein, 9 aa, Homo Sapiens
RIQEELSAL

SEQ ID NO: 10939 - protein, 9 aa, Homo Sapiens
RIQEIIEQL

SEQ ID NO: 10940 - protein, 9 aa, Homo Sapiens
RISDVHFSV

SEQ ID NO: 10941 - protein, 9 aa, Homo Sapiens
RLAEQIATL

SEQ ID NO: 10942 - protein, 9 aa, Homo Sapiens
RLAHYIDRV

SEQ ID NO: 10943 - protein, 9 aa, Homo Sapiens
RLALVISEL

SEQ ID NO: 10944 - protein, 9 aa, Homo Sapiens
RLAPAQWFL

SEQ ID NO: 10945 - protein, 9 aa, Homo Sapiens
RLAPTLSQL

SEQ ID NO: 10946 - protein, 9 aa, Homo Sapiens
RLAQHITYV

SEQ ID NO: 10947 - protein, 9 aa, Homo Sapiens
RLAVYIDRV

SEQ ID NO: 10948 - protein, 9 aa, Homo Sapiens
RLELELLRQ

SEQ ID NO: 10949 - protein, 9 aa, Homo Sapiens
RLFAVLEQL

SEQ ID NO: 10950 - protein, 9 aa, Homo Sapiens
RLFDDVPQV

SEQ ID NO: 10951 - protein, 9 aa, Homo Sapiens
RLFDWLVSV

SEQ ID NO: 10952 - protein, 9 aa, Homo Sapiens
RLFENLRML

SEQ ID NO: 10953 - protein, 9 aa, Homo Sapiens
RLFESINNL

SEQ ID NO: 10954 - protein, 9 aa, Homo Sapiens
RLFEVPHEL

SEQ ID NO: 10955 - protein, 9 aa, Homo Sapiens
RLFSKGFLV

SEQ ID NO: 10956 - protein, 9 aa, Homo Sapiens
RLGCFNLTV

SEQ ID NO: 10957 - protein, 9 aa, Homo Sapiens
RLGPVPPGL

SEQ ID NO: 10958 - protein, 9 aa, Homo Sapiens
RLIEESVTV

SEQ ID NO: 10959 - protein, 9 aa, Homo Sapiens
RLIESLFTI

SEQ ID NO: 10960 - protein, 9 aa, Homo Sapiens
RLINQVLEL

SEQ ID NO: 10961 - protein, 9 aa, Homo Sapiens
RLLATIVML

SEQ ID NO: 10962 - protein, 9 aa, Homo Sapiens
RLLAYISQV

SEQ ID NO: 10963 - protein, 9 aa, Homo Sapiens
RLLDALEFL

SEQ ID NO: 10964 - protein, 9 aa, Homo Sapiens
RLLDGAFKL

SEQ ID NO: 10965 - protein, 9 aa, Homo Sapiens
RLLDRLPSF

SEQ ID NO: 10966 - protein, 9 aa, Homo Sapiens
RLLDSVRAI

SEQ ID NO: 10967 - protein, 9 aa, Homo Sapiens
RLLDVLCEM

SEQ ID NO: 10968 - protein, 9 aa, Homo Sapiens
RLLDWFRSL

SEQ ID NO: 10969 - protein, 9 aa, Homo Sapiens
RLLDYVATV

SEQ ID NO: 10970 - protein, 9 aa, Homo Sapiens
RLLDYVVNI

SEQ ID NO: 10971 - protein, 9 aa, Homo Sapiens
RLLEALQGL

SEQ ID NO: 10972 - protein, 9 aa, Homo Sapiens
RLLEEIHAM

SEQ ID NO: 10973 - protein, 9 aa, Homo Sapiens
RLLEELQRL

SEQ ID NO: 10974 - protein, 9 aa, Homo Sapiens
RLLEFLVAL

SEQ ID NO: 10975 - protein, 9 aa, Homo Sapiens
RLLEGVNQL

SEQ ID NO: 10976 - protein, 9 aa, Homo Sapiens
RLLELLTKL

SEQ ID NO: 10977 - protein, 9 aa, Homo Sapiens
RLLENMTEV

SEQ ID NO: 10978 - protein, 9 aa, Homo Sapiens
RLLEQLQEI

SEQ ID NO: 10979 - protein, 9 aa, Homo Sapiens
RLLESLIRL

SEQ ID NO: 10980 - protein, 9 aa, Homo Sapiens
RLLEVVTSI

SEQ ID NO: 10981 - protein, 9 aa, Homo Sapiens
RLLFQLAQL

SEQ ID NO: 10982 - protein, 9 aa, Homo Sapiens
RLLGYVATL

SEQ ID NO: 10983 - protein, 9 aa, Homo Sapiens
RLLHEVQEL

SEQ ID NO: 10984 - protein, 9 aa, Homo Sapiens
RLLLTLPLL

SEQ ID NO: 10985 - protein, 9 aa, Homo Sapiens
RLLPALTVL

SEQ ID NO: 10986 - protein, 9 aa, Homo Sapiens
RLLPRLLLL

SEQ ID NO: 10987 - protein, 9 aa, Homo Sapiens
RLLPVIFLV

SEQ ID NO: 10988 - protein, 9 aa, Homo Sapiens
RLLSQVRAL

SEQ ID NO: 10989 - protein, 9 aa, Homo Sapiens
RLLVKLQEL

SEQ ID NO: 10990 - protein, 9 aa, Homo Sapiens
RLMAEIQDL

SEQ ID NO: 10991 - protein, 9 aa, Homo Sapiens
RLNELMSQI

SEQ ID NO: 10992 - protein, 9 aa, Homo Sapiens
RLNEVIRTL

SEQ ID NO: 10993 - protein, 9 aa, Homo Sapiens
RLNGVTLNL

SEQ ID NO: 10994 - protein, 9 aa, Homo Sapiens
RLNKVISEL

SEQ ID NO: 10995 - protein, 9 aa, Homo Sapiens
RLNPLVLLL

SEQ ID NO: 10996 - protein, 9 aa, Homo Sapiens
RLPDLIIFL

SEQ ID NO: 10997 - protein, 9 aa, Homo Sapiens
RLPEIYIQL

SEQ ID NO: 10998 - protein, 9 aa, Homo Sapiens
RLQDAIAKV

SEQ ID NO: 10999 - protein, 9 aa, Homo Sapiens
RLQDEIQNM

SEQ ID NO: 11000 - protein, 9 aa, Homo Sapiens
RLQDEIQRL

SEQ ID NO: 11001 - protein, 9 aa, Homo Sapiens
RLQDILWFL

SEQ ID NO: 11002 - protein, 9 aa, Homo Sapiens
RLQEEINEV

SEQ ID NO: 11003 - protein, 9 aa, Homo Sapiens
RLQEFIDEV

SEQ ID NO: 11004 - protein, 9 aa, Homo Sapiens
RLQEMLSLL

SEQ ID NO: 11005 - protein, 9 aa, Homo Sapiens
RLQESFFNL

SEQ ID NO: 11006 - protein, 9 aa, Homo Sapiens
RLQQELMTL

SEQ ID NO: 11007 - protein, 9 aa, Homo Sapiens
RLQQVLTGL

SEQ ID NO: 11008 - protein, 9 aa, Homo Sapiens
RLQSIVAGL

SEQ ID NO: 11009 - protein, 9 aa, Homo Sapiens
RLQTQVFKL

SEQ ID NO: 11010 - protein, 9 aa, Homo Sapiens
RLQTWWHGV

SEQ ID NO: 11011 - protein, 9 aa, Homo Sapiens
RLSDQVLFV

SEQ ID NO: 11012 - protein, 9 aa, Homo Sapiens
RLSDYLFTL

SEQ ID NO: 11013 - protein, 9 aa, Homo Sapiens
RLTDYISKV

SEQ ID NO: 11014 - protein, 9 aa, Homo Sapiens
RLTDYVAFL

SEQ ID NO: 11015 - protein, 9 aa, Homo Sapiens
RLVEIQYEL

SEQ ID NO: 11016 - protein, 9 aa, Homo Sapiens
RLVNWSCTL

SEQ ID NO: 11017 - protein, 9 aa, Homo Sapiens
RLVPFLVEL

SEQ ID NO: 11018 - protein, 9 aa, Homo Sapiens
RLVSWVNLI

SEQ ID NO: 11019 - protein, 9 aa, Homo Sapiens
RLWEGAISI

SEQ ID NO: 11020 - protein, 9 aa, Homo Sapiens
RLWEYLLEL

SEQ ID NO: 11021 - protein, 9 aa, Homo Sapiens
RLWGEPVNL

SEQ ID NO: 11022 - protein, 9 aa, Homo Sapiens
RLYHELVGL

SEQ ID NO: 11023 - protein, 9 aa, Homo Sapiens
RMLPHAPGV

SEQ ID NO: 11024 - protein, 9 aa, Homo Sapiens
RMNQEIVNL

SEQ ID NO: 11025 - protein, 9 aa, Homo Sapiens
RQADKVWRL

SEQ ID NO: 11026 - protein, 9 aa, Homo Sapiens
RQFLFHWTV

SEQ ID NO: 11027 - protein, 9 aa, Homo Sapiens
RQLEAIVRI

SEQ ID NO: 11028 - protein, 9 aa, Homo Sapiens
RSNPKIWNV

SEQ ID NO: 11029 - protein, 9 aa, Homo Sapiens
RTFSWASVT

SEQ ID NO: 11030 - protein, 9 aa, Homo Sapiens
RTISVILFL

SEQ ID NO: 11031 - protein, 9 aa, Homo Sapiens
RTLETLIRL

SEQ ID NO: 11032 - protein, 9 aa, Homo Sapiens
RTLPKLYSL

SEQ ID NO: 11033 - protein, 9 aa, Homo Sapiens
RTMPRIPTL

SEQ ID NO: 11034 - protein, 9 aa, Homo Sapiens
RVFENIVAV

SEQ ID NO: 11035 - protein, 9 aa, Homo Sapiens
RVIDYILDL

SEQ ID NO: 11036 - protein, 9 aa, Homo Sapiens
RVLEMLEAL

SEQ ID NO: 11037 - protein, 9 aa, Homo Sapiens
RVMEEIRNL

SEQ ID NO: 11038 - protein, 9 aa, Homo Sapiens
RVMELFFTV

SEQ ID NO: 11039 - protein, 9 aa, Homo Sapiens
RVMEYINRL

SEQ ID NO: 11040 - protein, 9 aa, Homo Sapiens
RVNQAIWLL

SEQ ID NO: 11041 - protein, 9 aa, Homo Sapiens
RVSDINFTL

SEQ ID NO: 11042 - protein, 9 aa, Homo Sapiens
RVSELLQGL

SEQ ID NO: 11043 - protein, 9 aa, Homo Sapiens
RVVDYLTKL

SEQ ID NO: 11044 - protein, 9 aa, Homo Sapiens
SAFYWIDRV

SEQ ID NO: 11045 - protein, 9 aa, Homo Sapiens
SAIDRIFTL

SEQ ID NO: 11046 - protein, 9 aa, Homo Sapiens
SALFWADKV

SEQ ID NO: 11047 - protein, 9 aa, Homo Sapiens
SALPWNITV

SEQ ID NO: 11048 - protein, 9 aa, Homo Sapiens
SAMELIWNL

SEQ ID NO: 11049 - protein, 9 aa, Homo Sapiens
SAMEVVPAL

SEQ ID NO: 11050 - protein, 9 aa, Homo Sapiens
SIAAFIQRL

SEQ ID NO: 11051 - protein, 9 aa, Homo Sapiens
SIAECLTYL

SEQ ID NO: 11052 - protein, 9 aa, Homo Sapiens
SIAEVVHQL

SEQ ID NO: 11053 - protein, 9 aa, Homo Sapiens
SIATWGIVV

SEQ ID NO: 11054 - protein, 9 aa, Homo Sapiens
SIHDVTFQV

SEQ ID NO: 11055 - protein, 9 aa, Homo Sapiens
SIIDWLNSV

SEQ ID NO: 11056 - protein, 9 aa, Homo Sapiens
SIIEYLPTL

SEQ ID NO: 11057 - protein, 9 aa, Homo Sapiens
SIIGRLLEV

SEQ ID NO: 11058 - protein, 9 aa, Homo Sapiens
SILDGLIHL

SEQ ID NO: 11059 - protein, 9 aa, Homo Sapiens
SILEDPPSI

SEQ ID NO: 11060 - protein, 9 aa, Homo Sapiens
SILEHQIQV

SEQ ID NO: 11061 - protein, 9 aa, Homo Sapiens
SILGMLVGL

SEQ ID NO: 11062 - protein, 9 aa, Homo Sapiens
SILNELIGL

SEQ ID NO: 11063 - protein, 9 aa, Homo Sapiens
SILTQPWRL

SEQ ID NO: 11064 - protein, 9 aa, Homo Sapiens
SILTSIQSL

SEQ ID NO: 11065 - protein, 9 aa, Homo Sapiens
SIMDYVVFV

SEQ ID NO: 11066 - protein, 9 aa, Homo Sapiens
SINDKIIEL

SEQ ID NO: 11067 - protein, 9 aa, Homo Sapiens
SINGVIFGL

SEQ ID NO: 11068 - protein, 9 aa, Homo Sapiens
SIQALIHGL

SEQ ID NO: 11069 - protein, 9 aa, Homo Sapiens
SIQQSIERL

SEQ ID NO: 11070 - protein, 9 aa, Homo Sapiens
SIQSIVPAL

SEQ ID NO: 11071 - protein, 9 aa, Homo Sapiens
SISDVIAQV

SEQ ID NO: 11072 - protein, 9 aa, Homo Sapiens
SISPIVLYL

SEQ ID NO: 11073 - protein, 9 aa, Homo Sapiens
SLAADIPRL

SEQ ID NO: 11074 - protein, 9 aa, Homo Sapiens
SLADCIPLL

SEQ ID NO: 11075 - protein, 9 aa, Homo Sapiens
SLADIAQKL

SEQ ID NO: 11076 - protein, 9 aa, Homo Sapiens
SLADVHIEV

SEQ ID NO: 11077 - protein, 9 aa, Homo Sapiens
SLAEFVQSL

SEQ ID NO: 11078 - protein, 9 aa, Homo Sapiens
SLAEKIQAL

SEQ ID NO: 11079 - protein, 9 aa, Homo Sapiens
SLAELIQAL

SEQ ID NO: 11080 - protein, 9 aa, Homo Sapiens
SLAEVLQQL

SEQ ID NO: 11081 - protein, 9 aa, Homo Sapiens
SLALGLPHL

SEQ ID NO: 11082 - protein, 9 aa, Homo Sapiens
SLAPIIVHV

SEQ ID NO: 11083 - protein, 9 aa, Homo Sapiens
SLAPLFFKL

SEQ ID NO: 11084 - protein, 9 aa, Homo Sapiens
SLAQYLINV

SEQ ID NO: 11085 - protein, 9 aa, Homo Sapiens
SLAQYNPKL

SEQ ID NO: 11086 - protein, 9 aa, Homo Sapiens
SLASFIPAV

SEQ ID NO: 11087 - protein, 9 aa, Homo Sapiens
SLASHIQSL

SEQ ID NO: 11088 - protein, 9 aa, Homo Sapiens
SLASLLVSV

SEQ ID NO: 11089 - protein, 9 aa, Homo Sapiens
SLASNIVNL

SEQ ID NO: 11090 - protein, 9 aa, Homo Sapiens
SLASVIFLL

SEQ ID NO: 11091 - protein, 9 aa, Homo Sapiens
SLATRISTL

SEQ ID NO: 11092 - protein, 9 aa, Homo Sapiens
SLATSLPRL

SEQ ID NO: 11093 - protein, 9 aa, Homo Sapiens
SLFDAVSSL

SEQ ID NO: 11094 - protein, 9 aa, Homo Sapiens
SLFDWNVKL

SEQ ID NO: 11095 - protein, 9 aa, Homo Sapiens
SLFEEMLQV

SEQ ID NO: 11096 - protein, 9 aa, Homo Sapiens
SLFEGTWYL

SEQ ID NO: 11097 - protein, 9 aa, Homo Sapiens
SLFERLVVL

SEQ ID NO: 11098 - protein, 9 aa, Homo Sapiens
SLFEWFHPL

SEQ ID NO: 11099 - protein, 9 aa, Homo Sapiens
SLFGGSVKL

SEQ ID NO: 11100 - protein, 9 aa, Homo Sapiens
SLFPGKLEV

SEQ ID NO: 11101 - protein, 9 aa, Homo Sapiens
SLFRVITEV

SEQ ID NO: 11102 - protein, 9 aa, Homo Sapiens
SLHDAIMIV

SEQ ID NO: 11103 - protein, 9 aa, Homo Sapiens
SLHEFLVNL

SEQ ID NO: 11104 - protein, 9 aa, Homo Sapiens
SLHFLILYV

SEQ ID NO: 11105 - protein, 9 aa, Homo Sapiens
SLHPSLPLL

SEQ ID NO: 11106 - protein, 9 aa, Homo Sapiens
SLHSVIIQL

SEQ ID NO: 11107 - protein, 9 aa, Homo Sapiens
SLHVWKIVV

SEQ ID NO: 11108 - protein, 9 aa, Homo Sapiens
SLIDIVTEI

SEQ ID NO: 11109 - protein, 9 aa, Homo Sapiens
SLIDKPTNL

SEQ ID NO: 11110 - protein, 9 aa, Homo Sapiens
SLIEDLILL

SEQ ID NO: 11111 - protein, 9 aa, Homo Sapiens
SLIEKLWQT

SEQ ID NO: 11112 - protein, 9 aa, Homo Sapiens
SLIEKYFSV

SEQ ID NO: 11113 - protein, 9 aa, Homo Sapiens
SLIFKLEEL

SEQ ID NO: 11114 - protein, 9 aa, Homo Sapiens
SLIGHLQTL

SEQ ID NO: 11115 - protein, 9 aa, Homo Sapiens
SLIHGLWNL

SEQ ID NO: 11116 - protein, 9 aa, Homo Sapiens
SLIKQIPRI

SEQ ID NO: 11117 - protein, 9 aa, Homo Sapiens
SLIKWILIV

SEQ ID NO: 11118 - protein, 9 aa, Homo Sapiens
SLITRLLEV

SEQ ID NO: 11119 - protein, 9 aa, Homo Sapiens
SLKEIVINV

SEQ ID NO: 11120 - protein, 9 aa, Homo Sapiens
SLKETIEEL

SEQ ID NO: 11121 - protein, 9 aa, Homo Sapiens
SLKGTLDNL

SEQ ID NO: 11122 - protein, 9 aa, Homo Sapiens
SLKKFIYAL

SEQ ID NO: 11123 - protein, 9 aa, Homo Sapiens
SLLALLHSL

SEQ ID NO: 11124 - protein, 9 aa, Homo Sapiens
SLLASLHTL

SEQ ID NO: 11125 - protein, 9 aa, Homo Sapiens
SLLDCTFRL

SEQ ID NO: 11126 - protein, 9 aa, Homo Sapiens
SLLDEFYKL

SEQ ID NO: 11127 - protein, 9 aa, Homo Sapiens
SLLDEVLNV

SEQ ID NO: 11128 - protein, 9 aa, Homo Sapiens
SLLDIIEKV

SEQ ID NO: 11129 - protein, 9 aa, Homo Sapiens
SLLDILKRL

SEQ ID NO: 11130 - protein, 9 aa, Homo Sapiens
SLLDPVPEV

SEQ ID NO: 11131 - protein, 9 aa, Homo Sapiens
SLLDQIPEM

SEQ ID NO: 11132 - protein, 9 aa, Homo Sapiens
SLLDQLRKL

SEQ ID NO: 11133 - protein, 9 aa, Homo Sapiens
SLLDSVVGL

SEQ ID NO: 11134 - protein, 9 aa, Homo Sapiens
SLLDTLVLL

SEQ ID NO: 11135 - protein, 9 aa, Homo Sapiens
SLLEALNGL

SEQ ID NO: 11136 - protein, 9 aa, Homo Sapiens
SLLEAVSFL

SEQ ID NO: 11137 - protein, 9 aa, Homo Sapiens
SLLEDLSHI

SEQ ID NO: 11138 - protein, 9 aa, Homo Sapiens
SLLEKLSAL

SEQ ID NO: 11139 - protein, 9 aa, Homo Sapiens
SLLEKPSEL

SEQ ID NO: 11140 - protein, 9 aa, Homo Sapiens
SLLELPHPL

SEQ ID NO: 11141 - protein, 9 aa, Homo Sapiens
SLLESVQKL

SEQ ID NO: 11142 - protein, 9 aa, Homo Sapiens
SLLGHLMIV

SEQ ID NO: 11143 - protein, 9 aa, Homo Sapiens
SLLGKLVSM

SEQ ID NO: 11144 - protein, 9 aa, Homo Sapiens
SLLHMPFTI

SEQ ID NO: 11145 - protein, 9 aa, Homo Sapiens
SLLHTLEEL

SEQ ID NO: 11146 - protein, 9 aa, Homo Sapiens
SLLKDLNFL

SEQ ID NO: 11147 - protein, 9 aa, Homo Sapiens
SLLNEIAFL

SEQ ID NO: 11148 - protein, 9 aa, Homo Sapiens
SLLNFLQHL

SEQ ID NO: 11149 - protein, 9 aa, Homo Sapiens
SLLNWRTKL

SEQ ID NO: 11150 - protein, 9 aa, Homo Sapiens
SLLPAIVEL

SEQ ID NO: 11151 - protein, 9 aa, Homo Sapiens
SLLPFLKAV

SEQ ID NO: 11152 - protein, 9 aa, Homo Sapiens
SLLPTSPRL

SEQ ID NO: 11153 - protein, 9 aa, Homo Sapiens
SLLPYLPML

SEQ ID NO: 11154 - protein, 9 aa, Homo Sapiens
SLLQAPARL

SEQ ID NO: 11155 - protein, 9 aa, Homo Sapiens
SLLQTLYKV

SEQ ID NO: 11156 - protein, 9 aa, Homo Sapiens
SLLRGLSQL

SEQ ID NO: 11157 - protein, 9 aa, Homo Sapiens
SLLRSIFTV

SEQ ID NO: 11158 - protein, 9 aa, Homo Sapiens
SLLRVGWSV

SEQ ID NO: 11159 - protein, 9 aa, Homo Sapiens
SLLSEIQAL

SEQ ID NO: 11160 - protein, 9 aa, Homo Sapiens
SLLSGLVRL

SEQ ID NO: 11161 - protein, 9 aa, Homo Sapiens
SLLSHVEQL

SEQ ID NO: 11162 - protein, 9 aa, Homo Sapiens
SLLSMLQSL

SEQ ID NO: 11163 - protein, 9 aa, Homo Sapiens
SLLSQQPFL

SEQ ID NO: 11164 - protein, 9 aa, Homo Sapiens
SLLSSVFKL

SEQ ID NO: 11165 - protein, 9 aa, Homo Sapiens
SLLTHIQNL

SEQ ID NO: 11166 - protein, 9 aa, Homo Sapiens
SLLTLLTQL

SEQ ID NO: 11167 - protein, 9 aa, Homo Sapiens
SLLTVIEKL

SEQ ID NO: 11168 - protein, 9 aa, Homo Sapiens
SLLYDLENL

SEQ ID NO: 11169 - protein, 9 aa, Homo Sapiens
SLLYHLSEL

SEQ ID NO: 11170 - protein, 9 aa, Homo Sapiens
SLMDLTLLL

SEQ ID NO: 11171 - protein, 9 aa, Homo Sapiens
SLMEILYTL

SEQ ID NO: 11172 - protein, 9 aa, Homo Sapiens
SLMGTLSKL

SEQ ID NO: 11173 - protein, 9 aa, Homo Sapiens
SLMHVPPSL

SEQ ID NO: 11174 - protein, 9 aa, Homo Sapiens
SLMLLIRQL

SEQ ID NO: 11175 - protein, 9 aa, Homo Sapiens
SLMMTIINL

SEQ ID NO: 11176 - protein, 9 aa, Homo Sapiens
SLMSHAIEL

SEQ ID NO: 11177 - protein, 9 aa, Homo Sapiens
SLNHLLNYV

SEQ ID NO: 11178 - protein, 9 aa, Homo Sapiens
SLNIITVTL

SEQ ID NO: 11179 - protein, 9 aa, Homo Sapiens
SLNISLPNL

SEQ ID NO: 11180 - protein, 9 aa, Homo Sapiens
SLNKWIFTV

SEQ ID NO: 11181 - protein, 9 aa, Homo Sapiens
SLNLAPPTV

SEQ ID NO: 11182 - protein, 9 aa, Homo Sapiens
SLNQDIPAF

SEQ ID NO: 11183 - protein, 9 aa, Homo Sapiens
SLPDIKVYL

SEQ ID NO: 11184 - protein, 9 aa, Homo Sapiens
SLQDEIQRV

SEQ ID NO: 11185 - protein, 9 aa, Homo Sapiens
SLQDLIEKV

SEQ ID NO: 11186 - protein, 9 aa, Homo Sapiens
SLQEEIAFL

SEQ ID NO: 11187 - protein, 9 aa, Homo Sapiens
SLQEEIAKL

SEQ ID NO: 11188 - protein, 9 aa, Homo Sapiens
SLQEFINWL

SEQ ID NO: 11189 - protein, 9 aa, Homo Sapiens
SLQEFLRQL

SEQ ID NO: 11190 - protein, 9 aa, Homo Sapiens
SLQEKLWAI

SEQ ID NO: 11191 - protein, 9 aa, Homo Sapiens
SLQETIQSL

SEQ ID NO: 11192 - protein, 9 aa, Homo Sapiens
SLQKEILYL

SEQ ID NO: 11193 - protein, 9 aa, Homo Sapiens
SLQLRIQEL

SEQ ID NO: 11194 - protein, 9 aa, Homo Sapiens
SLQQRTWLI

SEQ ID NO: 11195 - protein, 9 aa, Homo Sapiens
SLQSLIISV

SEQ ID NO: 11196 - protein, 9 aa, Homo Sapiens
SLQSTIQGL

SEQ ID NO: 11197 - protein, 9 aa, Homo Sapiens
SLQTRLIFL

SEQ ID NO: 11198 - protein, 9 aa, Homo Sapiens
SLQYFIPAL

SEQ ID NO: 11199 - protein, 9 aa, Homo Sapiens
SLRDLIQGL

SEQ ID NO: 11200 - protein, 9 aa, Homo Sapiens
SLRQLLHQL

SEQ ID NO: 11201 - protein, 9 aa, Homo Sapiens
SLSAFTPAL

SEQ ID NO: 11202 - protein, 9 aa, Homo Sapiens
SLSDLIYAL

SEQ ID NO: 11203 - protein, 9 aa, Homo Sapiens
SLSDLLVSL

SEQ ID NO: 11204 - protein, 9 aa, Homo Sapiens
SLSDSLFVL

SEQ ID NO: 11205 - protein, 9 aa, Homo Sapiens
SLSDTVEKL

SEQ ID NO: 11206 - protein, 9 aa, Homo Sapiens
SLSEELAKL

SEQ ID NO: 11207 - protein, 9 aa, Homo Sapiens
SLSEKQYFL

SEQ ID NO: 11208 - protein, 9 aa, Homo Sapiens
SLSEKTVLL

SEQ ID NO: 11209 - protein, 9 aa, Homo Sapiens
SLSERIMQL

SEQ ID NO: 11210 - protein, 9 aa, Homo Sapiens
SLSEYVSRM

SEQ ID NO: 11211 - protein, 9 aa, Homo Sapiens
SLSFLVPSL

SEQ ID NO: 11212 - protein, 9 aa, Homo Sapiens
SLSFMNPRL

SEQ ID NO: 11213 - protein, 9 aa, Homo Sapiens
SLSGYINYL

SEQ ID NO: 11214 - protein, 9 aa, Homo Sapiens
SLSHLVPAL

SEQ ID NO: 11215 - protein, 9 aa, Homo Sapiens
SLSQVFLHL

SEQ ID NO: 11216 - protein, 9 aa, Homo Sapiens
SLSSFLERL

SEQ ID NO: 11217 - protein, 9 aa, Homo Sapiens
SLSTVFVVL

SEQ ID NO: 11218 - protein, 9 aa, Homo Sapiens
SLTESIAQL

SEQ ID NO: 11219 - protein, 9 aa, Homo Sapiens
SLTSEIHFL

SEQ ID NO: 11220 - protein, 9 aa, Homo Sapiens
SLVEIILHV

SEQ ID NO: 11221 - protein, 9 aa, Homo Sapiens
SLVNEIFRL

SEQ ID NO: 11222 - protein, 9 aa, Homo Sapiens
SLVNVVPKL

SEQ ID NO: 11223 - protein, 9 aa, Homo Sapiens
SLWFKPEEL

SEQ ID NO: 11224 - protein, 9 aa, Homo Sapiens
SLWKEVSEL

SEQ ID NO: 11225 - protein, 9 aa, Homo Sapiens
SLWPMTFGL

SEQ ID NO: 11226 - protein, 9 aa, Homo Sapiens
SLYDELRNL

SEQ ID NO: 11227 - protein, 9 aa, Homo Sapiens
SLYDWHVKL

SEQ ID NO: 11228 - protein, 9 aa, Homo Sapiens
SLYDWNVKL

SEQ ID NO: 11229 - protein, 9 aa, Homo Sapiens
SLYDYNPNL

SEQ ID NO: 11230 - protein, 9 aa, Homo Sapiens
SLYEMVSRV

SEQ ID NO: 11231 - protein, 9 aa, Homo Sapiens
SMLDDLRNV

SEQ ID NO: 11232 - protein, 9 aa, Homo Sapiens
SMLEPVPEL

SEQ ID NO: 11233 - protein, 9 aa, Homo Sapiens
SMLNRILAV

SEQ ID NO: 11234 - protein, 9 aa, Homo Sapiens
SMLTYPFLL

SEQ ID NO: 11235 - protein, 9 aa, Homo Sapiens
SMTNFISGL

SEQ ID NO: 11236 - protein, 9 aa, Homo Sapiens
SMVDVVMLL

SEQ ID NO: 11237 - protein, 9 aa, Homo Sapiens
SMYDKVLML

SEQ ID NO: 11238 - protein, 9 aa, Homo Sapiens
SPSLKLPLS

SEQ ID NO: 11239 - protein, 9 aa, Homo Sapiens
SQAERLFNL

SEQ ID NO: 11240 - protein, 9 aa, Homo Sapiens
SQAPFIVAL

SEQ ID NO: 11241 - protein, 9 aa, Homo Sapiens
SQPEKVYTL

SEQ ID NO: 11242 - protein, 9 aa, Homo Sapiens
SQVDRLVAL

SEQ ID NO: 11243 - protein, 9 aa, Homo Sapiens
STLHLVLRL

SEQ ID NO: 11244 - protein, 9 aa, Homo Sapiens
STLRVLYNL

SEQ ID NO: 11245 - protein, 9 aa, Homo Sapiens
SVAFKIFEL

SEQ ID NO: 11246 - protein, 9 aa, Homo Sapiens
SVFAGVVGV

SEQ ID NO: 11247 - protein, 9 aa, Homo Sapiens
SVIDHIHLI

SEQ ID NO: 11248 - protein, 9 aa, Homo Sapiens
SVIEQIVYV

SEQ ID NO: 11249 - protein, 9 aa, Homo Sapiens
SVIEQLFFV

SEQ ID NO: 11250 - protein, 9 aa, Homo Sapiens
SVITQVFHV

SEQ ID NO: 11251 - protein, 9 aa, Homo Sapiens
SVLEALSGV

SEQ ID NO: 11252 - protein, 9 aa, Homo Sapiens
SVLELIPEL

SEQ ID NO: 11253 - protein, 9 aa, Homo Sapiens
SVLGKIWKL

SEQ ID NO: 11254 - protein, 9 aa, Homo Sapiens
SVLNVLHSL

SEQ ID NO: 11255 - protein, 9 aa, Homo Sapiens
SVLSKLSQL

SEQ ID NO: 11256 - protein, 9 aa, Homo Sapiens
SVLVSPPAV

SEQ ID NO: 11257 - protein, 9 aa, Homo Sapiens
SVMDRLSYL

SEQ ID NO: 11258 - protein, 9 aa, Homo Sapiens
SVMNSVVSL

SEQ ID NO: 11259 - protein, 9 aa, Homo Sapiens
SVMSILPKI

SEQ ID NO: 11260 - protein, 9 aa, Homo Sapiens
SVNPYIVKL

SEQ ID NO: 11261 - protein, 9 aa, Homo Sapiens
SVSSVVHYL

SEQ ID NO: 11262 - protein, 9 aa, Homo Sapiens
SVVESVFKL

SEQ ID NO: 11263 - protein, 9 aa, Homo Sapiens
SVVSWKTGV

SEQ ID NO: 11264 - protein, 9 aa, Homo Sapiens
SVYPNGHFV

SEQ ID NO: 11265 - protein, 9 aa, Homo Sapiens
SVYSWDIVV

SEQ ID NO: 11266 - protein, 9 aa, Homo Sapiens
TGFPWAFKV

SEQ ID NO: 11267 - protein, 9 aa, Homo Sapiens
TIDDIVLTI

SEQ ID NO: 11268 - protein, 9 aa, Homo Sapiens
TILNLLPRL

SEQ ID NO: 11269 - protein, 9 aa, Homo Sapiens
TILPGLPEL

SEQ ID NO: 11270 - protein, 9 aa, Homo Sapiens
TILSTLANL

SEQ ID NO: 11271 - protein, 9 aa, Homo Sapiens
TINSIIYGL

SEQ ID NO: 11272 - protein, 9 aa, Homo Sapiens
TIQEILPAL

SEQ ID NO: 11273 - protein, 9 aa, Homo Sapiens
TLAAIIEHL

SEQ ID NO: 11274 - protein, 9 aa, Homo Sapiens
TLADLVHHV

SEQ ID NO: 11275 - protein, 9 aa, Homo Sapiens
TLADVLYHV

SEQ ID NO: 11276 - protein, 9 aa, Homo Sapiens
TLADYLHLL

SEQ ID NO: 11277 - protein, 9 aa, Homo Sapiens
TLAELLVLL

SEQ ID NO: 11278 - protein, 9 aa, Homo Sapiens
TLAETIQGL

SEQ ID NO: 11279 - protein, 9 aa, Homo Sapiens
TLAETLVNL

SEQ ID NO: 11280 - protein, 9 aa, Homo Sapiens
TLAKYLMEL

SEQ ID NO: 11281 - protein, 9 aa, Homo Sapiens
TLASSLHTL

SEQ ID NO: 11282 - protein, 9 aa, Homo Sapiens
TLEEIIFKL

SEQ ID NO: 11283 - protein, 9 aa, Homo Sapiens
TLFDYEVRL

SEQ ID NO: 11284 - protein, 9 aa, Homo Sapiens
TLFPSKIGV

SEQ ID NO: 11285 - protein, 9 aa, Homo Sapiens
TLFSVLPEL

SEQ ID NO: 11286 - protein, 9 aa, Homo Sapiens
TLGHILPTL

SEQ ID NO: 11287 - protein, 9 aa, Homo Sapiens
TLHSIIISL

SEQ ID NO: 11288 - protein, 9 aa, Homo Sapiens
TLIEDILGV

SEQ ID NO: 11289 - protein, 9 aa, Homo Sapiens
TLIEELKAL

SEQ ID NO: 11290 - protein, 9 aa, Homo Sapiens
TLIEELKTL

SEQ ID NO: 11291 - protein, 9 aa, Homo Sapiens
TLIGLSIKV

SEQ ID NO: 11292 - protein, 9 aa, Homo Sapiens
TLINKINNL

SEQ ID NO: 11293 - protein, 9 aa, Homo Sapiens
TLIRSIPTM

SEQ ID NO: 11294 - protein, 9 aa, Homo Sapiens
TLKEYLESL

SEQ ID NO: 11295 - protein, 9 aa, Homo Sapiens
TLLAYLEGL

SEQ ID NO: 11296 - protein, 9 aa, Homo Sapiens
TLLDFINAV

SEQ ID NO: 11297 - protein, 9 aa, Homo Sapiens
TLLDWQDSL

SEQ ID NO: 11298 - protein, 9 aa, Homo Sapiens
TLLEALDCI

SEQ ID NO: 11299 - protein, 9 aa, Homo Sapiens
TLLERAFSL

SEQ ID NO: 11300 - protein, 9 aa, Homo Sapiens
TLLGHLDYI

SEQ ID NO: 11301 - protein, 9 aa, Homo Sapiens
TLLGKVVAL

SEQ ID NO: 11302 - protein, 9 aa, Homo Sapiens
TLLHFLAEL

SEQ ID NO: 11303 - protein, 9 aa, Homo Sapiens
TLLHFLVEI

SEQ ID NO: 11304 - protein, 9 aa, Homo Sapiens
TLLIQVPRI

SEQ ID NO: 11305 - protein, 9 aa, Homo Sapiens
TLLPELHLL

SEQ ID NO: 11306 - protein, 9 aa, Homo Sapiens
TLLPTLYEI

SEQ ID NO: 11307 - protein, 9 aa, Homo Sapiens
TLLPVIQFL

SEQ ID NO: 11308 - protein, 9 aa, Homo Sapiens
TLLQNIPSF

SEQ ID NO: 11309 - protein, 9 aa, Homo Sapiens
TLLRALQAL

SEQ ID NO: 11310 - protein, 9 aa, Homo Sapiens
TLLTAIVKL

SEQ ID NO: 11311 - protein, 9 aa, Homo Sapiens
TLLTKPVEI

SEQ ID NO: 11312 - protein, 9 aa, Homo Sapiens
TLLVVVPKL

SEQ ID NO: 11313 - protein, 9 aa, Homo Sapiens
TLMDILPRI

SEQ ID NO: 11314 - protein, 9 aa, Homo Sapiens
TLMEEVLLL

SEQ ID NO: 11315 - protein, 9 aa, Homo Sapiens
TLMSLPTKI

SEQ ID NO: 11316 - protein, 9 aa, Homo Sapiens
TLNDIMTRV

SEQ ID NO: 11317 - protein, 9 aa, Homo Sapiens
TLNDVLAQL

SEQ ID NO: 11318 - protein, 9 aa, Homo Sapiens
TLNEKLTAL

SEQ ID NO: 11319 - protein, 9 aa, Homo Sapiens
TLNKFIEEL

SEQ ID NO: 11320 - protein, 9 aa, Homo Sapiens
TLNNLEIFL

SEQ ID NO: 11321 - protein, 9 aa, Homo Sapiens
TLNNLVEKL

SEQ ID NO: 11322 - protein, 9 aa, Homo Sapiens
TLNSFIHVL

SEQ ID NO: 11323 - protein, 9 aa, Homo Sapiens
TLNSFISVL

SEQ ID NO: 11324 - protein, 9 aa, Homo Sapiens
TLQDIVYKL

SEQ ID NO: 11325 - protein, 9 aa, Homo Sapiens
TLQEFLERI

SEQ ID NO: 11326 - protein, 9 aa, Homo Sapiens
TLQEITFSF

SEQ ID NO: 11327 - protein, 9 aa, Homo Sapiens
TLQEKIHRL

SEQ ID NO: 11328 - protein, 9 aa, Homo Sapiens
TLQEQIEAI

SEQ ID NO: 11329 - protein, 9 aa, Homo Sapiens
TLQEVHFLL

SEQ ID NO: 11330 - protein, 9 aa, Homo Sapiens
TLQEVLTLL

SEQ ID NO: 11331 - protein, 9 aa, Homo Sapiens
TLQKLLRQL

SEQ ID NO: 11332 - protein, 9 aa, Homo Sapiens
TLQQQIQTL

SEQ ID NO: 11333 - protein, 9 aa, Homo Sapiens
TLQQQTFKI

SEQ ID NO: 11334 - protein, 9 aa, Homo Sapiens
TLSDIMVSL

SEQ ID NO: 11335 - protein, 9 aa, Homo Sapiens
TLSDLRVYL

SEQ ID NO: 11336 - protein, 9 aa, Homo Sapiens
TLSDVVVGL

SEQ ID NO: 11337 - protein, 9 aa, Homo Sapiens
TLSEALLQL

SEQ ID NO: 11338 - protein, 9 aa, Homo Sapiens
TLSERLWGL

SEQ ID NO: 11339 - protein, 9 aa, Homo Sapiens
TLSEVTNQL

SEQ ID NO: 11340 - protein, 9 aa, Homo Sapiens
TLSGLLWEL

SEQ ID NO: 11341 - protein, 9 aa, Homo Sapiens
TLSSLVFQL

SEQ ID NO: 11342 - protein, 9 aa, Homo Sapiens
TLTDCVVVV

SEQ ID NO: 11343 - protein, 9 aa, Homo Sapiens
TLTGKTITL

SEQ ID NO: 11344 - protein, 9 aa, Homo Sapiens
TLTKNIVEL

SEQ ID NO: 11345 - protein, 9 aa, Homo Sapiens
TLTNIIHNL

SEQ ID NO: 11346 - protein, 9 aa, Homo Sapiens
TLTSFITSL

SEQ ID NO: 11347 - protein, 9 aa, Homo Sapiens
TLTSKLYSL

SEQ ID NO: 11348 - protein, 9 aa, Homo Sapiens
TLVDEVFRI

SEQ ID NO: 11349 - protein, 9 aa, Homo Sapiens
TLVEAIKQV

SEQ ID NO: 11350 - protein, 9 aa, Homo Sapiens
TLVLTLPTV

SEQ ID NO: 11351 - protein, 9 aa, Homo Sapiens
TLVSWVALT

SEQ ID NO: 11352 - protein, 9 aa, Homo Sapiens
TLVTWLQCV

SEQ ID NO: 11353 - protein, 9 aa, Homo Sapiens
TLVYHVVGV

SEQ ID NO: 11354 - protein, 9 aa, Homo Sapiens
TLWNEIERL

SEQ ID NO: 11355 - protein, 9 aa, Homo Sapiens
TLWPEVQKL

SEQ ID NO: 11356 - protein, 9 aa, Homo Sapiens
TLWVDPYEV

SEQ ID NO: 11357 - protein, 9 aa, Homo Sapiens
TLWYRAPEV

SEQ ID NO: 11358 - protein, 9 aa, Homo Sapiens
TLWYRPPEL

SEQ ID NO: 11359 - protein, 9 aa, Homo Sapiens
TLYEAVREV

SEQ ID NO: 11360 - protein, 9 aa, Homo Sapiens
TMADQIVTV

SEQ ID NO: 11361 - protein, 9 aa, Homo Sapiens
TMIEINPMV

SEQ ID NO: 11362 - protein, 9 aa, Homo Sapiens
TMLDILQTL

SEQ ID NO: 11363 - protein, 9 aa, Homo Sapiens
TMLELINQL

SEQ ID NO: 11364 - protein, 9 aa, Homo Sapiens
TMQDIVYKL

SEQ ID NO: 11365 - protein, 9 aa, Homo Sapiens
TMTGWVHDV

SEQ ID NO: 11366 - protein, 9 aa, Homo Sapiens
TQILSVPKV

SEQ ID NO: 11367 - protein, 9 aa, Homo Sapiens
TQLATIWTL

SEQ ID NO: 11368 - protein, 9 aa, Homo Sapiens
TSMDWLPQL

SEQ ID NO: 11369 - protein, 9 aa, Homo Sapiens
TTVGWDHQV

SEQ ID NO: 11370 - protein, 9 aa, Homo Sapiens
TVAPFNPTV

SEQ ID NO: 11371 - protein, 9 aa, Homo Sapiens
TVFEHTFHV

SEQ ID NO: 11372 - protein, 9 aa, Homo Sapiens
TVIDQIPFL

SEQ ID NO: 11373 - protein, 9 aa, Homo Sapiens
TVLDAIYEV

SEQ ID NO: 11374 - protein, 9 aa, Homo Sapiens
TVLGKIWKL

SEQ ID NO: 11375 - protein, 9 aa, Homo Sapiens
TVLPFVSTV

SEQ ID NO: 11376 - protein, 9 aa, Homo Sapiens
TVNPIIYAL

SEQ ID NO: 11377 - protein, 9 aa, Homo Sapiens
TVQEILPAL

SEQ ID NO: 11378 - protein, 9 aa, Homo Sapiens
TVRIWVPNV

SEQ ID NO: 11379 - protein, 9 aa, Homo Sapiens
TVTGFIPLL

SEQ ID NO: 11380 - protein, 9 aa, Homo Sapiens
VALDILSRI

SEQ ID NO: 11381 - protein, 9 aa, Homo Sapiens
VILKILPTL

SEQ ID NO: 11382 - protein, 9 aa, Homo Sapiens
VILPTVHEV

SEQ ID NO: 11383 - protein, 9 aa, Homo Sapiens
VIQDFINAL

SEQ ID NO: 11384 - protein, 9 aa, Homo Sapiens
VIQELINTV

SEQ ID NO: 11385 - protein, 9 aa, Homo Sapiens
VIQTEVPPL

SEQ ID NO: 11386 - protein, 9 aa, Homo Sapiens
VLADLKVQL

SEQ ID NO: 11387 - protein, 9 aa, Homo Sapiens
VLADQVWTL

SEQ ID NO: 11388 - protein, 9 aa, Homo Sapiens
VLAFLVHEL

SEQ ID NO: 11389 - protein, 9 aa, Homo Sapiens
VLAHTILGV

SEQ ID NO: 11390 - protein, 9 aa, Homo Sapiens
VLAPLGFTL

SEQ ID NO: 11391 - protein, 9 aa, Homo Sapiens
VLAPLIALV

SEQ ID NO: 11392 - protein, 9 aa, Homo Sapiens
VLAQQIATL

SEQ ID NO: 11393 - protein, 9 aa, Homo Sapiens
VLASLIIRL

SEQ ID NO: 11394 - protein, 9 aa, Homo Sapiens
VLATILAQL

SEQ ID NO: 11395 - protein, 9 aa, Homo Sapiens
VLATLLNNL

SEQ ID NO: 11396 - protein, 9 aa, Homo Sapiens
VLAWGLLNV

SEQ ID NO: 11397 - protein, 9 aa, Homo Sapiens
VLFELKLLL

SEQ ID NO: 11398 - protein, 9 aa, Homo Sapiens
VLFGEITRL

SEQ ID NO: 11399 - protein, 9 aa, Homo Sapiens
VLFGKPMVV

SEQ ID NO: 11400 - protein, 9 aa, Homo Sapiens
VLFGLLREV

SEQ ID NO: 11401 - protein, 9 aa, Homo Sapiens
VLFHQLQEI

SEQ ID NO: 11402 - protein, 9 aa, Homo Sapiens
VLFNKLTYL

SEQ ID NO: 11403 - protein, 9 aa, Homo Sapiens
VLFPWQARL

SEQ ID NO: 11404 - protein, 9 aa, Homo Sapiens
VLFSSPPQM

SEQ ID NO: 11405 - protein, 9 aa, Homo Sapiens
VLFTGVKEV

SEQ ID NO: 11406 - protein, 9 aa, Homo Sapiens
VLFYAITTL

SEQ ID NO: 11407 - protein, 9 aa, Homo Sapiens
VLGELVPRL

SEQ ID NO: 11408 - protein, 9 aa, Homo Sapiens
VLGKVIFQV

SEQ ID NO: 11409 - protein, 9 aa, Homo Sapiens
VLGPKIEAV

SEQ ID NO: 11410 - protein, 9 aa, Homo Sapiens
VLGQYIENL

SEQ ID NO: 11411 - protein, 9 aa, Homo Sapiens
VLHDVIYVI

SEQ ID NO: 11412 - protein, 9 aa, Homo Sapiens
VLIANLEKL

SEQ ID NO: 11413 - protein, 9 aa, Homo Sapiens
VLIDYQRNV

SEQ ID NO: 11414 - protein, 9 aa, Homo Sapiens
VLIETLVTL

SEQ ID NO: 11415 - protein, 9 aa, Homo Sapiens
VLIPKLPQL

SEQ ID NO: 11416 - protein, 9 aa, Homo Sapiens
VLIPKMPQL

SEQ ID NO: 11417 - protein, 9 aa, Homo Sapiens
VLKEFIDQM

SEQ ID NO: 11418 - protein, 9 aa, Homo Sapiens
VLKVFLENV

SEQ ID NO: 11419 - protein, 9 aa, Homo Sapiens
VLLDAPIQL

SEQ ID NO: 11420 - protein, 9 aa, Homo Sapiens
VLLEEITNL

SEQ ID NO: 11421 - protein, 9 aa, Homo Sapiens
VLLGHIFYV

SEQ ID NO: 11422 - protein, 9 aa, Homo Sapiens
VLLGKVYVV

SEQ ID NO: 11423 - protein, 9 aa, Homo Sapiens
VLLPGLQKL

SEQ ID NO: 11424 - protein, 9 aa, Homo Sapiens
VLLPKLPQF

SEQ ID NO: 11425 - protein, 9 aa, Homo Sapiens
VLLPWIMNL

SEQ ID NO: 11426 - protein, 9 aa, Homo Sapiens
VLLQVLHVL

SEQ ID NO: 11427 - protein, 9 aa, Homo Sapiens
VLLSALERL

SEQ ID NO: 11428 - protein, 9 aa, Homo Sapiens
VLLSEILHL

SEQ ID NO: 11429 - protein, 9 aa, Homo Sapiens
VLLSHLSYL

SEQ ID NO: 11430 - protein, 9 aa, Homo Sapiens
VLLSPVPEL

SEQ ID NO: 11431 - protein, 9 aa, Homo Sapiens
VLLSTIHEL

SEQ ID NO: 11432 - protein, 9 aa, Homo Sapiens
VLLTWKYLL

SEQ ID NO: 11433 - protein, 9 aa, Homo Sapiens
VLMDHILNL

SEQ ID NO: 11434 - protein, 9 aa, Homo Sapiens
VLMDRLPSL

SEQ ID NO: 11435 - protein, 9 aa, Homo Sapiens
VLMEQIKLL

SEQ ID NO: 11436 - protein, 9 aa, Homo Sapiens
VLMEYIRSL

SEQ ID NO: 11437 - protein, 9 aa, Homo Sapiens
VLMNQPPQI

SEQ ID NO: 11438 - protein, 9 aa, Homo Sapiens
VLNALLPTL

SEQ ID NO: 11439 - protein, 9 aa, Homo Sapiens
VLNDYKWFA

SEQ ID NO: 11440 - protein, 9 aa, Homo Sapiens
VLNEYFHNV

SEQ ID NO: 11441 - protein, 9 aa, Homo Sapiens
VLNGKFANL

SEQ ID NO: 11442 - protein, 9 aa, Homo Sapiens
VLNLVLPNL

SEQ ID NO: 11443 - protein, 9 aa, Homo Sapiens
VLNNVVIHL

SEQ ID NO: 11444 - protein, 9 aa, Homo Sapiens
VLQDFYLEL

SEQ ID NO: 11445 - protein, 9 aa, Homo Sapiens
VLQDIQVML

SEQ ID NO: 11446 - protein, 9 aa, Homo Sapiens
VLQDPIWLL

SEQ ID NO: 11447 - protein, 9 aa, Homo Sapiens
VLQEEPPLL

SEQ ID NO: 11448 - protein, 9 aa, Homo Sapiens
VLQELINVL

SEQ ID NO: 11449 - protein, 9 aa, Homo Sapiens
VLQEWLSHL

SEQ ID NO: 11450 - protein, 9 aa, Homo Sapiens
VLQGAVPTV

SEQ ID NO: 11451 - protein, 9 aa, Homo Sapiens
VLQGLTFTL

SEQ ID NO: 11452 - protein, 9 aa, Homo Sapiens
VLQKLLEKL

SEQ ID NO: 11453 - protein, 9 aa, Homo Sapiens
VLQNVAFSV

SEQ ID NO: 11454 - protein, 9 aa, Homo Sapiens
VLQPQVQSL

SEQ ID NO: 11455 - protein, 9 aa, Homo Sapiens
VLQQHINSL

SEQ ID NO: 11456 - protein, 9 aa, Homo Sapiens
VLQQHLETL

SEQ ID NO: 11457 - protein, 9 aa, Homo Sapiens
VLQQRLIAL

SEQ ID NO: 11458 - protein, 9 aa, Homo Sapiens
VLQRSLVTV

SEQ ID NO: 11459 - protein, 9 aa, Homo Sapiens
VLQVHLNGL

SEQ ID NO: 11460 - protein, 9 aa, Homo Sapiens
VLQYQLQHL

SEQ ID NO: 11461 - protein, 9 aa, Homo Sapiens
VLQYVVPEV

SEQ ID NO: 11462 - protein, 9 aa, Homo Sapiens
VLRDNIQGI

SEQ ID NO: 11463 - protein, 9 aa, Homo Sapiens
VLSDIIQNL

SEQ ID NO: 11464 - protein, 9 aa, Homo Sapiens
VLSEKVSQL

SEQ ID NO: 11465 - protein, 9 aa, Homo Sapiens
VLSELLWQV

SEQ ID NO: 11466 - protein, 9 aa, Homo Sapiens
VLSFTIPSL

SEQ ID NO: 11467 - protein, 9 aa, Homo Sapiens
VLWDRTFSL

SEQ ID NO: 11468 - protein, 9 aa, Homo Sapiens
VLWFKPVEL

SEQ ID NO: 11469 - protein, 9 aa, Homo Sapiens
VLWGETVHL

SEQ ID NO: 11470 - protein, 9 aa, Homo Sapiens
VLYDWKERL

SEQ ID NO: 11471 - protein, 9 aa, Homo Sapiens
VMAPRTLVL

SEQ ID NO: 11472 - protein, 9 aa, Homo Sapiens
VMIPTLPSI

SEQ ID NO: 11473 - protein, 9 aa, Homo Sapiens
VMNPVIQAV

SEQ ID NO: 11474 - protein, 9 aa, Homo Sapiens
VMNSVVSLL

SEQ ID NO: 11475 - protein, 9 aa, Homo Sapiens
VMQDIVYKL

SEQ ID NO: 11476 - protein, 9 aa, Homo Sapiens
VMQTLLSQL

SEQ ID NO: 11477 - protein, 9 aa, Homo Sapiens
VMTLVSTYL

SEQ ID NO: 11478 - protein, 9 aa, Homo Sapiens
VMYDLITEL

SEQ ID NO: 11479 - protein, 9 aa, Homo Sapiens
VQIEHISSL

SEQ ID NO: 11480 - protein, 9 aa, Homo Sapiens
VQIGDIVTV

SEQ ID NO: 11481 - protein, 9 aa, Homo Sapiens
VQTDYVPLL

SEQ ID NO: 11482 - protein, 9 aa, Homo Sapiens
VTLDGIPEV

SEQ ID NO: 11483 - protein, 9 aa, Homo Sapiens
VTQINRLLS

SEQ ID NO: 11484 - protein, 9 aa, Homo Sapiens
VVLEEIPKL

SEQ ID NO: 11485 - protein, 9 aa, Homo Sapiens
VVLNATWLV

SEQ ID NO: 11486 - protein, 9 aa, Homo Sapiens
VVLPAPPAV

SEQ ID NO: 11487 - protein, 9 aa, Homo Sapiens
VVMNVVHQL

SEQ ID NO: 11488 - protein, 9 aa, Homo Sapiens
VVNDVLFAV

SEQ ID NO: 11489 - protein, 9 aa, Homo Sapiens
WAGCALGAL

SEQ ID NO: 11490 - protein, 9 aa, Homo Sapiens
WIQNKIPYL

SEQ ID NO: 11491 - protein, 9 aa, Homo Sapiens
WLAEKLPTL

SEQ ID NO: 11492 - protein, 9 aa, Homo Sapiens
WLMPVIPAL

SEQ ID NO: 11493 - protein, 9 aa, Homo Sapiens
WLQEHVADL

SEQ ID NO: 11494 - protein, 9 aa, Homo Sapiens
WLTPVIPAL

SEQ ID NO: 11495 - protein, 9 aa, Homo Sapiens
WLVDHVYAI

SEQ ID NO: 11496 - protein, 9 aa, Homo Sapiens
YAITTLHNL

SEQ ID NO: 11497 - protein, 9 aa, Homo Sapiens
YALNHTLSV

SEQ ID NO: 11498 - protein, 9 aa, Homo Sapiens
YANAKIYKL

SEQ ID NO: 11499 - protein, 9 aa, Homo Sapiens
YGLDKIEFL

SEQ ID NO: 11500 - protein, 9 aa, Homo Sapiens
YGLPVVVKL

SEQ ID NO: 11501 - protein, 9 aa, Homo Sapiens
YIFEEPFTI

SEQ ID NO: 11502 - protein, 9 aa, Homo Sapiens
YIITEIPSL

SEQ ID NO: 11503 - protein, 9 aa, Homo Sapiens
YILGKFFAL

SEQ ID NO: 11504 - protein, 9 aa, Homo Sapiens
YILPWESEL

SEQ ID NO: 11505 - protein, 9 aa, Homo Sapiens
YIMSYISRV

SEQ ID NO: 11506 - protein, 9 aa, Homo Sapiens
YIQRLLHAL

SEQ ID NO: 11507 - protein, 9 aa, Homo Sapiens
YITRYIASL

SEQ ID NO: 11508 - protein, 9 aa, Homo Sapiens
YIWDRHYNI

SEQ ID NO: 11509 - protein, 9 aa, Homo Sapiens
YLADIFTKL

SEQ ID NO: 11510 - protein, 9 aa, Homo Sapiens
YLADLYHFV

SEQ ID NO: 11511 - protein, 9 aa, Homo Sapiens
YLADVTNAL

SEQ ID NO: 11512 - protein, 9 aa, Homo Sapiens
YLAHFIEGL

SEQ ID NO: 11513 - protein, 9 aa, Homo Sapiens
YLASLIRSV

SEQ ID NO: 11514 - protein, 9 aa, Homo Sapiens
YLDEYIARM

SEQ ID NO: 11515 - protein, 9 aa, Homo Sapiens
YLDFTNPKV

SEQ ID NO: 11516 - protein, 9 aa, Homo Sapiens
YLFERIKEL

SEQ ID NO: 11517 - protein, 9 aa, Homo Sapiens
YLFPGIPEL

SEQ ID NO: 11518 - protein, 9 aa, Homo Sapiens
YLFQLLQGL

SEQ ID NO: 11519 - protein, 9 aa, Homo Sapiens
YLFREPATI

SEQ ID NO: 11520 - protein, 9 aa, Homo Sapiens
YLFTFLNHL

SEQ ID NO: 11521 - protein, 9 aa, Homo Sapiens
YLFTIINSL

SEQ ID NO: 11522 - protein, 9 aa, Homo Sapiens
YLGIVELLV

SEQ ID NO: 11523 - protein, 9 aa, Homo Sapiens
YLGNINPQM

SEQ ID NO: 11524 - protein, 9 aa, Homo Sapiens
YLGPHIASV

SEQ ID NO: 11525 - protein, 9 aa, Homo Sapiens
YLHDFLKYL

SEQ ID NO: 11526 - protein, 9 aa, Homo Sapiens
YLHNQGIGV

SEQ ID NO: 11527 - protein, 9 aa, Homo Sapiens
YLHSQVVSV

SEQ ID NO: 11528 - protein, 9 aa, Homo Sapiens
YLHSYLTYI

SEQ ID NO: 11529 - protein, 9 aa, Homo Sapiens
YLIARVMLL

SEQ ID NO: 11530 - protein, 9 aa, Homo Sapiens
YLIKDIRFL

SEQ ID NO: 11531 - protein, 9 aa, Homo Sapiens
YLIKYIAIV

SEQ ID NO: 11532 - protein, 9 aa, Homo Sapiens
YLINEIDRI

SEQ ID NO: 11533 - protein, 9 aa, Homo Sapiens
YLITLLEHL

SEQ ID NO: 11534 - protein, 9 aa, Homo Sapiens
YLITSVELL

SEQ ID NO: 11535 - protein, 9 aa, Homo Sapiens
YLKDFFSNV

SEQ ID NO: 11536 - protein, 9 aa, Homo Sapiens
YLKDLIEEV

SEQ ID NO: 11537 - protein, 9 aa, Homo Sapiens
YLKEILEQL

SEQ ID NO: 11538 - protein, 9 aa, Homo Sapiens
YLLDLHSYL

SEQ ID NO: 11539 - protein, 9 aa, Homo Sapiens
YLLDLLRLP

SEQ ID NO: 11540 - protein, 9 aa, Homo Sapiens
YLLDYPNNL

SEQ ID NO: 11541 - protein, 9 aa, Homo Sapiens
YLLESVNKL

SEQ ID NO: 11542 - protein, 9 aa, Homo Sapiens
YLLEWIEMA

SEQ ID NO: 11543 - protein, 9 aa, Homo Sapiens
YLLPAIVHI

SEQ ID NO: 11544 - protein, 9 aa, Homo Sapiens
YLLPLLQRL

SEQ ID NO: 11545 - protein, 9 aa, Homo Sapiens
YLLPYENLL

SEQ ID NO: 11546 - protein, 9 aa, Homo Sapiens
YLLQRAVEV

SEQ ID NO: 11547 - protein, 9 aa, Homo Sapiens
YLLSYIQSI

SEQ ID NO: 11548 - protein, 9 aa, Homo Sapiens
YLNDGLWHM

SEQ ID NO: 11549 - protein, 9 aa, Homo Sapiens
YLNDLHEVL

SEQ ID NO: 11550 - protein, 9 aa, Homo Sapiens
YLNDLIHSV

SEQ ID NO: 11551 - protein, 9 aa, Homo Sapiens
YLNEWLQIL

SEQ ID NO: 11552 - protein, 9 aa, Homo Sapiens
YLNHLIQGL

SEQ ID NO: 11553 - protein, 9 aa, Homo Sapiens
YLNSILQVL

SEQ ID NO: 11554 - protein, 9 aa, Homo Sapiens
YLNVQVKEL

SEQ ID NO: 11555 - protein, 9 aa, Homo Sapiens
YLQARFPQL

SEQ ID NO: 11556 - protein, 9 aa, Homo Sapiens
YLQDVIMQV

SEQ ID NO: 11557 - protein, 9 aa, Homo Sapiens
YLQEIQTQL

SEQ ID NO: 11558 - protein, 9 aa, Homo Sapiens
YLQIHPQEL

SEQ ID NO: 11559 - protein, 9 aa, Homo Sapiens
YLQILIEQL

SEQ ID NO: 11560 - protein, 9 aa, Homo Sapiens
YLQNWSHVL

SEQ ID NO: 11561 - protein, 9 aa, Homo Sapiens
YLQPFLAKL

SEQ ID NO: 11562 - protein, 9 aa, Homo Sapiens
YLQSITPCL

SEQ ID NO: 11563 - protein, 9 aa, Homo Sapiens
YLRELLTTM

SEQ ID NO: 11564 - protein, 9 aa, Homo Sapiens
YLRIDLERL

SEQ ID NO: 11565 - protein, 9 aa, Homo Sapiens
YLRLFQENL

SEQ ID NO: 11566 - protein, 9 aa, Homo Sapiens
YLRNLTWTL

SEQ ID NO: 11567 - protein, 9 aa, Homo Sapiens
YLRTLINEL

SEQ ID NO: 11568 - protein, 9 aa, Homo Sapiens
YLSGIIVTL

SEQ ID NO: 11569 - protein, 9 aa, Homo Sapiens
YLSKIIPAL

SEQ ID NO: 11570 - protein, 9 aa, Homo Sapiens
YLSPKLWAL

SEQ ID NO: 11571 - protein, 9 aa, Homo Sapiens
YLSSLQPRL

SEQ ID NO: 11572 - protein, 9 aa, Homo Sapiens
YLSVKIWDL

SEQ ID NO: 11573 - protein, 9 aa, Homo Sapiens
YLTAEILEL

SEQ ID NO: 11574 - protein, 9 aa, Homo Sapiens
YLTAEVLEL

SEQ ID NO: 11575 - protein, 9 aa, Homo Sapiens
YLTDLQVSL

SEQ ID NO: 11576 - protein, 9 aa, Homo Sapiens
YLTDRVMTV

SEQ ID NO: 11577 - protein, 9 aa, Homo Sapiens
YLTEVFLHV

SEQ ID NO: 11578 - protein, 9 aa, Homo Sapiens
YLTPLILTL

SEQ ID NO: 11579 - protein, 9 aa, Homo Sapiens
YLVPELDGV

SEQ ID NO: 11580 - protein, 9 aa, Homo Sapiens
YLVVKIEKV

SEQ ID NO: 11581 - protein, 9 aa, Homo Sapiens
YLVYILNEL

SEQ ID NO: 11582 - protein, 9 aa, Homo Sapiens
YLYDRLLRI

SEQ ID NO: 11583 - protein, 9 aa, Homo Sapiens
YLYFFRVLV

SEQ ID NO: 11584 - protein, 9 aa, Homo Sapiens
YLYPDITRL

SEQ ID NO: 11585 - protein, 9 aa, Homo Sapiens
YMAELIERL

SEQ ID NO: 11586 - protein, 9 aa, Homo Sapiens
YMIAHITGL

SEQ ID NO: 11587 - protein, 9 aa, Homo Sapiens
YMIDNVILL

SEQ ID NO: 11588 - protein, 9 aa, Homo Sapiens
YMLEHVITL

SEQ ID NO: 11589 - protein, 9 aa, Homo Sapiens
YMVHIQVTL

SEQ ID NO: 11590 - protein, 9 aa, Homo Sapiens
YQEEAIPAL

SEQ ID NO: 11591 - protein, 9 aa, Homo Sapiens
YQNIWNINL

SEQ ID NO: 11592 - protein, 9 aa, Homo Sapiens
YQNQEIHNL

SEQ ID NO: 11593 - protein, 9 aa, Homo Sapiens
YQVGVHYEL

SEQ ID NO: 11594 - protein, 9 aa, Homo Sapiens
YQYPVIIHL

SEQ ID NO: 11595 - protein, 9 aa, Homo Sapiens
YSVDRLYEL

SEQ ID NO: 11596 - protein, 9 aa, Homo Sapiens
YTFDPVTKV

SEQ ID NO: 11597 - protein, 9 aa, Homo Sapiens
YTFSEPFHL

SEQ ID NO: 11598 - protein, 9 aa, Homo Sapiens
YTTDFIFNL

SEQ ID NO: 11599 - protein, 9 aa, Homo Sapiens
YTTDFIYQL

SEQ ID NO: 11600 - protein, 9 aa, Homo Sapiens
YTWEEVFRV

SEQ ID NO: 11601 - protein, 9 aa, Homo Sapiens
YVAELIQQL

SEQ ID NO: 11602 - protein, 9 aa, Homo Sapiens
YVLEGLKSV

SEQ ID NO: 11603 - protein, 9 aa, Homo Sapiens
YVQALIFRL

SEQ ID NO: 11604 - protein, 9 aa, Homo Sapiens
YVQDFLNHL

SEQ ID NO: 11605 - protein, 9 aa, Homo Sapiens
YVSPKQFSV

SEQ ID NO: 11606 - protein, 9 aa, Homo Sapiens
YVTEELPQL

SEQ ID NO: 11607 - protein, 9 aa, Homo Sapiens
YVVPFVAKV

SEQ ID NO: 11608 - protein, 9 aa, Homo Sapiens
YVYEYLLHV

SEQ ID NO: 11609 - protein, 10 aa, Homo Sapiens
AIIDGKIFCV

SEQ ID NO: 11610 - protein, 10 aa, Homo Sapiens
AISGVPVLGF

SEQ ID NO: 11611 - protein, 10 aa, Homo Sapiens
ALADGVPVAL

SEQ ID NO: 11612 - protein, 10 aa, Homo Sapiens
ALFPAPLAQI

SEQ ID NO: 11613 - protein, 10 aa, Homo Sapiens
ALIDEQILCV

SEQ ID NO: 11614 - protein, 10 aa, Homo Sapiens
ALLDQLHTLL

SEQ ID NO: 11615 - protein, 10 aa, Homo Sapiens
ALLETNPYLL

SEQ ID NO: 11616 - protein, 10 aa, Homo Sapiens
ALLSGQLNTL

SEQ ID NO: 11617 - protein, 10 aa, Homo Sapiens
ALNEVGIYKL

SEQ ID NO: 11618 - protein, 10 aa, Homo Sapiens
ALNPAALTAL

SEQ ID NO: 11619 - protein, 10 aa, Homo Sapiens
ALNPVANFHL

SEQ ID NO: 11620 - protein, 10 aa, Homo Sapiens
ALSDLALHFL

SEQ ID NO: 11621 - protein, 10 aa, Homo Sapiens
ALTGIPLPLI

SEQ ID NO: 11622 - protein, 10 aa, Homo Sapiens
ALYPGQLVQL

SEQ ID NO: 11623 - protein, 10 aa, Homo Sapiens
ALYTGFSILV

SEQ ID NO: 11624 - protein, 10 aa, Homo Sapiens
AMFDHIPVGV

SEQ ID NO: 11625 - protein, 10 aa, Homo Sapiens
AMFNDYNFVF

SEQ ID NO: 11626 - protein, 10 aa, Homo Sapiens
AVFDKTLAEL

SEQ ID NO: 11627 - protein, 10 aa, Homo Sapiens
FLAEHPNVTL

SEQ ID NO: 11628 - protein, 10 aa, Homo Sapiens
FLAERLYAEV

SEQ ID NO: 11629 - protein, 10 aa, Homo Sapiens
FLDPNARPLV

SEQ ID NO: 11630 - protein, 10 aa, Homo Sapiens
FLFASTILHL

SEQ ID NO: 11631 - protein, 10 aa, Homo Sapiens
FLFDGSPTYV

SEQ ID NO: 11632 - protein, 10 aa, Homo Sapiens
FLFDNDFPAL

SEQ ID NO: 11633 - protein, 10 aa, Homo Sapiens
FLIEEQKIVV

SEQ ID NO: 11634 - protein, 10 aa, Homo Sapiens
FLLDGFPRTV

SEQ ID NO: 11635 - protein, 10 aa, Homo Sapiens
FLLDGKVLSL

SEQ ID NO: 11636 - protein, 10 aa, Homo Sapiens
FLLDSSLRKL

SEQ ID NO: 11637 - protein, 10 aa, Homo Sapiens
FLLEPGNLEV

SEQ ID NO: 11638 - protein, 10 aa, Homo Sapiens
FLLPDGLVRL

SEQ ID NO: 11639 - protein, 10 aa, Homo Sapiens
FLLPHPGLKV

SEQ ID NO: 11640 - protein, 10 aa, Homo Sapiens
FLLPHPGLQV

SEQ ID NO: 11641 - protein, 10 aa, Homo Sapiens
FLLPIKTVGV

SEQ ID NO: 11642 - protein, 10 aa, Homo Sapiens
FLLPTGLSSL

SEQ ID NO: 11643 - protein, 10 aa, Homo Sapiens
FLLSLRGAGA

SEQ ID NO: 11644 - protein, 10 aa, Homo Sapiens
FLQEAQVPFL

SEQ ID NO: 11645 - protein, 10 aa, Homo Sapiens
FLQEGDLISA

SEQ ID NO: 11646 - protein, 10 aa, Homo Sapiens
FLSDGTIISV

SEQ ID NO: 11647 - protein, 10 aa, Homo Sapiens
FLWDEGFHQL

SEQ ID NO: 11648 - protein, 10 aa, Homo Sapiens
FMFDEKLVTV

SEQ ID NO: 11649 - protein, 10 aa, Homo Sapiens
FMIEIAGVKL

SEQ ID NO: 11650 - protein, 10 aa, Homo Sapiens
FMYNFQLVTL

SEQ ID NO: 11651 - protein, 10 aa, Homo Sapiens
GILGIQPPSV

SEQ ID NO: 11652 - protein, 10 aa, Homo Sapiens
GLFSNDIPHV

SEQ ID NO: 11653 - protein, 10 aa, Homo Sapiens
GLGEDIIHQL

SEQ ID NO: 11654 - protein, 10 aa, Homo Sapiens
GLIDVKPLGV

SEQ ID NO: 11655 - protein, 10 aa, Homo Sapiens
GLIEDYEALL

SEQ ID NO: 11656 - protein, 10 aa, Homo Sapiens
GLIGVGLINV

SEQ ID NO: 11657 - protein, 10 aa, Homo Sapiens
GLLDPSVFHV

SEQ ID NO: 11658 - protein, 10 aa, Homo Sapiens
GLLPVPVPAV

SEQ ID NO: 11659 - protein, 10 aa, Homo Sapiens
GLSPVTNLTV

SEQ ID NO: 11660 - protein, 10 aa, Homo Sapiens
GLVGYYIFRV

SEQ ID NO: 11661 - protein, 10 aa, Homo Sapiens
GLWSGPLPRV

SEQ ID NO: 11662 - protein, 10 aa, Homo Sapiens
GLYQEILAQL

SEQ ID NO: 11663 - protein, 10 aa, Homo Sapiens
GVIDGHIYAV

SEQ ID NO: 11664 - protein, 10 aa, Homo Sapiens
HLFSGHLSTL

SEQ ID NO: 11665 - protein, 10 aa, Homo Sapiens
ILAPCKLETV

SEQ ID NO: 11666 - protein, 10 aa, Homo Sapiens
ILFEEYQFQA

SEQ ID NO: 11667 - protein, 10 aa, Homo Sapiens
ILLGNYCVAV

SEQ ID NO: 11668 - protein, 10 aa, Homo Sapiens
ILLPDNVHYV

SEQ ID NO: 11669 - protein, 10 aa, Homo Sapiens
ILNPIFRQNL

SEQ ID NO: 11670 - protein, 10 aa, Homo Sapiens
ILNSLYNENL

SEQ ID NO: 11671 - protein, 10 aa, Homo Sapiens
ILQDLTFVHL

SEQ ID NO: 11672 - protein, 10 aa, Homo Sapiens
ILYDIPDIRL

SEQ ID NO: 11673 - protein, 10 aa, Homo Sapiens
ILYNGLIEEL

SEQ ID NO: 11674 - protein, 10 aa, Homo Sapiens
IQLTQMSLQL

SEQ ID NO: 11675 - protein, 10 aa, Homo Sapiens
KLADIQIEQL

SEQ ID NO: 11676 - protein, 10 aa, Homo Sapiens
KLFDIFSQQV

SEQ ID NO: 11677 - protein, 10 aa, Homo Sapiens
KLFEPYVVHV

SEQ ID NO: 11678 - protein, 10 aa, Homo Sapiens
KLLDAYLLYI

SEQ ID NO: 11679 - protein, 10 aa, Homo Sapiens
KLLDIPGLEV

SEQ ID NO: 11680 - protein, 10 aa, Homo Sapiens
KLLDPEDISV

SEQ ID NO: 11681 - protein, 10 aa, Homo Sapiens
KLLEESIANL

SEQ ID NO: 11682 - protein, 10 aa, Homo Sapiens
KLLEIDIDGV

SEQ ID NO: 11683 - protein, 10 aa, Homo Sapiens
KLLEVQILEV

SEQ ID NO: 11684 - protein, 10 aa, Homo Sapiens
KLMDLDVEQL

SEQ ID NO: 11685 - protein, 10 aa, Homo Sapiens
KLQDAEIARL

SEQ ID NO: 11686 - protein, 10 aa, Homo Sapiens
KLWDIINVNI

SEQ ID NO: 11687 - protein, 10 aa, Homo Sapiens
KLWEMDNMLI

SEQ ID NO: 11688 - protein, 10 aa, Homo Sapiens
KLYDIDVAKV

SEQ ID NO: 11689 - protein, 10 aa, Homo Sapiens
KMLDEILLQL

SEQ ID NO: 11690 - protein, 10 aa, Homo Sapiens
KMYEEFLSKV

SEQ ID NO: 11691 - protein, 10 aa, Homo Sapiens
KVFDPVPVGV

SEQ ID NO: 11692 - protein, 10 aa, Homo Sapiens
KVLNLVLPNL

SEQ ID NO: 11693 - protein, 10 aa, Homo Sapiens
LASALAGLIA

SEQ ID NO: 11694 - protein, 10 aa, Homo Sapiens
LGPLLAGLIS

SEQ ID NO: 11695 - protein, 10 aa, Homo Sapiens
LILDRMLPEL

SEQ ID NO: 11696 - protein, 10 aa, Homo Sapiens
LIMGGTLLAL

SEQ ID NO: 11697 - protein, 10 aa, Homo Sapiens
LIYPWVHVVI

SEQ ID NO: 11698 - protein, 10 aa, Homo Sapiens
LLFEGEKITI

SEQ ID NO: 11699 - protein, 10 aa, Homo Sapiens
LLFPHPVNQV

SEQ ID NO: 11700 - protein, 10 aa, Homo Sapiens
LLKEIKDILK

SEQ ID NO: 11701 - protein, 10 aa, Homo Sapiens
LLLDTEGFVK

SEQ ID NO: 11702 - protein, 10 aa, Homo Sapiens
LLLDVPTAAV

SEQ ID NO: 11703 - protein, 10 aa, Homo Sapiens
LLLDVTPLSL

SEQ ID NO: 11704 - protein, 10 aa, Homo Sapiens
LLLPTGVFQV

SEQ ID NO: 11705 - protein, 10 aa, Homo Sapiens
LLPDQPPYHL

SEQ ID NO: 11706 - protein, 10 aa, Homo Sapiens
LLVSSWDTSV

SEQ ID NO: 11707 - protein, 10 aa, Homo Sapiens
LLYQGPHNTL

SEQ ID NO: 11708 - protein, 10 aa, Homo Sapiens
LVIVSALTFI

SEQ ID NO: 11709 - protein, 10 aa, Homo Sapiens
MLLEIPYMAA

SEQ ID NO: 11710 - protein, 10 aa, Homo Sapiens
MLLPGPLHSL

SEQ ID NO: 11711 - protein, 10 aa, Homo Sapiens
MLLSVPLLLG

SEQ ID NO: 11712 - protein, 10 aa, Homo Sapiens
NLFDLGGQYL

SEQ ID NO: 11713 - protein, 10 aa, Homo Sapiens
NLFEWHFTVR

SEQ ID NO: 11714 - protein, 10 aa, Homo Sapiens
NLIDLDDLYV

SEQ ID NO: 11715 - protein, 10 aa, Homo Sapiens
NLLSDYGYHL

SEQ ID NO: 11716 - protein, 10 aa, Homo Sapiens
QLLPGGLQGL

SEQ ID NO: 11717 - protein, 10 aa, Homo Sapiens
QLYDLTLEYL

SEQ ID NO: 11718 - protein, 10 aa, Homo Sapiens
QLYRGLGGQL

SEQ ID NO: 11719 - protein, 10 aa, Homo Sapiens
QVFPGLLERV

SEQ ID NO: 11720 - protein, 10 aa, Homo Sapiens
RIADGLPVAV

SEQ ID NO: 11721 - protein, 10 aa, Homo Sapiens
RLFNDPVAMV

SEQ ID NO: 11722 - protein, 10 aa, Homo Sapiens
RLLDLENIQI

SEQ ID NO: 11723 - protein, 10 aa, Homo Sapiens
RLLEFELAQL

SEQ ID NO: 11724 - protein, 10 aa, Homo Sapiens
RLLEGYEIYV

SEQ ID NO: 11725 - protein, 10 aa, Homo Sapiens
RLMMDPLTGL

SEQ ID NO: 11726 - protein, 10 aa, Homo Sapiens
RLYPEGLAQL

SEQ ID NO: 11727 - protein, 10 aa, Homo Sapiens
RLYPWGVVEV

SEQ ID NO: 11728 - protein, 10 aa, Homo Sapiens
RMFADDLHNL

SEQ ID NO: 11729 - protein, 10 aa, Homo Sapiens
RVAQLEQVYI

SEQ ID NO: 11730 - protein, 10 aa, Homo Sapiens
SIYGGFLLGV

SEQ ID NO: 11731 - protein, 10 aa, Homo Sapiens
SLADLQNDEV

SEQ ID NO: 11732 - protein, 10 aa, Homo Sapiens
SLAELKGFEV

SEQ ID NO: 11733 - protein, 10 aa, Homo Sapiens
SLAEVAGLQV

SEQ ID NO: 11734 - protein, 10 aa, Homo Sapiens
SLHEWQDINL

SEQ ID NO: 11735 - protein, 10 aa, Homo Sapiens
SLINVGLISV

SEQ ID NO: 11736 - protein, 10 aa, Homo Sapiens
SLLDGVVEKL

SEQ ID NO: 11737 - protein, 10 aa, Homo Sapiens
SLLDMSLVKL

SEQ ID NO: 11738 - protein, 10 aa, Homo Sapiens
SLLDRFLATV

SEQ ID NO: 11739 - protein, 10 aa, Homo Sapiens
SLLELPHPLL

SEQ ID NO: 11740 - protein, 10 aa, Homo Sapiens
SLLGGDVVSV

SEQ ID NO: 11741 - protein, 10 aa, Homo Sapiens
SLLPEGPPAI

SEQ ID NO: 11742 - protein, 10 aa, Homo Sapiens
SLMGPVVHEV

SEQ ID NO: 11743 - protein, 10 aa, Homo Sapiens
SLNQAALYRL

SEQ ID NO: 11744 - protein, 10 aa, Homo Sapiens
SLYDWNVKLL

SEQ ID NO: 11745 - protein, 10 aa, Homo Sapiens
SLYPQFMFHL

SEQ ID NO: 11746 - protein, 10 aa, Homo Sapiens
SMLPGFLHRL

SEQ ID NO: 11747 - protein, 10 aa, Homo Sapiens
SVAVWSGVNV

SEQ ID NO: 11748 - protein, 10 aa, Homo Sapiens
TLAYDKGWRV

SEQ ID NO: 11749 - protein, 10 aa, Homo Sapiens
TLFPGKVHSL

SEQ ID NO: 11750 - protein, 10 aa, Homo Sapiens
TLHGLQQYYV

SEQ ID NO: 11751 - protein, 10 aa, Homo Sapiens
TLIELLLPKL

SEQ ID NO: 11752 - protein, 10 aa, Homo Sapiens
TLLEDGTFKV

SEQ ID NO: 11753 - protein, 10 aa, Homo Sapiens
TLLPQGLPGL

SEQ ID NO: 11754 - protein, 10 aa, Homo Sapiens
TLNQIDSVKV

SEQ ID NO: 11755 - protein, 10 aa, Homo Sapiens
TLWEIAKAEV

SEQ ID NO: 11756 - protein, 10 aa, Homo Sapiens
TLYFSYTHMV

SEQ ID NO: 11757 - protein, 10 aa, Homo Sapiens
VAAKKIIIQR

SEQ ID NO: 11758 - protein, 10 aa, Homo Sapiens
VFGVIISIHG

SEQ ID NO: 11759 - protein, 10 aa, Homo Sapiens
VINDVRDIFL

SEQ ID NO: 11760 - protein, 10 aa, Homo Sapiens
VIWEHDYTSV

SEQ ID NO: 11761 - protein, 10 aa, Homo Sapiens
VLFDDELLMV

SEQ ID NO: 11762 - protein, 10 aa, Homo Sapiens
VLFDVSIMAV

SEQ ID NO: 11763 - protein, 10 aa, Homo Sapiens
VLLEPFVHQV

SEQ ID NO: 11764 - protein, 10 aa, Homo Sapiens
VLLGHILPGL

SEQ ID NO: 11765 - protein, 10 aa, Homo Sapiens
VLWDRTFSLF

SEQ ID NO: 11766 - protein, 10 aa, Homo Sapiens
VPGLYTLEEL

SEQ ID NO: 11767 - protein, 10 aa, Homo Sapiens
YIFEEPFTIR

SEQ ID NO: 11768 - protein, 10 aa, Homo Sapiens
YLAEKYEWDV

SEQ ID NO: 11769 - protein, 10 aa, Homo Sapiens
YLAELVTPIL

SEQ ID NO: 11770 - protein, 10 aa, Homo Sapiens
YLDEYIARMV

SEQ ID NO: 11771 - protein, 10 aa, Homo Sapiens
YLHLDYNFNL

SEQ ID NO: 11772 - protein, 10 aa, Homo Sapiens
YLINFEIRSL

SEQ ID NO: 11773 - protein, 10 aa, Homo Sapiens
YLIPDIDLKL

SEQ ID NO: 11774 - protein, 10 aa, Homo Sapiens
YLITGNLEKL

SEQ ID NO: 11775 - protein, 10 aa, Homo Sapiens
YLLDLHSYLL

SEQ ID NO: 11776 - protein, 10 aa, Homo Sapiens
YLLDMPLWYL

SEQ ID NO: 11777 - protein, 10 aa, Homo Sapiens
YLLEEKIASL

SEQ ID NO: 11778 - protein, 10 aa, Homo Sapiens
YLLQEPPRTV

SEQ ID NO: 11779 - protein, 10 aa, Homo Sapiens
YLLTHPPPIM

SEQ ID NO: 11780 - protein, 10 aa, Homo Sapiens
YLNHIEPLKI

SEQ ID NO: 11781 - protein, 10 aa, Homo Sapiens
YLQEVPILTL

SEQ ID NO: 11782 - protein, 10 aa, Homo Sapiens
YLTNEGIQYL

SEQ ID NO: 11783 - protein, 10 aa, Homo Sapiens
YLYEEYLQAF

SEQ ID NO: 11784 - protein, 10 aa, Homo Sapiens
YMIDNVILLI

SEQ ID NO: 11785 - protein, 10 aa, Homo Sapiens
YQILDGIHYL

SEQ ID NO: 11786 - protein, 10 aa, Homo Sapiens
YVMEYRELFL

SEQ ID NO: 11787 - protein, 11 aa, Homo Sapiens
ALADKELLPSV

SEQ ID NO: 11788 - protein, 11 aa, Homo Sapiens
ALAEALKEVSL

SEQ ID NO: 11789 - protein, 11 aa, Homo Sapiens
ALEEYGPELHV

SEQ ID NO: 11790 - protein, 11 aa, Homo Sapiens
ALFARPDLLLL

SEQ ID NO: 11791 - protein, 11 aa, Homo Sapiens
ALFASGLIHRV

SEQ ID NO: 11792 - protein, 11 aa, Homo Sapiens
ALFEAAREVTL

SEQ ID NO: 11793 - protein, 11 aa, Homo Sapiens
ALFEESGLIRI

SEQ ID NO: 11794 - protein, 11 aa, Homo Sapiens
ALFPHLLQPVL

SEQ ID NO: 11795 - protein, 11 aa, Homo Sapiens
ALGLVVGSHLL

SEQ ID NO: 11796 - protein, 11 aa, Homo Sapiens
ALGNWNPQNAV

SEQ ID NO: 11797 - protein, 11 aa, Homo Sapiens
ALIEAEKVAQV

SEQ ID NO: 11798 - protein, 11 aa, Homo Sapiens
ALILEPSLYTV

SEQ ID NO: 11799 - protein, 11 aa, Homo Sapiens
ALINEEAILNL

SEQ ID NO: 11800 - protein, 11 aa, Homo Sapiens
ALIPETTTLTV

SEQ ID NO: 11801 - protein, 11 aa, Homo Sapiens
ALLAGSEYLKL

SEQ ID NO: 11802 - protein, 11 aa, Homo Sapiens
ALLDAAGVASL

SEQ ID NO: 11803 - protein, 11 aa, Homo Sapiens
ALLDKLYALGL

SEQ ID NO: 11804 - protein, 11 aa, Homo Sapiens
ALLENMEGLFL

SEQ ID NO: 11805 - protein, 11 aa, Homo Sapiens
ALLETSLLHHF

SEQ ID NO: 11806 - protein, 11 aa, Homo Sapiens
ALLLPTGVFQV

SEQ ID NO: 11807 - protein, 11 aa, Homo Sapiens
ALNEEAGRLLL

SEQ ID NO: 11808 - protein, 11 aa, Homo Sapiens
ALSEAMGLFCL

SEQ ID NO: 11809 - protein, 11 aa, Homo Sapiens
ALSPNYDHVVL

SEQ ID NO: 11810 - protein, 11 aa, Homo Sapiens
ALVAVPLGMTV

SEQ ID NO: 11811 - protein, 11 aa, Homo Sapiens
AMASLGALALL

SEQ ID NO: 11812 - protein, 11 aa, Homo Sapiens
AQLDPEALGNI

SEQ ID NO: 11813 - protein, 11 aa, Homo Sapiens
AVMAPRTLVLL

SEQ ID NO: 11814 - protein, 11 aa, Homo Sapiens
DAAHGAWILII

SEQ ID NO: 11815 - protein, 11 aa, Homo Sapiens
FLADPSAFVAA

SEQ ID NO: 11816 - protein, 11 aa, Homo Sapiens
FLAELPGSLSL

SEQ ID NO: 11817 - protein, 11 aa, Homo Sapiens
FLASESLIKQI

SEQ ID NO: 11818 - protein, 11 aa, Homo Sapiens
FLFDGSPTYVL

SEQ ID NO: 11819 - protein, 11 aa, Homo Sapiens
FLFVDPELVSA

SEQ ID NO: 11820 - protein, 11 aa, Homo Sapiens
FLLDKPQDLSI

SEQ ID NO: 11821 - protein, 11 aa, Homo Sapiens
FLLDPYKYMTL

SEQ ID NO: 11822 - protein, 11 aa, Homo Sapiens
FLLEQEKTQAL

SEQ ID NO: 11823 - protein, 11 aa, Homo Sapiens
FLLPKVQSIQL

SEQ ID NO: 11824 - protein, 11 aa, Homo Sapiens
FLNSVTDIHQL

SEQ ID NO: 11825 - protein, 11 aa, Homo Sapiens
FLWDVPSNWTL

SEQ ID NO: 11826 - protein, 11 aa, Homo Sapiens
FMIDASVHPTL

SEQ ID NO: 11827 - protein, 11 aa, Homo Sapiens
FMLPDPQNISL

SEQ ID NO: 11828 - protein, 11 aa, Homo Sapiens
GLADASLLKKV

SEQ ID NO: 11829 - protein, 11 aa, Homo Sapiens
GLADNTVIAKV

SEQ ID NO: 11830 - protein, 11 aa, Homo Sapiens
GLFAHPSLWQL

SEQ ID NO: 11831 - protein, 11 aa, Homo Sapiens
GLIDIENPNRV

SEQ ID NO: 11832 - protein, 11 aa, Homo Sapiens
GLIDTKELEPL

SEQ ID NO: 11833 - protein, 11 aa, Homo Sapiens
GLLDLPFRVGV

SEQ ID NO: 11834 - protein, 11 aa, Homo Sapiens
GLLDPGMLVNI

SEQ ID NO: 11835 - protein, 11 aa, Homo Sapiens
GLLEARGILGL

SEQ ID NO: 11836 - protein, 11 aa, Homo Sapiens
GLLPEPNILQL

SEQ ID NO: 11837 - protein, 11 aa, Homo Sapiens
GLLQINDKIAL

SEQ ID NO: 11838 - protein, 11 aa, Homo Sapiens
GLLQQPSALML

SEQ ID NO: 11839 - protein, 11 aa, Homo Sapiens
GLSLEIGENRL

SEQ ID NO: 11840 - protein, 11 aa, Homo Sapiens
GLTSTDLLFHL

SEQ ID NO: 11841 - protein, 11 aa, Homo Sapiens
GLWEIENNPTV

SEQ ID NO: 11842 - protein, 11 aa, Homo Sapiens
GMLDPLEVHLL

SEQ ID NO: 11843 - protein, 11 aa, Homo Sapiens
GMYGKIAVMEL

SEQ ID NO: 11844 - protein, 11 aa, Homo Sapiens
GQSELASRLTL

SEQ ID NO: 11845 - protein, 11 aa, Homo Sapiens
HLFEDAYLLTL

SEQ ID NO: 11846 - protein, 11 aa, Homo Sapiens
HLQEYTSTLLL

SEQ ID NO: 11847 - protein, 11 aa, Homo Sapiens
HVNPYIGLFFF

SEQ ID NO: 11848 - protein, 11 aa, Homo Sapiens
IDVNMGEVLLV

SEQ ID NO: 11849 - protein, 11 aa, Homo Sapiens
IILEPMDLKII

SEQ ID NO: 11850 - protein, 11 aa, Homo Sapiens
IIQDIDDTHVF

SEQ ID NO: 11851 - protein, 11 aa, Homo Sapiens
ILLAEGRLVNL

SEQ ID NO: 11852 - protein, 11 aa, Homo Sapiens
ILLDDTGLAYI

SEQ ID NO: 11853 - protein, 11 aa, Homo Sapiens
ILLSEPGLVKL

SEQ ID NO: 11854 - protein, 11 aa, Homo Sapiens
ILQNEPLPERL

SEQ ID NO: 11855 - protein, 11 aa, Homo Sapiens
IVLPAGALHQV

SEQ ID NO: 11856 - protein, 11 aa, Homo Sapiens
KIIDEDGLLNL

SEQ ID NO: 11857 - protein, 11 aa, Homo Sapiens
KIVNTPEVIRV

SEQ ID NO: 11858 - protein, 11 aa, Homo Sapiens
KLFDLDEKLML

SEQ ID NO: 11859 - protein, 11 aa, Homo Sapiens
KLFPKGTIFTA

SEQ ID NO: 11860 - protein, 11 aa, Homo Sapiens
KLFSLQDLLLL

SEQ ID NO: 11861 - protein, 11 aa, Homo Sapiens
KLGDFGLLVEL

SEQ ID NO: 11862 - protein, 11 aa, Homo Sapiens
KLGEFAKVLEL

SEQ ID NO: 11863 - protein, 11 aa, Homo Sapiens
KLIDLSQVMYL

SEQ ID NO: 11864 - protein, 11 aa, Homo Sapiens
KLIEVDDERKL

SEQ ID NO: 11865 - protein, 11 aa, Homo Sapiens
KLLDFGSLSNL

SEQ ID NO: 11866 - protein, 11 aa, Homo Sapiens
KLLNIIDLQFL

SEQ ID NO: 11867 - protein, 11 aa, Homo Sapiens
KLLPDTILEKL

SEQ ID NO: 11868 - protein, 11 aa, Homo Sapiens
KLLSHSLLVTL

SEQ ID NO: 11869 - protein, 11 aa, Homo Sapiens
KLSLVAAMLLL

SEQ ID NO: 11870 - protein, 11 aa, Homo Sapiens
KVINTPEVLRV

SEQ ID NO: 11871 - protein, 11 aa, Homo Sapiens
LIGWENQPTTL

SEQ ID NO: 11872 - protein, 11 aa, Homo Sapiens
LKLDDTERRIK

SEQ ID NO: 11873 - protein, 11 aa, Homo Sapiens
LKLFDRPQELK

SEQ ID NO: 11874 - protein, 11 aa, Homo Sapiens
LLIDDKGTIKL

SEQ ID NO: 11875 - protein, 11 aa, Homo Sapiens
LLLEPGSLYIL

SEQ ID NO: 11876 - protein, 11 aa, Homo Sapiens
LLLPDYYLVTV

SEQ ID NO: 11877 - protein, 11 aa, Homo Sapiens
LLYDLADQLHA

SEQ ID NO: 11878 - protein, 11 aa, Homo Sapiens
LVLDPPTDLKF

SEQ ID NO: 11879 - protein, 11 aa, Homo Sapiens
LVLTQEQLHQL

SEQ ID NO: 11880 - protein, 11 aa, Homo Sapiens
MALDIDERHLL

SEQ ID NO: 11881 - protein, 11 aa, Homo Sapiens
NLITYDDRFNL

SEQ ID NO: 11882 - protein, 11 aa, Homo Sapiens
NMLDVNGLFTL

SEQ ID NO: 11883 - protein, 11 aa, Homo Sapiens
RILDIDIPMSV

SEQ ID NO: 11884 - protein, 11 aa, Homo Sapiens
RLFDEPQLASL

SEQ ID NO: 11885 - protein, 11 aa, Homo Sapiens
RLFEASDPYQV

SEQ ID NO: 11886 - protein, 11 aa, Homo Sapiens
RLLAEIGAVTL

SEQ ID NO: 11887 - protein, 11 aa, Homo Sapiens
RLLEEGVLRQI

SEQ ID NO: 11888 - protein, 11 aa, Homo Sapiens
RLLEESLLSLI

SEQ ID NO: 11889 - protein, 11 aa, Homo Sapiens
RLLEPAQVQQL

SEQ ID NO: 11890 - protein, 11 aa, Homo Sapiens
RLLEVTNTIRV

SEQ ID NO: 11891 - protein, 11 aa, Homo Sapiens
RLLPPELLRQL

SEQ ID NO: 11892 - protein, 11 aa, Homo Sapiens
RLLPPGAVVAV

SEQ ID NO: 11893 - protein, 11 aa, Homo Sapiens
RLMEPIYLVEI

SEQ ID NO: 11894 - protein, 11 aa, Homo Sapiens
RLNDFASTVRI

SEQ ID NO: 11895 - protein, 11 aa, Homo Sapiens
RLWTPPEDYRL

SEQ ID NO: 11896 - protein, 11 aa, Homo Sapiens
RMLEDRDLFVM

SEQ ID NO: 11897 - protein, 11 aa, Homo Sapiens
RQLEEEGITFV

SEQ ID NO: 11898 - protein, 11 aa, Homo Sapiens
RVLPPSALQSV

SEQ ID NO: 11899 - protein, 11 aa, Homo Sapiens
SLADDSVLERL

SEQ ID NO: 11900 - protein, 11 aa, Homo Sapiens
SLADIAQKLQL

SEQ ID NO: 11901 - protein, 11 aa, Homo Sapiens
SLFNGSHYLDV

SEQ ID NO: 11902 - protein, 11 aa, Homo Sapiens
SLFQGVEFHYV

SEQ ID NO: 11903 - protein, 11 aa, Homo Sapiens
SLLGDDALVQV

SEQ ID NO: 11904 - protein, 11 aa, Homo Sapiens
SLLHLGALYGI

SEQ ID NO: 11905 - protein, 11 aa, Homo Sapiens
SLLNPPETLNL

SEQ ID NO: 11906 - protein, 11 aa, Homo Sapiens
SLLPPDALVGL

SEQ ID NO: 11907 - protein, 11 aa, Homo Sapiens
SLLPPTALVGL

SEQ ID NO: 11908 - protein, 11 aa, Homo Sapiens
SLLSDYDILSL

SEQ ID NO: 11909 - protein, 11 aa, Homo Sapiens
SLLSPGLLPHL

SEQ ID NO: 11910 - protein, 11 aa, Homo Sapiens
SLMDPNKFLLL

SEQ ID NO: 11911 - protein, 11 aa, Homo Sapiens
SLQDVVKGLFV

SEQ ID NO: 11912 - protein, 11 aa, Homo Sapiens
SLSSEFKNITV

SEQ ID NO: 11913 - protein, 11 aa, Homo Sapiens
SLVENIERLKV

SEQ ID NO: 11914 - protein, 11 aa, Homo Sapiens
SLWEDYPHVHL

SEQ ID NO: 11915 - protein, 11 aa, Homo Sapiens
SMADIPLGFGV

SEQ ID NO: 11916 - protein, 11 aa, Homo Sapiens
SVLPESTLFRL

SEQ ID NO: 11917 - protein, 11 aa, Homo Sapiens
TIIDLPGITRV

SEQ ID NO: 11918 - protein, 11 aa, Homo Sapiens
TLADYLHLLQA

SEQ ID NO: 11919 - protein, 11 aa, Homo Sapiens
TLFHDPWKLLI

SEQ ID NO: 11920 - protein, 11 aa, Homo Sapiens
TLIDLPGITKV

SEQ ID NO: 11921 - protein, 11 aa, Homo Sapiens
TLLAAEFLKQV

SEQ ID NO: 11922 - protein, 11 aa, Homo Sapiens
TLLDAGLPQKV

SEQ ID NO: 11923 - protein, 11 aa, Homo Sapiens
TLLEEIRDLAL

SEQ ID NO: 11924 - protein, 11 aa, Homo Sapiens
TLLEISDLNEL

SEQ ID NO: 11925 - protein, 11 aa, Homo Sapiens
TLQEFLERIHL

SEQ ID NO: 11926 - protein, 11 aa, Homo Sapiens
TLYDIAHTPGV

SEQ ID NO: 11927 - protein, 11 aa, Homo Sapiens
VLFDVTGQVRL

SEQ ID NO: 11928 - protein, 11 aa, Homo Sapiens
VLFEHAVGYAL

SEQ ID NO: 11929 - protein, 11 aa, Homo Sapiens
VLIDVGTGYYV

SEQ ID NO: 11930 - protein, 11 aa, Homo Sapiens
VLLAEGRLLNL

SEQ ID NO: 11931 - protein, 11 aa, Homo Sapiens
VLNEAAQILRL

SEQ ID NO: 11932 - protein, 11 aa, Homo Sapiens
WLIEDGKVVTV

SEQ ID NO: 11933 - protein, 11 aa, Homo Sapiens
YIMEPSIFNTL

SEQ ID NO: 11934 - protein, 11 aa, Homo Sapiens
YLFDVQRNNIA

SEQ ID NO: 11935 - protein, 11 aa, Homo Sapiens
YLISQVEGHQV

SEQ ID NO: 11936 - protein, 11 aa, Homo Sapiens
YLLDIGCGTGL

SEQ ID NO: 11937 - protein, 11 aa, Homo Sapiens
YLLNDASLISV

SEQ ID NO: 11938 - protein, 11 aa, Homo Sapiens
YLNETFSELRL

SEQ ID NO: 11939 - protein, 11 aa, Homo Sapiens
YLSDPCPGLYL

SEQ ID NO: 11940 - protein, 11 aa, Homo Sapiens
YQFDKVGILTL

SEQ ID NO: 11941 - protein, 8 aa, Homo Sapiens
AADIDHKL

SEQ ID NO: 11942 - protein, 8 aa, Homo Sapiens
AIEHLDKI

SEQ ID NO: 11943 - protein, 8 aa, Homo Sapiens
APFPEVFG

SEQ ID NO: 11944 - protein, 8 aa, Homo Sapiens
ASGLIHRV

SEQ ID NO: 11945 - protein, 8 aa, Homo Sapiens
DTNADKQL

SEQ ID NO: 11946 - protein, 8 aa, Homo Sapiens
ELEKRVME

SEQ ID NO: 11947 - protein, 8 aa, Homo Sapiens
ESPPEINT

SEQ ID NO: 11948 - protein, 8 aa, Homo Sapiens
EVDDEALE

SEQ ID NO: 11949 - protein, 8 aa, Homo Sapiens
FDKTLAEL

SEQ ID NO: 11950 - protein, 8 aa, Homo Sapiens
FGGHIRSV

SEQ ID NO: 11951 - protein, 8 aa, Homo Sapiens
FKGKFKEG

SEQ ID NO: 11952 - protein, 8 aa, Homo Sapiens
FNEKSKEL

SEQ ID NO: 11953 - protein, 8 aa, Homo Sapiens
FQSEEQQQ

SEQ ID NO: 11954 - protein, 8 aa, Homo Sapiens
FSDIPNPI

SEQ ID NO: 11955 - protein, 8 aa, Homo Sapiens
FSEGLIKA

SEQ ID NO: 11956 - protein, 8 aa, Homo Sapiens
GAADIDHK

SEQ ID NO: 11957 - protein, 8 aa, Homo Sapiens
GEVPLTPT

SEQ ID NO: 11958 - protein, 8 aa, Homo Sapiens
ISEFEHRV

SEQ ID NO: 11959 - protein, 8 aa, Homo Sapiens
LMEHIHKL

SEQ ID NO: 11960 - protein, 8 aa, Homo Sapiens
LTGLLLLQ

SEQ ID NO: 11961 - protein, 8 aa, Homo Sapiens
NAVPITPT

SEQ ID NO: 11962 - protein, 8 aa, Homo Sapiens
NVPGEIVE

SEQ ID NO: 11963 - protein, 8 aa, Homo Sapiens
PFPGPIPN

SEQ ID NO: 11964 - protein, 8 aa, Homo Sapiens
QAEIVKRL

SEQ ID NO: 11965 - protein, 8 aa, Homo Sapiens
QEPVLGPV

SEQ ID NO: 11966 - protein, 8 aa, Homo Sapiens
STGDVNVE

SEQ ID NO: 11967 - protein, 8 aa, Homo Sapiens
TEDELQDK

SEQ ID NO: 11968 - protein, 8 aa, Homo Sapiens
TEELAYLK

SEQ ID NO: 11969 - protein, 8 aa, Homo Sapiens
TVGPVQKL

SEQ ID NO: 11970 - protein, 8 aa, Homo Sapiens
VADHIQKV

SEQ ID NO: 11971 - protein, 8 aa, Homo Sapiens
VIGIIKTV

SEQ ID NO: 11972 - protein, 8 aa, Homo Sapiens
VPGEIVES

SEQ ID NO: 11973 - protein, 8 aa, Homo Sapiens
VPPFLQPE

SEQ ID NO: 11974 - protein, 8 aa, Homo Sapiens
VQDGIVKA

SEQ ID NO: 11975 - protein, 8 aa, Homo Sapiens
VSLTACKV

SEQ ID NO: 11976 - protein, 8 aa, Homo Sapiens
VSQINHKL

SEQ ID NO: 11977 - protein, 8 aa, Homo Sapiens
YGVDLHKA

SEQ ID NO: 11978 - protein, 9 aa, Homo Sapiens
AAAAAVDPH

SEQ ID NO: 11979 - protein, 9 aa, Homo Sapiens
AAADITSSL

SEQ ID NO: 11980 - protein, 9 aa, Homo Sapiens
AAADIVNFL

SEQ ID NO: 11981 - protein, 9 aa, Homo Sapiens
AAAGVVHAV

SEQ ID NO: 11982 - protein, 9 aa, Homo Sapiens
AAALIIHHV

SEQ ID NO: 11983 - protein, 9 aa, Homo Sapiens
AAAPTANLL

SEQ ID NO: 11984 - protein, 9 aa, Homo Sapiens
AAFGQLHKV

SEQ ID NO: 11985 - protein, 9 aa, Homo Sapiens
AAGPPLVAA

SEQ ID NO: 11986 - protein, 9 aa, Homo Sapiens
AAGPPTHEV

SEQ ID NO: 11987 - protein, 9 aa, Homo Sapiens
AAIENLNEA

SEQ ID NO: 11988 - protein, 9 aa, Homo Sapiens
AAIKIIRQL

SEQ ID NO: 11989 - protein, 9 aa, Homo Sapiens
AAISQVDRL

SEQ ID NO: 11990 - protein, 9 aa, Homo Sapiens
AASPIITLV

SEQ ID NO: 11991 - protein, 9 aa, Homo Sapiens
AATEIVERV

SEQ ID NO: 11992 - protein, 9 aa, Homo Sapiens
AAVEKLHHL

SEQ ID NO: 11993 - protein, 9 aa, Homo Sapiens
AAVRDISEA

SEQ ID NO: 11994 - protein, 9 aa, Homo Sapiens
ADASLLKKV

SEQ ID NO: 11995 - protein, 9 aa, Homo Sapiens
AGAPVYLAA

SEQ ID NO: 11996 - protein, 9 aa, Homo Sapiens
AGAPVYMAA

SEQ ID NO: 11997 - protein, 9 aa, Homo Sapiens
AIAPIIAAV

SEQ ID NO: 11998 - protein, 9 aa, Homo Sapiens
AIATELAQA

SEQ ID NO: 11999 - protein, 9 aa, Homo Sapiens
AICPNNHEV

SEQ ID NO: 12000 - protein, 9 aa, Homo Sapiens
AIFEYIDRL

SEQ ID NO: 12001 - protein, 9 aa, Homo Sapiens
AIIDHIFAS

SEQ ID NO: 12002 - protein, 9 aa, Homo Sapiens
AIIEYMPLL

SEQ ID NO: 12003 - protein, 9 aa, Homo Sapiens
AIIPYIPTL

SEQ ID NO: 12004 - protein, 9 aa, Homo Sapiens
AIISKLVAL

SEQ ID NO: 12005 - protein, 9 aa, Homo Sapiens
AIKEILTQV

SEQ ID NO: 12006 - protein, 9 aa, Homo Sapiens
AIKELLDTV

SEQ ID NO: 12007 - protein, 9 aa, Homo Sapiens
AIKKELTQI

SEQ ID NO: 12008 - protein, 9 aa, Homo Sapiens
AIPDIINEI

SEQ ID NO: 12009 - protein, 9 aa, Homo Sapiens
AIPERVEEI

SEQ ID NO: 12010 - protein, 9 aa, Homo Sapiens
AISEMTDKL

SEQ ID NO: 12011 - protein, 9 aa, Homo Sapiens
AIVDKVPSV

SEQ ID NO: 12012 - protein, 9 aa, Homo Sapiens
AIVDLIHDI

SEQ ID NO: 12013 - protein, 9 aa, Homo Sapiens
AIVKEIVNI

SEQ ID NO: 12014 - protein, 9 aa, Homo Sapiens
ALADFAELI

SEQ ID NO: 12015 - protein, 9 aa, Homo Sapiens
ALADGVQKV

SEQ ID NO: 12016 - protein, 9 aa, Homo Sapiens
ALAEEVEQV

SEQ ID NO: 12017 - protein, 9 aa, Homo Sapiens
ALASVIMGL

SEQ ID NO: 12018 - protein, 9 aa, Homo Sapiens
ALATLIHQV

SEQ ID NO: 12019 - protein, 9 aa, Homo Sapiens
ALFNGAQKL

SEQ ID NO: 12020 - protein, 9 aa, Homo Sapiens
ALFPGVALL

SEQ ID NO: 12021 - protein, 9 aa, Homo Sapiens
ALGPKPQGL

SEQ ID NO: 12022 - protein, 9 aa, Homo Sapiens
ALIEKLVEL

SEQ ID NO: 12023 - protein, 9 aa, Homo Sapiens
ALIPVINKL

SEQ ID NO: 12024 - protein, 9 aa, Homo Sapiens
ALIRVISKL

SEQ ID NO: 12025 - protein, 9 aa, Homo Sapiens
ALKDEVQEL

SEQ ID NO: 12026 - protein, 9 aa, Homo Sapiens
ALKDKIEKA

SEQ ID NO: 12027 - protein, 9 aa, Homo Sapiens
ALKDLINEA

SEQ ID NO: 12028 - protein, 9 aa, Homo Sapiens
ALKERADSL

SEQ ID NO: 12029 - protein, 9 aa, Homo Sapiens
ALKKALAAA

SEQ ID NO: 12030 - protein, 9 aa, Homo Sapiens
ALKKNLEKI

SEQ ID NO: 12031 - protein, 9 aa, Homo Sapiens
ALKPDLVNV

SEQ ID NO: 12032 - protein, 9 aa, Homo Sapiens
ALKPEVDKL

SEQ ID NO: 12033 - protein, 9 aa, Homo Sapiens
ALMDEVVKA

SEQ ID NO: 12034 - protein, 9 aa, Homo Sapiens
ALPDWCEQL

SEQ ID NO: 12035 - protein, 9 aa, Homo Sapiens
ALPEAIAAL

SEQ ID NO: 12036 - protein, 9 aa, Homo Sapiens
ALPRHLHTA

SEQ ID NO: 12037 - protein, 9 aa, Homo Sapiens
ALSPNNHEV

SEQ ID NO: 12038 - protein, 9 aa, Homo Sapiens
ALSSFAHCL

SEQ ID NO: 12039 - protein, 9 aa, Homo Sapiens
ALSSLIHAL

SEQ ID NO: 12040 - protein, 9 aa, Homo Sapiens
ALTHIDHSL

SEQ ID NO: 12041 - protein, 9 aa, Homo Sapiens
ALVDHVAEL

SEQ ID NO: 12042 - protein, 9 aa, Homo Sapiens
ALVGFCDEV

SEQ ID NO: 12043 - protein, 9 aa, Homo Sapiens
ALVQDLAKA

SEQ ID NO: 12044 - protein, 9 aa, Homo Sapiens
ALYAVIEKA

SEQ ID NO: 12045 - protein, 9 aa, Homo Sapiens
ALYDNVEKL

SEQ ID NO: 12046 - protein, 9 aa, Homo Sapiens
AMASIINRL

SEQ ID NO: 12047 - protein, 9 aa, Homo Sapiens
AMIELVERL

SEQ ID NO: 12048 - protein, 9 aa, Homo Sapiens
AMIKGLQVL

SEQ ID NO: 12049 - protein, 9 aa, Homo Sapiens
AMMAKAEYL

SEQ ID NO: 12050 - protein, 9 aa, Homo Sapiens
AQADLAYQL

SEQ ID NO: 12051 - protein, 9 aa, Homo Sapiens
AQAEAAEQL

SEQ ID NO: 12052 - protein, 9 aa, Homo Sapiens
AQAEDYSQL

SEQ ID NO: 12053 - protein, 9 aa, Homo Sapiens
AQAELAQKL

SEQ ID NO: 12054 - protein, 9 aa, Homo Sapiens
AQAELQHVL

SEQ ID NO: 12055 - protein, 9 aa, Homo Sapiens
AQAEVYKEL

SEQ ID NO: 12056 - protein, 9 aa, Homo Sapiens
AQAFIHNSL

SEQ ID NO: 12057 - protein, 9 aa, Homo Sapiens
AQAGLSSGL

SEQ ID NO: 12058 - protein, 9 aa, Homo Sapiens
AQAHMFVKL

SEQ ID NO: 12059 - protein, 9 aa, Homo Sapiens
AQAKIYWNL

SEQ ID NO: 12060 - protein, 9 aa, Homo Sapiens
AQALINRGV

SEQ ID NO: 12061 - protein, 9 aa, Homo Sapiens
AQALIYAEM

SEQ ID NO: 12062 - protein, 9 aa, Homo Sapiens
AQAMIFCHT

SEQ ID NO: 12063 - protein, 9 aa, Homo Sapiens
AQAPDLQRV

SEQ ID NO: 12064 - protein, 9 aa, Homo Sapiens
AQAPIAAVL

SEQ ID NO: 12065 - protein, 9 aa, Homo Sapiens
AQAPPTAQL

SEQ ID NO: 12066 - protein, 9 aa, Homo Sapiens
AQAPPTFRA

SEQ ID NO: 12067 - protein, 9 aa, Homo Sapiens
AQAQEVFFL

SEQ ID NO: 12068 - protein, 9 aa, Homo Sapiens
AQASFRDGL

SEQ ID NO: 12069 - protein, 9 aa, Homo Sapiens
AQASIKQLV

SEQ ID NO: 12070 - protein, 9 aa, Homo Sapiens
AQCPIVERL

SEQ ID NO: 12071 - protein, 9 aa, Homo Sapiens
AQCTLINFL

SEQ ID NO: 12072 - protein, 9 aa, Homo Sapiens
AQFEHTILL

SEQ ID NO: 12073 - protein, 9 aa, Homo Sapiens
AQFGYYFRV

SEQ ID NO: 12074 - protein, 9 aa, Homo Sapiens
AQFKGTQSL

SEQ ID NO: 12075 - protein, 9 aa, Homo Sapiens
AQFPGACGL

SEQ ID NO: 12076 - protein, 9 aa, Homo Sapiens
AQIDHYLGL

SEQ ID NO: 12077 - protein, 9 aa, Homo Sapiens
AQIDQYVGL

SEQ ID NO: 12078 - protein, 9 aa, Homo Sapiens
AQIEAQNRL

SEQ ID NO: 12079 - protein, 9 aa, Homo Sapiens
AQIELLQLL

SEQ ID NO: 12080 - protein, 9 aa, Homo Sapiens
AQIEVVPSA

SEQ ID NO: 12081 - protein, 9 aa, Homo Sapiens
AQIGSYVHV

SEQ ID NO: 12082 - protein, 9 aa, Homo Sapiens
AQIKELEEL

SEQ ID NO: 12083 - protein, 9 aa, Homo Sapiens
AQIKEMVEL

SEQ ID NO: 12084 - protein, 9 aa, Homo Sapiens
AQIKHLARL

SEQ ID NO: 12085 - protein, 9 aa, Homo Sapiens
AQIKVTKEL

SEQ ID NO: 12086 - protein, 9 aa, Homo Sapiens
AQILELPYA

SEQ ID NO: 12087 - protein, 9 aa, Homo Sapiens
AQIPVVFRL

SEQ ID NO: 12088 - protein, 9 aa, Homo Sapiens
AQIPVVKTA

SEQ ID NO: 12089 - protein, 9 aa, Homo Sapiens
AQIRTIAII

SEQ ID NO: 12090 - protein, 9 aa, Homo Sapiens
AQIRYLTQV

SEQ ID NO: 12091 - protein, 9 aa, Homo Sapiens
AQITGTEHL

SEQ ID NO: 12092 - protein, 9 aa, Homo Sapiens
AQQNSGHFL

SEQ ID NO: 12093 - protein, 9 aa, Homo Sapiens
AQSPLCRSL

SEQ ID NO: 12094 - protein, 9 aa, Homo Sapiens
AQSRIALAL

SEQ ID NO: 12095 - protein, 9 aa, Homo Sapiens
AQTTLRNVL

SEQ ID NO: 12096 - protein, 9 aa, Homo Sapiens
AQVALVNEV

SEQ ID NO: 12097 - protein, 9 aa, Homo Sapiens
AQVGKLPCL

SEQ ID NO: 12098 - protein, 9 aa, Homo Sapiens
AQVNLKYLL

SEQ ID NO: 12099 - protein, 9 aa, Homo Sapiens
AQVSKVEAL

SEQ ID NO: 12100 - protein, 9 aa, Homo Sapiens
AQYDGAYKV

SEQ ID NO: 12101 - protein, 9 aa, Homo Sapiens
AQYEHDLEV

SEQ ID NO: 12102 - protein, 9 aa, Homo Sapiens
AQYGKLESL

SEQ ID NO: 12103 - protein, 9 aa, Homo Sapiens
AQYPSEHLI

SEQ ID NO: 12104 - protein, 9 aa, Homo Sapiens
ASSPISHFL

SEQ ID NO: 12105 - protein, 9 aa, Homo Sapiens
ATADYICKV

SEQ ID NO: 12106 - protein, 9 aa, Homo Sapiens
ATAEHAARL

SEQ ID NO: 12107 - protein, 9 aa, Homo Sapiens
ATAHMCQHL

SEQ ID NO: 12108 - protein, 9 aa, Homo Sapiens
ATAPDSQRL

SEQ ID NO: 12109 - protein, 9 aa, Homo Sapiens
ATAPLISGV

SEQ ID NO: 12110 - protein, 9 aa, Homo Sapiens
ATAPLTELL

SEQ ID NO: 12111 - protein, 9 aa, Homo Sapiens
ATAPQTQHV

SEQ ID NO: 12112 - protein, 9 aa, Homo Sapiens
ATCGHINLV

SEQ ID NO: 12113 - protein, 9 aa, Homo Sapiens
ATFKGIVRA

SEQ ID NO: 12114 - protein, 9 aa, Homo Sapiens
ATIDKVVKI

SEQ ID NO: 12115 - protein, 9 aa, Homo Sapiens
ATIQKIPRL

SEQ ID NO: 12116 - protein, 9 aa, Homo Sapiens
ATIRLLDVL

SEQ ID NO: 12117 - protein, 9 aa, Homo Sapiens
ATMERLEKV

SEQ ID NO: 12118 - protein, 9 aa, Homo Sapiens
ATSDLNIKV

SEQ ID NO: 12119 - protein, 9 aa, Homo Sapiens
ATSDLVNAI

SEQ ID NO: 12120 - protein, 9 aa, Homo Sapiens
ATSGLDHQL

SEQ ID NO: 12121 - protein, 9 aa, Homo Sapiens
ATSYLSHQL

SEQ ID NO: 12122 - protein, 9 aa, Homo Sapiens
ATVEEVDAA

SEQ ID NO: 12123 - protein, 9 aa, Homo Sapiens
ATVGEITHA

SEQ ID NO: 12124 - protein, 9 aa, Homo Sapiens
ATYEDIVTL

SEQ ID NO: 12125 - protein, 9 aa, Homo Sapiens
AVAAELVSA

SEQ ID NO: 12126 - protein, 9 aa, Homo Sapiens
AVADKHELL

SEQ ID NO: 12127 - protein, 9 aa, Homo Sapiens
AVADKVHLM

SEQ ID NO: 12128 - protein, 9 aa, Homo Sapiens
AVADLQTRL

SEQ ID NO: 12129 - protein, 9 aa, Homo Sapiens
AVADNVERA

SEQ ID NO: 12130 - protein, 9 aa, Homo Sapiens
AVADTVYRA

SEQ ID NO: 12131 - protein, 9 aa, Homo Sapiens
AVAEINAVM

SEQ ID NO: 12132 - protein, 9 aa, Homo Sapiens
AVAELNYGL

SEQ ID NO: 12133 - protein, 9 aa, Homo Sapiens
AVAEPANAV

SEQ ID NO: 12134 - protein, 9 aa, Homo Sapiens
AVALEVQRL

SEQ ID NO: 12135 - protein, 9 aa, Homo Sapiens
AVANIVNSV

SEQ ID NO: 12136 - protein, 9 aa, Homo Sapiens
AVAQLAQEL

SEQ ID NO: 12137 - protein, 9 aa, Homo Sapiens
AVAQQVQQV

SEQ ID NO: 12138 - protein, 9 aa, Homo Sapiens
AVASALHKL

SEQ ID NO: 12139 - protein, 9 aa, Homo Sapiens
AVASFKHAL

SEQ ID NO: 12140 - protein, 9 aa, Homo Sapiens
AVASFVTQL

SEQ ID NO: 12141 - protein, 9 aa, Homo Sapiens
AVASKTYNL

SEQ ID NO: 12142 - protein, 9 aa, Homo Sapiens
AVATAVQRV

SEQ ID NO: 12143 - protein, 9 aa, Homo Sapiens
AVCEGTWRL

SEQ ID NO: 12144 - protein, 9 aa, Homo Sapiens
AVCGQVQHL

SEQ ID NO: 12145 - protein, 9 aa, Homo Sapiens
AVCNHISSV

SEQ ID NO: 12146 - protein, 9 aa, Homo Sapiens
AVCVLIEKL

SEQ ID NO: 12147 - protein, 9 aa, Homo Sapiens
AVFDKCPEL

SEQ ID NO: 12148 - protein, 9 aa, Homo Sapiens
AVFDNLIQL

SEQ ID NO: 12149 - protein, 9 aa, Homo Sapiens
AVFKELVKL

SEQ ID NO: 12150 - protein, 9 aa, Homo Sapiens
AVGPVHNSV

SEQ ID NO: 12151 - protein, 9 aa, Homo Sapiens
AVIDEIQMI

SEQ ID NO: 12152 - protein, 9 aa, Homo Sapiens
AVIEAEHTL

SEQ ID NO: 12153 - protein, 9 aa, Homo Sapiens
AVIEHLERL

SEQ ID NO: 12154 - protein, 9 aa, Homo Sapiens
AVIEHTNRV

SEQ ID NO: 12155 - protein, 9 aa, Homo Sapiens
AVIEQVKAA

SEQ ID NO: 12156 - protein, 9 aa, Homo Sapiens
AVIGDVIRV

SEQ ID NO: 12157 - protein, 9 aa, Homo Sapiens
AVIKFLELL

SEQ ID NO: 12158 - protein, 9 aa, Homo Sapiens
AVINRVQKV

SEQ ID NO: 12159 - protein, 9 aa, Homo Sapiens
AVINSLEKA

SEQ ID NO: 12160 - protein, 9 aa, Homo Sapiens
AVIRDLNSL

SEQ ID NO: 12161 - protein, 9 aa, Homo Sapiens
AVIREIQNA

SEQ ID NO: 12162 - protein, 9 aa, Homo Sapiens
AVISHIDQT

SEQ ID NO: 12163 - protein, 9 aa, Homo Sapiens
AVISKIEST

SEQ ID NO: 12164 - protein, 9 aa, Homo Sapiens
AVITKVKGV

SEQ ID NO: 12165 - protein, 9 aa, Homo Sapiens
AVKEFLEKL

SEQ ID NO: 12166 - protein, 9 aa, Homo Sapiens
AVKKMLVEA

SEQ ID NO: 12167 - protein, 9 aa, Homo Sapiens
AVKPSVTCV

SEQ ID NO: 12168 - protein, 9 aa, Homo Sapiens
AVNAAVQRV

SEQ ID NO: 12169 - protein, 9 aa, Homo Sapiens
AVNEKINRV

SEQ ID NO: 12170 - protein, 9 aa, Homo Sapiens
AVPAFCQHV

SEQ ID NO: 12171 - protein, 9 aa, Homo Sapiens
AVPEHAARL

SEQ ID NO: 12172 - protein, 9 aa, Homo Sapiens
AVPEIMDRI

SEQ ID NO: 12173 - protein, 9 aa, Homo Sapiens
AVPEKIGQV

SEQ ID NO: 12174 - protein, 9 aa, Homo Sapiens
AVPVIISRA

SEQ ID NO: 12175 - protein, 9 aa, Homo Sapiens
AVSAQVEEL

SEQ ID NO: 12176 - protein, 9 aa, Homo Sapiens
AVSDLCEAL

SEQ ID NO: 12177 - protein, 9 aa, Homo Sapiens
AVSPTVSQL

SEQ ID NO: 12178 - protein, 9 aa, Homo Sapiens
AVSRVLNKL

SEQ ID NO: 12179 - protein, 9 aa, Homo Sapiens
AVTPLNESL

SEQ ID NO: 12180 - protein, 9 aa, Homo Sapiens
AVVAGIAKA

SEQ ID NO: 12181 - protein, 9 aa, Homo Sapiens
AVVETVTTA

SEQ ID NO: 12182 - protein, 9 aa, Homo Sapiens
AVVKTMQAL

SEQ ID NO: 12183 - protein, 9 aa, Homo Sapiens
AVVNSLYKL

SEQ ID NO: 12184 - protein, 9 aa, Homo Sapiens
AVVPKILTV

SEQ ID NO: 12185 - protein, 9 aa, Homo Sapiens
AVVTQVNKV

SEQ ID NO: 12186 - protein, 9 aa, Homo Sapiens
CLYGNVEKV

SEQ ID NO: 12187 - protein, 9 aa, Homo Sapiens
CQFRALYTL

SEQ ID NO: 12188 - protein, 9 aa, Homo Sapiens
CQNAQTFNL

SEQ ID NO: 12189 - protein, 9 aa, Homo Sapiens
CQSGSFDKL

SEQ ID NO: 12190 - protein, 9 aa, Homo Sapiens
CTAGTLHNL

SEQ ID NO: 12191 - protein, 9 aa, Homo Sapiens
CVGPEVEKA

SEQ ID NO: 12192 - protein, 9 aa, Homo Sapiens
DLIGVVEAL

SEQ ID NO: 12193 - protein, 9 aa, Homo Sapiens
DVIEVIEKA

SEQ ID NO: 12194 - protein, 9 aa, Homo Sapiens
EIPEWVHQL

SEQ ID NO: 12195 - protein, 9 aa, Homo Sapiens
EITTLNHKL

SEQ ID NO: 12196 - protein, 9 aa, Homo Sapiens
ELIERIPEL

SEQ ID NO: 12197 - protein, 9 aa, Homo Sapiens
EQAAWYHTL

SEQ ID NO: 12198 - protein, 9 aa, Homo Sapiens
EQADFYRTV

SEQ ID NO: 12199 - protein, 9 aa, Homo Sapiens
EQADIFERV

SEQ ID NO: 12200 - protein, 9 aa, Homo Sapiens
EQAHLWAEL

SEQ ID NO: 12201 - protein, 9 aa, Homo Sapiens
EQIEAIHKA

SEQ ID NO: 12202 - protein, 9 aa, Homo Sapiens
EQSDLVHRI

SEQ ID NO: 12203 - protein, 9 aa, Homo Sapiens
ETADITHAL

SEQ ID NO: 12204 - protein, 9 aa, Homo Sapiens
ETPKNELYN

SEQ ID NO: 12205 - protein, 9 aa, Homo Sapiens
EVDDEALEK

SEQ ID NO: 12206 - protein, 9 aa, Homo Sapiens
EVIGKITAL

SEQ ID NO: 12207 - protein, 9 aa, Homo Sapiens
EVIKELAQI

SEQ ID NO: 12208 - protein, 9 aa, Homo Sapiens
EVISKLYAV

SEQ ID NO: 12209 - protein, 9 aa, Homo Sapiens
FAADLAEEL

SEQ ID NO: 12210 - protein, 9 aa, Homo Sapiens
FACEKNENL

SEQ ID NO: 12211 - protein, 9 aa, Homo Sapiens
FACPKTDSL

SEQ ID NO: 12212 - protein, 9 aa, Homo Sapiens
FAIPLIEKL

SEQ ID NO: 12213 - protein, 9 aa, Homo Sapiens
FAIPLIERL

SEQ ID NO: 12214 - protein, 9 aa, Homo Sapiens
FAITAIKGV

SEQ ID NO: 12215 - protein, 9 aa, Homo Sapiens
FAKMVVDAV

SEQ ID NO: 12216 - protein, 9 aa, Homo Sapiens
FASGLIHRV

SEQ ID NO: 12217 - protein, 9 aa, Homo Sapiens
FASHVSPEV

SEQ ID NO: 12218 - protein, 9 aa, Homo Sapiens
FASTILHLV

SEQ ID NO: 12219 - protein, 9 aa, Homo Sapiens
FGFEITHEV

SEQ ID NO: 12220 - protein, 9 aa, Homo Sapiens
FGVPLIVHV

SEQ ID NO: 12221 - protein, 9 aa, Homo Sapiens
FIADAHEKI

SEQ ID NO: 12222 - protein, 9 aa, Homo Sapiens
FIADHCPTL

SEQ ID NO: 12223 - protein, 9 aa, Homo Sapiens
FIADQLDHL

SEQ ID NO: 12224 - protein, 9 aa, Homo Sapiens
FIAHFQDNL

SEQ ID NO: 12225 - protein, 9 aa, Homo Sapiens
FIAKLLNKL

SEQ ID NO: 12226 - protein, 9 aa, Homo Sapiens
FIAPQCEMI

SEQ ID NO: 12227 - protein, 9 aa, Homo Sapiens
FIAPSGHGL

SEQ ID NO: 12228 - protein, 9 aa, Homo Sapiens
FIAPTGHSL

SEQ ID NO: 12229 - protein, 9 aa, Homo Sapiens
FIFDEAEKL

SEQ ID NO: 12230 - protein, 9 aa, Homo Sapiens
FIFSDTHEL

SEQ ID NO: 12231 - protein, 9 aa, Homo Sapiens
FIIGRVIKA

SEQ ID NO: 12232 - protein, 9 aa, Homo Sapiens
FIINGIEKV

SEQ ID NO: 12233 - protein, 9 aa, Homo Sapiens
FIINGSEKV

SEQ ID NO: 12234 - protein, 9 aa, Homo Sapiens
FIIQGLRSV

SEQ ID NO: 12235 - protein, 9 aa, Homo Sapiens
FIISRTQAL

SEQ ID NO: 12236 - protein, 9 aa, Homo Sapiens
FILEKIEYL

SEQ ID NO: 12237 - protein, 9 aa, Homo Sapiens
FINQDNNTL

SEQ ID NO: 12238 - protein, 9 aa, Homo Sapiens
FIPATGHSL

SEQ ID NO: 12239 - protein, 9 aa, Homo Sapiens
FIPFLQQEV

SEQ ID NO: 12240 - protein, 9 aa, Homo Sapiens
FIPKFITHL

SEQ ID NO: 12241 - protein, 9 aa, Homo Sapiens
FIPYLVVKV

SEQ ID NO: 12242 - protein, 9 aa, Homo Sapiens
FISEFEHRV

SEQ ID NO: 12243 - protein, 9 aa, Homo Sapiens
FISGHTSEL

SEQ ID NO: 12244 - protein, 9 aa, Homo Sapiens
FISPFGHGL

SEQ ID NO: 12245 - protein, 9 aa, Homo Sapiens
FISPTGHSL

SEQ ID NO: 12246 - protein, 9 aa, Homo Sapiens
FITEDKTEL

SEQ ID NO: 12247 - protein, 9 aa, Homo Sapiens
FIVEEIQRI

SEQ ID NO: 12248 - protein, 9 aa, Homo Sapiens
FLADIVQKL

SEQ ID NO: 12249 - protein, 9 aa, Homo Sapiens
FLADNHHQV

SEQ ID NO: 12250 - protein, 9 aa, Homo Sapiens
FLADPSAFV

SEQ ID NO: 12251 - protein, 9 aa, Homo Sapiens
FLAKLIAQA

SEQ ID NO: 12252 - protein, 9 aa, Homo Sapiens
FLAPELPAV

SEQ ID NO: 12253 - protein, 9 aa, Homo Sapiens
FLCPFHLSV

SEQ ID NO: 12254 - protein, 9 aa, Homo Sapiens
FLCVVSKEL

SEQ ID NO: 12255 - protein, 9 aa, Homo Sapiens
FLFEDFSKA

SEQ ID NO: 12256 - protein, 9 aa, Homo Sapiens
FLFGEVHKA

SEQ ID NO: 12257 - protein, 9 aa, Homo Sapiens
FLFSDVCRV

SEQ ID NO: 12258 - protein, 9 aa, Homo Sapiens
FLIPIVNIS

SEQ ID NO: 12259 - protein, 9 aa, Homo Sapiens
FLIPIYHQV

SEQ ID NO: 12260 - protein, 9 aa, Homo Sapiens
FLIQEIKTL

SEQ ID NO: 12261 - protein, 9 aa, Homo Sapiens
FLIRESETL

SEQ ID NO: 12262 - protein, 9 aa, Homo Sapiens
FLITILDHL

SEQ ID NO: 12263 - protein, 9 aa, Homo Sapiens
FLKEGCELI

SEQ ID NO: 12264 - protein, 9 aa, Homo Sapiens
FLKNELDNV

SEQ ID NO: 12265 - protein, 9 aa, Homo Sapiens
FLKNEVERL

SEQ ID NO: 12266 - protein, 9 aa, Homo Sapiens
FLMDFIHQV

SEQ ID NO: 12267 - protein, 9 aa, Homo Sapiens
FLMGPVKQL

SEQ ID NO: 12268 - protein, 9 aa, Homo Sapiens
FLNAKCESA

SEQ ID NO: 12269 - protein, 9 aa, Homo Sapiens
FLPDGCDHL

SEQ ID NO: 12270 - protein, 9 aa, Homo Sapiens
FLPEEQDRL

SEQ ID NO: 12271 - protein, 9 aa, Homo Sapiens
FLPEVIYKM

SEQ ID NO: 12272 - protein, 9 aa, Homo Sapiens
FLPGICKEL

SEQ ID NO: 12273 - protein, 9 aa, Homo Sapiens
FLPKKLDEA

SEQ ID NO: 12274 - protein, 9 aa, Homo Sapiens
FLPLHYDYL

SEQ ID NO: 12275 - protein, 9 aa, Homo Sapiens
FLPLIVNTV

SEQ ID NO: 12276 - protein, 9 aa, Homo Sapiens
FLPQKIIYL

SEQ ID NO: 12277 - protein, 9 aa, Homo Sapiens
FLPSANEHL

SEQ ID NO: 12278 - protein, 9 aa, Homo Sapiens
FLPSHYNYL

SEQ ID NO: 12279 - protein, 9 aa, Homo Sapiens
FLPSYIIDV

SEQ ID NO: 12280 - protein, 9 aa, Homo Sapiens
FLPTILNQL

SEQ ID NO: 12281 - protein, 9 aa, Homo Sapiens
FLPTLLHQA

SEQ ID NO: 12282 - protein, 9 aa, Homo Sapiens
FLSDLRDML

SEQ ID NO: 12283 - protein, 9 aa, Homo Sapiens
FLSELTQQL

SEQ ID NO: 12284 - protein, 9 aa, Homo Sapiens
FLSEVFHQA

SEQ ID NO: 12285 - protein, 9 aa, Homo Sapiens
FLSILCNNL

SEQ ID NO: 12286 - protein, 9 aa, Homo Sapiens
FLSPKVDPS

SEQ ID NO: 12287 - protein, 9 aa, Homo Sapiens
FLSPVDNHM

SEQ ID NO: 12288 - protein, 9 aa, Homo Sapiens
FLSSVIQNL

SEQ ID NO: 12289 - protein, 9 aa, Homo Sapiens
FLSTLEHHL

SEQ ID NO: 12290 - protein, 9 aa, Homo Sapiens
FLVPTFEQL

SEQ ID NO: 12291 - protein, 9 aa, Homo Sapiens
FLVQNIHTL

SEQ ID NO: 12292 - protein, 9 aa, Homo Sapiens
FLVTVIHTL

SEQ ID NO: 12293 - protein, 9 aa, Homo Sapiens
FLYDDNQRV

SEQ ID NO: 12294 - protein, 9 aa, Homo Sapiens
FLYQYSTRL

SEQ ID NO: 12295 - protein, 9 aa, Homo Sapiens
FMATIAEGL

SEQ ID NO: 12296 - protein, 9 aa, Homo Sapiens
FMIKHSQKL

SEQ ID NO: 12297 - protein, 9 aa, Homo Sapiens
FMKKYIHVA

SEQ ID NO: 12298 - protein, 9 aa, Homo Sapiens
FQAAEGHDL

SEQ ID NO: 12299 - protein, 9 aa, Homo Sapiens
FQAEIAQLM

SEQ ID NO: 12300 - protein, 9 aa, Homo Sapiens
FQAEIPVGI

SEQ ID NO: 12301 - protein, 9 aa, Homo Sapiens
FQANEVRKV

SEQ ID NO: 12302 - protein, 9 aa, Homo Sapiens
FQATIVKAV

SEQ ID NO: 12303 - protein, 9 aa, Homo Sapiens
FQCQTKLEL

SEQ ID NO: 12304 - protein, 9 aa, Homo Sapiens
FQDEINWRL

SEQ ID NO: 12305 - protein, 9 aa, Homo Sapiens
FQEADSPTL

SEQ ID NO: 12306 - protein, 9 aa, Homo Sapiens
FQEAIISKL

SEQ ID NO: 12307 - protein, 9 aa, Homo Sapiens
FQFGVPQAL

SEQ ID NO: 12308 - protein, 9 aa, Homo Sapiens
FQHEDLNFL

SEQ ID NO: 12309 - protein, 9 aa, Homo Sapiens
FQHTGIYSV

SEQ ID NO: 12310 - protein, 9 aa, Homo Sapiens
FQIDRSWKA

SEQ ID NO: 12311 - protein, 9 aa, Homo Sapiens
FQIGKMRYV

SEQ ID NO: 12312 - protein, 9 aa, Homo Sapiens
FQIGPCEGI

SEQ ID NO: 12313 - protein, 9 aa, Homo Sapiens
FQIGPVAGV

SEQ ID NO: 12314 - protein, 9 aa, Homo Sapiens
FQIRNLPSL

SEQ ID NO: 12315 - protein, 9 aa, Homo Sapiens
FQIVNPHLL

SEQ ID NO: 12316 - protein, 9 aa, Homo Sapiens
FQMKKVLCL

SEQ ID NO: 12317 - protein, 9 aa, Homo Sapiens
FQMPTPIQM

SEQ ID NO: 12318 - protein, 9 aa, Homo Sapiens
FQNDFLRLL

SEQ ID NO: 12319 - protein, 9 aa, Homo Sapiens
FQNEVARQL

SEQ ID NO: 12320 - protein, 9 aa, Homo Sapiens
FQNNVQVKV

SEQ ID NO: 12321 - protein, 9 aa, Homo Sapiens
FQNPFRSEL

SEQ ID NO: 12322 - protein, 9 aa, Homo Sapiens
FQNPQTHVI

SEQ ID NO: 12323 - protein, 9 aa, Homo Sapiens
FQNSGNVNL

SEQ ID NO: 12324 - protein, 9 aa, Homo Sapiens
FQPPIHQSL

SEQ ID NO: 12325 - protein, 9 aa, Homo Sapiens
FQREAIENA

SEQ ID NO: 12326 - protein, 9 aa, Homo Sapiens
FQSDTNAML

SEQ ID NO: 12327 - protein, 9 aa, Homo Sapiens
FQSFQDHKL

SEQ ID NO: 12328 - protein, 9 aa, Homo Sapiens
FQSFVKDCL

SEQ ID NO: 12329 - protein, 9 aa, Homo Sapiens
FQSILRQDL

SEQ ID NO: 12330 - protein, 9 aa, Homo Sapiens
FQSKENLSV

SEQ ID NO: 12331 - protein, 9 aa, Homo Sapiens
FQSPLFAKA

SEQ ID NO: 12332 - protein, 9 aa, Homo Sapiens
FQSSAVMAL

SEQ ID NO: 12333 - protein, 9 aa, Homo Sapiens
FQSTTGHCV

SEQ ID NO: 12334 - protein, 9 aa, Homo Sapiens
FQTDLIYNL

SEQ ID NO: 12335 - protein, 9 aa, Homo Sapiens
FQTEVGKQL

SEQ ID NO: 12336 - protein, 9 aa, Homo Sapiens
FQTGTNARL

SEQ ID NO: 12337 - protein, 9 aa, Homo Sapiens
FQTIARNAL

SEQ ID NO: 12338 - protein, 9 aa, Homo Sapiens
FQYAKESYI

SEQ ID NO: 12339 - protein, 9 aa, Homo Sapiens
FQYPDTRYL

SEQ ID NO: 12340 - protein, 9 aa, Homo Sapiens
FSIGKMSTA

SEQ ID NO: 12341 - protein, 9 aa, Homo Sapiens
FSPQMCEHL

SEQ ID NO: 12342 - protein, 9 aa, Homo Sapiens
FTAEFLEKV

SEQ ID NO: 12343 - protein, 9 aa, Homo Sapiens
FTAEKTDEL

SEQ ID NO: 12344 - protein, 9 aa, Homo Sapiens
FTAKQLEKL

SEQ ID NO: 12345 - protein, 9 aa, Homo Sapiens
FTAWCNSHL

SEQ ID NO: 12346 - protein, 9 aa, Homo Sapiens
FTFIFCHEL

SEQ ID NO: 12347 - protein, 9 aa, Homo Sapiens
FTFPNIASA

SEQ ID NO: 12348 - protein, 9 aa, Homo Sapiens
FTFSGICRV

SEQ ID NO: 12349 - protein, 9 aa, Homo Sapiens
FTILDVRPA

SEQ ID NO: 12350 - protein, 9 aa, Homo Sapiens
FTIPHTQEA

SEQ ID NO: 12351 - protein, 9 aa, Homo Sapiens
FTNRDCDSL

SEQ ID NO: 12352 - protein, 9 aa, Homo Sapiens
FTPNNIKQV

SEQ ID NO: 12353 - protein, 9 aa, Homo Sapiens
FTPSLSETV

SEQ ID NO: 12354 - protein, 9 aa, Homo Sapiens
FTSPFCLQV

SEQ ID NO: 12355 - protein, 9 aa, Homo Sapiens
FTVDQIRAI

SEQ ID NO: 12356 - protein, 9 aa, Homo Sapiens
FTVSLNHKL

SEQ ID NO: 12357 - protein, 9 aa, Homo Sapiens
FTYATTEKV

SEQ ID NO: 12358 - protein, 9 aa, Homo Sapiens
FTYHHIQEI

SEQ ID NO: 12359 - protein, 9 aa, Homo Sapiens
FVADFADKL

SEQ ID NO: 12360 - protein, 9 aa, Homo Sapiens
FVADGIFKA

SEQ ID NO: 12361 - protein, 9 aa, Homo Sapiens
FVAEGGPEL

SEQ ID NO: 12362 - protein, 9 aa, Homo Sapiens
FVAETSQRI

SEQ ID NO: 12363 - protein, 9 aa, Homo Sapiens
FVANLDYKV

SEQ ID NO: 12364 - protein, 9 aa, Homo Sapiens
FVAPLQEKV

SEQ ID NO: 12365 - protein, 9 aa, Homo Sapiens
FVAPPTAAV

SEQ ID NO: 12366 - protein, 9 aa, Homo Sapiens
FVAPSDIQL

SEQ ID NO: 12367 - protein, 9 aa, Homo Sapiens
FVDDYTVRV

SEQ ID NO: 12368 - protein, 9 aa, Homo Sapiens
FVEEEEHFL

SEQ ID NO: 12369 - protein, 9 aa, Homo Sapiens
FVEPSRQFV

SEQ ID NO: 12370 - protein, 9 aa, Homo Sapiens
FVFPGELLL

SEQ ID NO: 12371 - protein, 9 aa, Homo Sapiens
FVHAQCLEL

SEQ ID NO: 12372 - protein, 9 aa, Homo Sapiens
FVHPGAATV

SEQ ID NO: 12373 - protein, 9 aa, Homo Sapiens
FVIATSTKI

SEQ ID NO: 12374 - protein, 9 aa, Homo Sapiens
FVIDEAHCV

SEQ ID NO: 12375 - protein, 9 aa, Homo Sapiens
FVIDLQTRL

SEQ ID NO: 12376 - protein, 9 aa, Homo Sapiens
FVIETARQL

SEQ ID NO: 12377 - protein, 9 aa, Homo Sapiens
FVIGHLKGA

SEQ ID NO: 12378 - protein, 9 aa, Homo Sapiens
FVIHDMETL

SEQ ID NO: 12379 - protein, 9 aa, Homo Sapiens
FVIRNIVEA

SEQ ID NO: 12380 - protein, 9 aa, Homo Sapiens
FVKEHFDEL

SEQ ID NO: 12381 - protein, 9 aa, Homo Sapiens
FVKELSEAL

SEQ ID NO: 12382 - protein, 9 aa, Homo Sapiens
FVKQGEEEV

SEQ ID NO: 12383 - protein, 9 aa, Homo Sapiens
FVNDIFERI

SEQ ID NO: 12384 - protein, 9 aa, Homo Sapiens
FVNEIISRI

SEQ ID NO: 12385 - protein, 9 aa, Homo Sapiens
FVNPKFEHL

SEQ ID NO: 12386 - protein, 9 aa, Homo Sapiens
FVNYATEKL

SEQ ID NO: 12387 - protein, 9 aa, Homo Sapiens
FVPDLKELL

SEQ ID NO: 12388 - protein, 9 aa, Homo Sapiens
FVPEIFHRI

SEQ ID NO: 12389 - protein, 9 aa, Homo Sapiens
FVPETKEEL

SEQ ID NO: 12390 - protein, 9 aa, Homo Sapiens
FVPFITEHI

SEQ ID NO: 12391 - protein, 9 aa, Homo Sapiens
FVPIKVEQI

SEQ ID NO: 12392 - protein, 9 aa, Homo Sapiens
FVPLFAENL

SEQ ID NO: 12393 - protein, 9 aa, Homo Sapiens
FVSDKDASL

SEQ ID NO: 12394 - protein, 9 aa, Homo Sapiens
FVSDKDTGL

SEQ ID NO: 12395 - protein, 9 aa, Homo Sapiens
FVSRVTECL

SEQ ID NO: 12396 - protein, 9 aa, Homo Sapiens
FVTEEIIPL

SEQ ID NO: 12397 - protein, 9 aa, Homo Sapiens
FVTPLKEAL

SEQ ID NO: 12398 - protein, 9 aa, Homo Sapiens
FVVDCSDKL

SEQ ID NO: 12399 - protein, 9 aa, Homo Sapiens
FVVDEVSNI

SEQ ID NO: 12400 - protein, 9 aa, Homo Sapiens
FVVDHVIKI

SEQ ID NO: 12401 - protein, 9 aa, Homo Sapiens
FVVDIESRL

SEQ ID NO: 12402 - protein, 9 aa, Homo Sapiens
FVVDLSDQV

SEQ ID NO: 12403 - protein, 9 aa, Homo Sapiens
FVVDRSDKL

SEQ ID NO: 12404 - protein, 9 aa, Homo Sapiens
FVVEKIELL

SEQ ID NO: 12405 - protein, 9 aa, Homo Sapiens
FVVHITDVL

SEQ ID NO: 12406 - protein, 9 aa, Homo Sapiens
FVVHTVQFL

SEQ ID NO: 12407 - protein, 9 aa, Homo Sapiens
GAADIDHKL

SEQ ID NO: 12408 - protein, 9 aa, Homo Sapiens
GGFDGTNRL

SEQ ID NO: 12409 - protein, 9 aa, Homo Sapiens
GGIDIYHLL

SEQ ID NO: 12410 - protein, 9 aa, Homo Sapiens
GIADLAHLL

SEQ ID NO: 12411 - protein, 9 aa, Homo Sapiens
GIAPCNNRL

SEQ ID NO: 12412 - protein, 9 aa, Homo Sapiens
GILDRTISV

SEQ ID NO: 12413 - protein, 9 aa, Homo Sapiens
GIPEHADNL

SEQ ID NO: 12414 - protein, 9 aa, Homo Sapiens
GIYAKVDRL

SEQ ID NO: 12415 - protein, 9 aa, Homo Sapiens
GLADITQQL

SEQ ID NO: 12416 - protein, 9 aa, Homo Sapiens
GLAELGHRL

SEQ ID NO: 12417 - protein, 9 aa, Homo Sapiens
GLAHFVNEI

SEQ ID NO: 12418 - protein, 9 aa, Homo Sapiens
GLATDVQTV

SEQ ID NO: 12419 - protein, 9 aa, Homo Sapiens
GLFQHICTA

SEQ ID NO: 12420 - protein, 9 aa, Homo Sapiens
GLIDKVNEL

SEQ ID NO: 12421 - protein, 9 aa, Homo Sapiens
GLIEILKKV

SEQ ID NO: 12422 - protein, 9 aa, Homo Sapiens
GLKDKIHHV

SEQ ID NO: 12423 - protein, 9 aa, Homo Sapiens
GLSHVDYAL

SEQ ID NO: 12424 - protein, 9 aa, Homo Sapiens
GLVKRLHKV

SEQ ID NO: 12425 - protein, 9 aa, Homo Sapiens
GLVPFLVSV

SEQ ID NO: 12426 - protein, 9 aa, Homo Sapiens
GQADLATKV

SEQ ID NO: 12427 - protein, 9 aa, Homo Sapiens
GQADVISKL

SEQ ID NO: 12428 - protein, 9 aa, Homo Sapiens
GQAEVLNFL

SEQ ID NO: 12429 - protein, 9 aa, Homo Sapiens
GQAFLYHQV

SEQ ID NO: 12430 - protein, 9 aa, Homo Sapiens
GQCEWLSRL

SEQ ID NO: 12431 - protein, 9 aa, Homo Sapiens
GQFDRPAGV

SEQ ID NO: 12432 - protein, 9 aa, Homo Sapiens
GQFSEVYKA

SEQ ID NO: 12433 - protein, 9 aa, Homo Sapiens
GQIDLLERL

SEQ ID NO: 12434 - protein, 9 aa, Homo Sapiens
GQIELRTYV

SEQ ID NO: 12435 - protein, 9 aa, Homo Sapiens
GQIGMIQAL

SEQ ID NO: 12436 - protein, 9 aa, Homo Sapiens
GQIKQIIRI

SEQ ID NO: 12437 - protein, 9 aa, Homo Sapiens
GQIPATALL

SEQ ID NO: 12438 - protein, 9 aa, Homo Sapiens
GQIQKVHPA

SEQ ID NO: 12439 - protein, 9 aa, Homo Sapiens
GQMGSFIRL

SEQ ID NO: 12440 - protein, 9 aa, Homo Sapiens
GQQEITNRL

SEQ ID NO: 12441 - protein, 9 aa, Homo Sapiens
GQSALYDAL

SEQ ID NO: 12442 - protein, 9 aa, Homo Sapiens
GQSELASRL

SEQ ID NO: 12443 - protein, 9 aa, Homo Sapiens
GQSKENNYL

SEQ ID NO: 12444 - protein, 9 aa, Homo Sapiens
GQSKVFFRA

SEQ ID NO: 12445 - protein, 9 aa, Homo Sapiens
GQSTVNHSL

SEQ ID NO: 12446 - protein, 9 aa, Homo Sapiens
GQSYVVNRV

SEQ ID NO: 12447 - protein, 9 aa, Homo Sapiens
GQTPVFSKA

SEQ ID NO: 12448 - protein, 9 aa, Homo Sapiens
GRLASLNLR

SEQ ID NO: 12449 - protein, 9 aa, Homo Sapiens
GTIDEIQKL

SEQ ID NO: 12450 - protein, 9 aa, Homo Sapiens
GTIFIIKGV

SEQ ID NO: 12451 - protein, 9 aa, Homo Sapiens
GTIGLIHAI

SEQ ID NO: 12452 - protein, 9 aa, Homo Sapiens
GTIGLIHAV

SEQ ID NO: 12453 - protein, 9 aa, Homo Sapiens
GTIKKINIL

SEQ ID NO: 12454 - protein, 9 aa, Homo Sapiens
GTKALMDEV

SEQ ID NO: 12455 - protein, 9 aa, Homo Sapiens
GTKNRIITA

SEQ ID NO: 12456 - protein, 9 aa, Homo Sapiens
GTVDKLCRV

SEQ ID NO: 12457 - protein, 9 aa, Homo Sapiens
GTYMGEEKL

SEQ ID NO: 12458 - protein, 9 aa, Homo Sapiens
GVADIIDCV

SEQ ID NO: 12459 - protein, 9 aa, Homo Sapiens
GVAEKTQLL

SEQ ID NO: 12460 - protein, 9 aa, Homo Sapiens
GVAVKAHQV

SEQ ID NO: 12461 - protein, 9 aa, Homo Sapiens
GVCDHIISL

SEQ ID NO: 12462 - protein, 9 aa, Homo Sapiens
GVCRHNYRL

SEQ ID NO: 12463 - protein, 9 aa, Homo Sapiens
GVEVAVLRV

SEQ ID NO: 12464 - protein, 9 aa, Homo Sapiens
GVFTTMEKA

SEQ ID NO: 12465 - protein, 9 aa, Homo Sapiens
GVGPVPARA

SEQ ID NO: 12466 - protein, 9 aa, Homo Sapiens
GVIKRTENV

SEQ ID NO: 12467 - protein, 9 aa, Homo Sapiens
GVINRVEKI

SEQ ID NO: 12468 - protein, 9 aa, Homo Sapiens
GVIPHIHKS

SEQ ID NO: 12469 - protein, 9 aa, Homo Sapiens
GVIPKIQCL

SEQ ID NO: 12470 - protein, 9 aa, Homo Sapiens
GVIPTLVKL

SEQ ID NO: 12471 - protein, 9 aa, Homo Sapiens
GVIRSLHSL

SEQ ID NO: 12472 - protein, 9 aa, Homo Sapiens
GVISKVSTL

SEQ ID NO: 12473 - protein, 9 aa, Homo Sapiens
GVISRVEKI

SEQ ID NO: 12474 - protein, 9 aa, Homo Sapiens
GVKKDIEKL

SEQ ID NO: 12475 - protein, 9 aa, Homo Sapiens
GVKQLIVGV

SEQ ID NO: 12476 - protein, 9 aa, Homo Sapiens
GVMPEIAQA

SEQ ID NO: 12477 - protein, 9 aa, Homo Sapiens
GVNPHVNHL

SEQ ID NO: 12478 - protein, 9 aa, Homo Sapiens
GVPVTITSV

SEQ ID NO: 12479 - protein, 9 aa, Homo Sapiens
GVSDVDYSL

SEQ ID NO: 12480 - protein, 9 aa, Homo Sapiens
GVSPVIDEL

SEQ ID NO: 12481 - protein, 9 aa, Homo Sapiens
GVTHVIPVA

SEQ ID NO: 12482 - protein, 9 aa, Homo Sapiens
GVTNFIHML

SEQ ID NO: 12483 - protein, 9 aa, Homo Sapiens
GVVDGIYRL

SEQ ID NO: 12484 - protein, 9 aa, Homo Sapiens
GVVEKLSVL

SEQ ID NO: 12485 - protein, 9 aa, Homo Sapiens
GVVESCEQV

SEQ ID NO: 12486 - protein, 9 aa, Homo Sapiens
GVVEYIDTL

SEQ ID NO: 12487 - protein, 9 aa, Homo Sapiens
GVVGLVNCL

SEQ ID NO: 12488 - protein, 9 aa, Homo Sapiens
GVVKGLQEV

SEQ ID NO: 12489 - protein, 9 aa, Homo Sapiens
GVVPQLVKL

SEQ ID NO: 12490 - protein, 9 aa, Homo Sapiens
GVVPTIQKV

SEQ ID NO: 12491 - protein, 9 aa, Homo Sapiens
GVYGALTKA

SEQ ID NO: 12492 - protein, 9 aa, Homo Sapiens
GVYGDVHRV

SEQ ID NO: 12493 - protein, 9 aa, Homo Sapiens
GVYGDVQRV

SEQ ID NO: 12494 - protein, 9 aa, Homo Sapiens
HAVGDIPGV

SEQ ID NO: 12495 - protein, 9 aa, Homo Sapiens
HAYDGKDYI

SEQ ID NO: 12496 - protein, 9 aa, Homo Sapiens
HIADIVHTL

SEQ ID NO: 12497 - protein, 9 aa, Homo Sapiens
HIADVSHFI

SEQ ID NO: 12498 - protein, 9 aa, Homo Sapiens
HIAEVSQEV

SEQ ID NO: 12499 - protein, 9 aa, Homo Sapiens
HIAHIIELL

SEQ ID NO: 12500 - protein, 9 aa, Homo Sapiens
HIANLCDSL

SEQ ID NO: 12501 - protein, 9 aa, Homo Sapiens
HIFGHIAKA

SEQ ID NO: 12502 - protein, 9 aa, Homo Sapiens
HIIENIVAV

SEQ ID NO: 12503 - protein, 9 aa, Homo Sapiens
HIMPTVHTV

SEQ ID NO: 12504 - protein, 9 aa, Homo Sapiens
HIPDVITYL

SEQ ID NO: 12505 - protein, 9 aa, Homo Sapiens
HIPEEAQKV

SEQ ID NO: 12506 - protein, 9 aa, Homo Sapiens
HIPNIFQKI

SEQ ID NO: 12507 - protein, 9 aa, Homo Sapiens
HIPVFSPAL

SEQ ID NO: 12508 - protein, 9 aa, Homo Sapiens
HISSQNSEL

SEQ ID NO: 12509 - protein, 9 aa, Homo Sapiens
HLANIVERL

SEQ ID NO: 12510 - protein, 9 aa, Homo Sapiens
HLANIVERV

SEQ ID NO: 12511 - protein, 9 aa, Homo Sapiens
HLFETISQA

SEQ ID NO: 12512 - protein, 9 aa, Homo Sapiens
HLIEPLANA

SEQ ID NO: 12513 - protein, 9 aa, Homo Sapiens
HLKNTMETI

SEQ ID NO: 12514 - protein, 9 aa, Homo Sapiens
HLKVHIERV

SEQ ID NO: 12515 - protein, 9 aa, Homo Sapiens
HLPDVCVNL

SEQ ID NO: 12516 - protein, 9 aa, Homo Sapiens
HLPSDFTPA

SEQ ID NO: 12517 - protein, 9 aa, Homo Sapiens
HLSIINEYL

SEQ ID NO: 12518 - protein, 9 aa, Homo Sapiens
HLVPFIHSA

SEQ ID NO: 12519 - protein, 9 aa, Homo Sapiens
HLWTGEEQL

SEQ ID NO: 12520 - protein, 9 aa, Homo Sapiens
HMIRDIQTL

SEQ ID NO: 12521 - protein, 9 aa, Homo Sapiens
HMSEICTEL

SEQ ID NO: 12522 - protein, 9 aa, Homo Sapiens
HQADIGEYV

SEQ ID NO: 12523 - protein, 9 aa, Homo Sapiens
HQAGISDTL

SEQ ID NO: 12524 - protein, 9 aa, Homo Sapiens
HQAQIDHYL

SEQ ID NO: 12525 - protein, 9 aa, Homo Sapiens
HQAVIAEQL

SEQ ID NO: 12526 - protein, 9 aa, Homo Sapiens
HQEGFSIPL

SEQ ID NO: 12527 - protein, 9 aa, Homo Sapiens
HQFESSFEL

SEQ ID NO: 12528 - protein, 9 aa, Homo Sapiens
HQSGIVQLL

SEQ ID NO: 12529 - protein, 9 aa, Homo Sapiens
HQSNVFHHI

SEQ ID NO: 12530 - protein, 9 aa, Homo Sapiens
HQSQAVHGL

SEQ ID NO: 12531 - protein, 9 aa, Homo Sapiens
HQVMVFVHA

SEQ ID NO: 12532 - protein, 9 aa, Homo Sapiens
HTIDTILTV

SEQ ID NO: 12533 - protein, 9 aa, Homo Sapiens
HTIEEIEGL

SEQ ID NO: 12534 - protein, 9 aa, Homo Sapiens
HTILIVEKV

SEQ ID NO: 12535 - protein, 9 aa, Homo Sapiens
HTIPVIQRA

SEQ ID NO: 12536 - protein, 9 aa, Homo Sapiens
HTKEILDTA

SEQ ID NO: 12537 - protein, 9 aa, Homo Sapiens
HTVGELIEV

SEQ ID NO: 12538 - protein, 9 aa, Homo Sapiens
HVANIVEKL

SEQ ID NO: 12539 - protein, 9 aa, Homo Sapiens
HVAPQQNAL

SEQ ID NO: 12540 - protein, 9 aa, Homo Sapiens
HVFDLIQEL

SEQ ID NO: 12541 - protein, 9 aa, Homo Sapiens
HVGIHPSKV

SEQ ID NO: 12542 - protein, 9 aa, Homo Sapiens
HVIEALRRA

SEQ ID NO: 12543 - protein, 9 aa, Homo Sapiens
HVIEKMHHV

SEQ ID NO: 12544 - protein, 9 aa, Homo Sapiens
HVIENLHAA

SEQ ID NO: 12545 - protein, 9 aa, Homo Sapiens
HVIGQIIGA

SEQ ID NO: 12546 - protein, 9 aa, Homo Sapiens
HVIGQLDKL

SEQ ID NO: 12547 - protein, 9 aa, Homo Sapiens
HVIKYLETL

SEQ ID NO: 12548 - protein, 9 aa, Homo Sapiens
HVINHILKA

SEQ ID NO: 12549 - protein, 9 aa, Homo Sapiens
HVIQALESL

SEQ ID NO: 12550 - protein, 9 aa, Homo Sapiens
HVKEECDRL

SEQ ID NO: 12551 - protein, 9 aa, Homo Sapiens
HVKEGMDVV

SEQ ID NO: 12552 - protein, 9 aa, Homo Sapiens
HVKEQLETL

SEQ ID NO: 12553 - protein, 9 aa, Homo Sapiens
HVLDVIHEV

SEQ ID NO: 12554 - protein, 9 aa, Homo Sapiens
HVMEHICKL

SEQ ID NO: 12555 - protein, 9 aa, Homo Sapiens
HVSHLTEKL

SEQ ID NO: 12556 - protein, 9 aa, Homo Sapiens
HVSTYAAFV

SEQ ID NO: 12557 - protein, 9 aa, Homo Sapiens
HVYCKTDRL

SEQ ID NO: 12558 - protein, 9 aa, Homo Sapiens
HVYSGKDLI

SEQ ID NO: 12559 - protein, 9 aa, Homo Sapiens
IAAGIFNDL

SEQ ID NO: 12560 - protein, 9 aa, Homo Sapiens
IAIDNLEKA

SEQ ID NO: 12561 - protein, 9 aa, Homo Sapiens
IASAIVNEL

SEQ ID NO: 12562 - protein, 9 aa, Homo Sapiens
IASPVIAAV

SEQ ID NO: 12563 - protein, 9 aa, Homo Sapiens
IGAEVYHNL

SEQ ID NO: 12564 - protein, 9 aa, Homo Sapiens
IIADCGEYV

SEQ ID NO: 12565 - protein, 9 aa, Homo Sapiens
IIAQIVQKL

SEQ ID NO: 12566 - protein, 9 aa, Homo Sapiens
IIATVDTRL

SEQ ID NO: 12567 - protein, 9 aa, Homo Sapiens
IIIDSVPEV

SEQ ID NO: 12568 - protein, 9 aa, Homo Sapiens
IIIPEIQKV

SEQ ID NO: 12569 - protein, 9 aa, Homo Sapiens
IIKGKVEEV

SEQ ID NO: 12570 - protein, 9 aa, Homo Sapiens
IILDEIHLL

SEQ ID NO: 12571 - protein, 9 aa, Homo Sapiens
IINELCHRL

SEQ ID NO: 12572 - protein, 9 aa, Homo Sapiens
IIPAEIPLA

SEQ ID NO: 12573 - protein, 9 aa, Homo Sapiens
IIPDKVWAV

SEQ ID NO: 12574 - protein, 9 aa, Homo Sapiens
IIPTLCHLL

SEQ ID NO: 12575 - protein, 9 aa, Homo Sapiens
IISPNCEKI

SEQ ID NO: 12576 - protein, 9 aa, Homo Sapiens
IISQVDAKV

SEQ ID NO: 12577 - protein, 9 aa, Homo Sapiens
IIVDIFHGL

SEQ ID NO: 12578 - protein, 9 aa, Homo Sapiens
ILAAIVNHL

SEQ ID NO: 12579 - protein, 9 aa, Homo Sapiens
ILADLEDYL

SEQ ID NO: 12580 - protein, 9 aa, Homo Sapiens
ILAPTVQEL

SEQ ID NO: 12581 - protein, 9 aa, Homo Sapiens
ILCELINKL

SEQ ID NO: 12582 - protein, 9 aa, Homo Sapiens
ILGPKPQGV

SEQ ID NO: 12583 - protein, 9 aa, Homo Sapiens
ILIDEVDKI

SEQ ID NO: 12584 - protein, 9 aa, Homo Sapiens
ILIDPFHKA

SEQ ID NO: 12585 - protein, 9 aa, Homo Sapiens
ILIGRIKNV

SEQ ID NO: 12586 - protein, 9 aa, Homo Sapiens
ILIKGLAKL

SEQ ID NO: 12587 - protein, 9 aa, Homo Sapiens
ILINKADLL

SEQ ID NO: 12588 - protein, 9 aa, Homo Sapiens
ILKEHITQL

SEQ ID NO: 12589 - protein, 9 aa, Homo Sapiens
ILKFGAEEL

SEQ ID NO: 12590 - protein, 9 aa, Homo Sapiens
ILKKIIPTL

SEQ ID NO: 12591 - protein, 9 aa, Homo Sapiens
ILKKVLEAL

SEQ ID NO: 12592 - protein, 9 aa, Homo Sapiens
ILMEHIHKL

SEQ ID NO: 12593 - protein, 9 aa, Homo Sapiens
ILNEIVNFV

SEQ ID NO: 12594 - protein, 9 aa, Homo Sapiens
ILPEELQTL

SEQ ID NO: 12595 - protein, 9 aa, Homo Sapiens
ILPEKVARV

SEQ ID NO: 12596 - protein, 9 aa, Homo Sapiens
ILRAILEVL

SEQ ID NO: 12597 - protein, 9 aa, Homo Sapiens
ILSELVEKI

SEQ ID NO: 12598 - protein, 9 aa, Homo Sapiens
ILSHLSSEL

SEQ ID NO: 12599 - protein, 9 aa, Homo Sapiens
ILTDITKGV

SEQ ID NO: 12600 - protein, 9 aa, Homo Sapiens
ILYDKLEKI

SEQ ID NO: 12601 - protein, 9 aa, Homo Sapiens
ILYGEVEKL

SEQ ID NO: 12602 - protein, 9 aa, Homo Sapiens
ILYSKTEHL

SEQ ID NO: 12603 - protein, 9 aa, Homo Sapiens
IMPKDIQLA

SEQ ID NO: 12604 - protein, 9 aa, Homo Sapiens
INPETLETI

SEQ ID NO: 12605 - protein, 9 aa, Homo Sapiens
IPPLTQTPV

SEQ ID NO: 12606 - protein, 9 aa, Homo Sapiens
IQAEEIMKL

SEQ ID NO: 12607 - protein, 9 aa, Homo Sapiens
IQAEHSYSL

SEQ ID NO: 12608 - protein, 9 aa, Homo Sapiens
IQAGLLSAL

SEQ ID NO: 12609 - protein, 9 aa, Homo Sapiens
IQAHSSDQL

SEQ ID NO: 12610 - protein, 9 aa, Homo Sapiens
IQALPGPFL

SEQ ID NO: 12611 - protein, 9 aa, Homo Sapiens
IQATWYEKL

SEQ ID NO: 12612 - protein, 9 aa, Homo Sapiens
IQEEILVHI

SEQ ID NO: 12613 - protein, 9 aa, Homo Sapiens
IQHDLIFSL

SEQ ID NO: 12614 - protein, 9 aa, Homo Sapiens
IQIGLIDLL

SEQ ID NO: 12615 - protein, 9 aa, Homo Sapiens
IQIMKVEEI

SEQ ID NO: 12616 - protein, 9 aa, Homo Sapiens
IQKEDVPSE

SEQ ID NO: 12617 - protein, 9 aa, Homo Sapiens
IQNEAVNLL

SEQ ID NO: 12618 - protein, 9 aa, Homo Sapiens
IQRTPKIQV

SEQ ID NO: 12619 - protein, 9 aa, Homo Sapiens
IQSPHVAVL

SEQ ID NO: 12620 - protein, 9 aa, Homo Sapiens
IQSRIVYYL

SEQ ID NO: 12621 - protein, 9 aa, Homo Sapiens
IQTELQETV

SEQ ID NO: 12622 - protein, 9 aa, Homo Sapiens
IQTRIKIGL

SEQ ID NO: 12623 - protein, 9 aa, Homo Sapiens
IQVDLADKL

SEQ ID NO: 12624 - protein, 9 aa, Homo Sapiens
IQVQVFEKL

SEQ ID NO: 12625 - protein, 9 aa, Homo Sapiens
IQVTKVTQV

SEQ ID NO: 12626 - protein, 9 aa, Homo Sapiens
IQYDKTNVL

SEQ ID NO: 12627 - protein, 9 aa, Homo Sapiens
IQYELTDRL

SEQ ID NO: 12628 - protein, 9 aa, Homo Sapiens
ITAIEAQHL

SEQ ID NO: 12629 - protein, 9 aa, Homo Sapiens
ITAPIEAQV

SEQ ID NO: 12630 - protein, 9 aa, Homo Sapiens
ITAQQINKL

SEQ ID NO: 12631 - protein, 9 aa, Homo Sapiens
ITFESIEKA

SEQ ID NO: 12632 - protein, 9 aa, Homo Sapiens
ITFPGLHEL

SEQ ID NO: 12633 - protein, 9 aa, Homo Sapiens
ITGPAHWEV

SEQ ID NO: 12634 - protein, 9 aa, Homo Sapiens
ITKDGIEAL

SEQ ID NO: 12635 - protein, 9 aa, Homo Sapiens
ITKDLLDLL

SEQ ID NO: 12636 - protein, 9 aa, Homo Sapiens
ITKEHIQAL

SEQ ID NO: 12637 - protein, 9 aa, Homo Sapiens
ITNTDVDCL

SEQ ID NO: 12638 - protein, 9 aa, Homo Sapiens
ITPETAEKL

SEQ ID NO: 12639 - protein, 9 aa, Homo Sapiens
ITPQTIHGV

SEQ ID NO: 12640 - protein, 9 aa, Homo Sapiens
ITREMVEML

SEQ ID NO: 12641 - protein, 9 aa, Homo Sapiens
ITSELVSKI

SEQ ID NO: 12642 - protein, 9 aa, Homo Sapiens
ITVEKIIKI

SEQ ID NO: 12643 - protein, 9 aa, Homo Sapiens
ITVGDIAQV

SEQ ID NO: 12644 - protein, 9 aa, Homo Sapiens
ITVGPVQKL

SEQ ID NO: 12645 - protein, 9 aa, Homo Sapiens
ITVSIIKEL

SEQ ID NO: 12646 - protein, 9 aa, Homo Sapiens
IVADKDYSV

SEQ ID NO: 12647 - protein, 9 aa, Homo Sapiens
IVADLGSPL

SEQ ID NO: 12648 - protein, 9 aa, Homo Sapiens
IVAEAIEKA

SEQ ID NO: 12649 - protein, 9 aa, Homo Sapiens
IVAKHTSAL

SEQ ID NO: 12650 - protein, 9 aa, Homo Sapiens
IVAPGTFEV

SEQ ID NO: 12651 - protein, 9 aa, Homo Sapiens
IVHEALYFL

SEQ ID NO: 12652 - protein, 9 aa, Homo Sapiens
IVIDGLREL

SEQ ID NO: 12653 - protein, 9 aa, Homo Sapiens
IVIGIIKTV

SEQ ID NO: 12654 - protein, 9 aa, Homo Sapiens
IVIGVLHQL

SEQ ID NO: 12655 - protein, 9 aa, Homo Sapiens
IVIRGLNTI

SEQ ID NO: 12656 - protein, 9 aa, Homo Sapiens
IVISKLTQI

SEQ ID NO: 12657 - protein, 9 aa, Homo Sapiens
IVKEVEAKA

SEQ ID NO: 12658 - protein, 9 aa, Homo Sapiens
IVMEHVVFL

SEQ ID NO: 12659 - protein, 9 aa, Homo Sapiens
IVNDKSQNL

SEQ ID NO: 12660 - protein, 9 aa, Homo Sapiens
IVPDKMQKA

SEQ ID NO: 12661 - protein, 9 aa, Homo Sapiens
IVPHICNLL

SEQ ID NO: 12662 - protein, 9 aa, Homo Sapiens
IVVDAIDVL

SEQ ID NO: 12663 - protein, 9 aa, Homo Sapiens
IVVGDIAQV

SEQ ID NO: 12664 - protein, 9 aa, Homo Sapiens
IVVGRITEV

SEQ ID NO: 12665 - protein, 9 aa, Homo Sapiens
IVVPDVETL

SEQ ID NO: 12666 - protein, 9 aa, Homo Sapiens
KAADIASKV

SEQ ID NO: 12667 - protein, 9 aa, Homo Sapiens
KAADIDQEV

SEQ ID NO: 12668 - protein, 9 aa, Homo Sapiens
KAAVMVHQL

SEQ ID NO: 12669 - protein, 9 aa, Homo Sapiens
KAIDLVTKA

SEQ ID NO: 12670 - protein, 9 aa, Homo Sapiens
KAIEQADLL

SEQ ID NO: 12671 - protein, 9 aa, Homo Sapiens
KAIGSLKEV

SEQ ID NO: 12672 - protein, 9 aa, Homo Sapiens
KAIHNICSV

SEQ ID NO: 12673 - protein, 9 aa, Homo Sapiens
KAISGVHTV

SEQ ID NO: 12674 - protein, 9 aa, Homo Sapiens
KAKVKLDFV

SEQ ID NO: 12675 - protein, 9 aa, Homo Sapiens
KAMEKLESV

SEQ ID NO: 12676 - protein, 9 aa, Homo Sapiens
KAPEMTNEL

SEQ ID NO: 12677 - protein, 9 aa, Homo Sapiens
KASAISIKL

SEQ ID NO: 12678 - protein, 9 aa, Homo Sapiens
KAVETVHNL

SEQ ID NO: 12679 - protein, 9 aa, Homo Sapiens
KAVHVIYTV

SEQ ID NO: 12680 - protein, 9 aa, Homo Sapiens
KDFVTLLTA

SEQ ID NO: 12681 - protein, 9 aa, Homo Sapiens
KIAEGVNSL

SEQ ID NO: 12682 - protein, 9 aa, Homo Sapiens
KIAELNTKL

SEQ ID NO: 12683 - protein, 9 aa, Homo Sapiens
KIAGYVTHL

SEQ ID NO: 12684 - protein, 9 aa, Homo Sapiens
KIAKESQFL

SEQ ID NO: 12685 - protein, 9 aa, Homo Sapiens
KIAPLVKSL

SEQ ID NO: 12686 - protein, 9 aa, Homo Sapiens
KIAPNTPQL

SEQ ID NO: 12687 - protein, 9 aa, Homo Sapiens
KICDYLFNV

SEQ ID NO: 12688 - protein, 9 aa, Homo Sapiens
KIFEDIPTL

SEQ ID NO: 12689 - protein, 9 aa, Homo Sapiens
KIGPALKTV

SEQ ID NO: 12690 - protein, 9 aa, Homo Sapiens
KIIDFIYTA

SEQ ID NO: 12691 - protein, 9 aa, Homo Sapiens
KIIDFLSAL

SEQ ID NO: 12692 - protein, 9 aa, Homo Sapiens
KIIERLDHL

SEQ ID NO: 12693 - protein, 9 aa, Homo Sapiens
KIIGIMEEV

SEQ ID NO: 12694 - protein, 9 aa, Homo Sapiens
KIINNTENL

SEQ ID NO: 12695 - protein, 9 aa, Homo Sapiens
KIIPAIATT

SEQ ID NO: 12696 - protein, 9 aa, Homo Sapiens
KIIQDIETI

SEQ ID NO: 12697 - protein, 9 aa, Homo Sapiens
KIISSAQKV

SEQ ID NO: 12698 - protein, 9 aa, Homo Sapiens
KIKATVEEL

SEQ ID NO: 12699 - protein, 9 aa, Homo Sapiens
KIKDNINCL

SEQ ID NO: 12700 - protein, 9 aa, Homo Sapiens
KIKDYLEEL

SEQ ID NO: 12701 - protein, 9 aa, Homo Sapiens
KIKEGAENL

SEQ ID NO: 12702 - protein, 9 aa, Homo Sapiens
KIKEGVENL

SEQ ID NO: 12703 - protein, 9 aa, Homo Sapiens
KIKEVTEEV

SEQ ID NO: 12704 - protein, 9 aa, Homo Sapiens
KIMEAMEKL

SEQ ID NO: 12705 - protein, 9 aa, Homo Sapiens
KIPDISSFL

SEQ ID NO: 12706 - protein, 9 aa, Homo Sapiens
KIPDIYDCI

SEQ ID NO: 12707 - protein, 9 aa, Homo Sapiens
KIPKHLTDA

SEQ ID NO: 12708 - protein, 9 aa, Homo Sapiens
KIPNFCVLL

SEQ ID NO: 12709 - protein, 9 aa, Homo Sapiens
KIPNTVEEA

SEQ ID NO: 12710 - protein, 9 aa, Homo Sapiens
KIPVEADFL

SEQ ID NO: 12711 - protein, 9 aa, Homo Sapiens
KIQEILTQV

SEQ ID NO: 12712 - protein, 9 aa, Homo Sapiens
KISDIQSQL

SEQ ID NO: 12713 - protein, 9 aa, Homo Sapiens
KITDLQNQL

SEQ ID NO: 12714 - protein, 9 aa, Homo Sapiens
KIVDFSYSV

SEQ ID NO: 12715 - protein, 9 aa, Homo Sapiens
KIYEGQVEV

SEQ ID NO: 12716 - protein, 9 aa, Homo Sapiens
KLAAVVNNL

SEQ ID NO: 12717 - protein, 9 aa, Homo Sapiens
KLADICKNL

SEQ ID NO: 12718 - protein, 9 aa, Homo Sapiens
KLADQCTGL

SEQ ID NO: 12719 - protein, 9 aa, Homo Sapiens
KLAECQDQL

SEQ ID NO: 12720 - protein, 9 aa, Homo Sapiens
KLAEFIDFL

SEQ ID NO: 12721 - protein, 9 aa, Homo Sapiens
KLAEIRHEV

SEQ ID NO: 12722 - protein, 9 aa, Homo Sapiens
KLAESVEKA

SEQ ID NO: 12723 - protein, 9 aa, Homo Sapiens
KLCDVTTGL

SEQ ID NO: 12724 - protein, 9 aa, Homo Sapiens
KLCERVTKV

SEQ ID NO: 12725 - protein, 9 aa, Homo Sapiens
KLCPTNQEV

SEQ ID NO: 12726 - protein, 9 aa, Homo Sapiens
KLFDQANKL

SEQ ID NO: 12727 - protein, 9 aa, Homo Sapiens
KLFDTQQFL

SEQ ID NO: 12728 - protein, 9 aa, Homo Sapiens
KLFEFMHET

SEQ ID NO: 12729 - protein, 9 aa, Homo Sapiens
KLFEKVKEV

SEQ ID NO: 12730 - protein, 9 aa, Homo Sapiens
KLFEQILKA

SEQ ID NO: 12731 - protein, 9 aa, Homo Sapiens
KLFGHLTSA

SEQ ID NO: 12732 - protein, 9 aa, Homo Sapiens
KLGPAPKTL

SEQ ID NO: 12733 - protein, 9 aa, Homo Sapiens
KLIDDVHRL

SEQ ID NO: 12734 - protein, 9 aa, Homo Sapiens
KLIDKLDSL

SEQ ID NO: 12735 - protein, 9 aa, Homo Sapiens
KLIDRTESL

SEQ ID NO: 12736 - protein, 9 aa, Homo Sapiens
KLIESAEEL

SEQ ID NO: 12737 - protein, 9 aa, Homo Sapiens
KLIGQVHEV

SEQ ID NO: 12738 - protein, 9 aa, Homo Sapiens
KLIKGVERL

SEQ ID NO: 12739 - protein, 9 aa, Homo Sapiens
KLIKSLEAA

SEQ ID NO: 12740 - protein, 9 aa, Homo Sapiens
KLILLITQV

SEQ ID NO: 12741 - protein, 9 aa, Homo Sapiens
KLIPFLEKL

SEQ ID NO: 12742 - protein, 9 aa, Homo Sapiens
KLISDINKA

SEQ ID NO: 12743 - protein, 9 aa, Homo Sapiens
KLISELQKL

SEQ ID NO: 12744 - protein, 9 aa, Homo Sapiens
KLKEDLAKA

SEQ ID NO: 12745 - protein, 9 aa, Homo Sapiens
KLKERLHQL

SEQ ID NO: 12746 - protein, 9 aa, Homo Sapiens
KLKEYVDCL

SEQ ID NO: 12747 - protein, 9 aa, Homo Sapiens
KLKKEIEEL

SEQ ID NO: 12748 - protein, 9 aa, Homo Sapiens
KLKKELERL

SEQ ID NO: 12749 - protein, 9 aa, Homo Sapiens
KLKKFLNKL

SEQ ID NO: 12750 - protein, 9 aa, Homo Sapiens
KLKNVIHKI

SEQ ID NO: 12751 - protein, 9 aa, Homo Sapiens
KLKSAIEQA

SEQ ID NO: 12752 - protein, 9 aa, Homo Sapiens
KLLDVVHPA

SEQ ID NO: 12753 - protein, 9 aa, Homo Sapiens
KLMDQLEAL

SEQ ID NO: 12754 - protein, 9 aa, Homo Sapiens
KLMELLEEI

SEQ ID NO: 12755 - protein, 9 aa, Homo Sapiens
KLPEISHRL

SEQ ID NO: 12756 - protein, 9 aa, Homo Sapiens
KLPGNISSL

SEQ ID NO: 12757 - protein, 9 aa, Homo Sapiens
KLPQFCAHL

SEQ ID NO: 12758 - protein, 9 aa, Homo Sapiens
KLREDLERL

SEQ ID NO: 12759 - protein, 9 aa, Homo Sapiens
KLSDLDNKL

SEQ ID NO: 12760 - protein, 9 aa, Homo Sapiens
KLSEECNSL

SEQ ID NO: 12761 - protein, 9 aa, Homo Sapiens
KLSEVNKRL

SEQ ID NO: 12762 - protein, 9 aa, Homo Sapiens
KLSPKAEEV

SEQ ID NO: 12763 - protein, 9 aa, Homo Sapiens
KLTEIRHEV

SEQ ID NO: 12764 - protein, 9 aa, Homo Sapiens
KLVEYIVKA

SEQ ID NO: 12765 - protein, 9 aa, Homo Sapiens
KLYDGFQYL

SEQ ID NO: 12766 - protein, 9 aa, Homo Sapiens
KMADIEYRL

SEQ ID NO: 12767 - protein, 9 aa, Homo Sapiens
KMAECYTML

SEQ ID NO: 12768 - protein, 9 aa, Homo Sapiens
KMAEMLVEL

SEQ ID NO: 12769 - protein, 9 aa, Homo Sapiens
KMIEAIKES

SEQ ID NO: 12770 - protein, 9 aa, Homo Sapiens
KMKETLQNV

SEQ ID NO: 12771 - protein, 9 aa, Homo Sapiens
KMMDKVEFV

SEQ ID NO: 12772 - protein, 9 aa, Homo Sapiens
KMPEINAKV

SEQ ID NO: 12773 - protein, 9 aa, Homo Sapiens
KQADPFASL

SEQ ID NO: 12774 - protein, 9 aa, Homo Sapiens
KQAEAVTAL

SEQ ID NO: 12775 - protein, 9 aa, Homo Sapiens
KQAEILQES

SEQ ID NO: 12776 - protein, 9 aa, Homo Sapiens
KQAEIVKRL

SEQ ID NO: 12777 - protein, 9 aa, Homo Sapiens
KQAETIEKL

SEQ ID NO: 12778 - protein, 9 aa, Homo Sapiens
KQAGLVSKI

SEQ ID NO: 12779 - protein, 9 aa, Homo Sapiens
KQAGLVVKL

SEQ ID NO: 12780 - protein, 9 aa, Homo Sapiens
KQAVLYNAL

SEQ ID NO: 12781 - protein, 9 aa, Homo Sapiens
KQCKYYHGL

SEQ ID NO: 12782 - protein, 9 aa, Homo Sapiens
KQCRLANGL

SEQ ID NO: 12783 - protein, 9 aa, Homo Sapiens
KQFEGTVEI

SEQ ID NO: 12784 - protein, 9 aa, Homo Sapiens
KQFEKQVEL

SEQ ID NO: 12785 - protein, 9 aa, Homo Sapiens
KQFQFGHAL

SEQ ID NO: 12786 - protein, 9 aa, Homo Sapiens
KQGAIYHGL

SEQ ID NO: 12787 - protein, 9 aa, Homo Sapiens
KQGPTGIHV

SEQ ID NO: 12788 - protein, 9 aa, Homo Sapiens
KQGPVATGV

SEQ ID NO: 12789 - protein, 9 aa, Homo Sapiens
KQIDRQLTA

SEQ ID NO: 12790 - protein, 9 aa, Homo Sapiens
KQIDSVNHI

SEQ ID NO: 12791 - protein, 9 aa, Homo Sapiens
KQIDVYRSV

SEQ ID NO: 12792 - protein, 9 aa, Homo Sapiens
KQIEICNRL

SEQ ID NO: 12793 - protein, 9 aa, Homo Sapiens
KQIETGPFL

SEQ ID NO: 12794 - protein, 9 aa, Homo Sapiens
KQIKEIKEV

SEQ ID NO: 12795 - protein, 9 aa, Homo Sapiens
KQIPAITCI

SEQ ID NO: 12796 - protein, 9 aa, Homo Sapiens
KQIQNLQKA

SEQ ID NO: 12797 - protein, 9 aa, Homo Sapiens
KQIVEILTA

SEQ ID NO: 12798 - protein, 9 aa, Homo Sapiens
KQKEHLDTL

SEQ ID NO: 12799 - protein, 9 aa, Homo Sapiens
KQMDHFVGL

SEQ ID NO: 12800 - protein, 9 aa, Homo Sapiens
KQMEKIQPA

SEQ ID NO: 12801 - protein, 9 aa, Homo Sapiens
KQMSISTGL

SEQ ID NO: 12802 - protein, 9 aa, Homo Sapiens
KQPAFTIHV

SEQ ID NO: 12803 - protein, 9 aa, Homo Sapiens
KQSDVMRFL

SEQ ID NO: 12804 - protein, 9 aa, Homo Sapiens
KQSEEHNML

SEQ ID NO: 12805 - protein, 9 aa, Homo Sapiens
KQSNVQILV

SEQ ID NO: 12806 - protein, 9 aa, Homo Sapiens
KQSSVAEEV

SEQ ID NO: 12807 - protein, 9 aa, Homo Sapiens
KQSSVMQRL

SEQ ID NO: 12808 - protein, 9 aa, Homo Sapiens
KQTEIAKRL

SEQ ID NO: 12809 - protein, 9 aa, Homo Sapiens
KQTEVLVTA

SEQ ID NO: 12810 - protein, 9 aa, Homo Sapiens
KQVDLIDLV

SEQ ID NO: 12811 - protein, 9 aa, Homo Sapiens
KQVDVNIKL

SEQ ID NO: 12812 - protein, 9 aa, Homo Sapiens
KQVEAGVCV

SEQ ID NO: 12813 - protein, 9 aa, Homo Sapiens
KQVEEIFNL

SEQ ID NO: 12814 - protein, 9 aa, Homo Sapiens
KQVSDLISV

SEQ ID NO: 12815 - protein, 9 aa, Homo Sapiens
KQYGNEVFL

SEQ ID NO: 12816 - protein, 9 aa, Homo Sapiens
KRISELEAL

SEQ ID NO: 12817 - protein, 9 aa, Homo Sapiens
KSVDFIEKA

SEQ ID NO: 12818 - protein, 9 aa, Homo Sapiens
KTADICQML

SEQ ID NO: 12819 - protein, 9 aa, Homo Sapiens
KTADVVQQA

SEQ ID NO: 12820 - protein, 9 aa, Homo Sapiens
KTAEEVAAL

SEQ ID NO: 12821 - protein, 9 aa, Homo Sapiens
KTAEFLSKL

SEQ ID NO: 12822 - protein, 9 aa, Homo Sapiens
KTAEMNEKL

SEQ ID NO: 12823 - protein, 9 aa, Homo Sapiens
KTAITVEHL

SEQ ID NO: 12824 - protein, 9 aa, Homo Sapiens
KTASINQNV

SEQ ID NO: 12825 - protein, 9 aa, Homo Sapiens
KTAVAIEKV

SEQ ID NO: 12826 - protein, 9 aa, Homo Sapiens
KTFEELEHV

SEQ ID NO: 12827 - protein, 9 aa, Homo Sapiens
KTFEGFCAL

SEQ ID NO: 12828 - protein, 9 aa, Homo Sapiens
KTGPVAKEL

SEQ ID NO: 12829 - protein, 9 aa, Homo Sapiens
KTIDAMKRV

SEQ ID NO: 12830 - protein, 9 aa, Homo Sapiens
KTIDYIQFL

SEQ ID NO: 12831 - protein, 9 aa, Homo Sapiens
KTIETSPSL

SEQ ID NO: 12832 - protein, 9 aa, Homo Sapiens
KTIETVKAA

SEQ ID NO: 12833 - protein, 9 aa, Homo Sapiens
KTIGDLSTL

SEQ ID NO: 12834 - protein, 9 aa, Homo Sapiens
KTIRDIIAL

SEQ ID NO: 12835 - protein, 9 aa, Homo Sapiens
KTKDIVNGL

SEQ ID NO: 12836 - protein, 9 aa, Homo Sapiens
KTKDLLNNV

SEQ ID NO: 12837 - protein, 9 aa, Homo Sapiens
KTKESSEYL

SEQ ID NO: 12838 - protein, 9 aa, Homo Sapiens
KTMETAEKL

SEQ ID NO: 12839 - protein, 9 aa, Homo Sapiens
KTTENCENL

SEQ ID NO: 12840 - protein, 9 aa, Homo Sapiens
KTTTIAVEV

SEQ ID NO: 12841 - protein, 9 aa, Homo Sapiens
KTVAQSQQL

SEQ ID NO: 12842 - protein, 9 aa, Homo Sapiens
KTVEYITKL

SEQ ID NO: 12843 - protein, 9 aa, Homo Sapiens
KTVLELQYV

SEQ ID NO: 12844 - protein, 9 aa, Homo Sapiens
KTVNVITTA

SEQ ID NO: 12845 - protein, 9 aa, Homo Sapiens
KTVQVIVQA

SEQ ID NO: 12846 - protein, 9 aa, Homo Sapiens
KVAEIHQAL

SEQ ID NO: 12847 - protein, 9 aa, Homo Sapiens
KVAEKLEAL

SEQ ID NO: 12848 - protein, 9 aa, Homo Sapiens
KVAELFEKL

SEQ ID NO: 12849 - protein, 9 aa, Homo Sapiens
KVAELKQEL

SEQ ID NO: 12850 - protein, 9 aa, Homo Sapiens
KVAETAVQL

SEQ ID NO: 12851 - protein, 9 aa, Homo Sapiens
KVAGMDVEL

SEQ ID NO: 12852 - protein, 9 aa, Homo Sapiens
KVANYCRQV

SEQ ID NO: 12853 - protein, 9 aa, Homo Sapiens
KVASLLHQV

SEQ ID NO: 12854 - protein, 9 aa, Homo Sapiens
KVCDIVSSL

SEQ ID NO: 12855 - protein, 9 aa, Homo Sapiens
KVFELMTSL

SEQ ID NO: 12856 - protein, 9 aa, Homo Sapiens
KVFGALKGA

SEQ ID NO: 12857 - protein, 9 aa, Homo Sapiens
KVFGDLDQV

SEQ ID NO: 12858 - protein, 9 aa, Homo Sapiens
KVFPSISKL

SEQ ID NO: 12859 - protein, 9 aa, Homo Sapiens
KVGPVPVLV

SEQ ID NO: 12860 - protein, 9 aa, Homo Sapiens
KVIAATNRV

SEQ ID NO: 12861 - protein, 9 aa, Homo Sapiens
KVIDEIYRV

SEQ ID NO: 12862 - protein, 9 aa, Homo Sapiens
KVIDGLETL

SEQ ID NO: 12863 - protein, 9 aa, Homo Sapiens
KVIDTQQKV

SEQ ID NO: 12864 - protein, 9 aa, Homo Sapiens
KVIDVDHGI

SEQ ID NO: 12865 - protein, 9 aa, Homo Sapiens
KVIDYVPGI

SEQ ID NO: 12866 - protein, 9 aa, Homo Sapiens
KVIEDVAFA

SEQ ID NO: 12867 - protein, 9 aa, Homo Sapiens
KVIEELLQT

SEQ ID NO: 12868 - protein, 9 aa, Homo Sapiens
KVIEINPYL

SEQ ID NO: 12869 - protein, 9 aa, Homo Sapiens
KVIEKVLIA

SEQ ID NO: 12870 - protein, 9 aa, Homo Sapiens
KVIESTQDL

SEQ ID NO: 12871 - protein, 9 aa, Homo Sapiens
KVIEVFIRA

SEQ ID NO: 12872 - protein, 9 aa, Homo Sapiens
KVIGIIEHL

SEQ ID NO: 12873 - protein, 9 aa, Homo Sapiens
KVIYVLPML

SEQ ID NO: 12874 - protein, 9 aa, Homo Sapiens
KVKAEVQNL

SEQ ID NO: 12875 - protein, 9 aa, Homo Sapiens
KVKDDVDKL

SEQ ID NO: 12876 - protein, 9 aa, Homo Sapiens
KVKDILSKV

SEQ ID NO: 12877 - protein, 9 aa, Homo Sapiens
KVKDWVERL

SEQ ID NO: 12878 - protein, 9 aa, Homo Sapiens
KVKEFCENL

SEQ ID NO: 12879 - protein, 9 aa, Homo Sapiens
KVKEFLSTL

SEQ ID NO: 12880 - protein, 9 aa, Homo Sapiens
KVKEGMNIV

SEQ ID NO: 12881 - protein, 9 aa, Homo Sapiens
KVKEQLEAA

SEQ ID NO: 12882 - protein, 9 aa, Homo Sapiens
KVKSILNSL

SEQ ID NO: 12883 - protein, 9 aa, Homo Sapiens
KVLERVNAV

SEQ ID NO: 12884 - protein, 9 aa, Homo Sapiens
KVLGKIEKV

SEQ ID NO: 12885 - protein, 9 aa, Homo Sapiens
KVMDDLDRA

SEQ ID NO: 12886 - protein, 9 aa, Homo Sapiens
KVMDEVEKA

SEQ ID NO: 12887 - protein, 9 aa, Homo Sapiens
KVMDVTEKL

SEQ ID NO: 12888 - protein, 9 aa, Homo Sapiens
KVMGTFSTV

SEQ ID NO: 12889 - protein, 9 aa, Homo Sapiens
KVPAGVQEL

SEQ ID NO: 12890 - protein, 9 aa, Homo Sapiens
KVPEIEVTV

SEQ ID NO: 12891 - protein, 9 aa, Homo Sapiens
KVPEIISSI

SEQ ID NO: 12892 - protein, 9 aa, Homo Sapiens
KVPELIRTI

SEQ ID NO: 12893 - protein, 9 aa, Homo Sapiens
KVPEWVDTV

SEQ ID NO: 12894 - protein, 9 aa, Homo Sapiens
KVPEYIKKA

SEQ ID NO: 12895 - protein, 9 aa, Homo Sapiens
KVRETIEAL

SEQ ID NO: 12896 - protein, 9 aa, Homo Sapiens
KVSELKEEL

SEQ ID NO: 12897 - protein, 9 aa, Homo Sapiens
KVSELTERL

SEQ ID NO: 12898 - protein, 9 aa, Homo Sapiens
KVSELVQFL

SEQ ID NO: 12899 - protein, 9 aa, Homo Sapiens
KVSESTHVL

SEQ ID NO: 12900 - protein, 9 aa, Homo Sapiens
KVSQLIHHL

SEQ ID NO: 12901 - protein, 9 aa, Homo Sapiens
KVTDDLVCL

SEQ ID NO: 12902 - protein, 9 aa, Homo Sapiens
KVVALVHAV

SEQ ID NO: 12903 - protein, 9 aa, Homo Sapiens
KVVDRIYSL

SEQ ID NO: 12904 - protein, 9 aa, Homo Sapiens
KVVDVDVKL

SEQ ID NO: 12905 - protein, 9 aa, Homo Sapiens
KVVDVVRNL

SEQ ID NO: 12906 - protein, 9 aa, Homo Sapiens
KVVEDIEYL

SEQ ID NO: 12907 - protein, 9 aa, Homo Sapiens
KVVEELTRI

SEQ ID NO: 12908 - protein, 9 aa, Homo Sapiens
KVVTGVANA

SEQ ID NO: 12909 - protein, 9 aa, Homo Sapiens
KVVTIIPKI

SEQ ID NO: 12910 - protein, 9 aa, Homo Sapiens
KVVVYLQKL

SEQ ID NO: 12911 - protein, 9 aa, Homo Sapiens
KVYENDDQL

SEQ ID NO: 12912 - protein, 9 aa, Homo Sapiens
KVYGSGEKV

SEQ ID NO: 12913 - protein, 9 aa, Homo Sapiens
KVYPVQEAL

SEQ ID NO: 12914 - protein, 9 aa, Homo Sapiens
KVYSKMEKL

SEQ ID NO: 12915 - protein, 9 aa, Homo Sapiens
LAAARLAAA

SEQ ID NO: 12916 - protein, 9 aa, Homo Sapiens
LAADCAHEL

SEQ ID NO: 12917 - protein, 9 aa, Homo Sapiens
LASTLVHSV

SEQ ID NO: 12918 - protein, 9 aa, Homo Sapiens
LDTNADKQL

SEQ ID NO: 12919 - protein, 9 aa, Homo Sapiens
LFNKQLESI

SEQ ID NO: 12920 - protein, 9 aa, Homo Sapiens
LGAEVYHTL

SEQ ID NO: 12921 - protein, 9 aa, Homo Sapiens
LIADLKYEL

SEQ ID NO: 12922 - protein, 9 aa, Homo Sapiens
LIAKINQRL

SEQ ID NO: 12923 - protein, 9 aa, Homo Sapiens
LIAKVIQNL

SEQ ID NO: 12924 - protein, 9 aa, Homo Sapiens
LICGFIIKL

SEQ ID NO: 12925 - protein, 9 aa, Homo Sapiens
LIGPKLYEA

SEQ ID NO: 12926 - protein, 9 aa, Homo Sapiens
LIIEKLLKL

SEQ ID NO: 12927 - protein, 9 aa, Homo Sapiens
LIKKIIECV

SEQ ID NO: 12928 - protein, 9 aa, Homo Sapiens
LIMDICDKV

SEQ ID NO: 12929 - protein, 9 aa, Homo Sapiens
LIPDIDLKL

SEQ ID NO: 12930 - protein, 9 aa, Homo Sapiens
LIPEYLNFI

SEQ ID NO: 12931 - protein, 9 aa, Homo Sapiens
LIPGFTPGL

SEQ ID NO: 12932 - protein, 9 aa, Homo Sapiens
LIPKFVSFL

SEQ ID NO: 12933 - protein, 9 aa, Homo Sapiens
LIPMIIHQL

SEQ ID NO: 12934 - protein, 9 aa, Homo Sapiens
LIPRMCHNV

SEQ ID NO: 12935 - protein, 9 aa, Homo Sapiens
LISDLEHRL

SEQ ID NO: 12936 - protein, 9 aa, Homo Sapiens
LISPLVQLL

SEQ ID NO: 12937 - protein, 9 aa, Homo Sapiens
LIVDQVQKL

SEQ ID NO: 12938 - protein, 9 aa, Homo Sapiens
LLAEENQRL

SEQ ID NO: 12939 - protein, 9 aa, Homo Sapiens
LLAEKVEQL

SEQ ID NO: 12940 - protein, 9 aa, Homo Sapiens
LLAEVIENL

SEQ ID NO: 12941 - protein, 9 aa, Homo Sapiens
LLAPIRVLL

SEQ ID NO: 12942 - protein, 9 aa, Homo Sapiens
LLASIVSEL

SEQ ID NO: 12943 - protein, 9 aa, Homo Sapiens
LLCDLINKL

SEQ ID NO: 12944 - protein, 9 aa, Homo Sapiens
LLEDSCHYL

SEQ ID NO: 12945 - protein, 9 aa, Homo Sapiens
LLGPPPVGV

SEQ ID NO: 12946 - protein, 9 aa, Homo Sapiens
LLGPRLVLA

SEQ ID NO: 12947 - protein, 9 aa, Homo Sapiens
LLIAPMPTA

SEQ ID NO: 12948 - protein, 9 aa, Homo Sapiens
LLIDELNKL

SEQ ID NO: 12949 - protein, 9 aa, Homo Sapiens
LLIEKCNTV

SEQ ID NO: 12950 - protein, 9 aa, Homo Sapiens
LLIPGLATA

SEQ ID NO: 12951 - protein, 9 aa, Homo Sapiens
LLKDSIVQL

SEQ ID NO: 12952 - protein, 9 aa, Homo Sapiens
LLKERLDQI

SEQ ID NO: 12953 - protein, 9 aa, Homo Sapiens
LLKEYLVTL

SEQ ID NO: 12954 - protein, 9 aa, Homo Sapiens
LLKQKMDEL

SEQ ID NO: 12955 - protein, 9 aa, Homo Sapiens
LLMDRVDEM

SEQ ID NO: 12956 - protein, 9 aa, Homo Sapiens
LLMEHIQEI

SEQ ID NO: 12957 - protein, 9 aa, Homo Sapiens
LLNSEVHML

SEQ ID NO: 12958 - protein, 9 aa, Homo Sapiens
LLPDIISRL

SEQ ID NO: 12959 - protein, 9 aa, Homo Sapiens
LLPDIVTCV

SEQ ID NO: 12960 - protein, 9 aa, Homo Sapiens
LLPDLIQKV

SEQ ID NO: 12961 - protein, 9 aa, Homo Sapiens
LLPDNVHYV

SEQ ID NO: 12962 - protein, 9 aa, Homo Sapiens
LLPDQIEKL

SEQ ID NO: 12963 - protein, 9 aa, Homo Sapiens
LLPEDSQKL

SEQ ID NO: 12964 - protein, 9 aa, Homo Sapiens
LLPEELTPL

SEQ ID NO: 12965 - protein, 9 aa, Homo Sapiens
LLPEICHFL

SEQ ID NO: 12966 - protein, 9 aa, Homo Sapiens
LLREKVEFL

SEQ ID NO: 12967 - protein, 9 aa, Homo Sapiens
LLRLQVEEL

SEQ ID NO: 12968 - protein, 9 aa, Homo Sapiens
LLSEIEEHL

SEQ ID NO: 12969 - protein, 9 aa, Homo Sapiens
LLSESNERL

SEQ ID NO: 12970 - protein, 9 aa, Homo Sapiens
LLSPHSQVL

SEQ ID NO: 12971 - protein, 9 aa, Homo Sapiens
LLSPSNEKL

SEQ ID NO: 12972 - protein, 9 aa, Homo Sapiens
LLSSIVEEL

SEQ ID NO: 12973 - protein, 9 aa, Homo Sapiens
LLTELSNSL

SEQ ID NO: 12974 - protein, 9 aa, Homo Sapiens
LLVDEIMRA

SEQ ID NO: 12975 - protein, 9 aa, Homo Sapiens
LLVEEIHRL

SEQ ID NO: 12976 - protein, 9 aa, Homo Sapiens
LLVGDVAQA

SEQ ID NO: 12977 - protein, 9 aa, Homo Sapiens
LLVKELQSL

SEQ ID NO: 12978 - protein, 9 aa, Homo Sapiens
LLYDLADQL

SEQ ID NO: 12979 - protein, 9 aa, Homo Sapiens
LMAHAMEEV

SEQ ID NO: 12980 - protein, 9 aa, Homo Sapiens
LMKDLADEL

SEQ ID NO: 12981 - protein, 9 aa, Homo Sapiens
LMKQYIEFV

SEQ ID NO: 12982 - protein, 9 aa, Homo Sapiens
LMPATLARA

SEQ ID NO: 12983 - protein, 9 aa, Homo Sapiens
LMVDHVTEV

SEQ ID NO: 12984 - protein, 9 aa, Homo Sapiens
LQAAIQKSL

SEQ ID NO: 12985 - protein, 9 aa, Homo Sapiens
LQADLQNGL

SEQ ID NO: 12986 - protein, 9 aa, Homo Sapiens
LQADVISKL

SEQ ID NO: 12987 - protein, 9 aa, Homo Sapiens
LQAEEVARL

SEQ ID NO: 12988 - protein, 9 aa, Homo Sapiens
LQAEPHNSL

SEQ ID NO: 12989 - protein, 9 aa, Homo Sapiens
LQAETSQQL

SEQ ID NO: 12990 - protein, 9 aa, Homo Sapiens
LQAHGADEL

SEQ ID NO: 12991 - protein, 9 aa, Homo Sapiens
LQAHYEDFL

SEQ ID NO: 12992 - protein, 9 aa, Homo Sapiens
LQAILVHEA

SEQ ID NO: 12993 - protein, 9 aa, Homo Sapiens
LQAMVAHEL

SEQ ID NO: 12994 - protein, 9 aa, Homo Sapiens
LQCDTTEKL

SEQ ID NO: 12995 - protein, 9 aa, Homo Sapiens
LQFDKAINA

SEQ ID NO: 12996 - protein, 9 aa, Homo Sapiens
LQFPRPVKL

SEQ ID NO: 12997 - protein, 9 aa, Homo Sapiens
LQFTPQHKL

SEQ ID NO: 12998 - protein, 9 aa, Homo Sapiens
LQHDKLVRL

SEQ ID NO: 12999 - protein, 9 aa, Homo Sapiens
LQIDNARLA

SEQ ID NO: 13000 - protein, 9 aa, Homo Sapiens
LQIKHTQAL

SEQ ID NO: 13001 - protein, 9 aa, Homo Sapiens
LQNAQHDPL

SEQ ID NO: 13002 - protein, 9 aa, Homo Sapiens
LQNPDLVSL

SEQ ID NO: 13003 - protein, 9 aa, Homo Sapiens
LQQEIYQTL

SEQ ID NO: 13004 - protein, 9 aa, Homo Sapiens
LQSAVITKV

SEQ ID NO: 13005 - protein, 9 aa, Homo Sapiens
LQSDVTCQV

SEQ ID NO: 13006 - protein, 9 aa, Homo Sapiens
LQSNITQCL

SEQ ID NO: 13007 - protein, 9 aa, Homo Sapiens
LQSVISHLL

SEQ ID NO: 13008 - protein, 9 aa, Homo Sapiens
LQSVVRCEV

SEQ ID NO: 13009 - protein, 9 aa, Homo Sapiens
LQTDLSDGL

SEQ ID NO: 13010 - protein, 9 aa, Homo Sapiens
LQTEIKNQL

SEQ ID NO: 13011 - protein, 9 aa, Homo Sapiens
LQTSIREEI

SEQ ID NO: 13012 - protein, 9 aa, Homo Sapiens
LQVEEVHQL

SEQ ID NO: 13013 - protein, 9 aa, Homo Sapiens
LQYSFPLQL

SEQ ID NO: 13014 - protein, 9 aa, Homo Sapiens
LQYSRQEGL

SEQ ID NO: 13015 - protein, 9 aa, Homo Sapiens
LSADIFQQV

SEQ ID NO: 13016 - protein, 9 aa, Homo Sapiens
LSVEIVHEL

SEQ ID NO: 13017 - protein, 9 aa, Homo Sapiens
LTADAHHYL

SEQ ID NO: 13018 - protein, 9 aa, Homo Sapiens
LTAEDLFEA

SEQ ID NO: 13019 - protein, 9 aa, Homo Sapiens
LTAEILELA

SEQ ID NO: 13020 - protein, 9 aa, Homo Sapiens
LTAPALALA

SEQ ID NO: 13021 - protein, 9 aa, Homo Sapiens
LTAPLSQRL

SEQ ID NO: 13022 - protein, 9 aa, Homo Sapiens
LTATLMHRL

SEQ ID NO: 13023 - protein, 9 aa, Homo Sapiens
LTATSIDRL

SEQ ID NO: 13024 - protein, 9 aa, Homo Sapiens
LTIEKISAL

SEQ ID NO: 13025 - protein, 9 aa, Homo Sapiens
LTKEKIEEL

SEQ ID NO: 13026 - protein, 9 aa, Homo Sapiens
LTKELLHSV

SEQ ID NO: 13027 - protein, 9 aa, Homo Sapiens
LTKKLLDLV

SEQ ID NO: 13028 - protein, 9 aa, Homo Sapiens
LTKVGAEEL

SEQ ID NO: 13029 - protein, 9 aa, Homo Sapiens
LTMEVIRQV

SEQ ID NO: 13030 - protein, 9 aa, Homo Sapiens
LTNDWEDHL

SEQ ID NO: 13031 - protein, 9 aa, Homo Sapiens
LTNEGIQYL

SEQ ID NO: 13032 - protein, 9 aa, Homo Sapiens
LTPEFSQRL

SEQ ID NO: 13033 - protein, 9 aa, Homo Sapiens
LTSELITHI

SEQ ID NO: 13034 - protein, 9 aa, Homo Sapiens
LTSVINQKL

SEQ ID NO: 13035 - protein, 9 aa, Homo Sapiens
LTTYLQEKL

SEQ ID NO: 13036 - protein, 9 aa, Homo Sapiens
LVADLVQEV

SEQ ID NO: 13037 - protein, 9 aa, Homo Sapiens
LVAEHLDHL

SEQ ID NO: 13038 - protein, 9 aa, Homo Sapiens
LVAEIANVV

SEQ ID NO: 13039 - protein, 9 aa, Homo Sapiens
LVAEIITHL

SEQ ID NO: 13040 - protein, 9 aa, Homo Sapiens
LVAEVTQQL

SEQ ID NO: 13041 - protein, 9 aa, Homo Sapiens
LVAQIVTKV

SEQ ID NO: 13042 - protein, 9 aa, Homo Sapiens
LVASFSERV

SEQ ID NO: 13043 - protein, 9 aa, Homo Sapiens
LVASHLEKL

SEQ ID NO: 13044 - protein, 9 aa, Homo Sapiens
LVEPKLAEL

SEQ ID NO: 13045 - protein, 9 aa, Homo Sapiens
LVFNEILQA

SEQ ID NO: 13046 - protein, 9 aa, Homo Sapiens
LVFPGAQRM

SEQ ID NO: 13047 - protein, 9 aa, Homo Sapiens
LVIDAVREI

SEQ ID NO: 13048 - protein, 9 aa, Homo Sapiens
LVKGSIDEV

SEQ ID NO: 13049 - protein, 9 aa, Homo Sapiens
LVKTDMEKL

SEQ ID NO: 13050 - protein, 9 aa, Homo Sapiens
LVMGDIPAA

SEQ ID NO: 13051 - protein, 9 aa, Homo Sapiens
LVPDVVNEV

SEQ ID NO: 13052 - protein, 9 aa, Homo Sapiens
LVPEFVHSI

SEQ ID NO: 13053 - protein, 9 aa, Homo Sapiens
LVPGHLDQV

SEQ ID NO: 13054 - protein, 9 aa, Homo Sapiens
LVPQNNEKL

SEQ ID NO: 13055 - protein, 9 aa, Homo Sapiens
LVSDANQHV

SEQ ID NO: 13056 - protein, 9 aa, Homo Sapiens
LVSPANQEL

SEQ ID NO: 13057 - protein, 9 aa, Homo Sapiens
LVSQLVHSL

SEQ ID NO: 13058 - protein, 9 aa, Homo Sapiens
LVTHLVTKL

SEQ ID NO: 13059 - protein, 9 aa, Homo Sapiens
LVVEHIEKM

SEQ ID NO: 13060 - protein, 9 aa, Homo Sapiens
LYEKDIEEL

SEQ ID NO: 13061 - protein, 9 aa, Homo Sapiens
LYSEVKEVL

SEQ ID NO: 13062 - protein, 9 aa, Homo Sapiens
MAINSISKL

SEQ ID NO: 13063 - protein, 9 aa, Homo Sapiens
MIADIHCMI

SEQ ID NO: 13064 - protein, 9 aa, Homo Sapiens
MIIENFEAL

SEQ ID NO: 13065 - protein, 9 aa, Homo Sapiens
MIIPSLEEL

SEQ ID NO: 13066 - protein, 9 aa, Homo Sapiens
MIKEKLCYV

SEQ ID NO: 13067 - protein, 9 aa, Homo Sapiens
MIPLLLAAL

SEQ ID NO: 13068 - protein, 9 aa, Homo Sapiens
MLANDIARL

SEQ ID NO: 13069 - protein, 9 aa, Homo Sapiens
MLASAVEKL

SEQ ID NO: 13070 - protein, 9 aa, Homo Sapiens
MLAWINESL

SEQ ID NO: 13071 - protein, 9 aa, Homo Sapiens
MLFPGSIAL

SEQ ID NO: 13072 - protein, 9 aa, Homo Sapiens
MLIEDVDAL

SEQ ID NO: 13073 - protein, 9 aa, Homo Sapiens
MLIEVIEKL

SEQ ID NO: 13074 - protein, 9 aa, Homo Sapiens
MLIKLLEVL

SEQ ID NO: 13075 - protein, 9 aa, Homo Sapiens
MLKEKLAEL

SEQ ID NO: 13076 - protein, 9 aa, Homo Sapiens
MLPGFLHRL

SEQ ID NO: 13077 - protein, 9 aa, Homo Sapiens
MLPKDIAKL

SEQ ID NO: 13078 - protein, 9 aa, Homo Sapiens
MLPLLAALL

SEQ ID NO: 13079 - protein, 9 aa, Homo Sapiens
MLPSILNQL

SEQ ID NO: 13080 - protein, 9 aa, Homo Sapiens
MLSEHTSKL

SEQ ID NO: 13081 - protein, 9 aa, Homo Sapiens
MLVPVIEKL

SEQ ID NO: 13082 - protein, 9 aa, Homo Sapiens
MQAESCYQL

SEQ ID NO: 13083 - protein, 9 aa, Homo Sapiens
MQAHITQAL

SEQ ID NO: 13084 - protein, 9 aa, Homo Sapiens
MQAPLLIAL

SEQ ID NO: 13085 - protein, 9 aa, Homo Sapiens
MQGPIPERI

SEQ ID NO: 13086 - protein, 9 aa, Homo Sapiens
MQISFIHQL

SEQ ID NO: 13087 - protein, 9 aa, Homo Sapiens
MTALVNVAL

SEQ ID NO: 13088 - protein, 9 aa, Homo Sapiens
MTCEQAQLL

SEQ ID NO: 13089 - protein, 9 aa, Homo Sapiens
MTGPGTHQL

SEQ ID NO: 13090 - protein, 9 aa, Homo Sapiens
MTIENMNHL

SEQ ID NO: 13091 - protein, 9 aa, Homo Sapiens
MTKEELNAL

SEQ ID NO: 13092 - protein, 9 aa, Homo Sapiens
MTPEIIQKL

SEQ ID NO: 13093 - protein, 9 aa, Homo Sapiens
MTSEIHNTV

SEQ ID NO: 13094 - protein, 9 aa, Homo Sapiens
MTSNIVQCL

SEQ ID NO: 13095 - protein, 9 aa, Homo Sapiens
MTYWHLLNA

SEQ ID NO: 13096 - protein, 9 aa, Homo Sapiens
MVADKFTEL

SEQ ID NO: 13097 - protein, 9 aa, Homo Sapiens
MVAEILHHL

SEQ ID NO: 13098 - protein, 9 aa, Homo Sapiens
MVAPAVASV

SEQ ID NO: 13099 - protein, 9 aa, Homo Sapiens
MVAQLVQRL

SEQ ID NO: 13100 - protein, 9 aa, Homo Sapiens
MVFNEILQA

SEQ ID NO: 13101 - protein, 9 aa, Homo Sapiens
MVIDVLHPG

SEQ ID NO: 13102 - protein, 9 aa, Homo Sapiens
MVKDALDQL

SEQ ID NO: 13103 - protein, 9 aa, Homo Sapiens
MVMETIEKI

SEQ ID NO: 13104 - protein, 9 aa, Homo Sapiens
MVPEDVPRL

SEQ ID NO: 13105 - protein, 9 aa, Homo Sapiens
MVPETTHEA

SEQ ID NO: 13106 - protein, 9 aa, Homo Sapiens
MVPPNIAEL

SEQ ID NO: 13107 - protein, 9 aa, Homo Sapiens
MVVDIVQEL

SEQ ID NO: 13108 - protein, 9 aa, Homo Sapiens
NAAAIYDLL

SEQ ID NO: 13109 - protein, 9 aa, Homo Sapiens
NAADIENRV

SEQ ID NO: 13110 - protein, 9 aa, Homo Sapiens
NAAEITDKL

SEQ ID NO: 13111 - protein, 9 aa, Homo Sapiens
NAANIFERL

SEQ ID NO: 13112 - protein, 9 aa, Homo Sapiens
NASPVISSV

SEQ ID NO: 13113 - protein, 9 aa, Homo Sapiens
NAVEAIHRA

SEQ ID NO: 13114 - protein, 9 aa, Homo Sapiens
NGLLFKELL

SEQ ID NO: 13115 - protein, 9 aa, Homo Sapiens
NIAILNNNL

SEQ ID NO: 13116 - protein, 9 aa, Homo Sapiens
NIAPIIQKV

SEQ ID NO: 13117 - protein, 9 aa, Homo Sapiens
NIFGPLVKL

SEQ ID NO: 13118 - protein, 9 aa, Homo Sapiens
NIICGITSV

SEQ ID NO: 13119 - protein, 9 aa, Homo Sapiens
NIIDHCEKL

SEQ ID NO: 13120 - protein, 9 aa, Homo Sapiens
NIIEAINEL

SEQ ID NO: 13121 - protein, 9 aa, Homo Sapiens
NIIELVHQV

SEQ ID NO: 13122 - protein, 9 aa, Homo Sapiens
NIIKLIDTV

SEQ ID NO: 13123 - protein, 9 aa, Homo Sapiens
NIIPFCDEV

SEQ ID NO: 13124 - protein, 9 aa, Homo Sapiens
NIIPIIAKA

SEQ ID NO: 13125 - protein, 9 aa, Homo Sapiens
NIIPVIAKA

SEQ ID NO: 13126 - protein, 9 aa, Homo Sapiens
NIIPVIEDA

SEQ ID NO: 13127 - protein, 9 aa, Homo Sapiens
NIIPYITNV

SEQ ID NO: 13128 - protein, 9 aa, Homo Sapiens
NIPEITPFL

SEQ ID NO: 13129 - protein, 9 aa, Homo Sapiens
NIPSFIVRL

SEQ ID NO: 13130 - protein, 9 aa, Homo Sapiens
NITELVNYL

SEQ ID NO: 13131 - protein, 9 aa, Homo Sapiens
NIVEKLREV

SEQ ID NO: 13132 - protein, 9 aa, Homo Sapiens
NIVERVKEV

SEQ ID NO: 13133 - protein, 9 aa, Homo Sapiens
NIVPVIAKA

SEQ ID NO: 13134 - protein, 9 aa, Homo Sapiens
NLFKHLAKA

SEQ ID NO: 13135 - protein, 9 aa, Homo Sapiens
NLIGKIEKL

SEQ ID NO: 13136 - protein, 9 aa, Homo Sapiens
NLKEAIETI

SEQ ID NO: 13137 - protein, 9 aa, Homo Sapiens
NLPAFVNRL

SEQ ID NO: 13138 - protein, 9 aa, Homo Sapiens
NLPSWCDRV

SEQ ID NO: 13139 - protein, 9 aa, Homo Sapiens
NMVAKVDEV

SEQ ID NO: 13140 - protein, 9 aa, Homo Sapiens
NMVDIIHSV

SEQ ID NO: 13141 - protein, 9 aa, Homo Sapiens
NQADTTHPL

SEQ ID NO: 13142 - protein, 9 aa, Homo Sapiens
NQAEPREFL

SEQ ID NO: 13143 - protein, 9 aa, Homo Sapiens
NQAIIKHLL

SEQ ID NO: 13144 - protein, 9 aa, Homo Sapiens
NQAKLIEFL

SEQ ID NO: 13145 - protein, 9 aa, Homo Sapiens
NQAQIEVRL

SEQ ID NO: 13146 - protein, 9 aa, Homo Sapiens
NQAVILYHL

SEQ ID NO: 13147 - protein, 9 aa, Homo Sapiens
NQCELLSQL

SEQ ID NO: 13148 - protein, 9 aa, Homo Sapiens
NQCRFVTGL

SEQ ID NO: 13149 - protein, 9 aa, Homo Sapiens
NQCTVQVRL

SEQ ID NO: 13150 - protein, 9 aa, Homo Sapiens
NQEDFFQRV

SEQ ID NO: 13151 - protein, 9 aa, Homo Sapiens
NQFDYQHGA

SEQ ID NO: 13152 - protein, 9 aa, Homo Sapiens
NQFPGFKEV

SEQ ID NO: 13153 - protein, 9 aa, Homo Sapiens
NQHPDVFYL

SEQ ID NO: 13154 - protein, 9 aa, Homo Sapiens
NQIECHPYL

SEQ ID NO: 13155 - protein, 9 aa, Homo Sapiens
NQIKKIENL

SEQ ID NO: 13156 - protein, 9 aa, Homo Sapiens
NQIPTVNNL

SEQ ID NO: 13157 - protein, 9 aa, Homo Sapiens
NQMSEAHKL

SEQ ID NO: 13158 - protein, 9 aa, Homo Sapiens
NQNPEVFFL

SEQ ID NO: 13159 - protein, 9 aa, Homo Sapiens
NQPEYIQKL

SEQ ID NO: 13160 - protein, 9 aa, Homo Sapiens
NQSDASHLL

SEQ ID NO: 13161 - protein, 9 aa, Homo Sapiens
NQSKIRVTL

SEQ ID NO: 13162 - protein, 9 aa, Homo Sapiens
NQSMLFDKL

SEQ ID NO: 13163 - protein, 9 aa, Homo Sapiens
NQSSVSHCV

SEQ ID NO: 13164 - protein, 9 aa, Homo Sapiens
NQVEALNNL

SEQ ID NO: 13165 - protein, 9 aa, Homo Sapiens
NQYENAEKL

SEQ ID NO: 13166 - protein, 9 aa, Homo Sapiens
NTATIFHEL

SEQ ID NO: 13167 - protein, 9 aa, Homo Sapiens
NTCPYVHNI

SEQ ID NO: 13168 - protein, 9 aa, Homo Sapiens
NTFGYIAKA

SEQ ID NO: 13169 - protein, 9 aa, Homo Sapiens
NTKEVIDRL

SEQ ID NO: 13170 - protein, 9 aa, Homo Sapiens
NTPEYMEKI

SEQ ID NO: 13171 - protein, 9 aa, Homo Sapiens
NTSSHVQEL

SEQ ID NO: 13172 - protein, 9 aa, Homo Sapiens
NVAAVDTNL

SEQ ID NO: 13173 - protein, 9 aa, Homo Sapiens
NVAEINRQV

SEQ ID NO: 13174 - protein, 9 aa, Homo Sapiens
NVAPIISKV

SEQ ID NO: 13175 - protein, 9 aa, Homo Sapiens
NVASIQNYL

SEQ ID NO: 13176 - protein, 9 aa, Homo Sapiens
NVIDNLIVA

SEQ ID NO: 13177 - protein, 9 aa, Homo Sapiens
NVIERLQEA

SEQ ID NO: 13178 - protein, 9 aa, Homo Sapiens
NVIETISSL

SEQ ID NO: 13179 - protein, 9 aa, Homo Sapiens
NVIRLISSL

SEQ ID NO: 13180 - protein, 9 aa, Homo Sapiens
NVIRQLGSL

SEQ ID NO: 13181 - protein, 9 aa, Homo Sapiens
NVKEYLESL

SEQ ID NO: 13182 - protein, 9 aa, Homo Sapiens
NVMEYCQSL

SEQ ID NO: 13183 - protein, 9 aa, Homo Sapiens
NVPDITTGL

SEQ ID NO: 13184 - protein, 9 aa, Homo Sapiens
NVPGEIVES

SEQ ID NO: 13185 - protein, 9 aa, Homo Sapiens
NVPSWCDRI

SEQ ID NO: 13186 - protein, 9 aa, Homo Sapiens
NVTHIDQAL

SEQ ID NO: 13187 - protein, 9 aa, Homo Sapiens
NVVLEIPAA

SEQ ID NO: 13188 - protein, 9 aa, Homo Sapiens
NVVNFIDCL

SEQ ID NO: 13189 - protein, 9 aa, Homo Sapiens
NVVVKIEEA

SEQ ID NO: 13190 - protein, 9 aa, Homo Sapiens
PDPKLLEKV

SEQ ID NO: 13191 - protein, 9 aa, Homo Sapiens
PKEGKVVDA

SEQ ID NO: 13192 - protein, 9 aa, Homo Sapiens
PLGPAPVSV

SEQ ID NO: 13193 - protein, 9 aa, Homo Sapiens
QAADLAYQL

SEQ ID NO: 13194 - protein, 9 aa, Homo Sapiens
QAIDSIHQV

SEQ ID NO: 13195 - protein, 9 aa, Homo Sapiens
QAPDIDVQL

SEQ ID NO: 13196 - protein, 9 aa, Homo Sapiens
QEQNQEQPI

SEQ ID NO: 13197 - protein, 9 aa, Homo Sapiens
QIADIVTSV

SEQ ID NO: 13198 - protein, 9 aa, Homo Sapiens
QIADLQQKL

SEQ ID NO: 13199 - protein, 9 aa, Homo Sapiens
QIAEAVEFL

SEQ ID NO: 13200 - protein, 9 aa, Homo Sapiens
QIFGNIKEA

SEQ ID NO: 13201 - protein, 9 aa, Homo Sapiens
QIHAFVDYL

SEQ ID NO: 13202 - protein, 9 aa, Homo Sapiens
QIIRELQVL

SEQ ID NO: 13203 - protein, 9 aa, Homo Sapiens
QITQINHGL

SEQ ID NO: 13204 - protein, 9 aa, Homo Sapiens
QIVEHLEEL

SEQ ID NO: 13205 - protein, 9 aa, Homo Sapiens
QIVELIEKI

SEQ ID NO: 13206 - protein, 9 aa, Homo Sapiens
QLAQFVHEV

SEQ ID NO: 13207 - protein, 9 aa, Homo Sapiens
QLIDIIHTA

SEQ ID NO: 13208 - protein, 9 aa, Homo Sapiens
QLIDKVWQL

SEQ ID NO: 13209 - protein, 9 aa, Homo Sapiens
QLIPEMQEA

SEQ ID NO: 13210 - protein, 9 aa, Homo Sapiens
QLIRDMVNV

SEQ ID NO: 13211 - protein, 9 aa, Homo Sapiens
QLNEKVAQL

SEQ ID NO: 13212 - protein, 9 aa, Homo Sapiens
QLVDIIEKV

SEQ ID NO: 13213 - protein, 9 aa, Homo Sapiens
QLVESLHKV

SEQ ID NO: 13214 - protein, 9 aa, Homo Sapiens
QMISRIEYI

SEQ ID NO: 13215 - protein, 9 aa, Homo Sapiens
QMISRIEYV

SEQ ID NO: 13216 - protein, 9 aa, Homo Sapiens
QMVKELQEI

SEQ ID NO: 13217 - protein, 9 aa, Homo Sapiens
QQADLQRRL

SEQ ID NO: 13218 - protein, 9 aa, Homo Sapiens
QQAELIQQL

SEQ ID NO: 13219 - protein, 9 aa, Homo Sapiens
QQASILHVL

SEQ ID NO: 13220 - protein, 9 aa, Homo Sapiens
QQIGKVVQV

SEQ ID NO: 13221 - protein, 9 aa, Homo Sapiens
QQIKELEKL

SEQ ID NO: 13222 - protein, 9 aa, Homo Sapiens
QQIKKLEEL

SEQ ID NO: 13223 - protein, 9 aa, Homo Sapiens
QQINKLEEL

SEQ ID NO: 13224 - protein, 9 aa, Homo Sapiens
QQNGSVVRV

SEQ ID NO: 13225 - protein, 9 aa, Homo Sapiens
QQSCLADHL

SEQ ID NO: 13226 - protein, 9 aa, Homo Sapiens
QQSELQSQV

SEQ ID NO: 13227 - protein, 9 aa, Homo Sapiens
QQSETFQFL

SEQ ID NO: 13228 - protein, 9 aa, Homo Sapiens
QQSQLVEKL

SEQ ID NO: 13229 - protein, 9 aa, Homo Sapiens
QQSSIHNVL

SEQ ID NO: 13230 - protein, 9 aa, Homo Sapiens
QQVARMEKL

SEQ ID NO: 13231 - protein, 9 aa, Homo Sapiens
QTGPLPTLV

SEQ ID NO: 13232 - protein, 9 aa, Homo Sapiens
QTIAKLEKA

SEQ ID NO: 13233 - protein, 9 aa, Homo Sapiens
QTIKDIASA

SEQ ID NO: 13234 - protein, 9 aa, Homo Sapiens
QTIQEIRHL

SEQ ID NO: 13235 - protein, 9 aa, Homo Sapiens
QTISALIKA

SEQ ID NO: 13236 - protein, 9 aa, Homo Sapiens
QTKEAIVSA

SEQ ID NO: 13237 - protein, 9 aa, Homo Sapiens
QTPGHTEEL

SEQ ID NO: 13238 - protein, 9 aa, Homo Sapiens
QVAELVKEL

SEQ ID NO: 13239 - protein, 9 aa, Homo Sapiens
QVAERVEAL

SEQ ID NO: 13240 - protein, 9 aa, Homo Sapiens
QVCAHTTRV

SEQ ID NO: 13241 - protein, 9 aa, Homo Sapiens
QVCAIIERV

SEQ ID NO: 13242 - protein, 9 aa, Homo Sapiens
QVFQGTNSL

SEQ ID NO: 13243 - protein, 9 aa, Homo Sapiens
QVGPLPSRL

SEQ ID NO: 13244 - protein, 9 aa, Homo Sapiens
QVGPQIPRA

SEQ ID NO: 13245 - protein, 9 aa, Homo Sapiens
QVIEELFKA

SEQ ID NO: 13246 - protein, 9 aa, Homo Sapiens
QVIEGISRL

SEQ ID NO: 13247 - protein, 9 aa, Homo Sapiens
QVIEKFEAL

SEQ ID NO: 13248 - protein, 9 aa, Homo Sapiens
QVIPQIQSA

SEQ ID NO: 13249 - protein, 9 aa, Homo Sapiens
QVIPQLQTV

SEQ ID NO: 13250 - protein, 9 aa, Homo Sapiens
QVIPVLPQV

SEQ ID NO: 13251 - protein, 9 aa, Homo Sapiens
QVIQSLIAL

SEQ ID NO: 13252 - protein, 9 aa, Homo Sapiens
QVKQHIDAV

SEQ ID NO: 13253 - protein, 9 aa, Homo Sapiens
QVMKFIEKA

SEQ ID NO: 13254 - protein, 9 aa, Homo Sapiens
QVPENTEEL

SEQ ID NO: 13255 - protein, 9 aa, Homo Sapiens
QVPETIETL

SEQ ID NO: 13256 - protein, 9 aa, Homo Sapiens
QVVDHIDSL

SEQ ID NO: 13257 - protein, 9 aa, Homo Sapiens
QVVEKVQEA

SEQ ID NO: 13258 - protein, 9 aa, Homo Sapiens
RAAAMANNL

SEQ ID NO: 13259 - protein, 9 aa, Homo Sapiens
RAADVLVYL

SEQ ID NO: 13260 - protein, 9 aa, Homo Sapiens
RAFGFMTRV

SEQ ID NO: 13261 - protein, 9 aa, Homo Sapiens
RAIDSIHQL

SEQ ID NO: 13262 - protein, 9 aa, Homo Sapiens
RAIELLEKL

SEQ ID NO: 13263 - protein, 9 aa, Homo Sapiens
RAIENIDTL

SEQ ID NO: 13264 - protein, 9 aa, Homo Sapiens
RAIPELTKL

SEQ ID NO: 13265 - protein, 9 aa, Homo Sapiens
RAVEELHKL

SEQ ID NO: 13266 - protein, 9 aa, Homo Sapiens
RIADLSYTV

SEQ ID NO: 13267 - protein, 9 aa, Homo Sapiens
RIAEEVNCL

SEQ ID NO: 13268 - protein, 9 aa, Homo Sapiens
RIAEFTTNL

SEQ ID NO: 13269 - protein, 9 aa, Homo Sapiens
RIAELLTEL

SEQ ID NO: 13270 - protein, 9 aa, Homo Sapiens
RIAEYAFKL

SEQ ID NO: 13271 - protein, 9 aa, Homo Sapiens
RIALYCHQL

SEQ ID NO: 13272 - protein, 9 aa, Homo Sapiens
RIFGGLDML

SEQ ID NO: 13273 - protein, 9 aa, Homo Sapiens
RIFQTLLEV

SEQ ID NO: 13274 - protein, 9 aa, Homo Sapiens
RIIDTVAQV

SEQ ID NO: 13275 - protein, 9 aa, Homo Sapiens
RIIDVVYNA

SEQ ID NO: 13276 - protein, 9 aa, Homo Sapiens
RIKNKIAEL

SEQ ID NO: 13277 - protein, 9 aa, Homo Sapiens
RIMGNIWDA

SEQ ID NO: 13278 - protein, 9 aa, Homo Sapiens
RIPEKVFQA

SEQ ID NO: 13279 - protein, 9 aa, Homo Sapiens
RIPSDIAKL

SEQ ID NO: 13280 - protein, 9 aa, Homo Sapiens
RIPSFVTEL

SEQ ID NO: 13281 - protein, 9 aa, Homo Sapiens
RIQSKLYRA

SEQ ID NO: 13282 - protein, 9 aa, Homo Sapiens
RISTINILL

SEQ ID NO: 13283 - protein, 9 aa, Homo Sapiens
RIVDKLLAL

SEQ ID NO: 13284 - protein, 9 aa, Homo Sapiens
RIYKYIHKV

SEQ ID NO: 13285 - protein, 9 aa, Homo Sapiens
RKYPTLLEV

SEQ ID NO: 13286 - protein, 9 aa, Homo Sapiens
RLAALQHRL

SEQ ID NO: 13287 - protein, 9 aa, Homo Sapiens
RLAAMANNL

SEQ ID NO: 13288 - protein, 9 aa, Homo Sapiens
RLAEQIATL

SEQ ID NO: 13289 - protein, 9 aa, Homo Sapiens
RLAEVVHEL

SEQ ID NO: 13290 - protein, 9 aa, Homo Sapiens
RLAHYIDRV

SEQ ID NO: 13291 - protein, 9 aa, Homo Sapiens
RLAQHITYV

SEQ ID NO: 13292 - protein, 9 aa, Homo Sapiens
RLAVYIDKV

SEQ ID NO: 13293 - protein, 9 aa, Homo Sapiens
RLAVYIDRV

SEQ ID NO: 13294 - protein, 9 aa, Homo Sapiens
RLFEGNALL

SEQ ID NO: 13295 - protein, 9 aa, Homo Sapiens
RLGPVPPGL

SEQ ID NO: 13296 - protein, 9 aa, Homo Sapiens
RLGPVPSGL

SEQ ID NO: 13297 - protein, 9 aa, Homo Sapiens
RLIEHCDHI

SEQ ID NO: 13298 - protein, 9 aa, Homo Sapiens
RLIESLFTI

SEQ ID NO: 13299 - protein, 9 aa, Homo Sapiens
RLIPTLVSI

SEQ ID NO: 13300 - protein, 9 aa, Homo Sapiens
RLKPALETL

SEQ ID NO: 13301 - protein, 9 aa, Homo Sapiens
RLKPEIQCV

SEQ ID NO: 13302 - protein, 9 aa, Homo Sapiens
RLKQEIERL

SEQ ID NO: 13303 - protein, 9 aa, Homo Sapiens
RLMEICESL

SEQ ID NO: 13304 - protein, 9 aa, Homo Sapiens
RLMNDMTAV

SEQ ID NO: 13305 - protein, 9 aa, Homo Sapiens
RLPDIIACA

SEQ ID NO: 13306 - protein, 9 aa, Homo Sapiens
RLPEAIEEV

SEQ ID NO: 13307 - protein, 9 aa, Homo Sapiens
RLPEIYIQL

SEQ ID NO: 13308 - protein, 9 aa, Homo Sapiens
RLPETVHTA

SEQ ID NO: 13309 - protein, 9 aa, Homo Sapiens
RLPLKADFV

SEQ ID NO: 13310 - protein, 9 aa, Homo Sapiens
RLSPIENFL

SEQ ID NO: 13311 - protein, 9 aa, Homo Sapiens
RLSSVNAEV

SEQ ID NO: 13312 - protein, 9 aa, Homo Sapiens
RLVPFLTEL

SEQ ID NO: 13313 - protein, 9 aa, Homo Sapiens
RLYQECEKL

SEQ ID NO: 13314 - protein, 9 aa, Homo Sapiens
RMIGQICEV

SEQ ID NO: 13315 - protein, 9 aa, Homo Sapiens
RMKDALDYL

SEQ ID NO: 13316 - protein, 9 aa, Homo Sapiens
RMKEFLDSL

SEQ ID NO: 13317 - protein, 9 aa, Homo Sapiens
RMVAEIQNV

SEQ ID NO: 13318 - protein, 9 aa, Homo Sapiens
RQADFVQVL

SEQ ID NO: 13319 - protein, 9 aa, Homo Sapiens
RQADKVWRL

SEQ ID NO: 13320 - protein, 9 aa, Homo Sapiens
RQADVEYEL

SEQ ID NO: 13321 - protein, 9 aa, Homo Sapiens
RQAQVAEKL

SEQ ID NO: 13322 - protein, 9 aa, Homo Sapiens
RQFPGSHRV

SEQ ID NO: 13323 - protein, 9 aa, Homo Sapiens
RQFQELNEL

SEQ ID NO: 13324 - protein, 9 aa, Homo Sapiens
RQFQYLHVL

SEQ ID NO: 13325 - protein, 9 aa, Homo Sapiens
RQFSTPFQL

SEQ ID NO: 13326 - protein, 9 aa, Homo Sapiens
RQGPVNQTV

SEQ ID NO: 13327 - protein, 9 aa, Homo Sapiens
RQIDKIQCA

SEQ ID NO: 13328 - protein, 9 aa, Homo Sapiens
RQIDQFLVV

SEQ ID NO: 13329 - protein, 9 aa, Homo Sapiens
RQIDQMVGL

SEQ ID NO: 13330 - protein, 9 aa, Homo Sapiens
RQIEYEYKL

SEQ ID NO: 13331 - protein, 9 aa, Homo Sapiens
RQIEYYFSV

SEQ ID NO: 13332 - protein, 9 aa, Homo Sapiens
RQIKNFHKL

SEQ ID NO: 13333 - protein, 9 aa, Homo Sapiens
RQIQKITNA

SEQ ID NO: 13334 - protein, 9 aa, Homo Sapiens
RQPSLFYHL

SEQ ID NO: 13335 - protein, 9 aa, Homo Sapiens
RQSDLLVKL

SEQ ID NO: 13336 - protein, 9 aa, Homo Sapiens
RQSETYNYL

SEQ ID NO: 13337 - protein, 9 aa, Homo Sapiens
RQSPLTTGL

SEQ ID NO: 13338 - protein, 9 aa, Homo Sapiens
RTAGHMQTL

SEQ ID NO: 13339 - protein, 9 aa, Homo Sapiens
RTFEKDHRL

SEQ ID NO: 13340 - protein, 9 aa, Homo Sapiens
RTFEKIEEV

SEQ ID NO: 13341 - protein, 9 aa, Homo Sapiens
RTIDFVHQV

SEQ ID NO: 13342 - protein, 9 aa, Homo Sapiens
RTIEYLEEV

SEQ ID NO: 13343 - protein, 9 aa, Homo Sapiens
RTIGVITKL

SEQ ID NO: 13344 - protein, 9 aa, Homo Sapiens
RTMENLVEL

SEQ ID NO: 13345 - protein, 9 aa, Homo Sapiens
RTMPRIPTL

SEQ ID NO: 13346 - protein, 9 aa, Homo Sapiens
RTPDLYEKL

SEQ ID NO: 13347 - protein, 9 aa, Homo Sapiens
RTPEAVQKL

SEQ ID NO: 13348 - protein, 9 aa, Homo Sapiens
RTPENHENL

SEQ ID NO: 13349 - protein, 9 aa, Homo Sapiens
RTPYHVNLL

SEQ ID NO: 13350 - protein, 9 aa, Homo Sapiens
RTTEILHHL

SEQ ID NO: 13351 - protein, 9 aa, Homo Sapiens
RTVEKTWKL

SEQ ID NO: 13352 - protein, 9 aa, Homo Sapiens
RTYKNSEEL

SEQ ID NO: 13353 - protein, 9 aa, Homo Sapiens
RVADRLYGV

SEQ ID NO: 13354 - protein, 9 aa, Homo Sapiens
RVAGFNPAL

SEQ ID NO: 13355 - protein, 9 aa, Homo Sapiens
RVANVADVV

SEQ ID NO: 13356 - protein, 9 aa, Homo Sapiens
RVCDYHTKL

SEQ ID NO: 13357 - protein, 9 aa, Homo Sapiens
RVCNQIEFL

SEQ ID NO: 13358 - protein, 9 aa, Homo Sapiens
RVFENIVAV

SEQ ID NO: 13359 - protein, 9 aa, Homo Sapiens
RVFEYMSYL

SEQ ID NO: 13360 - protein, 9 aa, Homo Sapiens
RVFKQFVQA

SEQ ID NO: 13361 - protein, 9 aa, Homo Sapiens
RVIDHSQYL

SEQ ID NO: 13362 - protein, 9 aa, Homo Sapiens
RVIDYILDL

SEQ ID NO: 13363 - protein, 9 aa, Homo Sapiens
RVIEPFSRV

SEQ ID NO: 13364 - protein, 9 aa, Homo Sapiens
RVIGDLDTV

SEQ ID NO: 13365 - protein, 9 aa, Homo Sapiens
RVIGTLEEV

SEQ ID NO: 13366 - protein, 9 aa, Homo Sapiens
RVISELQEA

SEQ ID NO: 13367 - protein, 9 aa, Homo Sapiens
RVIVEVCEV

SEQ ID NO: 13368 - protein, 9 aa, Homo Sapiens
RVKDSLICV

SEQ ID NO: 13369 - protein, 9 aa, Homo Sapiens
RVMEEIRNL

SEQ ID NO: 13370 - protein, 9 aa, Homo Sapiens
RVMEGLHRL

SEQ ID NO: 13371 - protein, 9 aa, Homo Sapiens
RVMEYINRL

SEQ ID NO: 13372 - protein, 9 aa, Homo Sapiens
RVNETTEFL

SEQ ID NO: 13373 - protein, 9 aa, Homo Sapiens
RVPAHISLL

SEQ ID NO: 13374 - protein, 9 aa, Homo Sapiens
RVPDGMVGL

SEQ ID NO: 13375 - protein, 9 aa, Homo Sapiens
RVPELLHRL

SEQ ID NO: 13376 - protein, 9 aa, Homo Sapiens
RVPESIKNA

SEQ ID NO: 13377 - protein, 9 aa, Homo Sapiens
RVPETVADA

SEQ ID NO: 13378 - protein, 9 aa, Homo Sapiens
RVSPECQQL

SEQ ID NO: 13379 - protein, 9 aa, Homo Sapiens
RVVDLITNL

SEQ ID NO: 13380 - protein, 9 aa, Homo Sapiens
RVVDLLNQA

SEQ ID NO: 13381 - protein, 9 aa, Homo Sapiens
RVVDYLTKL

SEQ ID NO: 13382 - protein, 9 aa, Homo Sapiens
RVVGTIDQL

SEQ ID NO: 13383 - protein, 9 aa, Homo Sapiens
RVYEFLDKL

SEQ ID NO: 13384 - protein, 9 aa, Homo Sapiens
SAAALCNNL

SEQ ID NO: 13385 - protein, 9 aa, Homo Sapiens
SAADLVHFL

SEQ ID NO: 13386 - protein, 9 aa, Homo Sapiens
SAAELNYGL

SEQ ID NO: 13387 - protein, 9 aa, Homo Sapiens
SAAPVAHLL

SEQ ID NO: 13388 - protein, 9 aa, Homo Sapiens
SAASICAKV

SEQ ID NO: 13389 - protein, 9 aa, Homo Sapiens
SAFGASHHV

SEQ ID NO: 13390 - protein, 9 aa, Homo Sapiens
SAFGEIETV

SEQ ID NO: 13391 - protein, 9 aa, Homo Sapiens
SAGPPLLAV

SEQ ID NO: 13392 - protein, 9 aa, Homo Sapiens
SAIDRIFTL

SEQ ID NO: 13393 - protein, 9 aa, Homo Sapiens
SAIGYIHSL

SEQ ID NO: 13394 - protein, 9 aa, Homo Sapiens
SAIHTIAHL

SEQ ID NO: 13395 - protein, 9 aa, Homo Sapiens
SAPKYIDYL

SEQ ID NO: 13396 - protein, 9 aa, Homo Sapiens
SAVMALQEA

SEQ ID NO: 13397 - protein, 9 aa, Homo Sapiens
SDPFTHLAP

SEQ ID NO: 13398 - protein, 9 aa, Homo Sapiens
SGITRVEKA

SEQ ID NO: 13399 - protein, 9 aa, Homo Sapiens
SGSEIHVEV

SEQ ID NO: 13400 - protein, 9 aa, Homo Sapiens
SIAAFIQRL

SEQ ID NO: 13401 - protein, 9 aa, Homo Sapiens
SIAEQAHEL

SEQ ID NO: 13402 - protein, 9 aa, Homo Sapiens
SIAEVVHQL

SEQ ID NO: 13403 - protein, 9 aa, Homo Sapiens
SIAPILAEA

SEQ ID NO: 13404 - protein, 9 aa, Homo Sapiens
SIAPIVIFA

SEQ ID NO: 13405 - protein, 9 aa, Homo Sapiens
SIASPDVKL

SEQ ID NO: 13406 - protein, 9 aa, Homo Sapiens
SIFEFVHAL

SEQ ID NO: 13407 - protein, 9 aa, Homo Sapiens
SIFKSLHQV

SEQ ID NO: 13408 - protein, 9 aa, Homo Sapiens
SIHEFCINL

SEQ ID NO: 13409 - protein, 9 aa, Homo Sapiens
SIIGRLLEV

SEQ ID NO: 13410 - protein, 9 aa, Homo Sapiens
SIIHEIDSI

SEQ ID NO: 13411 - protein, 9 aa, Homo Sapiens
SIIKKLAAL

SEQ ID NO: 13412 - protein, 9 aa, Homo Sapiens
SIILHLICL

SEQ ID NO: 13413 - protein, 9 aa, Homo Sapiens
SIIQRLLEV

SEQ ID NO: 13414 - protein, 9 aa, Homo Sapiens
SIPEINHRL

SEQ ID NO: 13415 - protein, 9 aa, Homo Sapiens
SIPELQNFL

SEQ ID NO: 13416 - protein, 9 aa, Homo Sapiens
SIPGFVERL

SEQ ID NO: 13417 - protein, 9 aa, Homo Sapiens
SIPLLINHL

SEQ ID NO: 13418 - protein, 9 aa, Homo Sapiens
SIPSMVDGL

SEQ ID NO: 13419 - protein, 9 aa, Homo Sapiens
SIPTTIYKA

SEQ ID NO: 13420 - protein, 9 aa, Homo Sapiens
SISDVIAQV

SEQ ID NO: 13421 - protein, 9 aa, Homo Sapiens
SISPIVLYL

SEQ ID NO: 13422 - protein, 9 aa, Homo Sapiens
SISSIDREL

SEQ ID NO: 13423 - protein, 9 aa, Homo Sapiens
SIVNHLEFL

SEQ ID NO: 13424 - protein, 9 aa, Homo Sapiens
SIVQDIKRA

SEQ ID NO: 13425 - protein, 9 aa, Homo Sapiens
SIVSSLHQA

SEQ ID NO: 13426 - protein, 9 aa, Homo Sapiens
SIYPKSELL

SEQ ID NO: 13427 - protein, 9 aa, Homo Sapiens
SLADIAQKL

SEQ ID NO: 13428 - protein, 9 aa, Homo Sapiens
SLAEFVQSL

SEQ ID NO: 13429 - protein, 9 aa, Homo Sapiens
SLAELIQAL

SEQ ID NO: 13430 - protein, 9 aa, Homo Sapiens
SLAERVDRL

SEQ ID NO: 13431 - protein, 9 aa, Homo Sapiens
SLANETHQL

SEQ ID NO: 13432 - protein, 9 aa, Homo Sapiens
SLAPLFFKL

SEQ ID NO: 13433 - protein, 9 aa, Homo Sapiens
SLAPYRDYL

SEQ ID NO: 13434 - protein, 9 aa, Homo Sapiens
SLAQYLINV

SEQ ID NO: 13435 - protein, 9 aa, Homo Sapiens
SLASHIQSL

SEQ ID NO: 13436 - protein, 9 aa, Homo Sapiens
SLFERLVVL

SEQ ID NO: 13437 - protein, 9 aa, Homo Sapiens
SLFGNIKGA

SEQ ID NO: 13438 - protein, 9 aa, Homo Sapiens
SLFNGSHYL

SEQ ID NO: 13439 - protein, 9 aa, Homo Sapiens
SLFPHAICL

SEQ ID NO: 13440 - protein, 9 aa, Homo Sapiens
SLIAKVATA

SEQ ID NO: 13441 - protein, 9 aa, Homo Sapiens
SLIDGIKRA

SEQ ID NO: 13442 - protein, 9 aa, Homo Sapiens
SLIEKIPTA

SEQ ID NO: 13443 - protein, 9 aa, Homo Sapiens
SLIFKLEEL

SEQ ID NO: 13444 - protein, 9 aa, Homo Sapiens
SLIGHLQTL

SEQ ID NO: 13445 - protein, 9 aa, Homo Sapiens
SLIKKIKDV

SEQ ID NO: 13446 - protein, 9 aa, Homo Sapiens
SLIKQIPRI

SEQ ID NO: 13447 - protein, 9 aa, Homo Sapiens
SLIRNLEQL

SEQ ID NO: 13448 - protein, 9 aa, Homo Sapiens
SLISGIIRA

SEQ ID NO: 13449 - protein, 9 aa, Homo Sapiens
SLITLIEKV

SEQ ID NO: 13450 - protein, 9 aa, Homo Sapiens
SLITRLLEV

SEQ ID NO: 13451 - protein, 9 aa, Homo Sapiens
SLKDRIHCV

SEQ ID NO: 13452 - protein, 9 aa, Homo Sapiens
SLKEDIQKA

SEQ ID NO: 13453 - protein, 9 aa, Homo Sapiens
SLKETIEEL

SEQ ID NO: 13454 - protein, 9 aa, Homo Sapiens
SLKSKLEHA

SEQ ID NO: 13455 - protein, 9 aa, Homo Sapiens
SLMEKISKL

SEQ ID NO: 13456 - protein, 9 aa, Homo Sapiens
SLNKHVEAV

SEQ ID NO: 13457 - protein, 9 aa, Homo Sapiens
SLPDFCHKF

SEQ ID NO: 13458 - protein, 9 aa, Homo Sapiens
SLPDHHEEL

SEQ ID NO: 13459 - protein, 9 aa, Homo Sapiens
SLPDIKVYL

SEQ ID NO: 13460 - protein, 9 aa, Homo Sapiens
SLPEIDNAL

SEQ ID NO: 13461 - protein, 9 aa, Homo Sapiens
SLPELTHAL

SEQ ID NO: 13462 - protein, 9 aa, Homo Sapiens
SLPSFSEKL

SEQ ID NO: 13463 - protein, 9 aa, Homo Sapiens
SLPYHSQKL

SEQ ID NO: 13464 - protein, 9 aa, Homo Sapiens
SLSDTVEKL

SEQ ID NO: 13465 - protein, 9 aa, Homo Sapiens
SLVDIYSQL

SEQ ID NO: 13466 - protein, 9 aa, Homo Sapiens
SLVENIERL

SEQ ID NO: 13467 - protein, 9 aa, Homo Sapiens
SLVKDVIGA

SEQ ID NO: 13468 - protein, 9 aa, Homo Sapiens
SLYDQAEKL

SEQ ID NO: 13469 - protein, 9 aa, Homo Sapiens
SMEEIFQHL

SEQ ID NO: 13470 - protein, 9 aa, Homo Sapiens
SMISKLKQA

SEQ ID NO: 13471 - protein, 9 aa, Homo Sapiens
SMKDDLERV

SEQ ID NO: 13472 - protein, 9 aa, Homo Sapiens
SMKEELERV

SEQ ID NO: 13473 - protein, 9 aa, Homo Sapiens
SQAAIAELL

SEQ ID NO: 13474 - protein, 9 aa, Homo Sapiens
SQAAVLSQL

SEQ ID NO: 13475 - protein, 9 aa, Homo Sapiens
SQADCAVLI

SEQ ID NO: 13476 - protein, 9 aa, Homo Sapiens
SQADFAEKL

SEQ ID NO: 13477 - protein, 9 aa, Homo Sapiens
SQADVHRQI

SEQ ID NO: 13478 - protein, 9 aa, Homo Sapiens
SQADVHRQV

SEQ ID NO: 13479 - protein, 9 aa, Homo Sapiens
SQAEIEARL

SEQ ID NO: 13480 - protein, 9 aa, Homo Sapiens
SQAEIEQKI

SEQ ID NO: 13481 - protein, 9 aa, Homo Sapiens
SQAETVHGL

SEQ ID NO: 13482 - protein, 9 aa, Homo Sapiens
SQAEWREEV

SEQ ID NO: 13483 - protein, 9 aa, Homo Sapiens
SQAFISHHL

SEQ ID NO: 13484 - protein, 9 aa, Homo Sapiens
SQAGLNQKL

SEQ ID NO: 13485 - protein, 9 aa, Homo Sapiens
SQANIAQVL

SEQ ID NO: 13486 - protein, 9 aa, Homo Sapiens
SQANVVVKI

SEQ ID NO: 13487 - protein, 9 aa, Homo Sapiens
SQAPFIVAL

SEQ ID NO: 13488 - protein, 9 aa, Homo Sapiens
SQAQTLHKV

SEQ ID NO: 13489 - protein, 9 aa, Homo Sapiens
SQATALAKL

SEQ ID NO: 13490 - protein, 9 aa, Homo Sapiens
SQCAKTFSL

SEQ ID NO: 13491 - protein, 9 aa, Homo Sapiens
SQCPHIVRI

SEQ ID NO: 13492 - protein, 9 aa, Homo Sapiens
SQCSAQHYV

SEQ ID NO: 13493 - protein, 9 aa, Homo Sapiens
SQDENYHHL

SEQ ID NO: 13494 - protein, 9 aa, Homo Sapiens
SQEGRPVQV

SEQ ID NO: 13495 - protein, 9 aa, Homo Sapiens
SQFGHVVDI

SEQ ID NO: 13496 - protein, 9 aa, Homo Sapiens
SQFGPIERA

SEQ ID NO: 13497 - protein, 9 aa, Homo Sapiens
SQFGTEHVL

SEQ ID NO: 13498 - protein, 9 aa, Homo Sapiens
SQFGTVEKA

SEQ ID NO: 13499 - protein, 9 aa, Homo Sapiens
SQFPGAITL

SEQ ID NO: 13500 - protein, 9 aa, Homo Sapiens
SQFPTPEAV

SEQ ID NO: 13501 - protein, 9 aa, Homo Sapiens
SQFSGKITV

SEQ ID NO: 13502 - protein, 9 aa, Homo Sapiens
SQFSYQHAI

SEQ ID NO: 13503 - protein, 9 aa, Homo Sapiens
SQHDQVNLL

SEQ ID NO: 13504 - protein, 9 aa, Homo Sapiens
SQHDQVTLL

SEQ ID NO: 13505 - protein, 9 aa, Homo Sapiens
SQHFFCKEV

SEQ ID NO: 13506 - protein, 9 aa, Homo Sapiens
SQIAKIVAA

SEQ ID NO: 13507 - protein, 9 aa, Homo Sapiens
SQIALNEKL

SEQ ID NO: 13508 - protein, 9 aa, Homo Sapiens
SQIDQQNSV

SEQ ID NO: 13509 - protein, 9 aa, Homo Sapiens
SQIEADFRL

SEQ ID NO: 13510 - protein, 9 aa, Homo Sapiens
SQIHDIVLV

SEQ ID NO: 13511 - protein, 9 aa, Homo Sapiens
SQIKYAAKV

SEQ ID NO: 13512 - protein, 9 aa, Homo Sapiens
SQINKFLYL

SEQ ID NO: 13513 - protein, 9 aa, Homo Sapiens
SQIPAQPSV

SEQ ID NO: 13514 - protein, 9 aa, Homo Sapiens
SQIQEFKEA

SEQ ID NO: 13515 - protein, 9 aa, Homo Sapiens
SQIQKVEPA

SEQ ID NO: 13516 - protein, 9 aa, Homo Sapiens
SQIQRLIVA

SEQ ID NO: 13517 - protein, 9 aa, Homo Sapiens
SQIREMETL

SEQ ID NO: 13518 - protein, 9 aa, Homo Sapiens
SQIRETQQL

SEQ ID NO: 13519 - protein, 9 aa, Homo Sapiens
SQITKIPIL

SEQ ID NO: 13520 - protein, 9 aa, Homo Sapiens
SQITSLVTL

SEQ ID NO: 13521 - protein, 9 aa, Homo Sapiens
SQIYCIENA

SEQ ID NO: 13522 - protein, 9 aa, Homo Sapiens
SQIYPVVCV

SEQ ID NO: 13523 - protein, 9 aa, Homo Sapiens
SQMEKIVRI

SEQ ID NO: 13524 - protein, 9 aa, Homo Sapiens
SQMPVPVHV

SEQ ID NO: 13525 - protein, 9 aa, Homo Sapiens
SQPALWHTV

SEQ ID NO: 13526 - protein, 9 aa, Homo Sapiens
SQPDLLHQL

SEQ ID NO: 13527 - protein, 9 aa, Homo Sapiens
SQPEKVYTL

SEQ ID NO: 13528 - protein, 9 aa, Homo Sapiens
SQSELENRL

SEQ ID NO: 13529 - protein, 9 aa, Homo Sapiens
SQSIVWVHA

SEQ ID NO: 13530 - protein, 9 aa, Homo Sapiens
SQSNMTQKV

SEQ ID NO: 13531 - protein, 9 aa, Homo Sapiens
SQSSIQQEL

SEQ ID NO: 13532 - protein, 9 aa, Homo Sapiens
SQSSIRTEA

SEQ ID NO: 13533 - protein, 9 aa, Homo Sapiens
SQSSLIHLV

SEQ ID NO: 13534 - protein, 9 aa, Homo Sapiens
SQSSVHSCL

SEQ ID NO: 13535 - protein, 9 aa, Homo Sapiens
SQSVIHNLL

SEQ ID NO: 13536 - protein, 9 aa, Homo Sapiens
SQSWNVETL

SEQ ID NO: 13537 - protein, 9 aa, Homo Sapiens
SQTDFSQLL

SEQ ID NO: 13538 - protein, 9 aa, Homo Sapiens
SQTDYISRL

SEQ ID NO: 13539 - protein, 9 aa, Homo Sapiens
SQTSVAERL

SEQ ID NO: 13540 - protein, 9 aa, Homo Sapiens
SQTTVYEKL

SEQ ID NO: 13541 - protein, 9 aa, Homo Sapiens
SQVDRLVAL

SEQ ID NO: 13542 - protein, 9 aa, Homo Sapiens
SQVEAHHSL

SEQ ID NO: 13543 - protein, 9 aa, Homo Sapiens
SQVEILQRV

SEQ ID NO: 13544 - protein, 9 aa, Homo Sapiens
SQVGFIDYI

SEQ ID NO: 13545 - protein, 9 aa, Homo Sapiens
SQVPNIVKA

SEQ ID NO: 13546 - protein, 9 aa, Homo Sapiens
SQVSVVHTL

SEQ ID NO: 13547 - protein, 9 aa, Homo Sapiens
SQYPEIIFL

SEQ ID NO: 13548 - protein, 9 aa, Homo Sapiens
SQYPFPVTL

SEQ ID NO: 13549 - protein, 9 aa, Homo Sapiens
SSIEKIVEI

SEQ ID NO: 13550 - protein, 9 aa, Homo Sapiens
STAAKIMGV

SEQ ID NO: 13551 - protein, 9 aa, Homo Sapiens
STAAVIQNV

SEQ ID NO: 13552 - protein, 9 aa, Homo Sapiens
STADVYCKL

SEQ ID NO: 13553 - protein, 9 aa, Homo Sapiens
STCEFVRTL

SEQ ID NO: 13554 - protein, 9 aa, Homo Sapiens
STFGELKTV

SEQ ID NO: 13555 - protein, 9 aa, Homo Sapiens
STGPQPVTV

SEQ ID NO: 13556 - protein, 9 aa, Homo Sapiens
STIAILNSV

SEQ ID NO: 13557 - protein, 9 aa, Homo Sapiens
STIDFLDRA

SEQ ID NO: 13558 - protein, 9 aa, Homo Sapiens
STIKEVAQA

SEQ ID NO: 13559 - protein, 9 aa, Homo Sapiens
STIKTLEEA

SEQ ID NO: 13560 - protein, 9 aa, Homo Sapiens
STIPGIQKI

SEQ ID NO: 13561 - protein, 9 aa, Homo Sapiens
STIQKIKEA

SEQ ID NO: 13562 - protein, 9 aa, Homo Sapiens
STIRLLTSL

SEQ ID NO: 13563 - protein, 9 aa, Homo Sapiens
STSAIIDYL

SEQ ID NO: 13564 - protein, 9 aa, Homo Sapiens
STSKWNHLL

SEQ ID NO: 13565 - protein, 9 aa, Homo Sapiens
STSNLNEKI

SEQ ID NO: 13566 - protein, 9 aa, Homo Sapiens
STVEALQNL

SEQ ID NO: 13567 - protein, 9 aa, Homo Sapiens
STVEKLYAA

SEQ ID NO: 13568 - protein, 9 aa, Homo Sapiens
STVGEIVNL

SEQ ID NO: 13569 - protein, 9 aa, Homo Sapiens
STVRHLQEL

SEQ ID NO: 13570 - protein, 9 aa, Homo Sapiens
SVAAQLTGV

SEQ ID NO: 13571 - protein, 9 aa, Homo Sapiens
SVADLAESI

SEQ ID NO: 13572 - protein, 9 aa, Homo Sapiens
SVADLAHVL

SEQ ID NO: 13573 - protein, 9 aa, Homo Sapiens
SVADLIESM

SEQ ID NO: 13574 - protein, 9 aa, Homo Sapiens
SVAECVERM

SEQ ID NO: 13575 - protein, 9 aa, Homo Sapiens
SVAEIEEAL

SEQ ID NO: 13576 - protein, 9 aa, Homo Sapiens
SVAEKLSKL

SEQ ID NO: 13577 - protein, 9 aa, Homo Sapiens
SVAELQSRL

SEQ ID NO: 13578 - protein, 9 aa, Homo Sapiens
SVAESLNYV

SEQ ID NO: 13579 - protein, 9 aa, Homo Sapiens
SVAETAQTI

SEQ ID NO: 13580 - protein, 9 aa, Homo Sapiens
SVAGKIQKL

SEQ ID NO: 13581 - protein, 9 aa, Homo Sapiens
SVAGSVERV

SEQ ID NO: 13582 - protein, 9 aa, Homo Sapiens
SVAGVVESL

SEQ ID NO: 13583 - protein, 9 aa, Homo Sapiens
SVAKESIPL

SEQ ID NO: 13584 - protein, 9 aa, Homo Sapiens
SVAKTSQLL

SEQ ID NO: 13585 - protein, 9 aa, Homo Sapiens
SVALHVEKL

SEQ ID NO: 13586 - protein, 9 aa, Homo Sapiens
SVALINRAL

SEQ ID NO: 13587 - protein, 9 aa, Homo Sapiens
SVAMHTNYL

SEQ ID NO: 13588 - protein, 9 aa, Homo Sapiens
SVANHNSFL

SEQ ID NO: 13589 - protein, 9 aa, Homo Sapiens
SVAPANSAL

SEQ ID NO: 13590 - protein, 9 aa, Homo Sapiens
SVAPFADYL

SEQ ID NO: 13591 - protein, 9 aa, Homo Sapiens
SVAPFDQNL

SEQ ID NO: 13592 - protein, 9 aa, Homo Sapiens
SVAPLVDHL

SEQ ID NO: 13593 - protein, 9 aa, Homo Sapiens
SVAQLEARL

SEQ ID NO: 13594 - protein, 9 aa, Homo Sapiens
SVAVIHQSL

SEQ ID NO: 13595 - protein, 9 aa, Homo Sapiens
SVAYLINTL

SEQ ID NO: 13596 - protein, 9 aa, Homo Sapiens
SVAYQINAL

SEQ ID NO: 13597 - protein, 9 aa, Homo Sapiens
SVEDMNFRV

SEQ ID NO: 13598 - protein, 9 aa, Homo Sapiens
SVFAGVVGV

SEQ ID NO: 13599 - protein, 9 aa, Homo Sapiens
SVFEGLERL

SEQ ID NO: 13600 - protein, 9 aa, Homo Sapiens
SVFENLEQL

SEQ ID NO: 13601 - protein, 9 aa, Homo Sapiens
SVFGQVERA

SEQ ID NO: 13602 - protein, 9 aa, Homo Sapiens
SVFNHLEEL

SEQ ID NO: 13603 - protein, 9 aa, Homo Sapiens
SVFPYNHRM

SEQ ID NO: 13604 - protein, 9 aa, Homo Sapiens
SVHKGFAFV

SEQ ID NO: 13605 - protein, 9 aa, Homo Sapiens
SVIDHIHLI

SEQ ID NO: 13606 - protein, 9 aa, Homo Sapiens
SVIEAHEQL

SEQ ID NO: 13607 - protein, 9 aa, Homo Sapiens
SVIEQIVYV

SEQ ID NO: 13608 - protein, 9 aa, Homo Sapiens
SVIGSLNGV

SEQ ID NO: 13609 - protein, 9 aa, Homo Sapiens
SVIGVSPAV

SEQ ID NO: 13610 - protein, 9 aa, Homo Sapiens
SVIKELRKA

SEQ ID NO: 13611 - protein, 9 aa, Homo Sapiens
SVIKELRQL

SEQ ID NO: 13612 - protein, 9 aa, Homo Sapiens
SVINEINKI

SEQ ID NO: 13613 - protein, 9 aa, Homo Sapiens
SVIPQIQKV

SEQ ID NO: 13614 - protein, 9 aa, Homo Sapiens
SVIPVINKI

SEQ ID NO: 13615 - protein, 9 aa, Homo Sapiens
SVIQNLRTV

SEQ ID NO: 13616 - protein, 9 aa, Homo Sapiens
SVIQTVNHV

SEQ ID NO: 13617 - protein, 9 aa, Homo Sapiens
SVIRDIGAI

SEQ ID NO: 13618 - protein, 9 aa, Homo Sapiens
SVIRKIPAL

SEQ ID NO: 13619 - protein, 9 aa, Homo Sapiens
SVISHLLRV

SEQ ID NO: 13620 - protein, 9 aa, Homo Sapiens
SVISKVNSV

SEQ ID NO: 13621 - protein, 9 aa, Homo Sapiens
SVISYLKKL

SEQ ID NO: 13622 - protein, 9 aa, Homo Sapiens
SVITQVFHV

SEQ ID NO: 13623 - protein, 9 aa, Homo Sapiens
SVKDSCEGL

SEQ ID NO: 13624 - protein, 9 aa, Homo Sapiens
SVKEQMDQI

SEQ ID NO: 13625 - protein, 9 aa, Homo Sapiens
SVKEQMETI

SEQ ID NO: 13626 - protein, 9 aa, Homo Sapiens
SVKTKIQKL

SEQ ID NO: 13627 - protein, 9 aa, Homo Sapiens
SVLGAITSV

SEQ ID NO: 13628 - protein, 9 aa, Homo Sapiens
SVNPYIVKL

SEQ ID NO: 13629 - protein, 9 aa, Homo Sapiens
SVPDTVHHV

SEQ ID NO: 13630 - protein, 9 aa, Homo Sapiens
SVPDVTHHL

SEQ ID NO: 13631 - protein, 9 aa, Homo Sapiens
SVPEKIERI

SEQ ID NO: 13632 - protein, 9 aa, Homo Sapiens
SVPELCHHV

SEQ ID NO: 13633 - protein, 9 aa, Homo Sapiens
SVPELKDAL

SEQ ID NO: 13634 - protein, 9 aa, Homo Sapiens
SVSAVTEEA

SEQ ID NO: 13635 - protein, 9 aa, Homo Sapiens
SVSDLADKL

SEQ ID NO: 13636 - protein, 9 aa, Homo Sapiens
SVSHITQHL

SEQ ID NO: 13637 - protein, 9 aa, Homo Sapiens
SVSKLIHYV

SEQ ID NO: 13638 - protein, 9 aa, Homo Sapiens
SVSQINHKL

SEQ ID NO: 13639 - protein, 9 aa, Homo Sapiens
SVSSLAERL

SEQ ID NO: 13640 - protein, 9 aa, Homo Sapiens
SVSSVVHYL

SEQ ID NO: 13641 - protein, 9 aa, Homo Sapiens
SVTELIQAA

SEQ ID NO: 13642 - protein, 9 aa, Homo Sapiens
SVTGKIQKL

SEQ ID NO: 13643 - protein, 9 aa, Homo Sapiens
SVTHLNDHL

SEQ ID NO: 13644 - protein, 9 aa, Homo Sapiens
SVTQLRHML

SEQ ID NO: 13645 - protein, 9 aa, Homo Sapiens
SVTTVNKKL

SEQ ID NO: 13646 - protein, 9 aa, Homo Sapiens
SVVAIDNKI

SEQ ID NO: 13647 - protein, 9 aa, Homo Sapiens
SVVDLTCRL

SEQ ID NO: 13648 - protein, 9 aa, Homo Sapiens
SVVELVNKL

SEQ ID NO: 13649 - protein, 9 aa, Homo Sapiens
SVVENLQRL

SEQ ID NO: 13650 - protein, 9 aa, Homo Sapiens
SVVESVFKL

SEQ ID NO: 13651 - protein, 9 aa, Homo Sapiens
SVVGNLHRL

SEQ ID NO: 13652 - protein, 9 aa, Homo Sapiens
SVVGPVKGV

SEQ ID NO: 13653 - protein, 9 aa, Homo Sapiens
SVVHLYELL

SEQ ID NO: 13654 - protein, 9 aa, Homo Sapiens
SVVSSTEKL

SEQ ID NO: 13655 - protein, 9 aa, Homo Sapiens
SVYGKLRKV

SEQ ID NO: 13656 - protein, 9 aa, Homo Sapiens
SVYPNGHFV

SEQ ID NO: 13657 - protein, 9 aa, Homo Sapiens
SVYPTQEEL

SEQ ID NO: 13658 - protein, 9 aa, Homo Sapiens
TIAQLVHAV

SEQ ID NO: 13659 - protein, 9 aa, Homo Sapiens
TIFAKVDRL

SEQ ID NO: 13660 - protein, 9 aa, Homo Sapiens
TIKETADEL

SEQ ID NO: 13661 - protein, 9 aa, Homo Sapiens
TIMPKDIQL

SEQ ID NO: 13662 - protein, 9 aa, Homo Sapiens
TINELNHCL

SEQ ID NO: 13663 - protein, 9 aa, Homo Sapiens
TINGHNAEV

SEQ ID NO: 13664 - protein, 9 aa, Homo Sapiens
TINGHNCEV

SEQ ID NO: 13665 - protein, 9 aa, Homo Sapiens
TIVDALDTL

SEQ ID NO: 13666 - protein, 9 aa, Homo Sapiens
TIVDHINGA

SEQ ID NO: 13667 - protein, 9 aa, Homo Sapiens
TIVEMLHKA

SEQ ID NO: 13668 - protein, 9 aa, Homo Sapiens
TLAAIIEHL

SEQ ID NO: 13669 - protein, 9 aa, Homo Sapiens
TLADLVHHV

SEQ ID NO: 13670 - protein, 9 aa, Homo Sapiens
TLAESSDHV

SEQ ID NO: 13671 - protein, 9 aa, Homo Sapiens
TLCDLYETL

SEQ ID NO: 13672 - protein, 9 aa, Homo Sapiens
TLFAGAHEL

SEQ ID NO: 13673 - protein, 9 aa, Homo Sapiens
TLFGTFHVA

SEQ ID NO: 13674 - protein, 9 aa, Homo Sapiens
TLFPGTDHI

SEQ ID NO: 13675 - protein, 9 aa, Homo Sapiens
TLIEDILGV

SEQ ID NO: 13676 - protein, 9 aa, Homo Sapiens
TLIRSIPTM

SEQ ID NO: 13677 - protein, 9 aa, Homo Sapiens
TLKEEMESL

SEQ ID NO: 13678 - protein, 9 aa, Homo Sapiens
TLKEYLESL

SEQ ID NO: 13679 - protein, 9 aa, Homo Sapiens
TLKITLDNA

SEQ ID NO: 13680 - protein, 9 aa, Homo Sapiens
TLKRQLDEV

SEQ ID NO: 13681 - protein, 9 aa, Homo Sapiens
TLPELVQRL

SEQ ID NO: 13682 - protein, 9 aa, Homo Sapiens
TLSPVNHSL

SEQ ID NO: 13683 - protein, 9 aa, Homo Sapiens
TLVDEVQEL

SEQ ID NO: 13684 - protein, 9 aa, Homo Sapiens
TLVDFDNHL

SEQ ID NO: 13685 - protein, 9 aa, Homo Sapiens
TLYEHNNEL

SEQ ID NO: 13686 - protein, 9 aa, Homo Sapiens
TMAIIVNKL

SEQ ID NO: 13687 - protein, 9 aa, Homo Sapiens
TMIGEIAAA

SEQ ID NO: 13688 - protein, 9 aa, Homo Sapiens
TMKDHLVRV

SEQ ID NO: 13689 - protein, 9 aa, Homo Sapiens
TMVGEIASA

SEQ ID NO: 13690 - protein, 9 aa, Homo Sapiens
TMVQHCEAL

SEQ ID NO: 13691 - protein, 9 aa, Homo Sapiens
TPVVVPPFL

SEQ ID NO: 13692 - protein, 9 aa, Homo Sapiens
TQADMGEKL

SEQ ID NO: 13693 - protein, 9 aa, Homo Sapiens
TQADWQHRV

SEQ ID NO: 13694 - protein, 9 aa, Homo Sapiens
TQAEQAAQL

SEQ ID NO: 13695 - protein, 9 aa, Homo Sapiens
TQAGIVAHI

SEQ ID NO: 13696 - protein, 9 aa, Homo Sapiens
TQAVIFINT

SEQ ID NO: 13697 - protein, 9 aa, Homo Sapiens
TQCELLTQL

SEQ ID NO: 13698 - protein, 9 aa, Homo Sapiens
TQEEIVAKV

SEQ ID NO: 13699 - protein, 9 aa, Homo Sapiens
TQESVFATV

SEQ ID NO: 13700 - protein, 9 aa, Homo Sapiens
TQFLVCYRL

SEQ ID NO: 13701 - protein, 9 aa, Homo Sapiens
TQIDAQNKL

SEQ ID NO: 13702 - protein, 9 aa, Homo Sapiens
TQIDHYVGI

SEQ ID NO: 13703 - protein, 9 aa, Homo Sapiens
TQIDYIHCL

SEQ ID NO: 13704 - protein, 9 aa, Homo Sapiens
TQNGILHML

SEQ ID NO: 13705 - protein, 9 aa, Homo Sapiens
TQTDCYNNL

SEQ ID NO: 13706 - protein, 9 aa, Homo Sapiens
TSAAIYHVL

SEQ ID NO: 13707 - protein, 9 aa, Homo Sapiens
TTAELNYGL

SEQ ID NO: 13708 - protein, 9 aa, Homo Sapiens
TTFESSHYL

SEQ ID NO: 13709 - protein, 9 aa, Homo Sapiens
TTIEAIHGL

SEQ ID NO: 13710 - protein, 9 aa, Homo Sapiens
TTISKVSQV

SEQ ID NO: 13711 - protein, 9 aa, Homo Sapiens
TTPERIAQI

SEQ ID NO: 13712 - protein, 9 aa, Homo Sapiens
TTSDIDYAL

SEQ ID NO: 13713 - protein, 9 aa, Homo Sapiens
TTVSSLHQA

SEQ ID NO: 13714 - protein, 9 aa, Homo Sapiens
TTVTELQKV

SEQ ID NO: 13715 - protein, 9 aa, Homo Sapiens
TVADHIQKV

SEQ ID NO: 13716 - protein, 9 aa, Homo Sapiens
TVADKIHSV

SEQ ID NO: 13717 - protein, 9 aa, Homo Sapiens
TVADVDEKA

SEQ ID NO: 13718 - protein, 9 aa, Homo Sapiens
TVAEINATM

SEQ ID NO: 13719 - protein, 9 aa, Homo Sapiens
TVAEISQFL

SEQ ID NO: 13720 - protein, 9 aa, Homo Sapiens
TVAEKVDAV

SEQ ID NO: 13721 - protein, 9 aa, Homo Sapiens
TVAELVQFL

SEQ ID NO: 13722 - protein, 9 aa, Homo Sapiens
TVAPFNPTV

SEQ ID NO: 13723 - protein, 9 aa, Homo Sapiens
TVDMESTEV

SEQ ID NO: 13724 - protein, 9 aa, Homo Sapiens
TVEDIAARL

SEQ ID NO: 13725 - protein, 9 aa, Homo Sapiens
TVFEHTFHV

SEQ ID NO: 13726 - protein, 9 aa, Homo Sapiens
TVFGNLHQA

SEQ ID NO: 13727 - protein, 9 aa, Homo Sapiens
TVFKNVDLL

SEQ ID NO: 13728 - protein, 9 aa, Homo Sapiens
TVFSHAQTV

SEQ ID NO: 13729 - protein, 9 aa, Homo Sapiens
TVIAKVNNV

SEQ ID NO: 13730 - protein, 9 aa, Homo Sapiens
TVIARIEAL

SEQ ID NO: 13731 - protein, 9 aa, Homo Sapiens
TVIDQIPFL

SEQ ID NO: 13732 - protein, 9 aa, Homo Sapiens
TVIEDCNKV

SEQ ID NO: 13733 - protein, 9 aa, Homo Sapiens
TVIEKVQIA

SEQ ID NO: 13734 - protein, 9 aa, Homo Sapiens
TVIENIHTI

SEQ ID NO: 13735 - protein, 9 aa, Homo Sapiens
TVIHHVHSL

SEQ ID NO: 13736 - protein, 9 aa, Homo Sapiens
TVIKLIERL

SEQ ID NO: 13737 - protein, 9 aa, Homo Sapiens
TVIQFLERI

SEQ ID NO: 13738 - protein, 9 aa, Homo Sapiens
TVIQTVKEV

SEQ ID NO: 13739 - protein, 9 aa, Homo Sapiens
TVIRPFPGL

SEQ ID NO: 13740 - protein, 9 aa, Homo Sapiens
TVKDTMEFI

SEQ ID NO: 13741 - protein, 9 aa, Homo Sapiens
TVKENLDQL

SEQ ID NO: 13742 - protein, 9 aa, Homo Sapiens
TVKNIMDSV

SEQ ID NO: 13743 - protein, 9 aa, Homo Sapiens
TVMDEIHTV

SEQ ID NO: 13744 - protein, 9 aa, Homo Sapiens
TVMGRIATL

SEQ ID NO: 13745 - protein, 9 aa, Homo Sapiens
TVPDEIQEV

SEQ ID NO: 13746 - protein, 9 aa, Homo Sapiens
TVPEHIQQL

SEQ ID NO: 13747 - protein, 9 aa, Homo Sapiens
TVPELTQQV

SEQ ID NO: 13748 - protein, 9 aa, Homo Sapiens
TVPVKIDKV

SEQ ID NO: 13749 - protein, 9 aa, Homo Sapiens
TVREQCEQL

SEQ ID NO: 13750 - protein, 9 aa, Homo Sapiens
TVSPLFQKL

SEQ ID NO: 13751 - protein, 9 aa, Homo Sapiens
TVTELSDFL

SEQ ID NO: 13752 - protein, 9 aa, Homo Sapiens
TVTGKLVHA

SEQ ID NO: 13753 - protein, 9 aa, Homo Sapiens
TVVERLVKV

SEQ ID NO: 13754 - protein, 9 aa, Homo Sapiens
TVVKAISGV

SEQ ID NO: 13755 - protein, 9 aa, Homo Sapiens
TVVMYLHHV

SEQ ID NO: 13756 - protein, 9 aa, Homo Sapiens
TVVPSISKL

SEQ ID NO: 13757 - protein, 9 aa, Homo Sapiens
TVVPWDHAL

SEQ ID NO: 13758 - protein, 9 aa, Homo Sapiens
TVYGGSDEL

SEQ ID NO: 13759 - protein, 9 aa, Homo Sapiens
TVYSGEEKL

SEQ ID NO: 13760 - protein, 9 aa, Homo Sapiens
TYLGAEALL

SEQ ID NO: 13761 - protein, 9 aa, Homo Sapiens
VAAPQVQQV

SEQ ID NO: 13762 - protein, 9 aa, Homo Sapiens
VAAPYIAKA

SEQ ID NO: 13763 - protein, 9 aa, Homo Sapiens
VACGANHTL

SEQ ID NO: 13764 - protein, 9 aa, Homo Sapiens
VACGLNHTL

SEQ ID NO: 13765 - protein, 9 aa, Homo Sapiens
VAIEHLDKI

SEQ ID NO: 13766 - protein, 9 aa, Homo Sapiens
VAPFPEVFG

SEQ ID NO: 13767 - protein, 9 aa, Homo Sapiens
VAVPLYDTL

SEQ ID NO: 13768 - protein, 9 aa, Homo Sapiens
VDAEAVHKL

SEQ ID NO: 13769 - protein, 9 aa, Homo Sapiens
VEELKPTPE

SEQ ID NO: 13770 - protein, 9 aa, Homo Sapiens
VIAAVSHEL

SEQ ID NO: 13771 - protein, 9 aa, Homo Sapiens
VIAEQIQHL

SEQ ID NO: 13772 - protein, 9 aa, Homo Sapiens
VIANINNCL

SEQ ID NO: 13773 - protein, 9 aa, Homo Sapiens
VIAPLTEEL

SEQ ID NO: 13774 - protein, 9 aa, Homo Sapiens
VIIKYLESL

SEQ ID NO: 13775 - protein, 9 aa, Homo Sapiens
VIINQIYEA

SEQ ID NO: 13776 - protein, 9 aa, Homo Sapiens
VIPELAQEL

SEQ ID NO: 13777 - protein, 9 aa, Homo Sapiens
VIPPFCNLL

SEQ ID NO: 13778 - protein, 9 aa, Homo Sapiens
VISGINEKL

SEQ ID NO: 13779 - protein, 9 aa, Homo Sapiens
VISPLNQLL

SEQ ID NO: 13780 - protein, 9 aa, Homo Sapiens
VIVPLYDTL

SEQ ID NO: 13781 - protein, 9 aa, Homo Sapiens
VKPEEHEQV

SEQ ID NO: 13782 - protein, 9 aa, Homo Sapiens
VLAFLVHEL

SEQ ID NO: 13783 - protein, 9 aa, Homo Sapiens
VLAGHDNRV

SEQ ID NO: 13784 - protein, 9 aa, Homo Sapiens
VLAPMFERL

SEQ ID NO: 13785 - protein, 9 aa, Homo Sapiens
VLAYFLPEA

SEQ ID NO: 13786 - protein, 9 aa, Homo Sapiens
VLCELINAL

SEQ ID NO: 13787 - protein, 9 aa, Homo Sapiens
VLFGLLREV

SEQ ID NO: 13788 - protein, 9 aa, Homo Sapiens
VLFNKLTYL

SEQ ID NO: 13789 - protein, 9 aa, Homo Sapiens
VLGPKIEAV

SEQ ID NO: 13790 - protein, 9 aa, Homo Sapiens
VLIDEVESL

SEQ ID NO: 13791 - protein, 9 aa, Homo Sapiens
VLIKTAEEL

SEQ ID NO: 13792 - protein, 9 aa, Homo Sapiens
VLIPKLPQL

SEQ ID NO: 13793 - protein, 9 aa, Homo Sapiens
VLKEIVERV

SEQ ID NO: 13794 - protein, 9 aa, Homo Sapiens
VLKEKLDSL

SEQ ID NO: 13795 - protein, 9 aa, Homo Sapiens
VLKENADFL

SEQ ID NO: 13796 - protein, 9 aa, Homo Sapiens
VLKESLDQL

SEQ ID NO: 13797 - protein, 9 aa, Homo Sapiens
VLKEYLDNV

SEQ ID NO: 13798 - protein, 9 aa, Homo Sapiens
VLKGDVEKL

SEQ ID NO: 13799 - protein, 9 aa, Homo Sapiens
VLKVFLENV

SEQ ID NO: 13800 - protein, 9 aa, Homo Sapiens
VLPAFTSNL

SEQ ID NO: 13801 - protein, 9 aa, Homo Sapiens
VLPETCEEL

SEQ ID NO: 13802 - protein, 9 aa, Homo Sapiens
VLPLLLMAS

SEQ ID NO: 13803 - protein, 9 aa, Homo Sapiens
VLPSIVNEV

SEQ ID NO: 13804 - protein, 9 aa, Homo Sapiens
VLREGAESL

SEQ ID NO: 13805 - protein, 9 aa, Homo Sapiens
VLSDIIQNL

SEQ ID NO: 13806 - protein, 9 aa, Homo Sapiens
VLVEMVQAL

SEQ ID NO: 13807 - protein, 9 aa, Homo Sapiens
VLYGDVEEL

SEQ ID NO: 13808 - protein, 9 aa, Homo Sapiens
VLYPGCDTL

SEQ ID NO: 13809 - protein, 9 aa, Homo Sapiens
VMKKIIETV

SEQ ID NO: 13810 - protein, 9 aa, Homo Sapiens
VPGEIVESL

SEQ ID NO: 13811 - protein, 9 aa, Homo Sapiens
VPQLEIVPN

SEQ ID NO: 13812 - protein, 9 aa, Homo Sapiens
VQADAPHGV

SEQ ID NO: 13813 - protein, 9 aa, Homo Sapiens
VQASHFEGL

SEQ ID NO: 13814 - protein, 9 aa, Homo Sapiens
VQEDFSVRV

SEQ ID NO: 13815 - protein, 9 aa, Homo Sapiens
VQFEHGYRL

SEQ ID NO: 13816 - protein, 9 aa, Homo Sapiens
VQFPSHYTL

SEQ ID NO: 13817 - protein, 9 aa, Homo Sapiens
VQIEEVRQV

SEQ ID NO: 13818 - protein, 9 aa, Homo Sapiens
VQIEHISSL

SEQ ID NO: 13819 - protein, 9 aa, Homo Sapiens
VQIGDIVTV

SEQ ID NO: 13820 - protein, 9 aa, Homo Sapiens
VQIPFFAKL

SEQ ID NO: 13821 - protein, 9 aa, Homo Sapiens
VQLGYSVLS

SEQ ID NO: 13822 - protein, 9 aa, Homo Sapiens
VQNGKVIGV

SEQ ID NO: 13823 - protein, 9 aa, Homo Sapiens
VQPEHIQYL

SEQ ID NO: 13824 - protein, 9 aa, Homo Sapiens
VQSGIKVRL

SEQ ID NO: 13825 - protein, 9 aa, Homo Sapiens
VQSGLRILL

SEQ ID NO: 13826 - protein, 9 aa, Homo Sapiens
VQTAIKSEL

SEQ ID NO: 13827 - protein, 9 aa, Homo Sapiens
VQTEVNREL

SEQ ID NO: 13828 - protein, 9 aa, Homo Sapiens
VQTHFIHTL

SEQ ID NO: 13829 - protein, 9 aa, Homo Sapiens
VSTSHTTIS

SEQ ID NO: 13830 - protein, 9 aa, Homo Sapiens
VTAPKAERL

SEQ ID NO: 13831 - protein, 9 aa, Homo Sapiens
VTFSENHGV

SEQ ID NO: 13832 - protein, 9 aa, Homo Sapiens
VTIEDVQKL

SEQ ID NO: 13833 - protein, 9 aa, Homo Sapiens
VTIRLLETI

SEQ ID NO: 13834 - protein, 9 aa, Homo Sapiens
VTISSIEKL

SEQ ID NO: 13835 - protein, 9 aa, Homo Sapiens
VTQTHIAEA

SEQ ID NO: 13836 - protein, 9 aa, Homo Sapiens
VTVENVQEL

SEQ ID NO: 13837 - protein, 9 aa, Homo Sapiens
VVAEELENV

SEQ ID NO: 13838 - protein, 9 aa, Homo Sapiens
VVAEEVAAL

SEQ ID NO: 13839 - protein, 9 aa, Homo Sapiens
VVAEKIQRI

SEQ ID NO: 13840 - protein, 9 aa, Homo Sapiens
VVAITVQEL

SEQ ID NO: 13841 - protein, 9 aa, Homo Sapiens
VVAPSIIAA

SEQ ID NO: 13842 - protein, 9 aa, Homo Sapiens
VVAQEAQSL

SEQ ID NO: 13843 - protein, 9 aa, Homo Sapiens
VVCGLIFRL

SEQ ID NO: 13844 - protein, 9 aa, Homo Sapiens
VVIGSIRHV

SEQ ID NO: 13845 - protein, 9 aa, Homo Sapiens
VVIKKLNEI

SEQ ID NO: 13846 - protein, 9 aa, Homo Sapiens
VVKEKLTGL

SEQ ID NO: 13847 - protein, 9 aa, Homo Sapiens
VVKGKVEYL

SEQ ID NO: 13848 - protein, 9 aa, Homo Sapiens
VVMETANRV

SEQ ID NO: 13849 - protein, 9 aa, Homo Sapiens
VVMNVVHQL

SEQ ID NO: 13850 - protein, 9 aa, Homo Sapiens
VVNETVEKL

SEQ ID NO: 13851 - protein, 9 aa, Homo Sapiens
VVPDSAHKL

SEQ ID NO: 13852 - protein, 9 aa, Homo Sapiens
VVPPFLQPE

SEQ ID NO: 13853 - protein, 9 aa, Homo Sapiens
VVSAIVDTL

SEQ ID NO: 13854 - protein, 9 aa, Homo Sapiens
VVSGVVSKV

SEQ ID NO: 13855 - protein, 9 aa, Homo Sapiens
VVSPVNVHI

SEQ ID NO: 13856 - protein, 9 aa, Homo Sapiens
VVVDPIQSV

SEQ ID NO: 13857 - protein, 9 aa, Homo Sapiens
VVVGDLVEV

SEQ ID NO: 13858 - protein, 9 aa, Homo Sapiens
VVVGGCERV

SEQ ID NO: 13859 - protein, 9 aa, Homo Sapiens
VVYEDIFDA

SEQ ID NO: 13860 - protein, 9 aa, Homo Sapiens
VVYERCEKL

SEQ ID NO: 13861 - protein, 9 aa, Homo Sapiens
WLVDHVYAI

SEQ ID NO: 13862 - protein, 9 aa, Homo Sapiens
WQYIKTHKL

SEQ ID NO: 13863 - protein, 9 aa, Homo Sapiens
WVAERVELL

SEQ ID NO: 13864 - protein, 9 aa, Homo Sapiens
WVYPFLEHI

SEQ ID NO: 13865 - protein, 9 aa, Homo Sapiens
YAFGGGCEL

SEQ ID NO: 13866 - protein, 9 aa, Homo Sapiens
YAFPKAVSV

SEQ ID NO: 13867 - protein, 9 aa, Homo Sapiens
YAFPKSITV

SEQ ID NO: 13868 - protein, 9 aa, Homo Sapiens
YAFPLAHSL

SEQ ID NO: 13869 - protein, 9 aa, Homo Sapiens
YAFVHMERA

SEQ ID NO: 13870 - protein, 9 aa, Homo Sapiens
YAIEKIERI

SEQ ID NO: 13871 - protein, 9 aa, Homo Sapiens
YAIKNIHGV

SEQ ID NO: 13872 - protein, 9 aa, Homo Sapiens
YAITTLHNL

SEQ ID NO: 13873 - protein, 9 aa, Homo Sapiens
YASENVNKL

SEQ ID NO: 13874 - protein, 9 aa, Homo Sapiens
YASGINVNL

SEQ ID NO: 13875 - protein, 9 aa, Homo Sapiens
YASPDLSKL

SEQ ID NO: 13876 - protein, 9 aa, Homo Sapiens
YAVELFEGL

SEQ ID NO: 13877 - protein, 9 aa, Homo Sapiens
YAYDGKDYI

SEQ ID NO: 13878 - protein, 9 aa, Homo Sapiens
YAYEAVEQL

SEQ ID NO: 13879 - protein, 9 aa, Homo Sapiens
YGAEALERM

SEQ ID NO: 13880 - protein, 9 aa, Homo Sapiens
YGMERVWCV

SEQ ID NO: 13881 - protein, 9 aa, Homo Sapiens
YGSHIQALL

SEQ ID NO: 13882 - protein, 9 aa, Homo Sapiens
YHADIYDKV

SEQ ID NO: 13883 - protein, 9 aa, Homo Sapiens
YIAEEYSRL

SEQ ID NO: 13884 - protein, 9 aa, Homo Sapiens
YIAHLRQIL

SEQ ID NO: 13885 - protein, 9 aa, Homo Sapiens
YIAPLFDKF

SEQ ID NO: 13886 - protein, 9 aa, Homo Sapiens
YIAPLKALV

SEQ ID NO: 13887 - protein, 9 aa, Homo Sapiens
YIATIHSRL

SEQ ID NO: 13888 - protein, 9 aa, Homo Sapiens
YIFDNCHEL

SEQ ID NO: 13889 - protein, 9 aa, Homo Sapiens
YIGPDTPAL

SEQ ID NO: 13890 - protein, 9 aa, Homo Sapiens
YIIELNHMI

SEQ ID NO: 13891 - protein, 9 aa, Homo Sapiens
YIIKDLEKL

SEQ ID NO: 13892 - protein, 9 aa, Homo Sapiens
YIITEIPSL

SEQ ID NO: 13893 - protein, 9 aa, Homo Sapiens
YIKRLLETL

SEQ ID NO: 13894 - protein, 9 aa, Homo Sapiens
YIKTELISV

SEQ ID NO: 13895 - protein, 9 aa, Homo Sapiens
YIMSYISRV

SEQ ID NO: 13896 - protein, 9 aa, Homo Sapiens
YIPEAILNL

SEQ ID NO: 13897 - protein, 9 aa, Homo Sapiens
YIPEHIKKL

SEQ ID NO: 13898 - protein, 9 aa, Homo Sapiens
YIPGVDVKL

SEQ ID NO: 13899 - protein, 9 aa, Homo Sapiens
YIPQIVQAL

SEQ ID NO: 13900 - protein, 9 aa, Homo Sapiens
YIPRTLNEV

SEQ ID NO: 13901 - protein, 9 aa, Homo Sapiens
YIPSVLHDV

SEQ ID NO: 13902 - protein, 9 aa, Homo Sapiens
YIPTELDQV

SEQ ID NO: 13903 - protein, 9 aa, Homo Sapiens
YIPTFICSV

SEQ ID NO: 13904 - protein, 9 aa, Homo Sapiens
YISDGKEYL

SEQ ID NO: 13905 - protein, 9 aa, Homo Sapiens
YITELANAL

SEQ ID NO: 13906 - protein, 9 aa, Homo Sapiens
YIVDLLTHL

SEQ ID NO: 13907 - protein, 9 aa, Homo Sapiens
YIYHGTVKL

SEQ ID NO: 13908 - protein, 9 aa, Homo Sapiens
YLADIFTKL

SEQ ID NO: 13909 - protein, 9 aa, Homo Sapiens
YLADLYHFV

SEQ ID NO: 13910 - protein, 9 aa, Homo Sapiens
YLADVTNAL

SEQ ID NO: 13911 - protein, 9 aa, Homo Sapiens
YLAHAIHQV

SEQ ID NO: 13912 - protein, 9 aa, Homo Sapiens
YLAHFIEGL

SEQ ID NO: 13913 - protein, 9 aa, Homo Sapiens
YLAHLAHHL

SEQ ID NO: 13914 - protein, 9 aa, Homo Sapiens
YLAPHVRTL

SEQ ID NO: 13915 - protein, 9 aa, Homo Sapiens
YLCYEVERL

SEQ ID NO: 13916 - protein, 9 aa, Homo Sapiens
YLEDILAKL

SEQ ID NO: 13917 - protein, 9 aa, Homo Sapiens
YLFCDDHKL

SEQ ID NO: 13918 - protein, 9 aa, Homo Sapiens
YLFERIKEL

SEQ ID NO: 13919 - protein, 9 aa, Homo Sapiens
YLGPHIASV

SEQ ID NO: 13920 - protein, 9 aa, Homo Sapiens
YLIASIDHL

SEQ ID NO: 13921 - protein, 9 aa, Homo Sapiens
YLIELIDRV

SEQ ID NO: 13922 - protein, 9 aa, Homo Sapiens
YLIKDIRFL

SEQ ID NO: 13923 - protein, 9 aa, Homo Sapiens
YLINEIDRI

SEQ ID NO: 13924 - protein, 9 aa, Homo Sapiens
YLIPLLERL

SEQ ID NO: 13925 - protein, 9 aa, Homo Sapiens
YLIPNIKHL

SEQ ID NO: 13926 - protein, 9 aa, Homo Sapiens
YLITLLEHL

SEQ ID NO: 13927 - protein, 9 aa, Homo Sapiens
YLKDEIEEL

SEQ ID NO: 13928 - protein, 9 aa, Homo Sapiens
YLKDKLDET

SEQ ID NO: 13929 - protein, 9 aa, Homo Sapiens
YLKDLIEEV

SEQ ID NO: 13930 - protein, 9 aa, Homo Sapiens
YLKEILEQL

SEQ ID NO: 13931 - protein, 9 aa, Homo Sapiens
YLKSSDNRL

SEQ ID NO: 13932 - protein, 9 aa, Homo Sapiens
YLLESVNKL

SEQ ID NO: 13933 - protein, 9 aa, Homo Sapiens
YLNDFTHEI

SEQ ID NO: 13934 - protein, 9 aa, Homo Sapiens
YLNDLIHSV

SEQ ID NO: 13935 - protein, 9 aa, Homo Sapiens
YLNKHIQKV

SEQ ID NO: 13936 - protein, 9 aa, Homo Sapiens
YLPDIQERL

SEQ ID NO: 13937 - protein, 9 aa, Homo Sapiens
YLPEVKDLL

SEQ ID NO: 13938 - protein, 9 aa, Homo Sapiens
YLPRHSIGL

SEQ ID NO: 13939 - protein, 9 aa, Homo Sapiens
YLPTHTSLL

SEQ ID NO: 13940 - protein, 9 aa, Homo Sapiens
YLPTKLFQA

SEQ ID NO: 13941 - protein, 9 aa, Homo Sapiens
YLPYPIHQV

SEQ ID NO: 13942 - protein, 9 aa, Homo Sapiens
YLSAKVEAL

SEQ ID NO: 13943 - protein, 9 aa, Homo Sapiens
YLSDPCPGL

SEQ ID NO: 13944 - protein, 9 aa, Homo Sapiens
YLSEEVQAV

SEQ ID NO: 13945 - protein, 9 aa, Homo Sapiens
YLSGIAHFL

SEQ ID NO: 13946 - protein, 9 aa, Homo Sapiens
YLSNADERL

SEQ ID NO: 13947 - protein, 9 aa, Homo Sapiens
YLSWKAHRL

SEQ ID NO: 13948 - protein, 9 aa, Homo Sapiens
YLVEDIQHI

SEQ ID NO: 13949 - protein, 9 aa, Homo Sapiens
YLVPELDGV

SEQ ID NO: 13950 - protein, 9 aa, Homo Sapiens
YLVQDLKCL

SEQ ID NO: 13951 - protein, 9 aa, Homo Sapiens
YLVVKIEKV

SEQ ID NO: 13952 - protein, 9 aa, Homo Sapiens
YLYPDITRL

SEQ ID NO: 13953 - protein, 9 aa, Homo Sapiens
YMAELIERL

SEQ ID NO: 13954 - protein, 9 aa, Homo Sapiens
YMAEREDEL

SEQ ID NO: 13955 - protein, 9 aa, Homo Sapiens
YMAPEVVEA

SEQ ID NO: 13956 - protein, 9 aa, Homo Sapiens
YMIAHITGL

SEQ ID NO: 13957 - protein, 9 aa, Homo Sapiens
YQAEAREAL

SEQ ID NO: 13958 - protein, 9 aa, Homo Sapiens
YQAEIPDRL

SEQ ID NO: 13959 - protein, 9 aa, Homo Sapiens
YQAHYGEQL

SEQ ID NO: 13960 - protein, 9 aa, Homo Sapiens
YQALALWKL

SEQ ID NO: 13961 - protein, 9 aa, Homo Sapiens
YQAPDMDTL

SEQ ID NO: 13962 - protein, 9 aa, Homo Sapiens
YQAQHDDEL

SEQ ID NO: 13963 - protein, 9 aa, Homo Sapiens
YQFGEIRTI

SEQ ID NO: 13964 - protein, 9 aa, Homo Sapiens
YQFSKNFSL

SEQ ID NO: 13965 - protein, 9 aa, Homo Sapiens
YQGEGAHHI

SEQ ID NO: 13966 - protein, 9 aa, Homo Sapiens
YQHGGVTGL

SEQ ID NO: 13967 - protein, 9 aa, Homo Sapiens
YQHKEEYQL

SEQ ID NO: 13968 - protein, 9 aa, Homo Sapiens
YQHYMADRL

SEQ ID NO: 13969 - protein, 9 aa, Homo Sapiens
YQIAEQFRV

SEQ ID NO: 13970 - protein, 9 aa, Homo Sapiens
YQIDSVVRA

SEQ ID NO: 13971 - protein, 9 aa, Homo Sapiens
YQIHKEYLL

SEQ ID NO: 13972 - protein, 9 aa, Homo Sapiens
YQIKEMMQL

SEQ ID NO: 13973 - protein, 9 aa, Homo Sapiens
YQIVPSHKL

SEQ ID NO: 13974 - protein, 9 aa, Homo Sapiens
YQNQEIHNL

SEQ ID NO: 13975 - protein, 9 aa, Homo Sapiens
YQPKIQQFL

SEQ ID NO: 13976 - protein, 9 aa, Homo Sapiens
YQQKEIEFL

SEQ ID NO: 13977 - protein, 9 aa, Homo Sapiens
YQQQQQSEL

SEQ ID NO: 13978 - protein, 9 aa, Homo Sapiens
YQRELLETL

SEQ ID NO: 13979 - protein, 9 aa, Homo Sapiens
YQSDFWQHL

SEQ ID NO: 13980 - protein, 9 aa, Homo Sapiens
YQSGCLYRL

SEQ ID NO: 13981 - protein, 9 aa, Homo Sapiens
YQSIEFSRL

SEQ ID NO: 13982 - protein, 9 aa, Homo Sapiens
YQSKVRELI

SEQ ID NO: 13983 - protein, 9 aa, Homo Sapiens
YQTEIGQTL

SEQ ID NO: 13984 - protein, 9 aa, Homo Sapiens
YQTEKGITV

SEQ ID NO: 13985 - protein, 9 aa, Homo Sapiens
YQTPFNKEV

SEQ ID NO: 13986 - protein, 9 aa, Homo Sapiens
YQTPLHLAV

SEQ ID NO: 13987 - protein, 9 aa, Homo Sapiens
YQTQLIQRV

SEQ ID NO: 13988 - protein, 9 aa, Homo Sapiens
YQVDSRTYL

SEQ ID NO: 13989 - protein, 9 aa, Homo Sapiens
YQVEGMEWL

SEQ ID NO: 13990 - protein, 9 aa, Homo Sapiens
YQVGQLYSV

SEQ ID NO: 13991 - protein, 9 aa, Homo Sapiens
YQVGVHYEL

SEQ ID NO: 13992 - protein, 9 aa, Homo Sapiens
YQVVQFNRL

SEQ ID NO: 13993 - protein, 9 aa, Homo Sapiens
YQYPRPLLI

SEQ ID NO: 13994 - protein, 9 aa, Homo Sapiens
YQYPVIIHL

SEQ ID NO: 13995 - protein, 9 aa, Homo Sapiens
YQYTSPDFL

SEQ ID NO: 13996 - protein, 9 aa, Homo Sapiens
YSAAILEYL

SEQ ID NO: 13997 - protein, 9 aa, Homo Sapiens
YSFHKFHYL

SEQ ID NO: 13998 - protein, 9 aa, Homo Sapiens
YSKEGWEYV

SEQ ID NO: 13999 - protein, 9 aa, Homo Sapiens
YTAEIKQNL

SEQ ID NO: 14000 - protein, 9 aa, Homo Sapiens
YTAPTAIRL

SEQ ID NO: 14001 - protein, 9 aa, Homo Sapiens
YTCERNDQL

SEQ ID NO: 14002 - protein, 9 aa, Homo Sapiens
YTFPLAEKV

SEQ ID NO: 14003 - protein, 9 aa, Homo Sapiens
YTIPLAIKL

SEQ ID NO: 14004 - protein, 9 aa, Homo Sapiens
YTIQSIERI

SEQ ID NO: 14005 - protein, 9 aa, Homo Sapiens
YTPEEIEKL

SEQ ID NO: 14006 - protein, 9 aa, Homo Sapiens
YTRESTEFL

SEQ ID NO: 14007 - protein, 9 aa, Homo Sapiens
YTSESGDRL

SEQ ID NO: 14008 - protein, 9 aa, Homo Sapiens
YTSPVNPAV

SEQ ID NO: 14009 - protein, 9 aa, Homo Sapiens
YTSRIVVRL

SEQ ID NO: 14010 - protein, 9 aa, Homo Sapiens
YTTDFIYQL

SEQ ID NO: 14011 - protein, 9 aa, Homo Sapiens
YTVEDIQRL

SEQ ID NO: 14012 - protein, 9 aa, Homo Sapiens
YTVILIERA

SEQ ID NO: 14013 - protein, 9 aa, Homo Sapiens
YVADLGDIL

SEQ ID NO: 14014 - protein, 9 aa, Homo Sapiens
YVADLVHSA

SEQ ID NO: 14015 - protein, 9 aa, Homo Sapiens
YVAEAEEKL

SEQ ID NO: 14016 - protein, 9 aa, Homo Sapiens
YVAELIQQL

SEQ ID NO: 14017 - protein, 9 aa, Homo Sapiens
YVAEREDEL

SEQ ID NO: 14018 - protein, 9 aa, Homo Sapiens
YVAPHLNNL

SEQ ID NO: 14019 - protein, 9 aa, Homo Sapiens
YVASNQHEV

SEQ ID NO: 14020 - protein, 9 aa, Homo Sapiens
YVFPGVTRL

SEQ ID NO: 14021 - protein, 9 aa, Homo Sapiens
YVFSHNHKL

SEQ ID NO: 14022 - protein, 9 aa, Homo Sapiens
YVHMVTHFI

SEQ ID NO: 14023 - protein, 9 aa, Homo Sapiens
YVHPFIFAL

SEQ ID NO: 14024 - protein, 9 aa, Homo Sapiens
YVIAYIRDL

SEQ ID NO: 14025 - protein, 9 aa, Homo Sapiens
YVIELQHVV

SEQ ID NO: 14026 - protein, 9 aa, Homo Sapiens
YVIESDEDL

SEQ ID NO: 14027 - protein, 9 aa, Homo Sapiens
YVIGGFDGL

SEQ ID NO: 14028 - protein, 9 aa, Homo Sapiens
YVINVTTHL

SEQ ID NO: 14029 - protein, 9 aa, Homo Sapiens
YVITDLTQL

SEQ ID NO: 14030 - protein, 9 aa, Homo Sapiens
YVKDRVEKV

SEQ ID NO: 14031 - protein, 9 aa, Homo Sapiens
YVKEELHQL

SEQ ID NO: 14032 - protein, 9 aa, Homo Sapiens
YVNAMNDKI

SEQ ID NO: 14033 - protein, 9 aa, Homo Sapiens
YVNGEIQKA

SEQ ID NO: 14034 - protein, 9 aa, Homo Sapiens
YVPAEVCRL

SEQ ID NO: 14035 - protein, 9 aa, Homo Sapiens
YVPDIVRCV

SEQ ID NO: 14036 - protein, 9 aa, Homo Sapiens
YVPETVYRV

SEQ ID NO: 14037 - protein, 9 aa, Homo Sapiens
YVRDCVEAL

SEQ ID NO: 14038 - protein, 9 aa, Homo Sapiens
YVSEILEKV

SEQ ID NO: 14039 - protein, 9 aa, Homo Sapiens
YVSKYIDYI

SEQ ID NO: 14040 - protein, 9 aa, Homo Sapiens
YVSKYINYI

SEQ ID NO: 14041 - protein, 9 aa, Homo Sapiens
YVSPRILTA

SEQ ID NO: 14042 - protein, 9 aa, Homo Sapiens
YVTEELPQL

SEQ ID NO: 14043 - protein, 9 aa, Homo Sapiens
YVTELAELI

SEQ ID NO: 14044 - protein, 9 aa, Homo Sapiens
YVTELTDRI

SEQ ID NO: 14045 - protein, 9 aa, Homo Sapiens
YVTELTHRI

SEQ ID NO: 14046 - protein, 9 aa, Homo Sapiens
YVTPVNRNV

SEQ ID NO: 14047 - protein, 9 aa, Homo Sapiens
YVTQINRLL

SEQ ID NO: 14048 - protein, 9 aa, Homo Sapiens
YVVAKLDDL

SEQ ID NO: 14049 - protein, 9 aa, Homo Sapiens
YVVDNIDHL

SEQ ID NO: 14050 - protein, 9 aa, Homo Sapiens
YVVPFVAKV

SEQ ID NO: 14051 - protein, 9 aa, Homo Sapiens
YVVPYTIHL

SEQ ID NO: 14052 - protein, 9 aa, Homo Sapiens
YVYEFRDKL

SEQ ID NO: 14053 - protein, 9 aa, Homo Sapiens
YVYEYLLHV

SEQ ID NO: 14054 - protein, 10 aa, Homo Sapiens
AAFDFLLQRV

SEQ ID NO: 14055 - protein, 10 aa, Homo Sapiens
AAFEFDIHQV

SEQ ID NO: 14056 - protein, 10 aa, Homo Sapiens
AAFGGTFKKV

SEQ ID NO: 14057 - protein, 10 aa, Homo Sapiens
AAFGRDLFLA

SEQ ID NO: 14058 - protein, 10 aa, Homo Sapiens
AAFLGHLEVL

SEQ ID NO: 14059 - protein, 10 aa, Homo Sapiens
AAFQETLETL

SEQ ID NO: 14060 - protein, 10 aa, Homo Sapiens
AAFVEELDKV

SEQ ID NO: 14061 - protein, 10 aa, Homo Sapiens
AAFYHHLPAA

SEQ ID NO: 14062 - protein, 10 aa, Homo Sapiens
AALALLFAIH

SEQ ID NO: 14063 - protein, 10 aa, Homo Sapiens
AAYNGHCEAL

SEQ ID NO: 14064 - protein, 10 aa, Homo Sapiens
AAYVGDLQTL

SEQ ID NO: 14065 - protein, 10 aa, Homo Sapiens
AGYQGEITSV

SEQ ID NO: 14066 - protein, 10 aa, Homo Sapiens
AGYTDNLVRV

SEQ ID NO: 14067 - protein, 10 aa, Homo Sapiens
AIFDRVLTEL

SEQ ID NO: 14068 - protein, 10 aa, Homo Sapiens
AIFPFNIHEN

SEQ ID NO: 14069 - protein, 10 aa, Homo Sapiens
AIFSEDLENL

SEQ ID NO: 14070 - protein, 10 aa, Homo Sapiens
AIIANGITKA

SEQ ID NO: 14071 - protein, 10 aa, Homo Sapiens
AIIDGKIFCV

SEQ ID NO: 14072 - protein, 10 aa, Homo Sapiens
AIPGFTINRV

SEQ ID NO: 14073 - protein, 10 aa, Homo Sapiens
AIYDHINEGV

SEQ ID NO: 14074 - protein, 10 aa, Homo Sapiens
ALAPASLTSA

SEQ ID NO: 14075 - protein, 10 aa, Homo Sapiens
ALFPAFIHQS

SEQ ID NO: 14076 - protein, 10 aa, Homo Sapiens
ALFPAPLAQI

SEQ ID NO: 14077 - protein, 10 aa, Homo Sapiens
ALFPGDVDRL

SEQ ID NO: 14078 - protein, 10 aa, Homo Sapiens
ALFQPHLINV

SEQ ID NO: 14079 - protein, 10 aa, Homo Sapiens
ALFTGGMKES

SEQ ID NO: 14080 - protein, 10 aa, Homo Sapiens
ALIDEQILCV

SEQ ID NO: 14081 - protein, 10 aa, Homo Sapiens
ALPDQGIAKA

SEQ ID NO: 14082 - protein, 10 aa, Homo Sapiens
ALYDHLMDFL

SEQ ID NO: 14083 - protein, 10 aa, Homo Sapiens
ALYNKEMECL

SEQ ID NO: 14084 - protein, 10 aa, Homo Sapiens
ALYPGQLVQL

SEQ ID NO: 14085 - protein, 10 aa, Homo Sapiens
AMFDHIPVGV

SEQ ID NO: 14086 - protein, 10 aa, Homo Sapiens
AMFEHEMEES

SEQ ID NO: 14087 - protein, 10 aa, Homo Sapiens
AMFEPDMQEA

SEQ ID NO: 14088 - protein, 10 aa, Homo Sapiens
AQAEDMNVKL

SEQ ID NO: 14089 - protein, 10 aa, Homo Sapiens
AQAEIEQYRL

SEQ ID NO: 14090 - protein, 10 aa, Homo Sapiens
AQAESNKAFL

SEQ ID NO: 14091 - protein, 10 aa, Homo Sapiens
AQAEVYKELR

SEQ ID NO: 14092 - protein, 10 aa, Homo Sapiens
AQAGEFGDRL

SEQ ID NO: 14093 - protein, 10 aa, Homo Sapiens
AQAKEENVGL

SEQ ID NO: 14094 - protein, 10 aa, Homo Sapiens
AQFAEATQRL

SEQ ID NO: 14095 - protein, 10 aa, Homo Sapiens
AQFAQKTEAL

SEQ ID NO: 14096 - protein, 10 aa, Homo Sapiens
AQFEESMIAA

SEQ ID NO: 14097 - protein, 10 aa, Homo Sapiens
AQIAEGMAYI

SEQ ID NO: 14098 - protein, 10 aa, Homo Sapiens
AQIEGGVHGL

SEQ ID NO: 14099 - protein, 10 aa, Homo Sapiens
AQMEVASFLL

SEQ ID NO: 14100 - protein, 10 aa, Homo Sapiens
AQVKPDGTYV

SEQ ID NO: 14101 - protein, 10 aa, Homo Sapiens
AQYEHDLEVA

SEQ ID NO: 14102 - protein, 10 aa, Homo Sapiens
AQYSGAQVRV

SEQ ID NO: 14103 - protein, 10 aa, Homo Sapiens
ASFNDTFVHV

SEQ ID NO: 14104 - protein, 10 aa, Homo Sapiens
ATFPKEIQML

SEQ ID NO: 14105 - protein, 10 aa, Homo Sapiens
ATFPRAMEAL

SEQ ID NO: 14106 - protein, 10 aa, Homo Sapiens
ATYDKLCKEV

SEQ ID NO: 14107 - protein, 10 aa, Homo Sapiens
ATYPYQVVRA

SEQ ID NO: 14108 - protein, 10 aa, Homo Sapiens
ATYTGRVDAV

SEQ ID NO: 14109 - protein, 10 aa, Homo Sapiens
AVFCPNLTEV

SEQ ID NO: 14110 - protein, 10 aa, Homo Sapiens
AVFDDDMEQL

SEQ ID NO: 14111 - protein, 10 aa, Homo Sapiens
AVFDKTLAEL

SEQ ID NO: 14112 - protein, 10 aa, Homo Sapiens
AVFENKIYVV

SEQ ID NO: 14113 - protein, 10 aa, Homo Sapiens
AVFKGKFKEG

SEQ ID NO: 14114 - protein, 10 aa, Homo Sapiens
AVFPDDMPTL

SEQ ID NO: 14115 - protein, 10 aa, Homo Sapiens
AVFPFQPGSV

SEQ ID NO: 14116 - protein, 10 aa, Homo Sapiens
AVFPFQQVSL

SEQ ID NO: 14117 - protein, 10 aa, Homo Sapiens
AVFPSQVNVA

SEQ ID NO: 14118 - protein, 10 aa, Homo Sapiens
AVFQKQMDSL

SEQ ID NO: 14119 - protein, 10 aa, Homo Sapiens
AVFREKILHI

SEQ ID NO: 14120 - protein, 10 aa, Homo Sapiens
AVFTDKDANV

SEQ ID NO: 14121 - protein, 10 aa, Homo Sapiens
AVIDVGINRV

SEQ ID NO: 14122 - protein, 10 aa, Homo Sapiens
AVIEKFAPIK

SEQ ID NO: 14123 - protein, 10 aa, Homo Sapiens
AVIGTRLHAA

SEQ ID NO: 14124 - protein, 10 aa, Homo Sapiens
AVITGAVVAA

SEQ ID NO: 14125 - protein, 10 aa, Homo Sapiens
AVNDFELARA

SEQ ID NO: 14126 - protein, 10 aa, Homo Sapiens
AVPDEIPPLE

SEQ ID NO: 14127 - protein, 10 aa, Homo Sapiens
AVPDGPLQEV

SEQ ID NO: 14128 - protein, 10 aa, Homo Sapiens
AVVTGAVVAA

SEQ ID NO: 14129 - protein, 10 aa, Homo Sapiens
AVYEGHVSCV

SEQ ID NO: 14130 - protein, 10 aa, Homo Sapiens
AVYGFKLQSL

SEQ ID NO: 14131 - protein, 10 aa, Homo Sapiens
AVYSQFITQL

SEQ ID NO: 14132 - protein, 10 aa, Homo Sapiens
CGFGGPLARV

SEQ ID NO: 14133 - protein, 10 aa, Homo Sapiens
CQFYVVNSEL

SEQ ID NO: 14134 - protein, 10 aa, Homo Sapiens
CQHDFQAPYL

SEQ ID NO: 14135 - protein, 10 aa, Homo Sapiens
DIGSESTEDQ

SEQ ID NO: 14136 - protein, 10 aa, Homo Sapiens
DTNADKQLSF

SEQ ID NO: 14137 - protein, 10 aa, Homo Sapiens
EESNYELEGK

SEQ ID NO: 14138 - protein, 10 aa, Homo Sapiens
ELFPAPILRA

SEQ ID NO: 14139 - protein, 10 aa, Homo Sapiens
ELFPIQMEGV

SEQ ID NO: 14140 - protein, 10 aa, Homo Sapiens
FAAPEKDIFL

SEQ ID NO: 14141 - protein, 10 aa, Homo Sapiens
FAFESDLHSL

SEQ ID NO: 14142 - protein, 10 aa, Homo Sapiens
FAFGGLCERL

SEQ ID NO: 14143 - protein, 10 aa, Homo Sapiens
FAFQAEIAQL

SEQ ID NO: 14144 - protein, 10 aa, Homo Sapiens
FAFTNKITSV

SEQ ID NO: 14145 - protein, 10 aa, Homo Sapiens
FAYDGKDYLT

SEQ ID NO: 14146 - protein, 10 aa, Homo Sapiens
FAYPNRPDVL

SEQ ID NO: 14147 - protein, 10 aa, Homo Sapiens
FDGHGGIRAS

SEQ ID NO: 14148 - protein, 10 aa, Homo Sapiens
FGFLGKIDEL

SEQ ID NO: 14149 - protein, 10 aa, Homo Sapiens
FGYDHLILNV

SEQ ID NO: 14150 - protein, 10 aa, Homo Sapiens
FGYDKDTSLL

SEQ ID NO: 14151 - protein, 10 aa, Homo Sapiens
FGYPFRLNEA

SEQ ID NO: 14152 - protein, 10 aa, Homo Sapiens
FICDYELHEL

SEQ ID NO: 14153 - protein, 10 aa, Homo Sapiens
FIFDVHVHEV

SEQ ID NO: 14154 - protein, 10 aa, Homo Sapiens
FIFEKKLAQA

SEQ ID NO: 14155 - protein, 10 aa, Homo Sapiens
FIFPASNVYL

SEQ ID NO: 14156 - protein, 10 aa, Homo Sapiens
FIFSDHIRCI

SEQ ID NO: 14157 - protein, 10 aa, Homo Sapiens
FIFSEGVERA

SEQ ID NO: 14158 - protein, 10 aa, Homo Sapiens
FIFSEKPVFV

SEQ ID NO: 14159 - protein, 10 aa, Homo Sapiens
FIPDSGTEFI

SEQ ID NO: 14160 - protein, 10 aa, Homo Sapiens
FIPEHTNLSL

SEQ ID NO: 14161 - protein, 10 aa, Homo Sapiens
FIPEKEVVQA

SEQ ID NO: 14162 - protein, 10 aa, Homo Sapiens
FIPKEGDDFL

SEQ ID NO: 14163 - protein, 10 aa, Homo Sapiens
FIPPDGNFRL

SEQ ID NO: 14164 - protein, 10 aa, Homo Sapiens
FISDIANDAL

SEQ ID NO: 14165 - protein, 10 aa, Homo Sapiens
FIYHGEVPQA

SEQ ID NO: 14166 - protein, 10 aa, Homo Sapiens
FLAEHPNVTL

SEQ ID NO: 14167 - protein, 10 aa, Homo Sapiens
FLFDEEMEQM

SEQ ID NO: 14168 - protein, 10 aa, Homo Sapiens
FLFDGSPTYV

SEQ ID NO: 14169 - protein, 10 aa, Homo Sapiens
FLFGEEPSKL

SEQ ID NO: 14170 - protein, 10 aa, Homo Sapiens
FLFPNKESLI

SEQ ID NO: 14171 - protein, 10 aa, Homo Sapiens
FLPDGMEARL

SEQ ID NO: 14172 - protein, 10 aa, Homo Sapiens
FLPEAPAELL

SEQ ID NO: 14173 - protein, 10 aa, Homo Sapiens
FLPEFAGTQL

SEQ ID NO: 14174 - protein, 10 aa, Homo Sapiens
FLPESMYERI

SEQ ID NO: 14175 - protein, 10 aa, Homo Sapiens
FLPSHSLDTV

SEQ ID NO: 14176 - protein, 10 aa, Homo Sapiens
FLYKEKLVSV

SEQ ID NO: 14177 - protein, 10 aa, Homo Sapiens
FLYTGEGDTV

SEQ ID NO: 14178 - protein, 10 aa, Homo Sapiens
FMFDEKLVTV

SEQ ID NO: 14179 - protein, 10 aa, Homo Sapiens
FQFEKEPSQL

SEQ ID NO: 14180 - protein, 10 aa, Homo Sapiens
FQIDEDGWRA

SEQ ID NO: 14181 - protein, 10 aa, Homo Sapiens
FQVDIPEHLI

SEQ ID NO: 14182 - protein, 10 aa, Homo Sapiens
FQVKEVDVGL

SEQ ID NO: 14183 - protein, 10 aa, Homo Sapiens
FQVPDWLHHL

SEQ ID NO: 14184 - protein, 10 aa, Homo Sapiens
FQYESKVFYL

SEQ ID NO: 14185 - protein, 10 aa, Homo Sapiens
FQYPCYQEGL

SEQ ID NO: 14186 - protein, 10 aa, Homo Sapiens
FTAPKEIAEI

SEQ ID NO: 14187 - protein, 10 aa, Homo Sapiens
FTFEKTLEEL

SEQ ID NO: 14188 - protein, 10 aa, Homo Sapiens
FTIAEGFVKA

SEQ ID NO: 14189 - protein, 10 aa, Homo Sapiens
FTIGEAITSA

SEQ ID NO: 14190 - protein, 10 aa, Homo Sapiens
FTSDRGFQFV

SEQ ID NO: 14191 - protein, 10 aa, Homo Sapiens
FTYDQDGESL

SEQ ID NO: 14192 - protein, 10 aa, Homo Sapiens
FVADEELVHL

SEQ ID NO: 14193 - protein, 10 aa, Homo Sapiens
FVADEGICYL

SEQ ID NO: 14194 - protein, 10 aa, Homo Sapiens
FVADHPFLFL

SEQ ID NO: 14195 - protein, 10 aa, Homo Sapiens
FVAPPGNISL

SEQ ID NO: 14196 - protein, 10 aa, Homo Sapiens
FVEDTECRTL

SEQ ID NO: 14197 - protein, 10 aa, Homo Sapiens
FVIRNIVEAA

SEQ ID NO: 14198 - protein, 10 aa, Homo Sapiens
FVPESMFDRL

SEQ ID NO: 14199 - protein, 10 aa, Homo Sapiens
FVSPIRPLGL

SEQ ID NO: 14200 - protein, 10 aa, Homo Sapiens
FVYCGKKAQL

SEQ ID NO: 14201 - protein, 10 aa, Homo Sapiens
FVYEMESHAI

SEQ ID NO: 14202 - protein, 10 aa, Homo Sapiens
FVYPLDFART

SEQ ID NO: 14203 - protein, 10 aa, Homo Sapiens
GAFGFQLKEV

SEQ ID NO: 14204 - protein, 10 aa, Homo Sapiens
GAFSDHMALL

SEQ ID NO: 14205 - protein, 10 aa, Homo Sapiens
GIFGGHIRSV

SEQ ID NO: 14206 - protein, 10 aa, Homo Sapiens
GIYKDDIAQV

SEQ ID NO: 14207 - protein, 10 aa, Homo Sapiens
GLFGKELHKV

SEQ ID NO: 14208 - protein, 10 aa, Homo Sapiens
GLYEFPLNKV

SEQ ID NO: 14209 - protein, 10 aa, Homo Sapiens
GLYPFRVNSA

SEQ ID NO: 14210 - protein, 10 aa, Homo Sapiens
GQFAEHLLGA

SEQ ID NO: 14211 - protein, 10 aa, Homo Sapiens
GQFKDIITKV

SEQ ID NO: 14212 - protein, 10 aa, Homo Sapiens
GQFPSYLETV

SEQ ID NO: 14213 - protein, 10 aa, Homo Sapiens
GQYEGHEAEL

SEQ ID NO: 14214 - protein, 10 aa, Homo Sapiens
GQYEGKVSSV

SEQ ID NO: 14215 - protein, 10 aa, Homo Sapiens
GSYPDAILQA

SEQ ID NO: 14216 - protein, 10 aa, Homo Sapiens
GTYADYLAEA

SEQ ID NO: 14217 - protein, 10 aa, Homo Sapiens
GTYQYDLERL

SEQ ID NO: 14218 - protein, 10 aa, Homo Sapiens
GVFEGHTSKV

SEQ ID NO: 14219 - protein, 10 aa, Homo Sapiens
GVFEGKLNVI

SEQ ID NO: 14220 - protein, 10 aa, Homo Sapiens
GVFEPTIVKV

SEQ ID NO: 14221 - protein, 10 aa, Homo Sapiens
GVFPDNFVKL

SEQ ID NO: 14222 - protein, 10 aa, Homo Sapiens
GVFTRDINKA

SEQ ID NO: 14223 - protein, 10 aa, Homo Sapiens
GVFTRDIQRA

SEQ ID NO: 14224 - protein, 10 aa, Homo Sapiens
GVIDGHIYAV

SEQ ID NO: 14225 - protein, 10 aa, Homo Sapiens
GVIDLIFEKA

SEQ ID NO: 14226 - protein, 10 aa, Homo Sapiens
GVIDLVFEKA

SEQ ID NO: 14227 - protein, 10 aa, Homo Sapiens
GVVDGNVARV

SEQ ID NO: 14228 - protein, 10 aa, Homo Sapiens
GVYGGSVHEA

SEQ ID NO: 14229 - protein, 10 aa, Homo Sapiens
GVYTEKVLEA

SEQ ID NO: 14230 - protein, 10 aa, Homo Sapiens
HIPAYKLETL

SEQ ID NO: 14231 - protein, 10 aa, Homo Sapiens
HLFSGHLSTL

SEQ ID NO: 14232 - protein, 10 aa, Homo Sapiens
HLPEGKLLTA

SEQ ID NO: 14233 - protein, 10 aa, Homo Sapiens
HLPSDFTPAV

SEQ ID NO: 14234 - protein, 10 aa, Homo Sapiens
HQAKDFGNYL

SEQ ID NO: 14235 - protein, 10 aa, Homo Sapiens
HQFDQVMPGV

SEQ ID NO: 14236 - protein, 10 aa, Homo Sapiens
HQHEPFLDFL

SEQ ID NO: 14237 - protein, 10 aa, Homo Sapiens
HVFAEKITSL

SEQ ID NO: 14238 - protein, 10 aa, Homo Sapiens
HVMGSALTGA

SEQ ID NO: 14239 - protein, 10 aa, Homo Sapiens
HVVDSPIINA

SEQ ID NO: 14240 - protein, 10 aa, Homo Sapiens
IAFSYELSKL

SEQ ID NO: 14241 - protein, 10 aa, Homo Sapiens
IAYDRYIKEV

SEQ ID NO: 14242 - protein, 10 aa, Homo Sapiens
IGYDYKLEQI

SEQ ID NO: 14243 - protein, 10 aa, Homo Sapiens
IIFDPNILTI

SEQ ID NO: 14244 - protein, 10 aa, Homo Sapiens
IIFDRDLVVT

SEQ ID NO: 14245 - protein, 10 aa, Homo Sapiens
IIPNFSLDKI

SEQ ID NO: 14246 - protein, 10 aa, Homo Sapiens
IIYDFEDPEM

SEQ ID NO: 14247 - protein, 10 aa, Homo Sapiens
IIYNGGNHKL

SEQ ID NO: 14248 - protein, 10 aa, Homo Sapiens
ILADKEVKKA

SEQ ID NO: 14249 - protein, 10 aa, Homo Sapiens
ILAPCKLETV

SEQ ID NO: 14250 - protein, 10 aa, Homo Sapiens
ILFPDIIARA

SEQ ID NO: 14251 - protein, 10 aa, Homo Sapiens
ILFSEGLIKA

SEQ ID NO: 14252 - protein, 10 aa, Homo Sapiens
ILKDVIPPLE

SEQ ID NO: 14253 - protein, 10 aa, Homo Sapiens
ILPDITKDEL

SEQ ID NO: 14254 - protein, 10 aa, Homo Sapiens
ILPEVENDRL

SEQ ID NO: 14255 - protein, 10 aa, Homo Sapiens
IMPAFIFEHI

SEQ ID NO: 14256 - protein, 10 aa, Homo Sapiens
IQSSISGVTA

SEQ ID NO: 14257 - protein, 10 aa, Homo Sapiens
IQVEPVLDYL

SEQ ID NO: 14258 - protein, 10 aa, Homo Sapiens
ITFPGCFTNT

SEQ ID NO: 14259 - protein, 10 aa, Homo Sapiens
ITHDIEEKGV

SEQ ID NO: 14260 - protein, 10 aa, Homo Sapiens
ITPWFKIIAA

SEQ ID NO: 14261 - protein, 10 aa, Homo Sapiens
IVFDSEMDKL

SEQ ID NO: 14262 - protein, 10 aa, Homo Sapiens
IVFPAGILQA

SEQ ID NO: 14263 - protein, 10 aa, Homo Sapiens
IVSPVPESRL

SEQ ID NO: 14264 - protein, 10 aa, Homo Sapiens
KAFDKHMNLI

SEQ ID NO: 14265 - protein, 10 aa, Homo Sapiens
KAFEESLSTL

SEQ ID NO: 14266 - protein, 10 aa, Homo Sapiens
KAFEKELSHA

SEQ ID NO: 14267 - protein, 10 aa, Homo Sapiens
KAFNIRLEEL

SEQ ID NO: 14268 - protein, 10 aa, Homo Sapiens
KAFQEGIAKA

SEQ ID NO: 14269 - protein, 10 aa, Homo Sapiens
KAFSSDLISI

SEQ ID NO: 14270 - protein, 10 aa, Homo Sapiens
KAIEELLKEA

SEQ ID NO: 14271 - protein, 10 aa, Homo Sapiens
KAIRDGVIEA

SEQ ID NO: 14272 - protein, 10 aa, Homo Sapiens
KAYNHHIQEL

SEQ ID NO: 14273 - protein, 10 aa, Homo Sapiens
KAYQDRLAYL

SEQ ID NO: 14274 - protein, 10 aa, Homo Sapiens
KAYQELLATV

SEQ ID NO: 14275 - protein, 10 aa, Homo Sapiens
KAYTDELVEL

SEQ ID NO: 14276 - protein, 10 aa, Homo Sapiens
KAYYHLLEQV

SEQ ID NO: 14277 - protein, 10 aa, Homo Sapiens
KIADFGFSNL

SEQ ID NO: 14278 - protein, 10 aa, Homo Sapiens
KIADFGLAKL

SEQ ID NO: 14279 - protein, 10 aa, Homo Sapiens
KIADFGLARI

SEQ ID NO: 14280 - protein, 10 aa, Homo Sapiens
KIADFGLARV

SEQ ID NO: 14281 - protein, 10 aa, Homo Sapiens
KIFDEILVNA

SEQ ID NO: 14282 - protein, 10 aa, Homo Sapiens
KIFHPNIDEA

SEQ ID NO: 14283 - protein, 10 aa, Homo Sapiens
KIFIDKIYSI

SEQ ID NO: 14284 - protein, 10 aa, Homo Sapiens
KIFLPVLLAA

SEQ ID NO: 14285 - protein, 10 aa, Homo Sapiens
KIFQEALVQI

SEQ ID NO: 14286 - protein, 10 aa, Homo Sapiens
KIFSGVFVKV

SEQ ID NO: 14287 - protein, 10 aa, Homo Sapiens
KIFTDIFHYL

SEQ ID NO: 14288 - protein, 10 aa, Homo Sapiens
KIFTEDLPEV

SEQ ID NO: 14289 - protein, 10 aa, Homo Sapiens
KIFVGNVSAA

SEQ ID NO: 14290 - protein, 10 aa, Homo Sapiens
KIGDFGLATV

SEQ ID NO: 14291 - protein, 10 aa, Homo Sapiens
KIIDETMAQL

SEQ ID NO: 14292 - protein, 10 aa, Homo Sapiens
KIIDRAITSL

SEQ ID NO: 14293 - protein, 10 aa, Homo Sapiens
KIIEENITSA

SEQ ID NO: 14294 - protein, 10 aa, Homo Sapiens
KIIETDFEKA

SEQ ID NO: 14295 - protein, 10 aa, Homo Sapiens
KIIYIVHDEV

SEQ ID NO: 14296 - protein, 10 aa, Homo Sapiens
KIKDYLEELW

SEQ ID NO: 14297 - protein, 10 aa, Homo Sapiens
KIPDEINDRV

SEQ ID NO: 14298 - protein, 10 aa, Homo Sapiens
KIPELDMTEV

SEQ ID NO: 14299 - protein, 10 aa, Homo Sapiens
KIPKKGFVEV

SEQ ID NO: 14300 - protein, 10 aa, Homo Sapiens
KIPNFDVREI

SEQ ID NO: 14301 - protein, 10 aa, Homo Sapiens
KISDFGLATV

SEQ ID NO: 14302 - protein, 10 aa, Homo Sapiens
KIYDEETAEL

SEQ ID NO: 14303 - protein, 10 aa, Homo Sapiens
KIYEHHIKVL

SEQ ID NO: 14304 - protein, 10 aa, Homo Sapiens
KIYERTMAVL

SEQ ID NO: 14305 - protein, 10 aa, Homo Sapiens
KLADIQIEQL

SEQ ID NO: 14306 - protein, 10 aa, Homo Sapiens
KLFDDMMYEL

SEQ ID NO: 14307 - protein, 10 aa, Homo Sapiens
KLFEGENEHL

SEQ ID NO: 14308 - protein, 10 aa, Homo Sapiens
KLFKDDMEKL

SEQ ID NO: 14309 - protein, 10 aa, Homo Sapiens
KLFNEHIEAL

SEQ ID NO: 14310 - protein, 10 aa, Homo Sapiens
KLFNGTFLKA

SEQ ID NO: 14311 - protein, 10 aa, Homo Sapiens
KLFPHHIGEL

SEQ ID NO: 14312 - protein, 10 aa, Homo Sapiens
KLFPQETLFL

SEQ ID NO: 14313 - protein, 10 aa, Homo Sapiens
KLFQSKLIKA

SEQ ID NO: 14314 - protein, 10 aa, Homo Sapiens
KLFSEGLFSA

SEQ ID NO: 14315 - protein, 10 aa, Homo Sapiens
KLFTNDCIFL

SEQ ID NO: 14316 - protein, 10 aa, Homo Sapiens
KLFVGFLNRA

SEQ ID NO: 14317 - protein, 10 aa, Homo Sapiens
KLHDVELHQV

SEQ ID NO: 14318 - protein, 10 aa, Homo Sapiens
KLKPGDLVGV

SEQ ID NO: 14319 - protein, 10 aa, Homo Sapiens
KLPDFESRYV

SEQ ID NO: 14320 - protein, 10 aa, Homo Sapiens
KLPDFLTAKL

SEQ ID NO: 14321 - protein, 10 aa, Homo Sapiens
KLPEFYDETL

SEQ ID NO: 14322 - protein, 10 aa, Homo Sapiens
KLVEFDFLGA

SEQ ID NO: 14323 - protein, 10 aa, Homo Sapiens
KLYDIDVAKV

SEQ ID NO: 14324 - protein, 10 aa, Homo Sapiens
KLYEGKTKEV

SEQ ID NO: 14325 - protein, 10 aa, Homo Sapiens
KLYEKKLLKL

SEQ ID NO: 14326 - protein, 10 aa, Homo Sapiens
KLYQYYLDHL

SEQ ID NO: 14327 - protein, 10 aa, Homo Sapiens
KMFEVDMKIA

SEQ ID NO: 14328 - protein, 10 aa, Homo Sapiens
KMFNQDIEKL

SEQ ID NO: 14329 - protein, 10 aa, Homo Sapiens
KMYEEFLSKV

SEQ ID NO: 14330 - protein, 10 aa, Homo Sapiens
KQAEIVKRLN

SEQ ID NO: 14331 - protein, 10 aa, Homo Sapiens
KQFDDVLIYL

SEQ ID NO: 14332 - protein, 10 aa, Homo Sapiens
KQFEGSTSFV

SEQ ID NO: 14333 - protein, 10 aa, Homo Sapiens
KQFEPNDFYL

SEQ ID NO: 14334 - protein, 10 aa, Homo Sapiens
KQFPLIISSV

SEQ ID NO: 14335 - protein, 10 aa, Homo Sapiens
KQFSENIYEA

SEQ ID NO: 14336 - protein, 10 aa, Homo Sapiens
KQIESDRQNL

SEQ ID NO: 14337 - protein, 10 aa, Homo Sapiens
KQMEQISQFL

SEQ ID NO: 14338 - protein, 10 aa, Homo Sapiens
KQYGITGENV

SEQ ID NO: 14339 - protein, 10 aa, Homo Sapiens
KQYKGIIDCV

SEQ ID NO: 14340 - protein, 10 aa, Homo Sapiens
KQYPYNNLYL

SEQ ID NO: 14341 - protein, 10 aa, Homo Sapiens
KSFDAVLEAL

SEQ ID NO: 14342 - protein, 10 aa, Homo Sapiens
KTAPGKIEKV

SEQ ID NO: 14343 - protein, 10 aa, Homo Sapiens
KTFEDNLIEA

SEQ ID NO: 14344 - protein, 10 aa, Homo Sapiens
KTFEDYLHNV

SEQ ID NO: 14345 - protein, 10 aa, Homo Sapiens
KTFEEKLTPL

SEQ ID NO: 14346 - protein, 10 aa, Homo Sapiens
KTFPEIIDYL

SEQ ID NO: 14347 - protein, 10 aa, Homo Sapiens
KTFSEILNRV

SEQ ID NO: 14348 - protein, 10 aa, Homo Sapiens
KTFSYPLDLL

SEQ ID NO: 14349 - protein, 10 aa, Homo Sapiens
KTFTVPIVEV

SEQ ID NO: 14350 - protein, 10 aa, Homo Sapiens
KTIEDDLVSA

SEQ ID NO: 14351 - protein, 10 aa, Homo Sapiens
KTIEDTLMTV

SEQ ID NO: 14352 - protein, 10 aa, Homo Sapiens
KTMEDTLMTV

SEQ ID NO: 14353 - protein, 10 aa, Homo Sapiens
KTPDFESTGL

SEQ ID NO: 14354 - protein, 10 aa, Homo Sapiens
KTYEAALETI

SEQ ID NO: 14355 - protein, 10 aa, Homo Sapiens
KVFDFAGEEV

SEQ ID NO: 14356 - protein, 10 aa, Homo Sapiens
KVFDPVPVGV

SEQ ID NO: 14357 - protein, 10 aa, Homo Sapiens
KVFEEKTQHL

SEQ ID NO: 14358 - protein, 10 aa, Homo Sapiens
KVFEHDSVEL

SEQ ID NO: 14359 - protein, 10 aa, Homo Sapiens
KVFEHFLENL

SEQ ID NO: 14360 - protein, 10 aa, Homo Sapiens
KVFELDLVTL

SEQ ID NO: 14361 - protein, 10 aa, Homo Sapiens
KVFFDLMREI

SEQ ID NO: 14362 - protein, 10 aa, Homo Sapiens
KVFGDILDFA

SEQ ID NO: 14363 - protein, 10 aa, Homo Sapiens
KVFNGEGEQI

SEQ ID NO: 14364 - protein, 10 aa, Homo Sapiens
KVFQERINCL

SEQ ID NO: 14365 - protein, 10 aa, Homo Sapiens
KVFQGQLDCL

SEQ ID NO: 14366 - protein, 10 aa, Homo Sapiens
KVFQGTDEQL

SEQ ID NO: 14367 - protein, 10 aa, Homo Sapiens
KVFSDVMEDL

SEQ ID NO: 14368 - protein, 10 aa, Homo Sapiens
KVFSEKLDHL

SEQ ID NO: 14369 - protein, 10 aa, Homo Sapiens
KVFYTELLNL

SEQ ID NO: 14370 - protein, 10 aa, Homo Sapiens
KVGNFKFIYV

SEQ ID NO: 14371 - protein, 10 aa, Homo Sapiens
KVIQEIWPVL

SEQ ID NO: 14372 - protein, 10 aa, Homo Sapiens
KVLDSFCEGL

SEQ ID NO: 14373 - protein, 10 aa, Homo Sapiens
KVMDLSIVRL

SEQ ID NO: 14374 - protein, 10 aa, Homo Sapiens
KVPDFPSKRL

SEQ ID NO: 14375 - protein, 10 aa, Homo Sapiens
KVVDSLYNKA

SEQ ID NO: 14376 - protein, 10 aa, Homo Sapiens
KVVEDGILKL

SEQ ID NO: 14377 - protein, 10 aa, Homo Sapiens
KVYVDDIYVI

SEQ ID NO: 14378 - protein, 10 aa, Homo Sapiens
LAYSGKLEEL

SEQ ID NO: 14379 - protein, 10 aa, Homo Sapiens
LFLHAGIVLP

SEQ ID NO: 14380 - protein, 10 aa, Homo Sapiens
LGAGARIQAL

SEQ ID NO: 14381 - protein, 10 aa, Homo Sapiens
LIAEENALRG

SEQ ID NO: 14382 - protein, 10 aa, Homo Sapiens
LIFPKEFETA

SEQ ID NO: 14383 - protein, 10 aa, Homo Sapiens
LIFSHMLAEI

SEQ ID NO: 14384 - protein, 10 aa, Homo Sapiens
LIIQAGIKEV

SEQ ID NO: 14385 - protein, 10 aa, Homo Sapiens
LLAARVVEEL

SEQ ID NO: 14386 - protein, 10 aa, Homo Sapiens
LLFPSDVQTL

SEQ ID NO: 14387 - protein, 10 aa, Homo Sapiens
LLFSESLKQL

SEQ ID NO: 14388 - protein, 10 aa, Homo Sapiens
LLPDYYLVTV

SEQ ID NO: 14389 - protein, 10 aa, Homo Sapiens
LMPYFLLTQA

SEQ ID NO: 14390 - protein, 10 aa, Homo Sapiens
LQADLSSFKS

SEQ ID NO: 14391 - protein, 10 aa, Homo Sapiens
LQAEAFQARL

SEQ ID NO: 14392 - protein, 10 aa, Homo Sapiens
LQAGDILHRV

SEQ ID NO: 14393 - protein, 10 aa, Homo Sapiens
LQFDKAINAA

SEQ ID NO: 14394 - protein, 10 aa, Homo Sapiens
LQIEDFEARI

SEQ ID NO: 14395 - protein, 10 aa, Homo Sapiens
LTFEHEMEKA

SEQ ID NO: 14396 - protein, 10 aa, Homo Sapiens
LTFPEKVNKA

SEQ ID NO: 14397 - protein, 10 aa, Homo Sapiens
LTFRDPLALL

SEQ ID NO: 14398 - protein, 10 aa, Homo Sapiens
LTFVAPIYGA

SEQ ID NO: 14399 - protein, 10 aa, Homo Sapiens
LTGQRVLDAL

SEQ ID NO: 14400 - protein, 10 aa, Homo Sapiens
LTIEDGIFEV

SEQ ID NO: 14401 - protein, 10 aa, Homo Sapiens
LTNQEDLPEV

SEQ ID NO: 14402 - protein, 10 aa, Homo Sapiens
LVFDTAIAHL

SEQ ID NO: 14403 - protein, 10 aa, Homo Sapiens
LVFLEGLKSA

SEQ ID NO: 14404 - protein, 10 aa, Homo Sapiens
LVFPGQVAQL

SEQ ID NO: 14405 - protein, 10 aa, Homo Sapiens
LVFPHDSSAL

SEQ ID NO: 14406 - protein, 10 aa, Homo Sapiens
LVPETIHDEL

SEQ ID NO: 14407 - protein, 10 aa, Homo Sapiens
LVYDGKIYTL

SEQ ID NO: 14408 - protein, 10 aa, Homo Sapiens
LVYEGQLSQA

SEQ ID NO: 14409 - protein, 10 aa, Homo Sapiens
LVYHEDMTAT

SEQ ID NO: 14410 - protein, 10 aa, Homo Sapiens
LVYPNNDPVM

SEQ ID NO: 14411 - protein, 10 aa, Homo Sapiens
LVYQEPIPTA

SEQ ID NO: 14412 - protein, 10 aa, Homo Sapiens
MIFDHEFTKL

SEQ ID NO: 14413 - protein, 10 aa, Homo Sapiens
MIFVDNFVHA

SEQ ID NO: 14414 - protein, 10 aa, Homo Sapiens
MIYEQKIAEL

SEQ ID NO: 14415 - protein, 10 aa, Homo Sapiens
MVAPDKDYFL

SEQ ID NO: 14416 - protein, 10 aa, Homo Sapiens
MVLSSPLALA

SEQ ID NO: 14417 - protein, 10 aa, Homo Sapiens
MVVQDGIVKA

SEQ ID NO: 14418 - protein, 10 aa, Homo Sapiens
MVYDSPLCRL

SEQ ID NO: 14419 - protein, 10 aa, Homo Sapiens
NAFLLPIKTV

SEQ ID NO: 14420 - protein, 10 aa, Homo Sapiens
NAFNQDITAL

SEQ ID NO: 14421 - protein, 10 aa, Homo Sapiens
NIFGEELERL

SEQ ID NO: 14422 - protein, 10 aa, Homo Sapiens
NIFPSNLVSA

SEQ ID NO: 14423 - protein, 10 aa, Homo Sapiens
NIPPLTQTPV

SEQ ID NO: 14424 - protein, 10 aa, Homo Sapiens
NLFPAALVHL

SEQ ID NO: 14425 - protein, 10 aa, Homo Sapiens
NLFPSNLVVA

SEQ ID NO: 14426 - protein, 10 aa, Homo Sapiens
NQIESKAAYV

SEQ ID NO: 14427 - protein, 10 aa, Homo Sapiens
NQIKKIENLE

SEQ ID NO: 14428 - protein, 10 aa, Homo Sapiens
NVFDEAILAA

SEQ ID NO: 14429 - protein, 10 aa, Homo Sapiens
NVPEGLLATV

SEQ ID NO: 14430 - protein, 10 aa, Homo Sapiens
NVPGEIVESL

SEQ ID NO: 14431 - protein, 10 aa, Homo Sapiens
NVPKFGLAHL

SEQ ID NO: 14432 - protein, 10 aa, Homo Sapiens
NVYGFDMSCI

SEQ ID NO: 14433 - protein, 10 aa, Homo Sapiens
QAFSDVILAV

SEQ ID NO: 14434 - protein, 10 aa, Homo Sapiens
QAYQHDLERL

SEQ ID NO: 14435 - protein, 10 aa, Homo Sapiens
QEQNQEQPIR

SEQ ID NO: 14436 - protein, 10 aa, Homo Sapiens
QIFGSHLHKV

SEQ ID NO: 14437 - protein, 10 aa, Homo Sapiens
QIFLRDIEQV

SEQ ID NO: 14438 - protein, 10 aa, Homo Sapiens
QIFNGTFVKL

SEQ ID NO: 14439 - protein, 10 aa, Homo Sapiens
QLFGQDFSHA

SEQ ID NO: 14440 - protein, 10 aa, Homo Sapiens
QLFQDEVAKA

SEQ ID NO: 14441 - protein, 10 aa, Homo Sapiens
QLYKEQLAKL

SEQ ID NO: 14442 - protein, 10 aa, Homo Sapiens
QLYPENSEQL

SEQ ID NO: 14443 - protein, 10 aa, Homo Sapiens
QMYHYDMNTA

SEQ ID NO: 14444 - protein, 10 aa, Homo Sapiens
QSFDSSLHGA

SEQ ID NO: 14445 - protein, 10 aa, Homo Sapiens
QSFPEHMANV

SEQ ID NO: 14446 - protein, 10 aa, Homo Sapiens
QSFTLELERA

SEQ ID NO: 14447 - protein, 10 aa, Homo Sapiens
QTIERMGSGV

SEQ ID NO: 14448 - protein, 10 aa, Homo Sapiens
QTYGQQLQKA

SEQ ID NO: 14449 - protein, 10 aa, Homo Sapiens
QTYHAKLENA

SEQ ID NO: 14450 - protein, 10 aa, Homo Sapiens
QVADIDGQYA

SEQ ID NO: 14451 - protein, 10 aa, Homo Sapiens
QVADILFQTA

SEQ ID NO: 14452 - protein, 10 aa, Homo Sapiens
QVFDQELDAL

SEQ ID NO: 14453 - protein, 10 aa, Homo Sapiens
QVFEGHTHYV

SEQ ID NO: 14454 - protein, 10 aa, Homo Sapiens
QVFPGLLERV

SEQ ID NO: 14455 - protein, 10 aa, Homo Sapiens
RAFADALEVI

SEQ ID NO: 14456 - protein, 10 aa, Homo Sapiens
RAFGGKDIKV

SEQ ID NO: 14457 - protein, 10 aa, Homo Sapiens
RAFHPDLEFV

SEQ ID NO: 14458 - protein, 10 aa, Homo Sapiens
RAFSDPFVEA

SEQ ID NO: 14459 - protein, 10 aa, Homo Sapiens
RAVDGKIAEA

SEQ ID NO: 14460 - protein, 10 aa, Homo Sapiens
RAYDASLAML

SEQ ID NO: 14461 - protein, 10 aa, Homo Sapiens
RAYGRDIVEA

SEQ ID NO: 14462 - protein, 10 aa, Homo Sapiens
RFFDGELTKV

SEQ ID NO: 14463 - protein, 10 aa, Homo Sapiens
RIFPNQTEEL

SEQ ID NO: 14464 - protein, 10 aa, Homo Sapiens
RIFQEQVEKL

SEQ ID NO: 14465 - protein, 10 aa, Homo Sapiens
RIFYPEIEEV

SEQ ID NO: 14466 - protein, 10 aa, Homo Sapiens
RIIDSLFNTV

SEQ ID NO: 14467 - protein, 10 aa, Homo Sapiens
RIIEENIPEL

SEQ ID NO: 14468 - protein, 10 aa, Homo Sapiens
RIPDIVLWPT

SEQ ID NO: 14469 - protein, 10 aa, Homo Sapiens
RIPNFKGSYL

SEQ ID NO: 14470 - protein, 10 aa, Homo Sapiens
RIYPHGLVLL

SEQ ID NO: 14471 - protein, 10 aa, Homo Sapiens
RLFADILNDV

SEQ ID NO: 14472 - protein, 10 aa, Homo Sapiens
RLFHKDLTSL

SEQ ID NO: 14473 - protein, 10 aa, Homo Sapiens
RLFNEHLVSA

SEQ ID NO: 14474 - protein, 10 aa, Homo Sapiens
RLFQQKLDEL

SEQ ID NO: 14475 - protein, 10 aa, Homo Sapiens
RLFSKSIETL

SEQ ID NO: 14476 - protein, 10 aa, Homo Sapiens
RLFTEKILRA

SEQ ID NO: 14477 - protein, 10 aa, Homo Sapiens
RLIDDMVAQA

SEQ ID NO: 14478 - protein, 10 aa, Homo Sapiens
RLIDDMVAQV

SEQ ID NO: 14479 - protein, 10 aa, Homo Sapiens
RLPEHCIEYV

SEQ ID NO: 14480 - protein, 10 aa, Homo Sapiens
RLYDGLFKVI

SEQ ID NO: 14481 - protein, 10 aa, Homo Sapiens
RLYDTHITVL

SEQ ID NO: 14482 - protein, 10 aa, Homo Sapiens
RLYEFDLIDG

SEQ ID NO: 14483 - protein, 10 aa, Homo Sapiens
RLYPAFMEGI

SEQ ID NO: 14484 - protein, 10 aa, Homo Sapiens
RLYPEGLAQL

SEQ ID NO: 14485 - protein, 10 aa, Homo Sapiens
RLYPWGVVEV

SEQ ID NO: 14486 - protein, 10 aa, Homo Sapiens
RMFADDLHNL

SEQ ID NO: 14487 - protein, 10 aa, Homo Sapiens
RMFDGKFVVA

SEQ ID NO: 14488 - protein, 10 aa, Homo Sapiens
RMFDKNLQDL

SEQ ID NO: 14489 - protein, 10 aa, Homo Sapiens
RMISEELVAA

SEQ ID NO: 14490 - protein, 10 aa, Homo Sapiens
RMYPFQIHSI

SEQ ID NO: 14491 - protein, 10 aa, Homo Sapiens
RQFQADLQTA

SEQ ID NO: 14492 - protein, 10 aa, Homo Sapiens
RQFSGARNQL

SEQ ID NO: 14493 - protein, 10 aa, Homo Sapiens
RQIEALDPPM

SEQ ID NO: 14494 - protein, 10 aa, Homo Sapiens
RQTEIYQYVL

SEQ ID NO: 14495 - protein, 10 aa, Homo Sapiens
RQYPWGTVQV

SEQ ID NO: 14496 - protein, 10 aa, Homo Sapiens
RQYPWGVAEV

SEQ ID NO: 14497 - protein, 10 aa, Homo Sapiens
RQYPWGVVQV

SEQ ID NO: 14498 - protein, 10 aa, Homo Sapiens
RSFTTTIHKV

SEQ ID NO: 14499 - protein, 10 aa, Homo Sapiens
RSYDDQLAQI

SEQ ID NO: 14500 - protein, 10 aa, Homo Sapiens
RSYDFEFMQV

SEQ ID NO: 14501 - protein, 10 aa, Homo Sapiens
RTFDRALRAL

SEQ ID NO: 14502 - protein, 10 aa, Homo Sapiens
RTFLGKLNEA

SEQ ID NO: 14503 - protein, 10 aa, Homo Sapiens
RTIDIGVVTA

SEQ ID NO: 14504 - protein, 10 aa, Homo Sapiens
RTITVGVYEA

SEQ ID NO: 14505 - protein, 10 aa, Homo Sapiens
RTVGTPIASV

SEQ ID NO: 14506 - protein, 10 aa, Homo Sapiens
RVAEHHVATL

SEQ ID NO: 14507 - protein, 10 aa, Homo Sapiens
RVFDREIAQM

SEQ ID NO: 14508 - protein, 10 aa, Homo Sapiens
RVFDWIEANL

SEQ ID NO: 14509 - protein, 10 aa, Homo Sapiens
RVFENIVAVL

SEQ ID NO: 14510 - protein, 10 aa, Homo Sapiens
RVFEVSLADL

SEQ ID NO: 14511 - protein, 10 aa, Homo Sapiens
RVFHPAFTKA

SEQ ID NO: 14512 - protein, 10 aa, Homo Sapiens
RVFHYVLDNL

SEQ ID NO: 14513 - protein, 10 aa, Homo Sapiens
RVFIGNLNTA

SEQ ID NO: 14514 - protein, 10 aa, Homo Sapiens
RVFIGNLNTL

SEQ ID NO: 14515 - protein, 10 aa, Homo Sapiens
RVFNFDSVEL

SEQ ID NO: 14516 - protein, 10 aa, Homo Sapiens
RVFNFDVRQL

SEQ ID NO: 14517 - protein, 10 aa, Homo Sapiens
RVFQEFIKMT

SEQ ID NO: 14518 - protein, 10 aa, Homo Sapiens
RVFTGIVTSL

SEQ ID NO: 14519 - protein, 10 aa, Homo Sapiens
RVIEGDVVSA

SEQ ID NO: 14520 - protein, 10 aa, Homo Sapiens
RVIGSVGKKV

SEQ ID NO: 14521 - protein, 10 aa, Homo Sapiens
RVPDFILEKI

SEQ ID NO: 14522 - protein, 10 aa, Homo Sapiens
RVVTHELIHA

SEQ ID NO: 14523 - protein, 10 aa, Homo Sapiens
RVYEIDITDA

SEQ ID NO: 14524 - protein, 10 aa, Homo Sapiens
RVYGGLTTKV

SEQ ID NO: 14525 - protein, 10 aa, Homo Sapiens
SAAGFPLSGA

SEQ ID NO: 14526 - protein, 10 aa, Homo Sapiens
SAFEDEIVSL

SEQ ID NO: 14527 - protein, 10 aa, Homo Sapiens
SDVSLTACKV

SEQ ID NO: 14528 - protein, 10 aa, Homo Sapiens
SIFDAVLKGV

SEQ ID NO: 14529 - protein, 10 aa, Homo Sapiens
SIFEGGATEL

SEQ ID NO: 14530 - protein, 10 aa, Homo Sapiens
SIPDFPMHLA

SEQ ID NO: 14531 - protein, 10 aa, Homo Sapiens
SIPDIEQPNV

SEQ ID NO: 14532 - protein, 10 aa, Homo Sapiens
SIYNGDMEKI

SEQ ID NO: 14533 - protein, 10 aa, Homo Sapiens
SIYPLHDVFV

SEQ ID NO: 14534 - protein, 10 aa, Homo Sapiens
SLFAGGMLRV

SEQ ID NO: 14535 - protein, 10 aa, Homo Sapiens
SLFEKGLKNV

SEQ ID NO: 14536 - protein, 10 aa, Homo Sapiens
SLFPGKLEVV

SEQ ID NO: 14537 - protein, 10 aa, Homo Sapiens
SLFPPGLHAI

SEQ ID NO: 14538 - protein, 10 aa, Homo Sapiens
SLFSHSLISI

SEQ ID NO: 14539 - protein, 10 aa, Homo Sapiens
SLFYRDIISI

SEQ ID NO: 14540 - protein, 10 aa, Homo Sapiens
SLINVGLISV

SEQ ID NO: 14541 - protein, 10 aa, Homo Sapiens
SLPDFGISYV

SEQ ID NO: 14542 - protein, 10 aa, Homo Sapiens
SMYGVDLHHA

SEQ ID NO: 14543 - protein, 10 aa, Homo Sapiens
SMYGVDLHKA

SEQ ID NO: 14544 - protein, 10 aa, Homo Sapiens
SQFDEELYKV

SEQ ID NO: 14545 - protein, 10 aa, Homo Sapiens
SQSDMFDQRL

SEQ ID NO: 14546 - protein, 10 aa, Homo Sapiens
SQYPFHVPLL

SEQ ID NO: 14547 - protein, 10 aa, Homo Sapiens
SSFSIEMEKV

SEQ ID NO: 14548 - protein, 10 aa, Homo Sapiens
STFPGAEHCL

SEQ ID NO: 14549 - protein, 10 aa, Homo Sapiens
STFSAPLNKA

SEQ ID NO: 14550 - protein, 10 aa, Homo Sapiens
STYDETLHVA

SEQ ID NO: 14551 - protein, 10 aa, Homo Sapiens
STYEEELAKA

SEQ ID NO: 14552 - protein, 10 aa, Homo Sapiens
SVAEITNACF

SEQ ID NO: 14553 - protein, 10 aa, Homo Sapiens
SVAHWSLDVA

SEQ ID NO: 14554 - protein, 10 aa, Homo Sapiens
SVAKNGVIRA

SEQ ID NO: 14555 - protein, 10 aa, Homo Sapiens
SVFDYSINSV

SEQ ID NO: 14556 - protein, 10 aa, Homo Sapiens
SVFERALSSV

SEQ ID NO: 14557 - protein, 10 aa, Homo Sapiens
SVFGGKNIHV

SEQ ID NO: 14558 - protein, 10 aa, Homo Sapiens
SVFNHAIRHT

SEQ ID NO: 14559 - protein, 10 aa, Homo Sapiens
SVFNIKLVQA

SEQ ID NO: 14560 - protein, 10 aa, Homo Sapiens
SVFVDSLTKA

SEQ ID NO: 14561 - protein, 10 aa, Homo Sapiens
SVIDIINGEA

SEQ ID NO: 14562 - protein, 10 aa, Homo Sapiens
SVIEEMGKEI

SEQ ID NO: 14563 - protein, 10 aa, Homo Sapiens
SVIEENIKCI

SEQ ID NO: 14564 - protein, 10 aa, Homo Sapiens
SVIKVKIHEA

SEQ ID NO: 14565 - protein, 10 aa, Homo Sapiens
SVYKNVILQV

SEQ ID NO: 14566 - protein, 10 aa, Homo Sapiens
TAFDEAIAEL

SEQ ID NO: 14567 - protein, 10 aa, Homo Sapiens
TAFQEALDAA

SEQ ID NO: 14568 - protein, 10 aa, Homo Sapiens
TEDHEEAGPL

SEQ ID NO: 14569 - protein, 10 aa, Homo Sapiens
TIANIPAAAV

SEQ ID NO: 14570 - protein, 10 aa, Homo Sapiens
TIFTGHTAVV

SEQ ID NO: 14571 - protein, 10 aa, Homo Sapiens
TIMPKDIQLA

SEQ ID NO: 14572 - protein, 10 aa, Homo Sapiens
TIPDFIFANV

SEQ ID NO: 14573 - protein, 10 aa, Homo Sapiens
TIPERGTIGV

SEQ ID NO: 14574 - protein, 10 aa, Homo Sapiens
TIPSFLLTRA

SEQ ID NO: 14575 - protein, 10 aa, Homo Sapiens
TISSNVASKA

SEQ ID NO: 14576 - protein, 10 aa, Homo Sapiens
TLAEIAKVEL

SEQ ID NO: 14577 - protein, 10 aa, Homo Sapiens
TLFPGKVHSL

SEQ ID NO: 14578 - protein, 10 aa, Homo Sapiens
TLFPVRLLVA

SEQ ID NO: 14579 - protein, 10 aa, Homo Sapiens
TLFQHQIIHA

SEQ ID NO: 14580 - protein, 10 aa, Homo Sapiens
TLYKEILTRA

SEQ ID NO: 14581 - protein, 10 aa, Homo Sapiens
TLYPLHILFV

SEQ ID NO: 14582 - protein, 10 aa, Homo Sapiens
TQFEGMNHRV

SEQ ID NO: 14583 - protein, 10 aa, Homo Sapiens
TQLGPPYHIL

SEQ ID NO: 14584 - protein, 10 aa, Homo Sapiens
TSFNYAMKEA

SEQ ID NO: 14585 - protein, 10 aa, Homo Sapiens
TTFEHDIQAL

SEQ ID NO: 14586 - protein, 10 aa, Homo Sapiens
TTFGEHLNAV

SEQ ID NO: 14587 - protein, 10 aa, Homo Sapiens
TTFQDELIRA

SEQ ID NO: 14588 - protein, 10 aa, Homo Sapiens
TTFQSHLNKA

SEQ ID NO: 14589 - protein, 10 aa, Homo Sapiens
TTFTWNINHA

SEQ ID NO: 14590 - protein, 10 aa, Homo Sapiens
TTVGKGVTTV

SEQ ID NO: 14591 - protein, 10 aa, Homo Sapiens
TTYEGIFKTL

SEQ ID NO: 14592 - protein, 10 aa, Homo Sapiens
TVADFFIKAV

SEQ ID NO: 14593 - protein, 10 aa, Homo Sapiens
TVFDEAIRAV

SEQ ID NO: 14594 - protein, 10 aa, Homo Sapiens
TVFGTALNYV

SEQ ID NO: 14595 - protein, 10 aa, Homo Sapiens
TVFKYKLIGI

SEQ ID NO: 14596 - protein, 10 aa, Homo Sapiens
TVFSKSFEQV

SEQ ID NO: 14597 - protein, 10 aa, Homo Sapiens
TVFTDHMLTV

SEQ ID NO: 14598 - protein, 10 aa, Homo Sapiens
TVIENIHTII

SEQ ID NO: 14599 - protein, 10 aa, Homo Sapiens
TVIGGGLMGA

SEQ ID NO: 14600 - protein, 10 aa, Homo Sapiens
TVMDSKIVQV

SEQ ID NO: 14601 - protein, 10 aa, Homo Sapiens
TVMPEDLVEA

SEQ ID NO: 14602 - protein, 10 aa, Homo Sapiens
TVYGGYLCSV

SEQ ID NO: 14603 - protein, 10 aa, Homo Sapiens
TVYPGLMITA

SEQ ID NO: 14604 - protein, 10 aa, Homo Sapiens
VIFEENVEHA

SEQ ID NO: 14605 - protein, 10 aa, Homo Sapiens
VIFPEFLKEL

SEQ ID NO: 14606 - protein, 10 aa, Homo Sapiens
VIFTSPIKAL

SEQ ID NO: 14607 - protein, 10 aa, Homo Sapiens
VILEGELERA

SEQ ID NO: 14608 - protein, 10 aa, Homo Sapiens
VIPDIPDHFL

SEQ ID NO: 14609 - protein, 10 aa, Homo Sapiens
VIYDGKECRA

SEQ ID NO: 14610 - protein, 10 aa, Homo Sapiens
VLFDDELLMV

SEQ ID NO: 14611 - protein, 10 aa, Homo Sapiens
VLFDKVCEHL

SEQ ID NO: 14612 - protein, 10 aa, Homo Sapiens
VLFEGRTVQL

SEQ ID NO: 14613 - protein, 10 aa, Homo Sapiens
VLFEKEVNEV

SEQ ID NO: 14614 - protein, 10 aa, Homo Sapiens
VLFKAQLEKA

SEQ ID NO: 14615 - protein, 10 aa, Homo Sapiens
VLFQEALWHV

SEQ ID NO: 14616 - protein, 10 aa, Homo Sapiens
VLFTGLHVYL

SEQ ID NO: 14617 - protein, 10 aa, Homo Sapiens
VLIGEFLEKV

SEQ ID NO: 14618 - protein, 10 aa, Homo Sapiens
VLPNFLPYNV

SEQ ID NO: 14619 - protein, 10 aa, Homo Sapiens
VLSAADKGNV

SEQ ID NO: 14620 - protein, 10 aa, Homo Sapiens
VLYGPKIDRA

SEQ ID NO: 14621 - protein, 10 aa, Homo Sapiens
VLYSLQICKA

SEQ ID NO: 14622 - protein, 10 aa, Homo Sapiens
VLYTGDFRLA

SEQ ID NO: 14623 - protein, 10 aa, Homo Sapiens
VMFGGKQVVV

SEQ ID NO: 14624 - protein, 10 aa, Homo Sapiens
VQFGHAGACA

SEQ ID NO: 14625 - protein, 10 aa, Homo Sapiens
VSFYEHIITV

SEQ ID NO: 14626 - protein, 10 aa, Homo Sapiens
VSKAQQLAEV

SEQ ID NO: 14627 - protein, 10 aa, Homo Sapiens
VTFPRELASL

SEQ ID NO: 14628 - protein, 10 aa, Homo Sapiens
VTPKFFLEEA

SEQ ID NO: 14629 - protein, 10 aa, Homo Sapiens
VTWHGRGDYL

SEQ ID NO: 14630 - protein, 10 aa, Homo Sapiens
VVAAAAAEAK

SEQ ID NO: 14631 - protein, 10 aa, Homo Sapiens
VVAAGGVEKA

SEQ ID NO: 14632 - protein, 10 aa, Homo Sapiens
VVADFGLARL

SEQ ID NO: 14633 - protein, 10 aa, Homo Sapiens
VVAPDNLKQV

SEQ ID NO: 14634 - protein, 10 aa, Homo Sapiens
VVFDCKFIET

SEQ ID NO: 14635 - protein, 10 aa, Homo Sapiens
VVFGGGEARL

SEQ ID NO: 14636 - protein, 10 aa, Homo Sapiens
VVFGPELVSL

SEQ ID NO: 14637 - protein, 10 aa, Homo Sapiens
VVFTDEMAHF

SEQ ID NO: 14638 - protein, 10 aa, Homo Sapiens
VVPPFLQPEV

SEQ ID NO: 14639 - protein, 10 aa, Homo Sapiens
VVYENVSHFL

SEQ ID NO: 14640 - protein, 10 aa, Homo Sapiens
VVYGGGAAEI

SEQ ID NO: 14641 - protein, 10 aa, Homo Sapiens
VVYLQKLDTA

SEQ ID NO: 14642 - protein, 10 aa, Homo Sapiens
YAAPGGLIGV

SEQ ID NO: 14643 - protein, 10 aa, Homo Sapiens
YAAPYKSDFL

SEQ ID NO: 14644 - protein, 10 aa, Homo Sapiens
YAFDLKCDSV

SEQ ID NO: 14645 - protein, 10 aa, Homo Sapiens
YAVDRAITHL

SEQ ID NO: 14646 - protein, 10 aa, Homo Sapiens
YAYDGKDYIA

SEQ ID NO: 14647 - protein, 10 aa, Homo Sapiens
YGYDNVKEYL

SEQ ID NO: 14648 - protein, 10 aa, Homo Sapiens
YIFEGLGHLI

SEQ ID NO: 14649 - protein, 10 aa, Homo Sapiens
YIFPAGGDGL

SEQ ID NO: 14650 - protein, 10 aa, Homo Sapiens
YIIEQGVCYL

SEQ ID NO: 14651 - protein, 10 aa, Homo Sapiens
YIPDEADFLL

SEQ ID NO: 14652 - protein, 10 aa, Homo Sapiens
YIPDGHTKEM

SEQ ID NO: 14653 - protein, 10 aa, Homo Sapiens
YIPDLYNHFL

SEQ ID NO: 14654 - protein, 10 aa, Homo Sapiens
YIPEITSVLL

SEQ ID NO: 14655 - protein, 10 aa, Homo Sapiens
YIPFYGILGA

SEQ ID NO: 14656 - protein, 10 aa, Homo Sapiens
YIPGRQIIEV

SEQ ID NO: 14657 - protein, 10 aa, Homo Sapiens
YIPPMAQPGL

SEQ ID NO: 14658 - protein, 10 aa, Homo Sapiens
YIYDKDMEII

SEQ ID NO: 14659 - protein, 10 aa, Homo Sapiens
YIYNEKIVNG

SEQ ID NO: 14660 - protein, 10 aa, Homo Sapiens
YLFDEIDQAL

SEQ ID NO: 14661 - protein, 10 aa, Homo Sapiens
YLFDRNGVCL

SEQ ID NO: 14662 - protein, 10 aa, Homo Sapiens
YLITGNLEKL

SEQ ID NO: 14663 - protein, 10 aa, Homo Sapiens
YLPENKPCYL

SEQ ID NO: 14664 - protein, 10 aa, Homo Sapiens
YLSDIPLHDA

SEQ ID NO: 14665 - protein, 10 aa, Homo Sapiens
YMFPDTMLQA

SEQ ID NO: 14666 - protein, 10 aa, Homo Sapiens
YQAPDIDVQL

SEQ ID NO: 14667 - protein, 10 aa, Homo Sapiens
YQFIHAADML

SEQ ID NO: 14668 - protein, 10 aa, Homo Sapiens
YQIDAAIVRI

SEQ ID NO: 14669 - protein, 10 aa, Homo Sapiens
YQILDGIHYL

SEQ ID NO: 14670 - protein, 10 aa, Homo Sapiens
YQNEDEKVTL

SEQ ID NO: 14671 - protein, 10 aa, Homo Sapiens
YQPDWRFMES

SEQ ID NO: 14672 - protein, 10 aa, Homo Sapiens
YQQQGRLDKL

SEQ ID NO: 14673 - protein, 10 aa, Homo Sapiens
YQWDDPDPRL

SEQ ID NO: 14674 - protein, 10 aa, Homo Sapiens
YQYMHETITV

SEQ ID NO: 14675 - protein, 10 aa, Homo Sapiens
YSFSRKITEA

SEQ ID NO: 14676 - protein, 10 aa, Homo Sapiens
YSFYLPIAAA

SEQ ID NO: 14677 - protein, 10 aa, Homo Sapiens
YSKYYKTIDD

SEQ ID NO: 14678 - protein, 10 aa, Homo Sapiens
YTFPGWKVGV

SEQ ID NO: 14679 - protein, 10 aa, Homo Sapiens
YTFSEPFHLI

SEQ ID NO: 14680 - protein, 10 aa, Homo Sapiens
YTPEHHLIQA

SEQ ID NO: 14681 - protein, 10 aa, Homo Sapiens
YTYDEAIHSV

SEQ ID NO: 14682 - protein, 10 aa, Homo Sapiens
YTYEEGLSHL

SEQ ID NO: 14683 - protein, 10 aa, Homo Sapiens
YTYEELLNRV

SEQ ID NO: 14684 - protein, 10 aa, Homo Sapiens
YTYEKLLWTT

SEQ ID NO: 14685 - protein, 10 aa, Homo Sapiens
YTYESKMAFL

SEQ ID NO: 14686 - protein, 10 aa, Homo Sapiens
YVAPAYGVYL

SEQ ID NO: 14687 - protein, 10 aa, Homo Sapiens
YVFDVESREL

SEQ ID NO: 14688 - protein, 10 aa, Homo Sapiens
YVFEGKMLEA

SEQ ID NO: 14689 - protein, 10 aa, Homo Sapiens
YVIAYIRDLA

SEQ ID NO: 14690 - protein, 10 aa, Homo Sapiens
YVISEGFLKA

SEQ ID NO: 14691 - protein, 10 aa, Homo Sapiens
YVPDFVLQGI

SEQ ID NO: 14692 - protein, 10 aa, Homo Sapiens
YVVDTGMVKA

SEQ ID NO: 14693 - protein, 10 aa, Homo Sapiens
YVYDKDIEQI

SEQ ID NO: 14694 - protein, 11 aa, Homo Sapiens
AAAAAAAAAAA

SEQ ID NO: 14695 - protein, 11 aa, Homo Sapiens
AAAAAAAAVAA

SEQ ID NO: 14696 - protein, 11 aa, Homo Sapiens
AAAAAAAVTAA

SEQ ID NO: 14697 - protein, 11 aa, Homo Sapiens
AAAAAAPAAPA

SEQ ID NO: 14698 - protein, 11 aa, Homo Sapiens
AAAAAPALAAA

SEQ ID NO: 14699 - protein, 11 aa, Homo Sapiens
AAAAPAAATAA

SEQ ID NO: 14700 - protein, 11 aa, Homo Sapiens
AGAPARAVSAV

SEQ ID NO: 14701 - protein, 11 aa, Homo Sapiens
AIAPCEVTVPA

SEQ ID NO: 14702 - protein, 11 aa, Homo Sapiens
AIFPTPDPAAL

SEQ ID NO: 14703 - protein, 11 aa, Homo Sapiens
AIIPYIPTLIT

SEQ ID NO: 14704 - protein, 11 aa, Homo Sapiens
ALADKELLPSV

SEQ ID NO: 14705 - protein, 11 aa, Homo Sapiens
ALFPHLLQPVL

SEQ ID NO: 14706 - protein, 11 aa, Homo Sapiens
ALIEAEKVAQV

SEQ ID NO: 14707 - protein, 11 aa, Homo Sapiens
APAAAAAAAAA

SEQ ID NO: 14708 - protein, 11 aa, Homo Sapiens
APSFSDIPNPI

SEQ ID NO: 14709 - protein, 11 aa, Homo Sapiens
AQAEVYKELRL

SEQ ID NO: 14710 - protein, 11 aa, Homo Sapiens
AQAPVTKGCYL

SEQ ID NO: 14711 - protein, 11 aa, Homo Sapiens
AQIDSNIAHTV

SEQ ID NO: 14712 - protein, 11 aa, Homo Sapiens
AQYDPAKPNYI

SEQ ID NO: 14713 - protein, 11 aa, Homo Sapiens
ASVSQNAIVSA

SEQ ID NO: 14714 - protein, 11 aa, Homo Sapiens
ATAAKQVAAKP

SEQ ID NO: 14715 - protein, 11 aa, Homo Sapiens
ATVPIRLIINA

SEQ ID NO: 14716 - protein, 11 aa, Homo Sapiens
AVAEEALVDHV

SEQ ID NO: 14717 - protein, 11 aa, Homo Sapiens
AVANEEGFVRL

SEQ ID NO: 14718 - protein, 11 aa, Homo Sapiens
AVARVGAVASA

SEQ ID NO: 14719 - protein, 11 aa, Homo Sapiens
AVCDASKVVTV

SEQ ID NO: 14720 - protein, 11 aa, Homo Sapiens
AVIEAEKIAQV

SEQ ID NO: 14721 - protein, 11 aa, Homo Sapiens
AVISSAGTHSV

SEQ ID NO: 14722 - protein, 11 aa, Homo Sapiens
AVIVPEGVHAL

SEQ ID NO: 14723 - protein, 11 aa, Homo Sapiens
AVPEGDWFCTV

SEQ ID NO: 14724 - protein, 11 aa, Homo Sapiens
AVPKEGKVVDA

SEQ ID NO: 14725 - protein, 11 aa, Homo Sapiens
AVPQPGAFQRA

SEQ ID NO: 14726 - protein, 11 aa, Homo Sapiens
AVPREELFVTS

SEQ ID NO: 14727 - protein, 11 aa, Homo Sapiens
AVPSAGSVQRV

SEQ ID NO: 14728 - protein, 11 aa, Homo Sapiens
AVVDEGDVVEV

SEQ ID NO: 14729 - protein, 11 aa, Homo Sapiens
AVVGSTCDVKV

SEQ ID NO: 14730 - protein, 11 aa, Homo Sapiens
AVVSPPALHNA

SEQ ID NO: 14731 - protein, 11 aa, Homo Sapiens
FAEDVGSNKGA

SEQ ID NO: 14732 - protein, 11 aa, Homo Sapiens
FAYDGKDYLTL

SEQ ID NO: 14733 - protein, 11 aa, Homo Sapiens
FAYDPSNYEYL

SEQ ID NO: 14734 - protein, 11 aa, Homo Sapiens
FGIDRDAIAQA

SEQ ID NO: 14735 - protein, 11 aa, Homo Sapiens
FICEQDHQNFL

SEQ ID NO: 14736 - protein, 11 aa, Homo Sapiens
FIFEKKLAQAL

SEQ ID NO: 14737 - protein, 11 aa, Homo Sapiens
FIIGPGGVVNL

SEQ ID NO: 14738 - protein, 11 aa, Homo Sapiens
FIIQGLRSVGA

SEQ ID NO: 14739 - protein, 11 aa, Homo Sapiens
FIPLPSAVVQA

SEQ ID NO: 14740 - protein, 11 aa, Homo Sapiens
FLADPSAFVAA

SEQ ID NO: 14741 - protein, 11 aa, Homo Sapiens
FLASESLIKQI

SEQ ID NO: 14742 - protein, 11 aa, Homo Sapiens
FLIEPEHVNTV

SEQ ID NO: 14743 - protein, 11 aa, Homo Sapiens
FLPDPSALQNL

SEQ ID NO: 14744 - protein, 11 aa, Homo Sapiens
FLPETRIMTSV

SEQ ID NO: 14745 - protein, 11 aa, Homo Sapiens
FLPPEHTIVYI

SEQ ID NO: 14746 - protein, 11 aa, Homo Sapiens
FLVGEAARALS

SEQ ID NO: 14747 - protein, 11 aa, Homo Sapiens
FLVPAEPCRKA

SEQ ID NO: 14748 - protein, 11 aa, Homo Sapiens
FLVPIESIERA

SEQ ID NO: 14749 - protein, 11 aa, Homo Sapiens
FQAHKEAIREA

SEQ ID NO: 14750 - protein, 11 aa, Homo Sapiens
FQAVHVQGEDL

SEQ ID NO: 14751 - protein, 11 aa, Homo Sapiens
FQKADGVPVYL

SEQ ID NO: 14752 - protein, 11 aa, Homo Sapiens
FQVEHFSQEEL

SEQ ID NO: 14753 - protein, 11 aa, Homo Sapiens
FQVENDQERFL

SEQ ID NO: 14754 - protein, 11 aa, Homo Sapiens
FQYASTDMDKV

SEQ ID NO: 14755 - protein, 11 aa, Homo Sapiens
FQYDDSGNTFF

SEQ ID NO: 14756 - protein, 11 aa, Homo Sapiens
FSVSPQAVYTA

SEQ ID NO: 14757 - protein, 11 aa, Homo Sapiens
FTCDEGHGIFV

SEQ ID NO: 14758 - protein, 11 aa, Homo Sapiens
FTYPKGAGEML

SEQ ID NO: 14759 - protein, 11 aa, Homo Sapiens
FVADEELVHLL

SEQ ID NO: 14760 - protein, 11 aa, Homo Sapiens
FVADILKGENL

SEQ ID NO: 14761 - protein, 11 aa, Homo Sapiens
FVAGVLPFKVA

SEQ ID NO: 14762 - protein, 11 aa, Homo Sapiens
FVPEPSSTMGL

SEQ ID NO: 14763 - protein, 11 aa, Homo Sapiens
FVPGSQVVVQA

SEQ ID NO: 14764 - protein, 11 aa, Homo Sapiens
FVTEGSHFVEA

SEQ ID NO: 14765 - protein, 11 aa, Homo Sapiens
FVVYENVSHFL

SEQ ID NO: 14766 - protein, 11 aa, Homo Sapiens
GAADKSAVVAA

SEQ ID NO: 14767 - protein, 11 aa, Homo Sapiens
GLADASLLKKV

SEQ ID NO: 14768 - protein, 11 aa, Homo Sapiens
GLVDEKALAQA

SEQ ID NO: 14769 - protein, 11 aa, Homo Sapiens
GQMDTKGLVRA

SEQ ID NO: 14770 - protein, 11 aa, Homo Sapiens
GQVEEKLLQKL

SEQ ID NO: 14771 - protein, 11 aa, Homo Sapiens
GTIDEIQKLHI

SEQ ID NO: 14772 - protein, 11 aa, Homo Sapiens
GVAPSRAIYFA

SEQ ID NO: 14773 - protein, 11 aa, Homo Sapiens
GVPSATEIIKA

SEQ ID NO: 14774 - protein, 11 aa, Homo Sapiens
GVVDPRAISVL

SEQ ID NO: 14775 - protein, 11 aa, Homo Sapiens
GVVNKPATFTV

SEQ ID NO: 14776 - protein, 11 aa, Homo Sapiens
GVYDGTEIHEA

SEQ ID NO: 14777 - protein, 11 aa, Homo Sapiens
GVYNGKTFNQV

SEQ ID NO: 14778 - protein, 11 aa, Homo Sapiens
HQIEAVDGEEL

SEQ ID NO: 14779 - protein, 11 aa, Homo Sapiens
HVIDLDDATFL

SEQ ID NO: 14780 - protein, 11 aa, Homo Sapiens
HVISADAIEAL

SEQ ID NO: 14781 - protein, 11 aa, Homo Sapiens
HVPSTDLILNV

SEQ ID NO: 14782 - protein, 11 aa, Homo Sapiens
HVYDGKFLARV

SEQ ID NO: 14783 - protein, 11 aa, Homo Sapiens
ILVGENLVCKV

SEQ ID NO: 14784 - protein, 11 aa, Homo Sapiens
IMPNGDHIVSA

SEQ ID NO: 14785 - protein, 11 aa, Homo Sapiens
IQAEHSESGQL

SEQ ID NO: 14786 - protein, 11 aa, Homo Sapiens
IQEEEDEKQRL

SEQ ID NO: 14787 - protein, 11 aa, Homo Sapiens
IQYIPTELDQV

SEQ ID NO: 14788 - protein, 11 aa, Homo Sapiens
ITQIEHEVSSS

SEQ ID NO: 14789 - protein, 11 aa, Homo Sapiens
IVADDRFTKSI

SEQ ID NO: 14790 - protein, 11 aa, Homo Sapiens
IVAECNAVRQA

SEQ ID NO: 14791 - protein, 11 aa, Homo Sapiens
IVAGQRCIKKL

SEQ ID NO: 14792 - protein, 11 aa, Homo Sapiens
IVISAAGIPNL

SEQ ID NO: 14793 - protein, 11 aa, Homo Sapiens
KAMTEDGFLAV

SEQ ID NO: 14794 - protein, 11 aa, Homo Sapiens
KAVDAEPVLKA

SEQ ID NO: 14795 - protein, 11 aa, Homo Sapiens
KAVPKSAVQQV

SEQ ID NO: 14796 - protein, 11 aa, Homo Sapiens
KAVWAKGIRNV

SEQ ID NO: 14797 - protein, 11 aa, Homo Sapiens
KIFDENELELL

SEQ ID NO: 14798 - protein, 11 aa, Homo Sapiens
KIIDEDGLLNL

SEQ ID NO: 14799 - protein, 11 aa, Homo Sapiens
KIIEKDAMIKV

SEQ ID NO: 14800 - protein, 11 aa, Homo Sapiens
KISDFGLATVF

SEQ ID NO: 14801 - protein, 11 aa, Homo Sapiens
KIYPEEITPLL

SEQ ID NO: 14802 - protein, 11 aa, Homo Sapiens
KKDVDNAYMIK

SEQ ID NO: 14803 - protein, 11 aa, Homo Sapiens
KLADFGLARAF

SEQ ID NO: 14804 - protein, 11 aa, Homo Sapiens
KLFPGFEIETV

SEQ ID NO: 14805 - protein, 11 aa, Homo Sapiens
KLFTAESLIGL

SEQ ID NO: 14806 - protein, 11 aa, Homo Sapiens
KLPKQPVIVKA

SEQ ID NO: 14807 - protein, 11 aa, Homo Sapiens
KLYQRDLEVAL

SEQ ID NO: 14808 - protein, 11 aa, Homo Sapiens
KMAEEKLTHKM

SEQ ID NO: 14809 - protein, 11 aa, Homo Sapiens
KQADLYISEGL

SEQ ID NO: 14810 - protein, 11 aa, Homo Sapiens
KQIESDRQNLL

SEQ ID NO: 14811 - protein, 11 aa, Homo Sapiens
KSADEVLFTGV

SEQ ID NO: 14812 - protein, 11 aa, Homo Sapiens
KTAAEDAIRNL

SEQ ID NO: 14813 - protein, 11 aa, Homo Sapiens
KTAEAQLAYEL

SEQ ID NO: 14814 - protein, 11 aa, Homo Sapiens
KTATELSTVYL

SEQ ID NO: 14815 - protein, 11 aa, Homo Sapiens
KTPIESLFIEA

SEQ ID NO: 14816 - protein, 11 aa, Homo Sapiens
KTYDTSFLDFL

SEQ ID NO: 14817 - protein, 11 aa, Homo Sapiens
KVFPSEITDTV

SEQ ID NO: 14818 - protein, 11 aa, Homo Sapiens
KVFSGALQEAL

SEQ ID NO: 14819 - protein, 11 aa, Homo Sapiens
KVIDIEGCAHI

SEQ ID NO: 14820 - protein, 11 aa, Homo Sapiens
KVIEDVAFACA

SEQ ID NO: 14821 - protein, 11 aa, Homo Sapiens
KVITDIAGVIP

SEQ ID NO: 14822 - protein, 11 aa, Homo Sapiens
KVVDAKTIFTG

SEQ ID NO: 14823 - protein, 11 aa, Homo Sapiens
KVVDEEAMEKV

SEQ ID NO: 14824 - protein, 11 aa, Homo Sapiens
KVVGFDAVMRV

SEQ ID NO: 14825 - protein, 11 aa, Homo Sapiens
KVVVVQAISAL

SEQ ID NO: 14826 - protein, 11 aa, Homo Sapiens
LIIDENGVHEL

SEQ ID NO: 14827 - protein, 11 aa, Homo Sapiens
LLFDHLEPIEL

SEQ ID NO: 14828 - protein, 11 aa, Homo Sapiens
LLSHSLLVTLA

SEQ ID NO: 14829 - protein, 11 aa, Homo Sapiens
LPAAAAAAAAA

SEQ ID NO: 14830 - protein, 11 aa, Homo Sapiens
LQIEDFEARIA

SEQ ID NO: 14831 - protein, 11 aa, Homo Sapiens
LQKKIEENERL

SEQ ID NO: 14832 - protein, 11 aa, Homo Sapiens
LQMEPDNVNAL

SEQ ID NO: 14833 - protein, 11 aa, Homo Sapiens
LSRSSALASKA

SEQ ID NO: 14834 - protein, 11 aa, Homo Sapiens
LTAPEDVFSKL

SEQ ID NO: 14835 - protein, 11 aa, Homo Sapiens
LTAPPEALLMV

SEQ ID NO: 14836 - protein, 11 aa, Homo Sapiens
LTFDGKRMRKA

SEQ ID NO: 14837 - protein, 11 aa, Homo Sapiens
LVYDQQREVYV

SEQ ID NO: 14838 - protein, 11 aa, Homo Sapiens
LVYPEELKPVL

SEQ ID NO: 14839 - protein, 11 aa, Homo Sapiens
MQAPRAALVFA

SEQ ID NO: 14840 - protein, 11 aa, Homo Sapiens
MVPEPKIIDAA

SEQ ID NO: 14841 - protein, 11 aa, Homo Sapiens
NAAPRIALHTA

SEQ ID NO: 14842 - protein, 11 aa, Homo Sapiens
NAVSEALIREV

SEQ ID NO: 14843 - protein, 11 aa, Homo Sapiens
NEEVVLNDVMI

SEQ ID NO: 14844 - protein, 11 aa, Homo Sapiens
NQIEDNDDFQL

SEQ ID NO: 14845 - protein, 11 aa, Homo Sapiens
NQIGDAGVQHL

SEQ ID NO: 14846 - protein, 11 aa, Homo Sapiens
NQIQAHSSDQL

SEQ ID NO: 14847 - protein, 11 aa, Homo Sapiens
NTAPDDLIRYA

SEQ ID NO: 14848 - protein, 11 aa, Homo Sapiens
NTISEQAVKAS

SEQ ID NO: 14849 - protein, 11 aa, Homo Sapiens
NVIQSTAVTTV

SEQ ID NO: 14850 - protein, 11 aa, Homo Sapiens
NVVFEKAIQRT

SEQ ID NO: 14851 - protein, 11 aa, Homo Sapiens
PAAAAAAAAAP

SEQ ID NO: 14852 - protein, 11 aa, Homo Sapiens
PAASAAAALAP

SEQ ID NO: 14853 - protein, 11 aa, Homo Sapiens
PGIGGAPTLNP

SEQ ID NO: 14854 - protein, 11 aa, Homo Sapiens
QQIPASDTQQL

SEQ ID NO: 14855 - protein, 11 aa, Homo Sapiens
QQIRKLIKDGL

SEQ ID NO: 14856 - protein, 11 aa, Homo Sapiens
QTAPEEAFIKL

SEQ ID NO: 14857 - protein, 11 aa, Homo Sapiens
QVFDAKNMMAA

SEQ ID NO: 14858 - protein, 11 aa, Homo Sapiens
QVISQAAVVHA

SEQ ID NO: 14859 - protein, 11 aa, Homo Sapiens
QVPEEQVLNAA

SEQ ID NO: 14860 - protein, 11 aa, Homo Sapiens
QVPQANTIVQA

SEQ ID NO: 14861 - protein, 11 aa, Homo Sapiens
QVSDPESTVAV

SEQ ID NO: 14862 - protein, 11 aa, Homo Sapiens
RAAMEALVVEV

SEQ ID NO: 14863 - protein, 11 aa, Homo Sapiens
RIFGESIMIGV

SEQ ID NO: 14864 - protein, 11 aa, Homo Sapiens
RIIDEEGVESI

SEQ ID NO: 14865 - protein, 11 aa, Homo Sapiens
RIIDKNGIHDL

SEQ ID NO: 14866 - protein, 11 aa, Homo Sapiens
RLFDDSTVTTV

SEQ ID NO: 14867 - protein, 11 aa, Homo Sapiens
RLFDRGDFYTA

SEQ ID NO: 14868 - protein, 11 aa, Homo Sapiens
RLFTSEKMVKA

SEQ ID NO: 14869 - protein, 11 aa, Homo Sapiens
RLIGDAAKNQV

SEQ ID NO: 14870 - protein, 11 aa, Homo Sapiens
RLPGSGAVQAA

SEQ ID NO: 14871 - protein, 11 aa, Homo Sapiens
RLPPDTLLQQV

SEQ ID NO: 14872 - protein, 11 aa, Homo Sapiens
RLPPEGILHNV

SEQ ID NO: 14873 - protein, 11 aa, Homo Sapiens
RQPEPTKFDYL

SEQ ID NO: 14874 - protein, 11 aa, Homo Sapiens
RSVTKQAIREA

SEQ ID NO: 14875 - protein, 11 aa, Homo Sapiens
RTFDETVSTYV

SEQ ID NO: 14876 - protein, 11 aa, Homo Sapiens
RTFPEVMIPVF

SEQ ID NO: 14877 - protein, 11 aa, Homo Sapiens
RTPPPELLQTL

SEQ ID NO: 14878 - protein, 11 aa, Homo Sapiens
RTPSSASTVSV

SEQ ID NO: 14879 - protein, 11 aa, Homo Sapiens
RTVEENILKKA

SEQ ID NO: 14880 - protein, 11 aa, Homo Sapiens
RTVETEAVQML

SEQ ID NO: 14881 - protein, 11 aa, Homo Sapiens
RVAAQGFVVGA

SEQ ID NO: 14882 - protein, 11 aa, Homo Sapiens
RVAEELALEQA

SEQ ID NO: 14883 - protein, 11 aa, Homo Sapiens
RVFGSQNLTTV

SEQ ID NO: 14884 - protein, 11 aa, Homo Sapiens
RVFIGNLNTAI

SEQ ID NO: 14885 - protein, 11 aa, Homo Sapiens
RVFNRPRIETL

SEQ ID NO: 14886 - protein, 11 aa, Homo Sapiens
RVFPEKGYSFV

SEQ ID NO: 14887 - protein, 11 aa, Homo Sapiens
RVFSDIIYTVA

SEQ ID NO: 14888 - protein, 11 aa, Homo Sapiens
RVFTEANLVSV

SEQ ID NO: 14889 - protein, 11 aa, Homo Sapiens
RVFTTQELVQA

SEQ ID NO: 14890 - protein, 11 aa, Homo Sapiens
RVGPIEATSFI

SEQ ID NO: 14891 - protein, 11 aa, Homo Sapiens
RVIDDSLVVGV

SEQ ID NO: 14892 - protein, 11 aa, Homo Sapiens
RVIDREGVYEI

SEQ ID NO: 14893 - protein, 11 aa, Homo Sapiens
RVIEEAKTAFL

SEQ ID NO: 14894 - protein, 11 aa, Homo Sapiens
RVIEGDVVSAL

SEQ ID NO: 14895 - protein, 11 aa, Homo Sapiens
RVINKEHVLAA

SEQ ID NO: 14896 - protein, 11 aa, Homo Sapiens
RVPAHAVVVRA

SEQ ID NO: 14897 - protein, 11 aa, Homo Sapiens
RVQEPGAVLLA

SEQ ID NO: 14898 - protein, 11 aa, Homo Sapiens
SAAPGSAAPAA

SEQ ID NO: 14899 - protein, 11 aa, Homo Sapiens
SIIEQLDPVSF

SEQ ID NO: 14900 - protein, 11 aa, Homo Sapiens
SLAGDVALQQL

SEQ ID NO: 14901 - protein, 11 aa, Homo Sapiens
SLMEESGICKV

SEQ ID NO: 14902 - protein, 11 aa, Homo Sapiens
SLPQNIPPLTQ

SEQ ID NO: 14903 - protein, 11 aa, Homo Sapiens
SQAAEELITRI

SEQ ID NO: 14904 - protein, 11 aa, Homo Sapiens
SQAGKGLMHHL

SEQ ID NO: 14905 - protein, 11 aa, Homo Sapiens
SQATELITQAL

SEQ ID NO: 14906 - protein, 11 aa, Homo Sapiens
SQHDLSQSAFL

SEQ ID NO: 14907 - protein, 11 aa, Homo Sapiens
SQICAKAVRDA

SEQ ID NO: 14908 - protein, 11 aa, Homo Sapiens
SQIDPSSIERA

SEQ ID NO: 14909 - protein, 11 aa, Homo Sapiens
SQIGIEATTRA

SEQ ID NO: 14910 - protein, 11 aa, Homo Sapiens
SQITAIEAQHL

SEQ ID NO: 14911 - protein, 11 aa, Homo Sapiens
STVDAEAVHKL

SEQ ID NO: 14912 - protein, 11 aa, Homo Sapiens
SVAEGRALMSV

SEQ ID NO: 14913 - protein, 11 aa, Homo Sapiens
SVAGDALTRHL

SEQ ID NO: 14914 - protein, 11 aa, Homo Sapiens
SVANADIINAA

SEQ ID NO: 14915 - protein, 11 aa, Homo Sapiens
SVAPDTINNHV

SEQ ID NO: 14916 - protein, 11 aa, Homo Sapiens
SVAPKNALVQL

SEQ ID NO: 14917 - protein, 11 aa, Homo Sapiens
SVAPSPAVDKA

SEQ ID NO: 14918 - protein, 11 aa, Homo Sapiens
SVIDPPAVNLA

SEQ ID NO: 14919 - protein, 11 aa, Homo Sapiens
SVIEQGGIQTV

SEQ ID NO: 14920 - protein, 11 aa, Homo Sapiens
SVIPVINKIDL

SEQ ID NO: 14921 - protein, 11 aa, Homo Sapiens
SVIWDKAVVTG

SEQ ID NO: 14922 - protein, 11 aa, Homo Sapiens
SVPEKIERIEL

SEQ ID NO: 14923 - protein, 11 aa, Homo Sapiens
SVPGQTAVTAA

SEQ ID NO: 14924 - protein, 11 aa, Homo Sapiens
SVPGRGTVVTG

SEQ ID NO: 14925 - protein, 11 aa, Homo Sapiens
SVPNKDVFQEL

SEQ ID NO: 14926 - protein, 11 aa, Homo Sapiens
SVPPPDITYTL

SEQ ID NO: 14927 - protein, 11 aa, Homo Sapiens
SVSDAPVHITA

SEQ ID NO: 14928 - protein, 11 aa, Homo Sapiens
SVVKKSLITFV

SEQ ID NO: 14929 - protein, 11 aa, Homo Sapiens
SVYDGHGGEEV

SEQ ID NO: 14930 - protein, 11 aa, Homo Sapiens
SVYDSISMETL

SEQ ID NO: 14931 - protein, 11 aa, Homo Sapiens
TAAPAAAAAAA

SEQ ID NO: 14932 - protein, 11 aa, Homo Sapiens
TDAPSFSDIPN

SEQ ID NO: 14933 - protein, 11 aa, Homo Sapiens
TIIDLPGITRV

SEQ ID NO: 14934 - protein, 11 aa, Homo Sapiens
TLIDLPGITKV

SEQ ID NO: 14935 - protein, 11 aa, Homo Sapiens
TLIRSDAVALV

SEQ ID NO: 14936 - protein, 11 aa, Homo Sapiens
TMAKESSIIGV

SEQ ID NO: 14937 - protein, 11 aa, Homo Sapiens
TQAESAQSNRL

SEQ ID NO: 14938 - protein, 11 aa, Homo Sapiens
TQANPGKGEGL

SEQ ID NO: 14939 - protein, 11 aa, Homo Sapiens
TQFGGKRPFGV

SEQ ID NO: 14940 - protein, 11 aa, Homo Sapiens
TQMNAELNYKV

SEQ ID NO: 14941 - protein, 11 aa, Homo Sapiens
TQTPVVVPPFL

SEQ ID NO: 14942 - protein, 11 aa, Homo Sapiens
TVAPPQGVVKA

SEQ ID NO: 14943 - protein, 11 aa, Homo Sapiens
TVISEDSVVKA

SEQ ID NO: 14944 - protein, 11 aa, Homo Sapiens
TVPKPDVVVQV

SEQ ID NO: 14945 - protein, 11 aa, Homo Sapiens
TVYGGYLCSVR

SEQ ID NO: 14946 - protein, 11 aa, Homo Sapiens
VGCISVTVPSM

SEQ ID NO: 14947 - protein, 11 aa, Homo Sapiens
VISAAGIPNLI

SEQ ID NO: 14948 - protein, 11 aa, Homo Sapiens
VQKELSDMDYL

SEQ ID NO: 14949 - protein, 11 aa, Homo Sapiens
VTHNEQLCYQL

SEQ ID NO: 14950 - protein, 11 aa, Homo Sapiens
VVAEARATPFL

SEQ ID NO: 14951 - protein, 11 aa, Homo Sapiens
VVASDKETYEL

SEQ ID NO: 14952 - protein, 11 aa, Homo Sapiens
VVATEKNVIAA

SEQ ID NO: 14953 - protein, 11 aa, Homo Sapiens
VVITEKGISDL

SEQ ID NO: 14954 - protein, 11 aa, Homo Sapiens
VVPPFLQPEVM

SEQ ID NO: 14955 - protein, 11 aa, Homo Sapiens
WLANEGLITRL

SEQ ID NO: 14956 - protein, 11 aa, Homo Sapiens
WLIEDGKVVTV

SEQ ID NO: 14957 - protein, 11 aa, Homo Sapiens
YAYDGKDYIAL

SEQ ID NO: 14958 - protein, 11 aa, Homo Sapiens
YEDIAQKSKAE

SEQ ID NO: 14959 - protein, 11 aa, Homo Sapiens
YGAEALERMFL

SEQ ID NO: 14960 - protein, 11 aa, Homo Sapiens
YIPEVELNHKL

SEQ ID NO: 14961 - protein, 11 aa, Homo Sapiens
YIPYEAGTYSL

SEQ ID NO: 14962 - protein, 11 aa, Homo Sapiens
YIYDGKTGEKV

SEQ ID NO: 14963 - protein, 11 aa, Homo Sapiens
YIYDKDMEIIA

SEQ ID NO: 14964 - protein, 11 aa, Homo Sapiens
YLPDIIKDQKA

SEQ ID NO: 14965 - protein, 11 aa, Homo Sapiens
YLPEADSILFL

SEQ ID NO: 14966 - protein, 11 aa, Homo Sapiens
YLYESGETEKL

SEQ ID NO: 14967 - protein, 11 aa, Homo Sapiens
YQAEINDLENL

SEQ ID NO: 14968 - protein, 11 aa, Homo Sapiens
YQAKENDFDRL

SEQ ID NO: 14969 - protein, 11 aa, Homo Sapiens
YQANITETQRL

SEQ ID NO: 14970 - protein, 11 aa, Homo Sapiens
YQIDPDACFSA

SEQ ID NO: 14971 - protein, 11 aa, Homo Sapiens
YQIEHYSMDDL

SEQ ID NO: 14972 - protein, 11 aa, Homo Sapiens
YQIGEKGAVKV

SEQ ID NO: 14973 - protein, 11 aa, Homo Sapiens
YQIPTENSMTA

SEQ ID NO: 14974 - protein, 11 aa, Homo Sapiens
YQPDEPLTQFL

SEQ ID NO: 14975 - protein, 11 aa, Homo Sapiens
YTIGEVPISFV

SEQ ID NO: 14976 - protein, 11 aa, Homo Sapiens
YTPEHHLIQAV

SEQ ID NO: 14977 - protein, 11 aa, Homo Sapiens
YTSPEEIDAQL

SEQ ID NO: 14978 - protein, 11 aa, Homo Sapiens
YVEDGKGIRRV

SEQ ID NO: 14979 - protein, 11 aa, Homo Sapiens
YVIDSTDEERL

SEQ ID NO: 14980 - protein, 11 aa, Homo Sapiens
YVIEPHSMEFA

SEQ ID NO: 14981 - protein, 11 aa, Homo Sapiens
YVSPEDLEAQL

SEQ ID NO: 14982 - protein, 8 aa, Homo Sapiens
AIEHLDKI

SEQ ID NO: 14983 - protein, 8 aa, Homo Sapiens
FSPVGSVL

SEQ ID NO: 14984 - protein, 8 aa, Homo Sapiens
GVGPIRKV

SEQ ID NO: 14985 - protein, 8 aa, Homo Sapiens
LDKKVEKV

SEQ ID NO: 14986 - protein, 8 aa, Homo Sapiens
LMEHIHKL

SEQ ID NO: 14987 - protein, 8 aa, Homo Sapiens
LPSDFTPA

SEQ ID NO: 14988 - protein, 8 aa, Homo Sapiens
PDIKVLTL

SEQ ID NO: 14989 - protein, 8 aa, Homo Sapiens
TEAPLNPK

SEQ ID NO: 14990 - protein, 8 aa, Homo Sapiens
TLHLVLRL

SEQ ID NO: 14991 - protein, 8 aa, Homo Sapiens
VSLTACKV

SEQ ID NO: 14992 - protein, 8 aa, Homo Sapiens
WVWLSVCL

SEQ ID NO: 14993 - protein, 9 aa, Homo Sapiens
AAAAVIPTV

SEQ ID NO: 14994 - protein, 9 aa, Homo Sapiens
AAAGVVHAV

SEQ ID NO: 14995 - protein, 9 aa, Homo Sapiens
AAALIIHHV

SEQ ID NO: 14996 - protein, 9 aa, Homo Sapiens
AAFHNFIKV

SEQ ID NO: 14997 - protein, 9 aa, Homo Sapiens
AAIEIFEKV

SEQ ID NO: 14998 - protein, 9 aa, Homo Sapiens
AAIENLNEA

SEQ ID NO: 14999 - protein, 9 aa, Homo Sapiens
AAIPSLLNA

SEQ ID NO: 15000 - protein, 9 aa, Homo Sapiens
AALNGLYRV

SEQ ID NO: 15001 - protein, 9 aa, Homo Sapiens
AALPNVYEV

SEQ ID NO: 15002 - protein, 9 aa, Homo Sapiens
AALPSDPRL

SEQ ID NO: 15003 - protein, 9 aa, Homo Sapiens
AALTSDPAV

SEQ ID NO: 15004 - protein, 9 aa, Homo Sapiens
AAMYELVRV

SEQ ID NO: 15005 - protein, 9 aa, Homo Sapiens
AASGHFICV

SEQ ID NO: 15006 - protein, 9 aa, Homo Sapiens
AATEIVERV

SEQ ID NO: 15007 - protein, 9 aa, Homo Sapiens
AATNEVPEV

SEQ ID NO: 15008 - protein, 9 aa, Homo Sapiens
AAVDAVARV

SEQ ID NO: 15009 - protein, 9 aa, Homo Sapiens
AAVRDISEA

SEQ ID NO: 15010 - protein, 9 aa, Homo Sapiens
AICPNNHEV

SEQ ID NO: 15011 - protein, 9 aa, Homo Sapiens
AIIDHIFAS

SEQ ID NO: 15012 - protein, 9 aa, Homo Sapiens
AIIEYMPLL

SEQ ID NO: 15013 - protein, 9 aa, Homo Sapiens
AIISKLVAL

SEQ ID NO: 15014 - protein, 9 aa, Homo Sapiens
AILELDEHL

SEQ ID NO: 15015 - protein, 9 aa, Homo Sapiens
AILKELVTL

SEQ ID NO: 15016 - protein, 9 aa, Homo Sapiens
AILSQFEKV

SEQ ID NO: 15017 - protein, 9 aa, Homo Sapiens
AIMDIVIKV

SEQ ID NO: 15018 - protein, 9 aa, Homo Sapiens
AIMDLLLRL

SEQ ID NO: 15019 - protein, 9 aa, Homo Sapiens
AIQDKLFQV

SEQ ID NO: 15020 - protein, 9 aa, Homo Sapiens
AIVDHLVAL

SEQ ID NO: 15021 - protein, 9 aa, Homo Sapiens
AIVDKVPSV

SEQ ID NO: 15022 - protein, 9 aa, Homo Sapiens
AIVDLIHDI

SEQ ID NO: 15023 - protein, 9 aa, Homo Sapiens
AIVKEIVNI

SEQ ID NO: 15024 - protein, 9 aa, Homo Sapiens
AIVRSLPSV

SEQ ID NO: 15025 - protein, 9 aa, Homo Sapiens
ALAEALKEV

SEQ ID NO: 15026 - protein, 9 aa, Homo Sapiens
ALAEEVEQV

SEQ ID NO: 15027 - protein, 9 aa, Homo Sapiens
ALAEKFKEL

SEQ ID NO: 15028 - protein, 9 aa, Homo Sapiens
ALANHLIKV

SEQ ID NO: 15029 - protein, 9 aa, Homo Sapiens
ALATLIHQV

SEQ ID NO: 15030 - protein, 9 aa, Homo Sapiens
ALDDRLYCV

SEQ ID NO: 15031 - protein, 9 aa, Homo Sapiens
ALHSWFQTL

SEQ ID NO: 15032 - protein, 9 aa, Homo Sapiens
ALIEKLVEL

SEQ ID NO: 15033 - protein, 9 aa, Homo Sapiens
ALIGQCIHI

SEQ ID NO: 15034 - protein, 9 aa, Homo Sapiens
ALITRIFGV

SEQ ID NO: 15035 - protein, 9 aa, Homo Sapiens
ALLDKLYAL

SEQ ID NO: 15036 - protein, 9 aa, Homo Sapiens
ALLDRIVSV

SEQ ID NO: 15037 - protein, 9 aa, Homo Sapiens
ALLDVFREA

SEQ ID NO: 15038 - protein, 9 aa, Homo Sapiens
ALLGDLTKA

SEQ ID NO: 15039 - protein, 9 aa, Homo Sapiens
ALLGILQHV

SEQ ID NO: 15040 - protein, 9 aa, Homo Sapiens
ALLGKIEKV

SEQ ID NO: 15041 - protein, 9 aa, Homo Sapiens
ALLQQVHSA

SEQ ID NO: 15042 - protein, 9 aa, Homo Sapiens
ALLQRLEAL

SEQ ID NO: 15043 - protein, 9 aa, Homo Sapiens
ALLSRLEQI

SEQ ID NO: 15044 - protein, 9 aa, Homo Sapiens
ALLVRLQEV

SEQ ID NO: 15045 - protein, 9 aa, Homo Sapiens
ALMDEVVKA

SEQ ID NO: 15046 - protein, 9 aa, Homo Sapiens
ALMPVLNQV

SEQ ID NO: 15047 - protein, 9 aa, Homo Sapiens
ALPEDLVEV

SEQ ID NO: 15048 - protein, 9 aa, Homo Sapiens
ALPHVVPTL

SEQ ID NO: 15049 - protein, 9 aa, Homo Sapiens
ALPKELPLI

SEQ ID NO: 15050 - protein, 9 aa, Homo Sapiens
ALPPVLTTV

SEQ ID NO: 15051 - protein, 9 aa, Homo Sapiens
ALQEKLWNV

SEQ ID NO: 15052 - protein, 9 aa, Homo Sapiens
ALSDSIHTV

SEQ ID NO: 15053 - protein, 9 aa, Homo Sapiens
ALTDVILCV

SEQ ID NO: 15054 - protein, 9 aa, Homo Sapiens
ALTELLAKI

SEQ ID NO: 15055 - protein, 9 aa, Homo Sapiens
ALVDHVAEL

SEQ ID NO: 15056 - protein, 9 aa, Homo Sapiens
ALVDQLWKL

SEQ ID NO: 15057 - protein, 9 aa, Homo Sapiens
ALVQDLAKA

SEQ ID NO: 15058 - protein, 9 aa, Homo Sapiens
AMFRPFVEV

SEQ ID NO: 15059 - protein, 9 aa, Homo Sapiens
AMLTVLHEI

SEQ ID NO: 15060 - protein, 9 aa, Homo Sapiens
AQAEVYKEL

SEQ ID NO: 15061 - protein, 9 aa, Homo Sapiens
AQAPDLQRV

SEQ ID NO: 15062 - protein, 9 aa, Homo Sapiens
AQAQEVFFL

SEQ ID NO: 15063 - protein, 9 aa, Homo Sapiens
AQCPIVERL

SEQ ID NO: 15064 - protein, 9 aa, Homo Sapiens
AQDEHLITF

SEQ ID NO: 15065 - protein, 9 aa, Homo Sapiens
AQDFRVLYV

SEQ ID NO: 15066 - protein, 9 aa, Homo Sapiens
AQFEHTILL

SEQ ID NO: 15067 - protein, 9 aa, Homo Sapiens
AQFEHTLLV

SEQ ID NO: 15068 - protein, 9 aa, Homo Sapiens
AQFPESFTV

SEQ ID NO: 15069 - protein, 9 aa, Homo Sapiens
AQHSVPLQL

SEQ ID NO: 15070 - protein, 9 aa, Homo Sapiens
AQIDHYLGL

SEQ ID NO: 15071 - protein, 9 aa, Homo Sapiens
AQIEAFVRL

SEQ ID NO: 15072 - protein, 9 aa, Homo Sapiens
AQIEVVPSA

SEQ ID NO: 15073 - protein, 9 aa, Homo Sapiens
AQIGSYVHV

SEQ ID NO: 15074 - protein, 9 aa, Homo Sapiens
AQIHDLVLV

SEQ ID NO: 15075 - protein, 9 aa, Homo Sapiens
AQIKELEEL

SEQ ID NO: 15076 - protein, 9 aa, Homo Sapiens
AQIKEMVEL

SEQ ID NO: 15077 - protein, 9 aa, Homo Sapiens
AQIKHLARL

SEQ ID NO: 15078 - protein, 9 aa, Homo Sapiens
AQIPVVFRL

SEQ ID NO: 15079 - protein, 9 aa, Homo Sapiens
AQIRYLTQV

SEQ ID NO: 15080 - protein, 9 aa, Homo Sapiens
AQITQKIGV

SEQ ID NO: 15081 - protein, 9 aa, Homo Sapiens
AQLELISRI

SEQ ID NO: 15082 - protein, 9 aa, Homo Sapiens
AQLENPAAV

SEQ ID NO: 15083 - protein, 9 aa, Homo Sapiens
AQLGAVVAV

SEQ ID NO: 15084 - protein, 9 aa, Homo Sapiens
AQLPLKVEV

SEQ ID NO: 15085 - protein, 9 aa, Homo Sapiens
AQLPSLLSV

SEQ ID NO: 15086 - protein, 9 aa, Homo Sapiens
AQLRQYHRL

SEQ ID NO: 15087 - protein, 9 aa, Homo Sapiens
AQLSEKISL

SEQ ID NO: 15088 - protein, 9 aa, Homo Sapiens
AQQELKLLL

SEQ ID NO: 15089 - protein, 9 aa, Homo Sapiens
AQRKHFPSV

SEQ ID NO: 15090 - protein, 9 aa, Homo Sapiens
AQSESILKV

SEQ ID NO: 15091 - protein, 9 aa, Homo Sapiens
AQSLATPVV

SEQ ID NO: 15092 - protein, 9 aa, Homo Sapiens
AQVALVNEV

SEQ ID NO: 15093 - protein, 9 aa, Homo Sapiens
AQVGKLPCL

SEQ ID NO: 15094 - protein, 9 aa, Homo Sapiens
AQVHHFMEL

SEQ ID NO: 15095 - protein, 9 aa, Homo Sapiens
AQVMWFEKL

SEQ ID NO: 15096 - protein, 9 aa, Homo Sapiens
AQVSKVEAL

SEQ ID NO: 15097 - protein, 9 aa, Homo Sapiens
AQWHEQILV

SEQ ID NO: 15098 - protein, 9 aa, Homo Sapiens
AQYDGAYKV

SEQ ID NO: 15099 - protein, 9 aa, Homo Sapiens
AQYDRQIRL

SEQ ID NO: 15100 - protein, 9 aa, Homo Sapiens
AQYEHDLEV

SEQ ID NO: 15101 - protein, 9 aa, Homo Sapiens
ASIDILHSI

SEQ ID NO: 15102 - protein, 9 aa, Homo Sapiens
ASVPKVETV

SEQ ID NO: 15103 - protein, 9 aa, Homo Sapiens
ATADYICKV

SEQ ID NO: 15104 - protein, 9 aa, Homo Sapiens
ATAPLISGV

SEQ ID NO: 15105 - protein, 9 aa, Homo Sapiens
ATASNLVKV

SEQ ID NO: 15106 - protein, 9 aa, Homo Sapiens
ATDKNDPHL

SEQ ID NO: 15107 - protein, 9 aa, Homo Sapiens
ATDPTIHTV

SEQ ID NO: 15108 - protein, 9 aa, Homo Sapiens
ATGENLPRV

SEQ ID NO: 15109 - protein, 9 aa, Homo Sapiens
ATHGRFLEI

SEQ ID NO: 15110 - protein, 9 aa, Homo Sapiens
ATIDKVVKI

SEQ ID NO: 15111 - protein, 9 aa, Homo Sapiens
ATINEVVQV

SEQ ID NO: 15112 - protein, 9 aa, Homo Sapiens
ATLEKVIEI

SEQ ID NO: 15113 - protein, 9 aa, Homo Sapiens
ATLKELTSL

SEQ ID NO: 15114 - protein, 9 aa, Homo Sapiens
ATLNIIHSV

SEQ ID NO: 15115 - protein, 9 aa, Homo Sapiens
ATLNSFIHV

SEQ ID NO: 15116 - protein, 9 aa, Homo Sapiens
ATMPVVPSV

SEQ ID NO: 15117 - protein, 9 aa, Homo Sapiens
ATQTQFFHV

SEQ ID NO: 15118 - protein, 9 aa, Homo Sapiens
ATVPGLLKV

SEQ ID NO: 15119 - protein, 9 aa, Homo Sapiens
ATYVFLHTV

SEQ ID NO: 15120 - protein, 9 aa, Homo Sapiens
AVADDFCKV

SEQ ID NO: 15121 - protein, 9 aa, Homo Sapiens
AVAELNYGL

SEQ ID NO: 15122 - protein, 9 aa, Homo Sapiens
AVAKHFVAL

SEQ ID NO: 15123 - protein, 9 aa, Homo Sapiens
AVAPQVPAL

SEQ ID NO: 15124 - protein, 9 aa, Homo Sapiens
AVCEGTWRL

SEQ ID NO: 15125 - protein, 9 aa, Homo Sapiens
AVCNHISSV

SEQ ID NO: 15126 - protein, 9 aa, Homo Sapiens
AVCPLVVRL

SEQ ID NO: 15127 - protein, 9 aa, Homo Sapiens
AVDLTLPKV

SEQ ID NO: 15128 - protein, 9 aa, Homo Sapiens
AVFASFLWH

SEQ ID NO: 15129 - protein, 9 aa, Homo Sapiens
AVFKELVKL

SEQ ID NO: 15130 - protein, 9 aa, Homo Sapiens
AVFPHLTVV

SEQ ID NO: 15131 - protein, 9 aa, Homo Sapiens
AVGPVHNSV

SEQ ID NO: 15132 - protein, 9 aa, Homo Sapiens
AVHDSFVAV

SEQ ID NO: 15133 - protein, 9 aa, Homo Sapiens
AVHEDIVAV

SEQ ID NO: 15134 - protein, 9 aa, Homo Sapiens
AVHETLVAV

SEQ ID NO: 15135 - protein, 9 aa, Homo Sapiens
AVIDEIQMI

SEQ ID NO: 15136 - protein, 9 aa, Homo Sapiens
AVIEHLERL

SEQ ID NO: 15137 - protein, 9 aa, Homo Sapiens
AVIEHTNRV

SEQ ID NO: 15138 - protein, 9 aa, Homo Sapiens
AVIGDVIRV

SEQ ID NO: 15139 - protein, 9 aa, Homo Sapiens
AVIGSTEEL

SEQ ID NO: 15140 - protein, 9 aa, Homo Sapiens
AVIHEAPAV

SEQ ID NO: 15141 - protein, 9 aa, Homo Sapiens
AVIHYLLQV

SEQ ID NO: 15142 - protein, 9 aa, Homo Sapiens
AVIKFLELL

SEQ ID NO: 15143 - protein, 9 aa, Homo Sapiens
AVIKGLTYL

SEQ ID NO: 15144 - protein, 9 aa, Homo Sapiens
AVINRVQKV

SEQ ID NO: 15145 - protein, 9 aa, Homo Sapiens
AVIPETEAV

SEQ ID NO: 15146 - protein, 9 aa, Homo Sapiens
AVIQGLETL

SEQ ID NO: 15147 - protein, 9 aa, Homo Sapiens
AVIRDLNSL

SEQ ID NO: 15148 - protein, 9 aa, Homo Sapiens
AVIREIQNA

SEQ ID NO: 15149 - protein, 9 aa, Homo Sapiens
AVISKFWKS

SEQ ID NO: 15150 - protein, 9 aa, Homo Sapiens
AVITKVKGV

SEQ ID NO: 15151 - protein, 9 aa, Homo Sapiens
AVIVEVHAA

SEQ ID NO: 15152 - protein, 9 aa, Homo Sapiens
AVLDFCYHL

SEQ ID NO: 15153 - protein, 9 aa, Homo Sapiens
AVLDLVHSA

SEQ ID NO: 15154 - protein, 9 aa, Homo Sapiens
AVLDRMHSL

SEQ ID NO: 15155 - protein, 9 aa, Homo Sapiens
AVLEHMEEL

SEQ ID NO: 15156 - protein, 9 aa, Homo Sapiens
AVLERLVDI

SEQ ID NO: 15157 - protein, 9 aa, Homo Sapiens
AVLNALDKI

SEQ ID NO: 15158 - protein, 9 aa, Homo Sapiens
AVLPFSPAL

SEQ ID NO: 15159 - protein, 9 aa, Homo Sapiens
AVLPHVDQV

SEQ ID NO: 15160 - protein, 9 aa, Homo Sapiens
AVMEQIPEI

SEQ ID NO: 15161 - protein, 9 aa, Homo Sapiens
AVMKQFAFV

SEQ ID NO: 15162 - protein, 9 aa, Homo Sapiens
AVMLHSFTL

SEQ ID NO: 15163 - protein, 9 aa, Homo Sapiens
AVPEIMDRI

SEQ ID NO: 15164 - protein, 9 aa, Homo Sapiens
AVPEKIGQV

SEQ ID NO: 15165 - protein, 9 aa, Homo Sapiens
AVPFSLDSV

SEQ ID NO: 15166 - protein, 9 aa, Homo Sapiens
AVPSWFVRV

SEQ ID NO: 15167 - protein, 9 aa, Homo Sapiens
AVQDFLHEI

SEQ ID NO: 15168 - protein, 9 aa, Homo Sapiens
AVQEKVFEL

SEQ ID NO: 15169 - protein, 9 aa, Homo Sapiens
AVRSHFTKV

SEQ ID NO: 15170 - protein, 9 aa, Homo Sapiens
AVSDGVIKV

SEQ ID NO: 15171 - protein, 9 aa, Homo Sapiens
AVTEAFVRL

SEQ ID NO: 15172 - protein, 9 aa, Homo Sapiens
AVTNVGHAV

SEQ ID NO: 15173 - protein, 9 aa, Homo Sapiens
AVTPELEGV

SEQ ID NO: 15174 - protein, 9 aa, Homo Sapiens
AVVEFLTSV

SEQ ID NO: 15175 - protein, 9 aa, Homo Sapiens
AVVPGLLEV

SEQ ID NO: 15176 - protein, 9 aa, Homo Sapiens
AVVPKILTV

SEQ ID NO: 15177 - protein, 9 aa, Homo Sapiens
AVVPKTKEV

SEQ ID NO: 15178 - protein, 9 aa, Homo Sapiens
AVVTQVNKV

SEQ ID NO: 15179 - protein, 9 aa, Homo Sapiens
CTTPHLHSI

SEQ ID NO: 15180 - protein, 9 aa, Homo Sapiens
DKKNKVLEV

SEQ ID NO: 15181 - protein, 9 aa, Homo Sapiens
DLNQKAWDI

SEQ ID NO: 15182 - protein, 9 aa, Homo Sapiens
EIYKEFFEV

SEQ ID NO: 15183 - protein, 9 aa, Homo Sapiens
ELKPFIEEL

SEQ ID NO: 15184 - protein, 9 aa, Homo Sapiens
EPYGHLGPA

SEQ ID NO: 15185 - protein, 9 aa, Homo Sapiens
EQIAEFKEA

SEQ ID NO: 15186 - protein, 9 aa, Homo Sapiens
EQIKDIFYI

SEQ ID NO: 15187 - protein, 9 aa, Homo Sapiens
EQIKFFEEV

SEQ ID NO: 15188 - protein, 9 aa, Homo Sapiens
EQVDKFFPL

SEQ ID NO: 15189 - protein, 9 aa, Homo Sapiens
ERTPHFALV

SEQ ID NO: 15190 - protein, 9 aa, Homo Sapiens
EVIEKFDYV

SEQ ID NO: 15191 - protein, 9 aa, Homo Sapiens
EVIKELAQI

SEQ ID NO: 15192 - protein, 9 aa, Homo Sapiens
EVIRELAGI

SEQ ID NO: 15193 - protein, 9 aa, Homo Sapiens
EVISKLYAV

SEQ ID NO: 15194 - protein, 9 aa, Homo Sapiens
EVITKFINV

SEQ ID NO: 15195 - protein, 9 aa, Homo Sapiens
EVVERLLSV

SEQ ID NO: 15196 - protein, 9 aa, Homo Sapiens
FAHVIFQNV

SEQ ID NO: 15197 - protein, 9 aa, Homo Sapiens
FAIPLIEKL

SEQ ID NO: 15198 - protein, 9 aa, Homo Sapiens
FAIPMIHAV

SEQ ID NO: 15199 - protein, 9 aa, Homo Sapiens
FAITAIKGV

SEQ ID NO: 15200 - protein, 9 aa, Homo Sapiens
FALGPVASV

SEQ ID NO: 15201 - protein, 9 aa, Homo Sapiens
FAMEIDPSL

SEQ ID NO: 15202 - protein, 9 aa, Homo Sapiens
FAPEKLQEL

SEQ ID NO: 15203 - protein, 9 aa, Homo Sapiens
FASHVSPEV

SEQ ID NO: 15204 - protein, 9 aa, Homo Sapiens
FASPKIDSV

SEQ ID NO: 15205 - protein, 9 aa, Homo Sapiens
FGIDLDTRV

SEQ ID NO: 15206 - protein, 9 aa, Homo Sapiens
FGLARAFGV

SEQ ID NO: 15207 - protein, 9 aa, Homo Sapiens
FGVPLIVHV

SEQ ID NO: 15208 - protein, 9 aa, Homo Sapiens
FGYVDFESA

SEQ ID NO: 15209 - protein, 9 aa, Homo Sapiens
FIDDANYSV

SEQ ID NO: 15210 - protein, 9 aa, Homo Sapiens
FIDEYVETV

SEQ ID NO: 15211 - protein, 9 aa, Homo Sapiens
FIFSDTHEL

SEQ ID NO: 15212 - protein, 9 aa, Homo Sapiens
FIHQHFVEV

SEQ ID NO: 15213 - protein, 9 aa, Homo Sapiens
FIINGIEKV

SEQ ID NO: 15214 - protein, 9 aa, Homo Sapiens
FIIQGLRSV

SEQ ID NO: 15215 - protein, 9 aa, Homo Sapiens
FIISDFESV

SEQ ID NO: 15216 - protein, 9 aa, Homo Sapiens
FILKKLDSI

SEQ ID NO: 15217 - protein, 9 aa, Homo Sapiens
FILPHISTA

SEQ ID NO: 15218 - protein, 9 aa, Homo Sapiens
FIPYLVVKV

SEQ ID NO: 15219 - protein, 9 aa, Homo Sapiens
FIVEEIQRI

SEQ ID NO: 15220 - protein, 9 aa, Homo Sapiens
FIVHTIEEI

SEQ ID NO: 15221 - protein, 9 aa, Homo Sapiens
FLAGAVTSV

SEQ ID NO: 15222 - protein, 9 aa, Homo Sapiens
FLCPFHLSV

SEQ ID NO: 15223 - protein, 9 aa, Homo Sapiens
FLDKNDHSL

SEQ ID NO: 15224 - protein, 9 aa, Homo Sapiens
FLDNSFEKV

SEQ ID NO: 15225 - protein, 9 aa, Homo Sapiens
FLEKLLPPV

SEQ ID NO: 15226 - protein, 9 aa, Homo Sapiens
FLEPVNPRL

SEQ ID NO: 15227 - protein, 9 aa, Homo Sapiens
FLFEDFSKA

SEQ ID NO: 15228 - protein, 9 aa, Homo Sapiens
FLFSKFIEL

SEQ ID NO: 15229 - protein, 9 aa, Homo Sapiens
FLGEKIASV

SEQ ID NO: 15230 - protein, 9 aa, Homo Sapiens
FLGTFILKV

SEQ ID NO: 15231 - protein, 9 aa, Homo Sapiens
FLHDNMVEI

SEQ ID NO: 15232 - protein, 9 aa, Homo Sapiens
FLIRESETL

SEQ ID NO: 15233 - protein, 9 aa, Homo Sapiens
FLITILDHL

SEQ ID NO: 15234 - protein, 9 aa, Homo Sapiens
FLKDKFVEI

SEQ ID NO: 15235 - protein, 9 aa, Homo Sapiens
FLKNELDNV

SEQ ID NO: 15236 - protein, 9 aa, Homo Sapiens
FLLDKKIGV

SEQ ID NO: 15237 - protein, 9 aa, Homo Sapiens
FLLEKGYEV

SEQ ID NO: 15238 - protein, 9 aa, Homo Sapiens
FLLHIQQQV

SEQ ID NO: 15239 - protein, 9 aa, Homo Sapiens
FLLPDVIRI

SEQ ID NO: 15240 - protein, 9 aa, Homo Sapiens
FLLPKVQSI

SEQ ID NO: 15241 - protein, 9 aa, Homo Sapiens
FLLPVINEM

SEQ ID NO: 15242 - protein, 9 aa, Homo Sapiens
FLMDFIHQV

SEQ ID NO: 15243 - protein, 9 aa, Homo Sapiens
FLPAGIVAV

SEQ ID NO: 15244 - protein, 9 aa, Homo Sapiens
FLPARFYQA

SEQ ID NO: 15245 - protein, 9 aa, Homo Sapiens
FLPHELPLL

SEQ ID NO: 15246 - protein, 9 aa, Homo Sapiens
FLPLKWSLA

SEQ ID NO: 15247 - protein, 9 aa, Homo Sapiens
FLPRKFPSL

SEQ ID NO: 15248 - protein, 9 aa, Homo Sapiens
FLPSYIIDV

SEQ ID NO: 15249 - protein, 9 aa, Homo Sapiens
FLPTLLHQA

SEQ ID NO: 15250 - protein, 9 aa, Homo Sapiens
FLPVKLIFV

SEQ ID NO: 15251 - protein, 9 aa, Homo Sapiens
FLQPELVKL

SEQ ID NO: 15252 - protein, 9 aa, Homo Sapiens
FLQPHLDAV

SEQ ID NO: 15253 - protein, 9 aa, Homo Sapiens
FLREYFERL

SEQ ID NO: 15254 - protein, 9 aa, Homo Sapiens
FLSEVFHQA

SEQ ID NO: 15255 - protein, 9 aa, Homo Sapiens
FLVDGVCTV

SEQ ID NO: 15256 - protein, 9 aa, Homo Sapiens
FLVPTFEQL

SEQ ID NO: 15257 - protein, 9 aa, Homo Sapiens
FLVQNIHTL

SEQ ID NO: 15258 - protein, 9 aa, Homo Sapiens
FLVTVIHTL

SEQ ID NO: 15259 - protein, 9 aa, Homo Sapiens
FMTTNVPNV

SEQ ID NO: 15260 - protein, 9 aa, Homo Sapiens
FQAEIAQLM

SEQ ID NO: 15261 - protein, 9 aa, Homo Sapiens
FQATIVKAV

SEQ ID NO: 15262 - protein, 9 aa, Homo Sapiens
FQDDRYLYM

SEQ ID NO: 15263 - protein, 9 aa, Homo Sapiens
FQDEINWRL

SEQ ID NO: 15264 - protein, 9 aa, Homo Sapiens
FQDENHLYL

SEQ ID NO: 15265 - protein, 9 aa, Homo Sapiens
FQDGTKATF

SEQ ID NO: 15266 - protein, 9 aa, Homo Sapiens
FQDKNRPCL

SEQ ID NO: 15267 - protein, 9 aa, Homo Sapiens
FQDPVPLTV

SEQ ID NO: 15268 - protein, 9 aa, Homo Sapiens
FQEADSPTL

SEQ ID NO: 15269 - protein, 9 aa, Homo Sapiens
FQGVEFHYV

SEQ ID NO: 15270 - protein, 9 aa, Homo Sapiens
FQHTGIYSV

SEQ ID NO: 15271 - protein, 9 aa, Homo Sapiens
FQIGPCEGI

SEQ ID NO: 15272 - protein, 9 aa, Homo Sapiens
FQIGPVAGV

SEQ ID NO: 15273 - protein, 9 aa, Homo Sapiens
FQIVNPHLL

SEQ ID NO: 15274 - protein, 9 aa, Homo Sapiens
FQLEHIMDL

SEQ ID NO: 15275 - protein, 9 aa, Homo Sapiens
FQLPIRFNL

SEQ ID NO: 15276 - protein, 9 aa, Homo Sapiens
FQLTQGDQL

SEQ ID NO: 15277 - protein, 9 aa, Homo Sapiens
FQPPGPQAV

SEQ ID NO: 15278 - protein, 9 aa, Homo Sapiens
FQSSAVMAL

SEQ ID NO: 15279 - protein, 9 aa, Homo Sapiens
FQSTTGHCV

SEQ ID NO: 15280 - protein, 9 aa, Homo Sapiens
FQTEGKLYL

SEQ ID NO: 15281 - protein, 9 aa, Homo Sapiens
FQTEVGKQL

SEQ ID NO: 15282 - protein, 9 aa, Homo Sapiens
FSPFHASVL

SEQ ID NO: 15283 - protein, 9 aa, Homo Sapiens
FSSPHLVQV

SEQ ID NO: 15284 - protein, 9 aa, Homo Sapiens
FTAEFLEKV

SEQ ID NO: 15285 - protein, 9 aa, Homo Sapiens
FTAGHLIGL

SEQ ID NO: 15286 - protein, 9 aa, Homo Sapiens
FTEGELMSV

SEQ ID NO: 15287 - protein, 9 aa, Homo Sapiens
FTFSGICRV

SEQ ID NO: 15288 - protein, 9 aa, Homo Sapiens
FTHKEFEQL

SEQ ID NO: 15289 - protein, 9 aa, Homo Sapiens
FTIDVDKKL

SEQ ID NO: 15290 - protein, 9 aa, Homo Sapiens
FTIFRTISV

SEQ ID NO: 15291 - protein, 9 aa, Homo Sapiens
FTILDVRPA

SEQ ID NO: 15292 - protein, 9 aa, Homo Sapiens
FTLPLTDQV

SEQ ID NO: 15293 - protein, 9 aa, Homo Sapiens
FTMDDVVKV

SEQ ID NO: 15294 - protein, 9 aa, Homo Sapiens
FTPNNIKQV

SEQ ID NO: 15295 - protein, 9 aa, Homo Sapiens
FTVDKDITL

SEQ ID NO: 15296 - protein, 9 aa, Homo Sapiens
FTVDQIRAI

SEQ ID NO: 15297 - protein, 9 aa, Homo Sapiens
FTVPRVVAV

SEQ ID NO: 15298 - protein, 9 aa, Homo Sapiens
FVAKHLKTI

SEQ ID NO: 15299 - protein, 9 aa, Homo Sapiens
FVAPPTAAV

SEQ ID NO: 15300 - protein, 9 aa, Homo Sapiens
FVARMIPKV

SEQ ID NO: 15301 - protein, 9 aa, Homo Sapiens
FVCDIRPEI

SEQ ID NO: 15302 - protein, 9 aa, Homo Sapiens
FVDDYTVRV

SEQ ID NO: 15303 - protein, 9 aa, Homo Sapiens
FVDEYDPTI

SEQ ID NO: 15304 - protein, 9 aa, Homo Sapiens
FVDGLTFKV

SEQ ID NO: 15305 - protein, 9 aa, Homo Sapiens
FVDIVDAKL

SEQ ID NO: 15306 - protein, 9 aa, Homo Sapiens
FVDPAQITM

SEQ ID NO: 15307 - protein, 9 aa, Homo Sapiens
FVDRGFYSV

SEQ ID NO: 15308 - protein, 9 aa, Homo Sapiens
FVEEEEHFL

SEQ ID NO: 15309 - protein, 9 aa, Homo Sapiens
FVEPSRQFV

SEQ ID NO: 15310 - protein, 9 aa, Homo Sapiens
FVHDLVLYL

SEQ ID NO: 15311 - protein, 9 aa, Homo Sapiens
FVHPGAATV

SEQ ID NO: 15312 - protein, 9 aa, Homo Sapiens
FVIDEAHCV

SEQ ID NO: 15313 - protein, 9 aa, Homo Sapiens
FVIDLQTRL

SEQ ID NO: 15314 - protein, 9 aa, Homo Sapiens
FVIGHLKGA

SEQ ID NO: 15315 - protein, 9 aa, Homo Sapiens
FVIRNIVEA

SEQ ID NO: 15316 - protein, 9 aa, Homo Sapiens
FVKEHFDEL

SEQ ID NO: 15317 - protein, 9 aa, Homo Sapiens
FVLDKVPFL

SEQ ID NO: 15318 - protein, 9 aa, Homo Sapiens
FVLPELPSV

SEQ ID NO: 15319 - protein, 9 aa, Homo Sapiens
FVLPILQKL

SEQ ID NO: 15320 - protein, 9 aa, Homo Sapiens
FVLPVATQI

SEQ ID NO: 15321 - protein, 9 aa, Homo Sapiens
FVLQHICYI

SEQ ID NO: 15322 - protein, 9 aa, Homo Sapiens
FVMETFVHL

SEQ ID NO: 15323 - protein, 9 aa, Homo Sapiens
FVNDIFERI

SEQ ID NO: 15324 - protein, 9 aa, Homo Sapiens
FVPEIFHRI

SEQ ID NO: 15325 - protein, 9 aa, Homo Sapiens
FVPIKVEQI

SEQ ID NO: 15326 - protein, 9 aa, Homo Sapiens
FVPRSFDEL

SEQ ID NO: 15327 - protein, 9 aa, Homo Sapiens
FVVDEVHLI

SEQ ID NO: 15328 - protein, 9 aa, Homo Sapiens
FVVDEVSNI

SEQ ID NO: 15329 - protein, 9 aa, Homo Sapiens
FVVDHVIKI

SEQ ID NO: 15330 - protein, 9 aa, Homo Sapiens
FVVDIESRL

SEQ ID NO: 15331 - protein, 9 aa, Homo Sapiens
FVVDRLIAL

SEQ ID NO: 15332 - protein, 9 aa, Homo Sapiens
FVVDRSDKL

SEQ ID NO: 15333 - protein, 9 aa, Homo Sapiens
FVVEKIELL

SEQ ID NO: 15334 - protein, 9 aa, Homo Sapiens
FVWSGTAEA

SEQ ID NO: 15335 - protein, 9 aa, Homo Sapiens
GAAKDLPGV

SEQ ID NO: 15336 - protein, 9 aa, Homo Sapiens
GAASRIPGV

SEQ ID NO: 15337 - protein, 9 aa, Homo Sapiens
GAFQEFPQV

SEQ ID NO: 15338 - protein, 9 aa, Homo Sapiens
GAFVHFHGV

SEQ ID NO: 15339 - protein, 9 aa, Homo Sapiens
GAIQVLPKL

SEQ ID NO: 15340 - protein, 9 aa, Homo Sapiens
GIIDAFHQI

SEQ ID NO: 15341 - protein, 9 aa, Homo Sapiens
GILLRLPQV

SEQ ID NO: 15342 - protein, 9 aa, Homo Sapiens
GILSHINTV

SEQ ID NO: 15343 - protein, 9 aa, Homo Sapiens
GIMDRFLQV

SEQ ID NO: 15344 - protein, 9 aa, Homo Sapiens
GIPAEVPHI

SEQ ID NO: 15345 - protein, 9 aa, Homo Sapiens
GIYTGFIKV

SEQ ID NO: 15346 - protein, 9 aa, Homo Sapiens
GLIEILKKV

SEQ ID NO: 15347 - protein, 9 aa, Homo Sapiens
GLLTEIRAV

SEQ ID NO: 15348 - protein, 9 aa, Homo Sapiens
GLPTSVPQI

SEQ ID NO: 15349 - protein, 9 aa, Homo Sapiens
GPPPPGKPQ

SEQ ID NO: 15350 - protein, 9 aa, Homo Sapiens
GQDEPLIHV

SEQ ID NO: 15351 - protein, 9 aa, Homo Sapiens
GQDVGRYQV

SEQ ID NO: 15352 - protein, 9 aa, Homo Sapiens
GQFDRPAGV

SEQ ID NO: 15353 - protein, 9 aa, Homo Sapiens
GQIDLLERL

SEQ ID NO: 15354 - protein, 9 aa, Homo Sapiens
GQIELRTYV

SEQ ID NO: 15355 - protein, 9 aa, Homo Sapiens
GQIEVVPEV

SEQ ID NO: 15356 - protein, 9 aa, Homo Sapiens
GQIRNLESA

SEQ ID NO: 15357 - protein, 9 aa, Homo Sapiens
GQISEVVVV

SEQ ID NO: 15358 - protein, 9 aa, Homo Sapiens
GQLDKVVEL

SEQ ID NO: 15359 - protein, 9 aa, Homo Sapiens
GQLEFRALL

SEQ ID NO: 15360 - protein, 9 aa, Homo Sapiens
GQLPNLQTV

SEQ ID NO: 15361 - protein, 9 aa, Homo Sapiens
GQMGSFIRL

SEQ ID NO: 15362 - protein, 9 aa, Homo Sapiens
GQSYVVNRV

SEQ ID NO: 15363 - protein, 9 aa, Homo Sapiens
GQTGVIRSV

SEQ ID NO: 15364 - protein, 9 aa, Homo Sapiens
GQTITISRV

SEQ ID NO: 15365 - protein, 9 aa, Homo Sapiens
GQTQVEIKV

SEQ ID NO: 15366 - protein, 9 aa, Homo Sapiens
GQTTVQVRV

SEQ ID NO: 15367 - protein, 9 aa, Homo Sapiens
GQVDMDIKL

SEQ ID NO: 15368 - protein, 9 aa, Homo Sapiens
GQVPPLQSV

SEQ ID NO: 15369 - protein, 9 aa, Homo Sapiens
GQWASVIRV

SEQ ID NO: 15370 - protein, 9 aa, Homo Sapiens
GQWGRAWEV

SEQ ID NO: 15371 - protein, 9 aa, Homo Sapiens
GTAAVFNAV

SEQ ID NO: 15372 - protein, 9 aa, Homo Sapiens
GTIDEIQKL

SEQ ID NO: 15373 - protein, 9 aa, Homo Sapiens
GTIFIIKGV

SEQ ID NO: 15374 - protein, 9 aa, Homo Sapiens
GTIGLIHAI

SEQ ID NO: 15375 - protein, 9 aa, Homo Sapiens
GTIGLIHAV

SEQ ID NO: 15376 - protein, 9 aa, Homo Sapiens
GTIKKFLSL

SEQ ID NO: 15377 - protein, 9 aa, Homo Sapiens
GTIKVLELV

SEQ ID NO: 15378 - protein, 9 aa, Homo Sapiens
GTITQVIKV

SEQ ID NO: 15379 - protein, 9 aa, Homo Sapiens
GTITTFEHA

SEQ ID NO: 15380 - protein, 9 aa, Homo Sapiens
GTPEKVFTV

SEQ ID NO: 15381 - protein, 9 aa, Homo Sapiens
GTVDKLCRV

SEQ ID NO: 15382 - protein, 9 aa, Homo Sapiens
GTVRFFNSV

SEQ ID NO: 15383 - protein, 9 aa, Homo Sapiens
GTYTGFIKV

SEQ ID NO: 15384 - protein, 9 aa, Homo Sapiens
GVADIIDCV

SEQ ID NO: 15385 - protein, 9 aa, Homo Sapiens
GVAPGFQVV

SEQ ID NO: 15386 - protein, 9 aa, Homo Sapiens
GVARHFNYV

SEQ ID NO: 15387 - protein, 9 aa, Homo Sapiens
GVARLFTKV

SEQ ID NO: 15388 - protein, 9 aa, Homo Sapiens
GVCKEVFQL

SEQ ID NO: 15389 - protein, 9 aa, Homo Sapiens
GVDVTLPRV

SEQ ID NO: 15390 - protein, 9 aa, Homo Sapiens
GVGPVPARA

SEQ ID NO: 15391 - protein, 9 aa, Homo Sapiens
GVHGNFPRL

SEQ ID NO: 15392 - protein, 9 aa, Homo Sapiens
GVIDACIKL

SEQ ID NO: 15393 - protein, 9 aa, Homo Sapiens
GVIDACVKL

SEQ ID NO: 15394 - protein, 9 aa, Homo Sapiens
GVIEKLLTS

SEQ ID NO: 15395 - protein, 9 aa, Homo Sapiens
GVIGKFIYA

SEQ ID NO: 15396 - protein, 9 aa, Homo Sapiens
GVIKRTENV

SEQ ID NO: 15397 - protein, 9 aa, Homo Sapiens
GVINRVEKI

SEQ ID NO: 15398 - protein, 9 aa, Homo Sapiens
GVINSFVHV

SEQ ID NO: 15399 - protein, 9 aa, Homo Sapiens
GVIPTLVKL

SEQ ID NO: 15400 - protein, 9 aa, Homo Sapiens
GVKEKFTMV

SEQ ID NO: 15401 - protein, 9 aa, Homo Sapiens
GVLDKLRSV

SEQ ID NO: 15402 - protein, 9 aa, Homo Sapiens
GVLDTLTKV

SEQ ID NO: 15403 - protein, 9 aa, Homo Sapiens
GVLIKLFCV

SEQ ID NO: 15404 - protein, 9 aa, Homo Sapiens
GVLPNIQAV

SEQ ID NO: 15405 - protein, 9 aa, Homo Sapiens
GVLPQLSMV

SEQ ID NO: 15406 - protein, 9 aa, Homo Sapiens
GVMYGFKGV

SEQ ID NO: 15407 - protein, 9 aa, Homo Sapiens
GVPARLPAV

SEQ ID NO: 15408 - protein, 9 aa, Homo Sapiens
GVPELLQKI

SEQ ID NO: 15409 - protein, 9 aa, Homo Sapiens
GVPEWFHGA

SEQ ID NO: 15410 - protein, 9 aa, Homo Sapiens
GVPQALFGV

SEQ ID NO: 15411 - protein, 9 aa, Homo Sapiens
GVPRTFKEI

SEQ ID NO: 15412 - protein, 9 aa, Homo Sapiens
GVPTKVFNV

SEQ ID NO: 15413 - protein, 9 aa, Homo Sapiens
GVPVTITSV

SEQ ID NO: 15414 - protein, 9 aa, Homo Sapiens
GVSDVDYSL

SEQ ID NO: 15415 - protein, 9 aa, Homo Sapiens
GVVEKLSVL

SEQ ID NO: 15416 - protein, 9 aa, Homo Sapiens
GVVGEVTQV

SEQ ID NO: 15417 - protein, 9 aa, Homo Sapiens
GVVIHLPGL

SEQ ID NO: 15418 - protein, 9 aa, Homo Sapiens
GVVPQLVKL

SEQ ID NO: 15419 - protein, 9 aa, Homo Sapiens
GVVPTIQKV

SEQ ID NO: 15420 - protein, 9 aa, Homo Sapiens
GVYGDVHRV

SEQ ID NO: 15421 - protein, 9 aa, Homo Sapiens
HALGLLYHV

SEQ ID NO: 15422 - protein, 9 aa, Homo Sapiens
HAVGDIPGV

SEQ ID NO: 15423 - protein, 9 aa, Homo Sapiens
HIIENIVAV

SEQ ID NO: 15424 - protein, 9 aa, Homo Sapiens
HILKDVSGV

SEQ ID NO: 15425 - protein, 9 aa, Homo Sapiens
HIMPTVHTV

SEQ ID NO: 15426 - protein, 9 aa, Homo Sapiens
HIPDVITYL

SEQ ID NO: 15427 - protein, 9 aa, Homo Sapiens
HIPNIFQKI

SEQ ID NO: 15428 - protein, 9 aa, Homo Sapiens
HLAIKLEQV

SEQ ID NO: 15429 - protein, 9 aa, Homo Sapiens
HLANIVERV

SEQ ID NO: 15430 - protein, 9 aa, Homo Sapiens
HLFRKFHYL

SEQ ID NO: 15431 - protein, 9 aa, Homo Sapiens
HLIGDFSKV

SEQ ID NO: 15432 - protein, 9 aa, Homo Sapiens
HLIHEVTKV

SEQ ID NO: 15433 - protein, 9 aa, Homo Sapiens
HLLERVDQV

SEQ ID NO: 15434 - protein, 9 aa, Homo Sapiens
HLPEELAEL

SEQ ID NO: 15435 - protein, 9 aa, Homo Sapiens
HLPPTFHAV

SEQ ID NO: 15436 - protein, 9 aa, Homo Sapiens
HLPSDFTPA

SEQ ID NO: 15437 - protein, 9 aa, Homo Sapiens
HLVPEVPTV

SEQ ID NO: 15438 - protein, 9 aa, Homo Sapiens
HMAKAFKEV

SEQ ID NO: 15439 - protein, 9 aa, Homo Sapiens
HMVTHFIQA

SEQ ID NO: 15440 - protein, 9 aa, Homo Sapiens
HQDGIHILV

SEQ ID NO: 15441 - protein, 9 aa, Homo Sapiens
HQFESSFEL

SEQ ID NO: 15442 - protein, 9 aa, Homo Sapiens
HQHEYFFLI

SEQ ID NO: 15443 - protein, 9 aa, Homo Sapiens
HQIDLIVQL

SEQ ID NO: 15444 - protein, 9 aa, Homo Sapiens
HQILTPFLL

SEQ ID NO: 15445 - protein, 9 aa, Homo Sapiens
HQLALISQL

SEQ ID NO: 15446 - protein, 9 aa, Homo Sapiens
HQLNICSKV

SEQ ID NO: 15447 - protein, 9 aa, Homo Sapiens
HQTQVSQRL

SEQ ID NO: 15448 - protein, 9 aa, Homo Sapiens
HQVPAVSSV

SEQ ID NO: 15449 - protein, 9 aa, Homo Sapiens
HSIPVTVEV

SEQ ID NO: 15450 - protein, 9 aa, Homo Sapiens
HTAQKFFTV

SEQ ID NO: 15451 - protein, 9 aa, Homo Sapiens
HTCLHLASI

SEQ ID NO: 15452 - protein, 9 aa, Homo Sapiens
HTIDTILTV

SEQ ID NO: 15453 - protein, 9 aa, Homo Sapiens
HTILIVEKV

SEQ ID NO: 15454 - protein, 9 aa, Homo Sapiens
HTPQNLITV

SEQ ID NO: 15455 - protein, 9 aa, Homo Sapiens
HTVEDLVKV

SEQ ID NO: 15456 - protein, 9 aa, Homo Sapiens
HTVGELIEV

SEQ ID NO: 15457 - protein, 9 aa, Homo Sapiens
HVESKVYAV

SEQ ID NO: 15458 - protein, 9 aa, Homo Sapiens
HVICVTPKL

SEQ ID NO: 15459 - protein, 9 aa, Homo Sapiens
HVIEALRRA

SEQ ID NO: 15460 - protein, 9 aa, Homo Sapiens
HVIEKMHHV

SEQ ID NO: 15461 - protein, 9 aa, Homo Sapiens
HVIENLHAA

SEQ ID NO: 15462 - protein, 9 aa, Homo Sapiens
HVIKYLETL

SEQ ID NO: 15463 - protein, 9 aa, Homo Sapiens
HVIQALESL

SEQ ID NO: 15464 - protein, 9 aa, Homo Sapiens
HVLDTLIQL

SEQ ID NO: 15465 - protein, 9 aa, Homo Sapiens
HVLDVIHEV

SEQ ID NO: 15466 - protein, 9 aa, Homo Sapiens
HVLEEVQQV

SEQ ID NO: 15467 - protein, 9 aa, Homo Sapiens
HVLKQLERV

SEQ ID NO: 15468 - protein, 9 aa, Homo Sapiens
HVLPGVCQV

SEQ ID NO: 15469 - protein, 9 aa, Homo Sapiens
HVPAAVPLV

SEQ ID NO: 15470 - protein, 9 aa, Homo Sapiens
HVVDFFNRV

SEQ ID NO: 15471 - protein, 9 aa, Homo Sapiens
HVVEILVET

SEQ ID NO: 15472 - protein, 9 aa, Homo Sapiens
HVVERLFEI

SEQ ID NO: 15473 - protein, 9 aa, Homo Sapiens
HVVHQIPAV

SEQ ID NO: 15474 - protein, 9 aa, Homo Sapiens
HVYDLFEKA

SEQ ID NO: 15475 - protein, 9 aa, Homo Sapiens
IADDADPRV

SEQ ID NO: 15476 - protein, 9 aa, Homo Sapiens
IASPVIAAV

SEQ ID NO: 15477 - protein, 9 aa, Homo Sapiens
IDDKGTIKL

SEQ ID NO: 15478 - protein, 9 aa, Homo Sapiens
IIDGKIFCV

SEQ ID NO: 15479 - protein, 9 aa, Homo Sapiens
IIINHVISV

SEQ ID NO: 15480 - protein, 9 aa, Homo Sapiens
IIIPEIQKV

SEQ ID NO: 15481 - protein, 9 aa, Homo Sapiens
IILDEAHNV

SEQ ID NO: 15482 - protein, 9 aa, Homo Sapiens
IILDEIHLL

SEQ ID NO: 15483 - protein, 9 aa, Homo Sapiens
IILPEDIEL

SEQ ID NO: 15484 - protein, 9 aa, Homo Sapiens
IIPDKVWAV

SEQ ID NO: 15485 - protein, 9 aa, Homo Sapiens
IIQQAFINV

SEQ ID NO: 15486 - protein, 9 aa, Homo Sapiens
IISQVDAKV

SEQ ID NO: 15487 - protein, 9 aa, Homo Sapiens
IITDLLRSV

SEQ ID NO: 15488 - protein, 9 aa, Homo Sapiens
IITKDLFQV

SEQ ID NO: 15489 - protein, 9 aa, Homo Sapiens
IIVKEVCTV

SEQ ID NO: 15490 - protein, 9 aa, Homo Sapiens
IIVSIVHSV

SEQ ID NO: 15491 - protein, 9 aa, Homo Sapiens
ILDKKVEKV

SEQ ID NO: 15492 - protein, 9 aa, Homo Sapiens
ILDQKINEV

SEQ ID NO: 15493 - protein, 9 aa, Homo Sapiens
ILEKKVEKV

SEQ ID NO: 15494 - protein, 9 aa, Homo Sapiens
ILIPVLDRI

SEQ ID NO: 15495 - protein, 9 aa, Homo Sapiens
ILISKLLGA

SEQ ID NO: 15496 - protein, 9 aa, Homo Sapiens
ILLAELEQL

SEQ ID NO: 15497 - protein, 9 aa, Homo Sapiens
ILLAEVDKV

SEQ ID NO: 15498 - protein, 9 aa, Homo Sapiens
ILLAEVPTM

SEQ ID NO: 15499 - protein, 9 aa, Homo Sapiens
ILLDQTVRV

SEQ ID NO: 15500 - protein, 9 aa, Homo Sapiens
ILLKDILSV

SEQ ID NO: 15501 - protein, 9 aa, Homo Sapiens
ILMEHIHKL

SEQ ID NO: 15502 - protein, 9 aa, Homo Sapiens
ILPDDLPEL

SEQ ID NO: 15503 - protein, 9 aa, Homo Sapiens
ILPEELQTL

SEQ ID NO: 15504 - protein, 9 aa, Homo Sapiens
ILPEKVARV

SEQ ID NO: 15505 - protein, 9 aa, Homo Sapiens
ILPSNLLTV

SEQ ID NO: 15506 - protein, 9 aa, Homo Sapiens
ILQDRLNQV

SEQ ID NO: 15507 - protein, 9 aa, Homo Sapiens
ILRAILEVL

SEQ ID NO: 15508 - protein, 9 aa, Homo Sapiens
ILTDITKGV

SEQ ID NO: 15509 - protein, 9 aa, Homo Sapiens
ILYDKLEKI

SEQ ID NO: 15510 - protein, 9 aa, Homo Sapiens
IMLEALERV

SEQ ID NO: 15511 - protein, 9 aa, Homo Sapiens
IQAERVRGV

SEQ ID NO: 15512 - protein, 9 aa, Homo Sapiens
IQDKCVPLV

SEQ ID NO: 15513 - protein, 9 aa, Homo Sapiens
IQEAVYKNV

SEQ ID NO: 15514 - protein, 9 aa, Homo Sapiens
IQHDLIFSL

SEQ ID NO: 15515 - protein, 9 aa, Homo Sapiens
IQHSEFEEV

SEQ ID NO: 15516 - protein, 9 aa, Homo Sapiens
IQIMKVEEI

SEQ ID NO: 15517 - protein, 9 aa, Homo Sapiens
IQLEHLNIV

SEQ ID NO: 15518 - protein, 9 aa, Homo Sapiens
IQLNGRYYL

SEQ ID NO: 15519 - protein, 9 aa, Homo Sapiens
IQLPSVNTV

SEQ ID NO: 15520 - protein, 9 aa, Homo Sapiens
IQPDNIVYV

SEQ ID NO: 15521 - protein, 9 aa, Homo Sapiens
IQTAVRLLL

SEQ ID NO: 15522 - protein, 9 aa, Homo Sapiens
IQTELQETV

SEQ ID NO: 15523 - protein, 9 aa, Homo Sapiens
IQTLVKEGL

SEQ ID NO: 15524 - protein, 9 aa, Homo Sapiens
IQVQVFEKL

SEQ ID NO: 15525 - protein, 9 aa, Homo Sapiens
IQVTKVTQV

SEQ ID NO: 15526 - protein, 9 aa, Homo Sapiens
IQWDKSMCV

SEQ ID NO: 15527 - protein, 9 aa, Homo Sapiens
IQYDKTNVL

SEQ ID NO: 15528 - protein, 9 aa, Homo Sapiens
IQYIRPVFV

SEQ ID NO: 15529 - protein, 9 aa, Homo Sapiens
ISDRPSLSV

SEQ ID NO: 15530 - protein, 9 aa, Homo Sapiens
ISTEVNPKL

SEQ ID NO: 15531 - protein, 9 aa, Homo Sapiens
ITAPIEAQV

SEQ ID NO: 15532 - protein, 9 aa, Homo Sapiens
ITDPANEKL

SEQ ID NO: 15533 - protein, 9 aa, Homo Sapiens
ITEKWLPEI

SEQ ID NO: 15534 - protein, 9 aa, Homo Sapiens
ITFESIEKA

SEQ ID NO: 15535 - protein, 9 aa, Homo Sapiens
ITINDIVHV

SEQ ID NO: 15536 - protein, 9 aa, Homo Sapiens
ITPDEFHFV

SEQ ID NO: 15537 - protein, 9 aa, Homo Sapiens
ITPENLPQI

SEQ ID NO: 15538 - protein, 9 aa, Homo Sapiens
ITPGGFSSV

SEQ ID NO: 15539 - protein, 9 aa, Homo Sapiens
ITPQKLPSL

SEQ ID NO: 15540 - protein, 9 aa, Homo Sapiens
ITPQTIHGV

SEQ ID NO: 15541 - protein, 9 aa, Homo Sapiens
ITTDVLYTI

SEQ ID NO: 15542 - protein, 9 aa, Homo Sapiens
ITVEKIIKI

SEQ ID NO: 15543 - protein, 9 aa, Homo Sapiens
ITVKGLEVV

SEQ ID NO: 15544 - protein, 9 aa, Homo Sapiens
IVAESLQQV

SEQ ID NO: 15545 - protein, 9 aa, Homo Sapiens
IVAPGTFEV

SEQ ID NO: 15546 - protein, 9 aa, Homo Sapiens
IVDQTNVKL

SEQ ID NO: 15547 - protein, 9 aa, Homo Sapiens
IVHSVFEFL

SEQ ID NO: 15548 - protein, 9 aa, Homo Sapiens
IVIDGLREL

SEQ ID NO: 15549 - protein, 9 aa, Homo Sapiens
IVIGIIKTV

SEQ ID NO: 15550 - protein, 9 aa, Homo Sapiens
IVIGVLHQL

SEQ ID NO: 15551 - protein, 9 aa, Homo Sapiens
IVIRGLNTI

SEQ ID NO: 15552 - protein, 9 aa, Homo Sapiens
IVISKLTQI

SEQ ID NO: 15553 - protein, 9 aa, Homo Sapiens
IVLDRLIEL

SEQ ID NO: 15554 - protein, 9 aa, Homo Sapiens
IVLDRVPAF

SEQ ID NO: 15555 - protein, 9 aa, Homo Sapiens
IVLPEDLQL

SEQ ID NO: 15556 - protein, 9 aa, Homo Sapiens
IVMEHVVFL

SEQ ID NO: 15557 - protein, 9 aa, Homo Sapiens
IVMQEVETV

SEQ ID NO: 15558 - protein, 9 aa, Homo Sapiens
IVNWVNETL

SEQ ID NO: 15559 - protein, 9 aa, Homo Sapiens
IVPATLPQL

SEQ ID NO: 15560 - protein, 9 aa, Homo Sapiens
IVTEELIVV

SEQ ID NO: 15561 - protein, 9 aa, Homo Sapiens
IVVGRITEV

SEQ ID NO: 15562 - protein, 9 aa, Homo Sapiens
IVWQEDPRL

SEQ ID NO: 15563 - protein, 9 aa, Homo Sapiens
KAIDIYEQV

SEQ ID NO: 15564 - protein, 9 aa, Homo Sapiens
KAIEVLLTL

SEQ ID NO: 15565 - protein, 9 aa, Homo Sapiens
KAIGSLKEV

SEQ ID NO: 15566 - protein, 9 aa, Homo Sapiens
KAISGVHTV

SEQ ID NO: 15567 - protein, 9 aa, Homo Sapiens
KALAKLDHV

SEQ ID NO: 15568 - protein, 9 aa, Homo Sapiens
KALDKIAEI

SEQ ID NO: 15569 - protein, 9 aa, Homo Sapiens
KALESIEYV

SEQ ID NO: 15570 - protein, 9 aa, Homo Sapiens
KALETLRQV

SEQ ID NO: 15571 - protein, 9 aa, Homo Sapiens
KALQFLEEV

SEQ ID NO: 15572 - protein, 9 aa, Homo Sapiens
KAMDDTFYL

SEQ ID NO: 15573 - protein, 9 aa, Homo Sapiens
KATGKLFAV

SEQ ID NO: 15574 - protein, 9 aa, Homo Sapiens
KAVDIVKQV

SEQ ID NO: 15575 - protein, 9 aa, Homo Sapiens
KAVELLVEL

SEQ ID NO: 15576 - protein, 9 aa, Homo Sapiens
KAVHVIYTV

SEQ ID NO: 15577 - protein, 9 aa, Homo Sapiens
KICDYLFNV

SEQ ID NO: 15578 - protein, 9 aa, Homo Sapiens
KICEVDLVI

SEQ ID NO: 15579 - protein, 9 aa, Homo Sapiens
KIEKELETV

SEQ ID NO: 15580 - protein, 9 aa, Homo Sapiens
KIFEDIPTL

SEQ ID NO: 15581 - protein, 9 aa, Homo Sapiens
KIFHINPRL

SEQ ID NO: 15582 - protein, 9 aa, Homo Sapiens
KIFPALCTV

SEQ ID NO: 15583 - protein, 9 aa, Homo Sapiens
KIHSSFRSL

SEQ ID NO: 15584 - protein, 9 aa, Homo Sapiens
KIIDFIYTA

SEQ ID NO: 15585 - protein, 9 aa, Homo Sapiens
KIIDIQEKV

SEQ ID NO: 15586 - protein, 9 aa, Homo Sapiens
KIIGIMEEV

SEQ ID NO: 15587 - protein, 9 aa, Homo Sapiens
KILAAILHL

SEQ ID NO: 15588 - protein, 9 aa, Homo Sapiens
KILDLETQL

SEQ ID NO: 15589 - protein, 9 aa, Homo Sapiens
KILDVLEEI

SEQ ID NO: 15590 - protein, 9 aa, Homo Sapiens
KILEDVVGV

SEQ ID NO: 15591 - protein, 9 aa, Homo Sapiens
KILEELQKV

SEQ ID NO: 15592 - protein, 9 aa, Homo Sapiens
KILETLYTL

SEQ ID NO: 15593 - protein, 9 aa, Homo Sapiens
KILPDLNTV

SEQ ID NO: 15594 - protein, 9 aa, Homo Sapiens
KILPTLEAV

SEQ ID NO: 15595 - protein, 9 aa, Homo Sapiens
KILPVMVTL

SEQ ID NO: 15596 - protein, 9 aa, Homo Sapiens
KILQELPSV

SEQ ID NO: 15597 - protein, 9 aa, Homo Sapiens
KILSELFTV

SEQ ID NO: 15598 - protein, 9 aa, Homo Sapiens
KILTKLLEV

SEQ ID NO: 15599 - protein, 9 aa, Homo Sapiens
KIMEAMEKL

SEQ ID NO: 15600 - protein, 9 aa, Homo Sapiens
KIPQVLVKL

SEQ ID NO: 15601 - protein, 9 aa, Homo Sapiens
KIQEILTQV

SEQ ID NO: 15602 - protein, 9 aa, Homo Sapiens
KITEDFRAL

SEQ ID NO: 15603 - protein, 9 aa, Homo Sapiens
KIVDFSYSV

SEQ ID NO: 15604 - protein, 9 aa, Homo Sapiens
KIVKWDRDM

SEQ ID NO: 15605 - protein, 9 aa, Homo Sapiens
KIVPVEITI

SEQ ID NO: 15606 - protein, 9 aa, Homo Sapiens
KIYEGAYHV

SEQ ID NO: 15607 - protein, 9 aa, Homo Sapiens
KIYEGQVEV

SEQ ID NO: 15608 - protein, 9 aa, Homo Sapiens
KLAPPLVTL

SEQ ID NO: 15609 - protein, 9 aa, Homo Sapiens
KLCDIIVHI

SEQ ID NO: 15610 - protein, 9 aa, Homo Sapiens
KLFEKVKEV

SEQ ID NO: 15611 - protein, 9 aa, Homo Sapiens
KLFNEFIQL

SEQ ID NO: 15612 - protein, 9 aa, Homo Sapiens
KLHEYFPEM

SEQ ID NO: 15613 - protein, 9 aa, Homo Sapiens
KLHGVNINV

SEQ ID NO: 15614 - protein, 9 aa, Homo Sapiens
KLHLGFIEI

SEQ ID NO: 15615 - protein, 9 aa, Homo Sapiens
KLHPHFAKV

SEQ ID NO: 15616 - protein, 9 aa, Homo Sapiens
KLHVDFRNV

SEQ ID NO: 15617 - protein, 9 aa, Homo Sapiens
KLIDDVHRL

SEQ ID NO: 15618 - protein, 9 aa, Homo Sapiens
KLIDRTESL

SEQ ID NO: 15619 - protein, 9 aa, Homo Sapiens
KLIEELETL

SEQ ID NO: 15620 - protein, 9 aa, Homo Sapiens
KLILLITQV

SEQ ID NO: 15621 - protein, 9 aa, Homo Sapiens
KLIPFLEKL

SEQ ID NO: 15622 - protein, 9 aa, Homo Sapiens
KLIPQLPTL

SEQ ID NO: 15623 - protein, 9 aa, Homo Sapiens
KLIQNVFEI

SEQ ID NO: 15624 - protein, 9 aa, Homo Sapiens
KLISELQKL

SEQ ID NO: 15625 - protein, 9 aa, Homo Sapiens
KLITSFLEL

SEQ ID NO: 15626 - protein, 9 aa, Homo Sapiens
KLLDQMPSL

SEQ ID NO: 15627 - protein, 9 aa, Homo Sapiens
KLLDVVHPA

SEQ ID NO: 15628 - protein, 9 aa, Homo Sapiens
KLLEPVLLL

SEQ ID NO: 15629 - protein, 9 aa, Homo Sapiens
KLLERVSAI

SEQ ID NO: 15630 - protein, 9 aa, Homo Sapiens
KLLEYIEEI

SEQ ID NO: 15631 - protein, 9 aa, Homo Sapiens
KLLFWVTEV

SEQ ID NO: 15632 - protein, 9 aa, Homo Sapiens
KLLGELHTL

SEQ ID NO: 15633 - protein, 9 aa, Homo Sapiens
KLLGNIKNV

SEQ ID NO: 15634 - protein, 9 aa, Homo Sapiens
KLLKDLPEL

SEQ ID NO: 15635 - protein, 9 aa, Homo Sapiens
KLLKLFQGV

SEQ ID NO: 15636 - protein, 9 aa, Homo Sapiens
KLLPQLTYL

SEQ ID NO: 15637 - protein, 9 aa, Homo Sapiens
KLLSKFYEL

SEQ ID NO: 15638 - protein, 9 aa, Homo Sapiens
KLLTEVHAA

SEQ ID NO: 15639 - protein, 9 aa, Homo Sapiens
KLMDHIYAV

SEQ ID NO: 15640 - protein, 9 aa, Homo Sapiens
KLMELLEEI

SEQ ID NO: 15641 - protein, 9 aa, Homo Sapiens
KLPEKWESV

SEQ ID NO: 15642 - protein, 9 aa, Homo Sapiens
KLPSNLPQL

SEQ ID NO: 15643 - protein, 9 aa, Homo Sapiens
KLVDCIIEV

SEQ ID NO: 15644 - protein, 9 aa, Homo Sapiens
KLVEYIVKA

SEQ ID NO: 15645 - protein, 9 aa, Homo Sapiens
KLVGEFLEV

SEQ ID NO: 15646 - protein, 9 aa, Homo Sapiens
KLVKEVIAV

SEQ ID NO: 15647 - protein, 9 aa, Homo Sapiens
KLVTTVTEI

SEQ ID NO: 15648 - protein, 9 aa, Homo Sapiens
KLYTDFDEI

SEQ ID NO: 15649 - protein, 9 aa, Homo Sapiens
KMAEMLVEL

SEQ ID NO: 15650 - protein, 9 aa, Homo Sapiens
KMAPALRKV

SEQ ID NO: 15651 - protein, 9 aa, Homo Sapiens
KMLEKLPEL

SEQ ID NO: 15652 - protein, 9 aa, Homo Sapiens
KMMDVTVTI

SEQ ID NO: 15653 - protein, 9 aa, Homo Sapiens
KMNEKLYTV

SEQ ID NO: 15654 - protein, 9 aa, Homo Sapiens
KMPDDVWLV

SEQ ID NO: 15655 - protein, 9 aa, Homo Sapiens
KQADPFASL

SEQ ID NO: 15656 - protein, 9 aa, Homo Sapiens
KQAEIVKRL

SEQ ID NO: 15657 - protein, 9 aa, Homo Sapiens
KQDSLVINL

SEQ ID NO: 15658 - protein, 9 aa, Homo Sapiens
KQFEGTVEI

SEQ ID NO: 15659 - protein, 9 aa, Homo Sapiens
KQFEKQVEL

SEQ ID NO: 15660 - protein, 9 aa, Homo Sapiens
KQFELALQL

SEQ ID NO: 15661 - protein, 9 aa, Homo Sapiens
KQHGVNVSV

SEQ ID NO: 15662 - protein, 9 aa, Homo Sapiens
KQIDPVLQV

SEQ ID NO: 15663 - protein, 9 aa, Homo Sapiens
KQIDQFLVV

SEQ ID NO: 15664 - protein, 9 aa, Homo Sapiens
KQIDVYRSV

SEQ ID NO: 15665 - protein, 9 aa, Homo Sapiens
KQIETGPFL

SEQ ID NO: 15666 - protein, 9 aa, Homo Sapiens
KQIQEDWEL

SEQ ID NO: 15667 - protein, 9 aa, Homo Sapiens
KQLDDLKGA

SEQ ID NO: 15668 - protein, 9 aa, Homo Sapiens
KQLDENISL

SEQ ID NO: 15669 - protein, 9 aa, Homo Sapiens
KQLEDGRTL

SEQ ID NO: 15670 - protein, 9 aa, Homo Sapiens
KQLEEAIQL

SEQ ID NO: 15671 - protein, 9 aa, Homo Sapiens
KQLEVVHTL

SEQ ID NO: 15672 - protein, 9 aa, Homo Sapiens
KQLNFLTKL

SEQ ID NO: 15673 - protein, 9 aa, Homo Sapiens
KQLNHFWEI

SEQ ID NO: 15674 - protein, 9 aa, Homo Sapiens
KQMDHFVGL

SEQ ID NO: 15675 - protein, 9 aa, Homo Sapiens
KQMSISTGL

SEQ ID NO: 15676 - protein, 9 aa, Homo Sapiens
KQPRWMETV

SEQ ID NO: 15677 - protein, 9 aa, Homo Sapiens
KQQDHFFQA

SEQ ID NO: 15678 - protein, 9 aa, Homo Sapiens
KQTDLEITV

SEQ ID NO: 15679 - protein, 9 aa, Homo Sapiens
KQTEIAKRL

SEQ ID NO: 15680 - protein, 9 aa, Homo Sapiens
KQVEAGVCV

SEQ ID NO: 15681 - protein, 9 aa, Homo Sapiens
KQVEEIFNL

SEQ ID NO: 15682 - protein, 9 aa, Homo Sapiens
KQYGNEVFL

SEQ ID NO: 15683 - protein, 9 aa, Homo Sapiens
KSIDTFFGV

SEQ ID NO: 15684 - protein, 9 aa, Homo Sapiens
KSLSVVTEV

SEQ ID NO: 15685 - protein, 9 aa, Homo Sapiens
KSMESFLKV

SEQ ID NO: 15686 - protein, 9 aa, Homo Sapiens
KTAEFLSKL

SEQ ID NO: 15687 - protein, 9 aa, Homo Sapiens
KTAEMNEKL

SEQ ID NO: 15688 - protein, 9 aa, Homo Sapiens
KTAENFRAL

SEQ ID NO: 15689 - protein, 9 aa, Homo Sapiens
KTAVAIEKV

SEQ ID NO: 15690 - protein, 9 aa, Homo Sapiens
KTFEGFCAL

SEQ ID NO: 15691 - protein, 9 aa, Homo Sapiens
KTFNLIPAV

SEQ ID NO: 15692 - protein, 9 aa, Homo Sapiens
KTGEVLHEV

SEQ ID NO: 15693 - protein, 9 aa, Homo Sapiens
KTIDAMKRV

SEQ ID NO: 15694 - protein, 9 aa, Homo Sapiens
KTIDGILLL

SEQ ID NO: 15695 - protein, 9 aa, Homo Sapiens
KTIENFLVV

SEQ ID NO: 15696 - protein, 9 aa, Homo Sapiens
KTIETSPSL

SEQ ID NO: 15697 - protein, 9 aa, Homo Sapiens
KTLEGEFSV

SEQ ID NO: 15698 - protein, 9 aa, Homo Sapiens
KTLERSYLL

SEQ ID NO: 15699 - protein, 9 aa, Homo Sapiens
KTLGKLWRL

SEQ ID NO: 15700 - protein, 9 aa, Homo Sapiens
KTLPNAICV

SEQ ID NO: 15701 - protein, 9 aa, Homo Sapiens
KTLPVAFKV

SEQ ID NO: 15702 - protein, 9 aa, Homo Sapiens
KTMTDTYLL

SEQ ID NO: 15703 - protein, 9 aa, Homo Sapiens
KTNVKFLAI

SEQ ID NO: 15704 - protein, 9 aa, Homo Sapiens
KTTTIAVEV

SEQ ID NO: 15705 - protein, 9 aa, Homo Sapiens
KTVLELQYV

SEQ ID NO: 15706 - protein, 9 aa, Homo Sapiens
KTVPLLSKV

SEQ ID NO: 15707 - protein, 9 aa, Homo Sapiens
KVADGFKVV

SEQ ID NO: 15708 - protein, 9 aa, Homo Sapiens
KVADGLVKV

SEQ ID NO: 15709 - protein, 9 aa, Homo Sapiens
KVAEKLEAL

SEQ ID NO: 15710 - protein, 9 aa, Homo Sapiens
KVAELFEKL

SEQ ID NO: 15711 - protein, 9 aa, Homo Sapiens
KVASLLHQV

SEQ ID NO: 15712 - protein, 9 aa, Homo Sapiens
KVDENFDCV

SEQ ID NO: 15713 - protein, 9 aa, Homo Sapiens
KVEETFQCI

SEQ ID NO: 15714 - protein, 9 aa, Homo Sapiens
KVEGVLASV

SEQ ID NO: 15715 - protein, 9 aa, Homo Sapiens
KVFDYDFGL

SEQ ID NO: 15716 - protein, 9 aa, Homo Sapiens
KVFGNEIKL

SEQ ID NO: 15717 - protein, 9 aa, Homo Sapiens
KVIDEIYRV

SEQ ID NO: 15718 - protein, 9 aa, Homo Sapiens
KVIDGLETL

SEQ ID NO: 15719 - protein, 9 aa, Homo Sapiens
KVIDTQQKV

SEQ ID NO: 15720 - protein, 9 aa, Homo Sapiens
KVIDYVPGI

SEQ ID NO: 15721 - protein, 9 aa, Homo Sapiens
KVIEINPYL

SEQ ID NO: 15722 - protein, 9 aa, Homo Sapiens
KVIESFIKA

SEQ ID NO: 15723 - protein, 9 aa, Homo Sapiens
KVIESTQDL

SEQ ID NO: 15724 - protein, 9 aa, Homo Sapiens
KVIEVFIRA

SEQ ID NO: 15725 - protein, 9 aa, Homo Sapiens
KVIKILITI

SEQ ID NO: 15726 - protein, 9 aa, Homo Sapiens
KVIKTLTEI

SEQ ID NO: 15727 - protein, 9 aa, Homo Sapiens
KVIVRFLTV

SEQ ID NO: 15728 - protein, 9 aa, Homo Sapiens
KVIYVLPML

SEQ ID NO: 15729 - protein, 9 aa, Homo Sapiens
KVKEFFEKL

SEQ ID NO: 15730 - protein, 9 aa, Homo Sapiens
KVLDFEHFL

SEQ ID NO: 15731 - protein, 9 aa, Homo Sapiens
KVLDILQHI

SEQ ID NO: 15732 - protein, 9 aa, Homo Sapiens
KVLDLKINL

SEQ ID NO: 15733 - protein, 9 aa, Homo Sapiens
KVLDLRINL

SEQ ID NO: 15734 - protein, 9 aa, Homo Sapiens
KVLDVLWEL

SEQ ID NO: 15735 - protein, 9 aa, Homo Sapiens
KVLEGMEVV

SEQ ID NO: 15736 - protein, 9 aa, Homo Sapiens
KVLEHVPLL

SEQ ID NO: 15737 - protein, 9 aa, Homo Sapiens
KVLEILHRV

SEQ ID NO: 15738 - protein, 9 aa, Homo Sapiens
KVLELDPAL

SEQ ID NO: 15739 - protein, 9 aa, Homo Sapiens
KVLERVNAV

SEQ ID NO: 15740 - protein, 9 aa, Homo Sapiens
KVLGKIEKV

SEQ ID NO: 15741 - protein, 9 aa, Homo Sapiens
KVLNKVITV

SEQ ID NO: 15742 - protein, 9 aa, Homo Sapiens
KVLQGLIEV

SEQ ID NO: 15743 - protein, 9 aa, Homo Sapiens
KVLQHMKAV

SEQ ID NO: 15744 - protein, 9 aa, Homo Sapiens
KVMDEVEKA

SEQ ID NO: 15745 - protein, 9 aa, Homo Sapiens
KVMDVTEKL

SEQ ID NO: 15746 - protein, 9 aa, Homo Sapiens
KVMELLVHL

SEQ ID NO: 15747 - protein, 9 aa, Homo Sapiens
KVPDVLPVL

SEQ ID NO: 15748 - protein, 9 aa, Homo Sapiens
KVPEIEVTV

SEQ ID NO: 15749 - protein, 9 aa, Homo Sapiens
KVPEIISSI

SEQ ID NO: 15750 - protein, 9 aa, Homo Sapiens
KVPEWVDTV

SEQ ID NO: 15751 - protein, 9 aa, Homo Sapiens
KVPFSVPKI

SEQ ID NO: 15752 - protein, 9 aa, Homo Sapiens
KVTDDLVCL

SEQ ID NO: 15753 - protein, 9 aa, Homo Sapiens
KVTEAFDYL

SEQ ID NO: 15754 - protein, 9 aa, Homo Sapiens
KVVALVHAV

SEQ ID NO: 15755 - protein, 9 aa, Homo Sapiens
KVVDVDVKL

SEQ ID NO: 15756 - protein, 9 aa, Homo Sapiens
KVVDVVRNL

SEQ ID NO: 15757 - protein, 9 aa, Homo Sapiens
KVVEELTRI

SEQ ID NO: 15758 - protein, 9 aa, Homo Sapiens
KVVNIVPVI

SEQ ID NO: 15759 - protein, 9 aa, Homo Sapiens
KVVRVLEML

SEQ ID NO: 15760 - protein, 9 aa, Homo Sapiens
KVVSNLPAI

SEQ ID NO: 15761 - protein, 9 aa, Homo Sapiens
KVVSVLHHL

SEQ ID NO: 15762 - protein, 9 aa, Homo Sapiens
KVVTIIPKI

SEQ ID NO: 15763 - protein, 9 aa, Homo Sapiens
KVVVYLQKL

SEQ ID NO: 15764 - protein, 9 aa, Homo Sapiens
LAAARLAAA

SEQ ID NO: 15765 - protein, 9 aa, Homo Sapiens
LAAEFLKQV

SEQ ID NO: 15766 - protein, 9 aa, Homo Sapiens
LAAKHFIDV

SEQ ID NO: 15767 - protein, 9 aa, Homo Sapiens
LAIKDIPEV

SEQ ID NO: 15768 - protein, 9 aa, Homo Sapiens
LGCRVFTTV

SEQ ID NO: 15769 - protein, 9 aa, Homo Sapiens
LIDENDNKI

SEQ ID NO: 15770 - protein, 9 aa, Homo Sapiens
LIDEQILCV

SEQ ID NO: 15771 - protein, 9 aa, Homo Sapiens
LIGEFLEKV

SEQ ID NO: 15772 - protein, 9 aa, Homo Sapiens
LILDPIFKV

SEQ ID NO: 15773 - protein, 9 aa, Homo Sapiens
LILKDMVKV

SEQ ID NO: 15774 - protein, 9 aa, Homo Sapiens
LIPDIDLKL

SEQ ID NO: 15775 - protein, 9 aa, Homo Sapiens
LIPEYLNFI

SEQ ID NO: 15776 - protein, 9 aa, Homo Sapiens
LIYSGKLLL

SEQ ID NO: 15777 - protein, 9 aa, Homo Sapiens
LLDPSVFHV

SEQ ID NO: 15778 - protein, 9 aa, Homo Sapiens
LLDRFLATV

SEQ ID NO: 15779 - protein, 9 aa, Homo Sapiens
LLFSAFSRA

SEQ ID NO: 15780 - protein, 9 aa, Homo Sapiens
LLGPPPVGV

SEQ ID NO: 15781 - protein, 9 aa, Homo Sapiens
LLGPRLVLA

SEQ ID NO: 15782 - protein, 9 aa, Homo Sapiens
LLIDELNKL

SEQ ID NO: 15783 - protein, 9 aa, Homo Sapiens
LLIPGLATA

SEQ ID NO: 15784 - protein, 9 aa, Homo Sapiens
LLLEILHEI

SEQ ID NO: 15785 - protein, 9 aa, Homo Sapiens
LLLETLPEL

SEQ ID NO: 15786 - protein, 9 aa, Homo Sapiens
LLLKGVEAV

SEQ ID NO: 15787 - protein, 9 aa, Homo Sapiens
LLLPDVIKV

SEQ ID NO: 15788 - protein, 9 aa, Homo Sapiens
LLMEHIQEI

SEQ ID NO: 15789 - protein, 9 aa, Homo Sapiens
LLNEILEQV

SEQ ID NO: 15790 - protein, 9 aa, Homo Sapiens
LLPDEIADV

SEQ ID NO: 15791 - protein, 9 aa, Homo Sapiens
LLPDIVTCV

SEQ ID NO: 15792 - protein, 9 aa, Homo Sapiens
LLPDLIQKV

SEQ ID NO: 15793 - protein, 9 aa, Homo Sapiens
LLPDNFIAA

SEQ ID NO: 15794 - protein, 9 aa, Homo Sapiens
LLPDNVHYV

SEQ ID NO: 15795 - protein, 9 aa, Homo Sapiens
LLPEHFLFL

SEQ ID NO: 15796 - protein, 9 aa, Homo Sapiens
LLPHILPLL

SEQ ID NO: 15797 - protein, 9 aa, Homo Sapiens
LLPKAMIEV

SEQ ID NO: 15798 - protein, 9 aa, Homo Sapiens
LLPNAVYKV

SEQ ID NO: 15799 - protein, 9 aa, Homo Sapiens
LLQNNLPAV

SEQ ID NO: 15800 - protein, 9 aa, Homo Sapiens
LLTDGIMRV

SEQ ID NO: 15801 - protein, 9 aa, Homo Sapiens
LLVDEFLKV

SEQ ID NO: 15802 - protein, 9 aa, Homo Sapiens
LLVGVDEKL

SEQ ID NO: 15803 - protein, 9 aa, Homo Sapiens
LLVKELQSL

SEQ ID NO: 15804 - protein, 9 aa, Homo Sapiens
LMAHAMEEV

SEQ ID NO: 15805 - protein, 9 aa, Homo Sapiens
LMDHTIPEV

SEQ ID NO: 15806 - protein, 9 aa, Homo Sapiens
LMQTEVHHV

SEQ ID NO: 15807 - protein, 9 aa, Homo Sapiens
LMVDHVTEV

SEQ ID NO: 15808 - protein, 9 aa, Homo Sapiens
LQDDAHPTL

SEQ ID NO: 15809 - protein, 9 aa, Homo Sapiens
LQEDPPAGV

SEQ ID NO: 15810 - protein, 9 aa, Homo Sapiens
LQEDPPVGV

SEQ ID NO: 15811 - protein, 9 aa, Homo Sapiens
LQEEPVEGF

SEQ ID NO: 15812 - protein, 9 aa, Homo Sapiens
LQFDGIHVV

SEQ ID NO: 15813 - protein, 9 aa, Homo Sapiens
LQFDKAINA

SEQ ID NO: 15814 - protein, 9 aa, Homo Sapiens
LQLDKEFQL

SEQ ID NO: 15815 - protein, 9 aa, Homo Sapiens
LQLEAIHKV

SEQ ID NO: 15816 - protein, 9 aa, Homo Sapiens
LQLELHCQV

SEQ ID NO: 15817 - protein, 9 aa, Homo Sapiens
LQQEIYQTL

SEQ ID NO: 15818 - protein, 9 aa, Homo Sapiens
LQTEIKNQL

SEQ ID NO: 15819 - protein, 9 aa, Homo Sapiens
LQTPLDIRL

SEQ ID NO: 15820 - protein, 9 aa, Homo Sapiens
LQTSIREEI

SEQ ID NO: 15821 - protein, 9 aa, Homo Sapiens
LQWDKVLRL

SEQ ID NO: 15822 - protein, 9 aa, Homo Sapiens
LQYSFPLQL

SEQ ID NO: 15823 - protein, 9 aa, Homo Sapiens
LRLLHIEEL

SEQ ID NO: 15824 - protein, 9 aa, Homo Sapiens
LSLENLEKI

SEQ ID NO: 15825 - protein, 9 aa, Homo Sapiens
LSLIKDLGL

SEQ ID NO: 15826 - protein, 9 aa, Homo Sapiens
LTDPAIVKV

SEQ ID NO: 15827 - protein, 9 aa, Homo Sapiens
LTLTKIIEA

SEQ ID NO: 15828 - protein, 9 aa, Homo Sapiens
LTMEVIRQV

SEQ ID NO: 15829 - protein, 9 aa, Homo Sapiens
LTMPDTPRL

SEQ ID NO: 15830 - protein, 9 aa, Homo Sapiens
LTPDKIYHV

SEQ ID NO: 15831 - protein, 9 aa, Homo Sapiens
LTPEKFDKL

SEQ ID NO: 15832 - protein, 9 aa, Homo Sapiens
LTPERFHNL

SEQ ID NO: 15833 - protein, 9 aa, Homo Sapiens
LTPKLFHEV

SEQ ID NO: 15834 - protein, 9 aa, Homo Sapiens
LTPVRLPSI

SEQ ID NO: 15835 - protein, 9 aa, Homo Sapiens
LTTCISAHV

SEQ ID NO: 15836 - protein, 9 aa, Homo Sapiens
LTTEVHPEL

SEQ ID NO: 15837 - protein, 9 aa, Homo Sapiens
LVAPPLPAA

SEQ ID NO: 15838 - protein, 9 aa, Homo Sapiens
LVAVELEKV

SEQ ID NO: 15839 - protein, 9 aa, Homo Sapiens
LVDSNNPKI

SEQ ID NO: 15840 - protein, 9 aa, Homo Sapiens
LVHDLFQKV

SEQ ID NO: 15841 - protein, 9 aa, Homo Sapiens
LVIDAVREI

SEQ ID NO: 15842 - protein, 9 aa, Homo Sapiens
LVLDALMRV

SEQ ID NO: 15843 - protein, 9 aa, Homo Sapiens
LVLDKLFQL

SEQ ID NO: 15844 - protein, 9 aa, Homo Sapiens
LVPDVVNEV

SEQ ID NO: 15845 - protein, 9 aa, Homo Sapiens
LVPEFVHSI

SEQ ID NO: 15846 - protein, 9 aa, Homo Sapiens
LVPGHLDQV

SEQ ID NO: 15847 - protein, 9 aa, Homo Sapiens
LVSQYFQTV

SEQ ID NO: 15848 - protein, 9 aa, Homo Sapiens
LVVDWDHHL

SEQ ID NO: 15849 - protein, 9 aa, Homo Sapiens
LVYKNFPQL

SEQ ID NO: 15850 - protein, 9 aa, Homo Sapiens
MALGSDPRV

SEQ ID NO: 15851 - protein, 9 aa, Homo Sapiens
MGVDKIIPV

SEQ ID NO: 15852 - protein, 9 aa, Homo Sapiens
MIIENFEAL

SEQ ID NO: 15853 - protein, 9 aa, Homo Sapiens
MIIKLITSV

SEQ ID NO: 15854 - protein, 9 aa, Homo Sapiens
MIIPSLEEL

SEQ ID NO: 15855 - protein, 9 aa, Homo Sapiens
MILKNIEKI

SEQ ID NO: 15856 - protein, 9 aa, Homo Sapiens
MIPQIMPSI

SEQ ID NO: 15857 - protein, 9 aa, Homo Sapiens
MISLEIPQV

SEQ ID NO: 15858 - protein, 9 aa, Homo Sapiens
MITDVVPEV

SEQ ID NO: 15859 - protein, 9 aa, Homo Sapiens
MIWKGLIVL

SEQ ID NO: 15860 - protein, 9 aa, Homo Sapiens
MLHPIFEEA

SEQ ID NO: 15861 - protein, 9 aa, Homo Sapiens
MLIKLLEVL

SEQ ID NO: 15862 - protein, 9 aa, Homo Sapiens
MLLDVMHTV

SEQ ID NO: 15863 - protein, 9 aa, Homo Sapiens
MQDDNQVMV

SEQ ID NO: 15864 - protein, 9 aa, Homo Sapiens
MQDPMEIFV

SEQ ID NO: 15865 - protein, 9 aa, Homo Sapiens
MTDDKITEV

SEQ ID NO: 15866 - protein, 9 aa, Homo Sapiens
MTDPIRILV

SEQ ID NO: 15867 - protein, 9 aa, Homo Sapiens
MTLEGDIRL

SEQ ID NO: 15868 - protein, 9 aa, Homo Sapiens
MTYWHLLNA

SEQ ID NO: 15869 - protein, 9 aa, Homo Sapiens
MVADKFTEL

SEQ ID NO: 15870 - protein, 9 aa, Homo Sapiens
MVADRFSEL

SEQ ID NO: 15871 - protein, 9 aa, Homo Sapiens
MVAPAVASV

SEQ ID NO: 15872 - protein, 9 aa, Homo Sapiens
MVDGTLLLL

SEQ ID NO: 15873 - protein, 9 aa, Homo Sapiens
MVIDVLHPG

SEQ ID NO: 15874 - protein, 9 aa, Homo Sapiens
MVMETIEKI

SEQ ID NO: 15875 - protein, 9 aa, Homo Sapiens
MVPEDVPRL

SEQ ID NO: 15876 - protein, 9 aa, Homo Sapiens
MVVESVERI

SEQ ID NO: 15877 - protein, 9 aa, Homo Sapiens
NAAQKMQTV

SEQ ID NO: 15878 - protein, 9 aa, Homo Sapiens
NAIDRLVNI

SEQ ID NO: 15879 - protein, 9 aa, Homo Sapiens
NAIEKVFKV

SEQ ID NO: 15880 - protein, 9 aa, Homo Sapiens
NAIETMPCV

SEQ ID NO: 15881 - protein, 9 aa, Homo Sapiens
NALDKVLSV

SEQ ID NO: 15882 - protein, 9 aa, Homo Sapiens
NALRELETV

SEQ ID NO: 15883 - protein, 9 aa, Homo Sapiens
NAVGPLESV

SEQ ID NO: 15884 - protein, 9 aa, Homo Sapiens
NAVVELVTV

SEQ ID NO: 15885 - protein, 9 aa, Homo Sapiens
NGFPVFATV

SEQ ID NO: 15886 - protein, 9 aa, Homo Sapiens
NIANHFFTV

SEQ ID NO: 15887 - protein, 9 aa, Homo Sapiens
NIICGITSV

SEQ ID NO: 15888 - protein, 9 aa, Homo Sapiens
NIIELVHQV

SEQ ID NO: 15889 - protein, 9 aa, Homo Sapiens
NIIPIIAKA

SEQ ID NO: 15890 - protein, 9 aa, Homo Sapiens
NIIPRFVQV

SEQ ID NO: 15891 - protein, 9 aa, Homo Sapiens
NIIPYITNV

SEQ ID NO: 15892 - protein, 9 aa, Homo Sapiens
NIPVHLPNI

SEQ ID NO: 15893 - protein, 9 aa, Homo Sapiens
NIPVRFIEA

SEQ ID NO: 15894 - protein, 9 aa, Homo Sapiens
NIVDKFVIV

SEQ ID NO: 15895 - protein, 9 aa, Homo Sapiens
NIVEKLREV

SEQ ID NO: 15896 - protein, 9 aa, Homo Sapiens
NIVERLKEV

SEQ ID NO: 15897 - protein, 9 aa, Homo Sapiens
NIVERVKEV

SEQ ID NO: 15898 - protein, 9 aa, Homo Sapiens
NIVPVIAKA

SEQ ID NO: 15899 - protein, 9 aa, Homo Sapiens
NLAEKLIGV

SEQ ID NO: 15900 - protein, 9 aa, Homo Sapiens
NLAKCIVSV

SEQ ID NO: 15901 - protein, 9 aa, Homo Sapiens
NLIPILKTV

SEQ ID NO: 15902 - protein, 9 aa, Homo Sapiens
NLLKLIAEV

SEQ ID NO: 15903 - protein, 9 aa, Homo Sapiens
NLLPKLHIV

SEQ ID NO: 15904 - protein, 9 aa, Homo Sapiens
NLNPEFISV

SEQ ID NO: 15905 - protein, 9 aa, Homo Sapiens
NLPDEIYHV

SEQ ID NO: 15906 - protein, 9 aa, Homo Sapiens
NLVPMIIHL

SEQ ID NO: 15907 - protein, 9 aa, Homo Sapiens
NMLPQIFRV

SEQ ID NO: 15908 - protein, 9 aa, Homo Sapiens
NMVAKVDEV

SEQ ID NO: 15909 - protein, 9 aa, Homo Sapiens
NMVDIIHSV

SEQ ID NO: 15910 - protein, 9 aa, Homo Sapiens
NQAAQLWKV

SEQ ID NO: 15911 - protein, 9 aa, Homo Sapiens
NQCTVQVRL

SEQ ID NO: 15912 - protein, 9 aa, Homo Sapiens
NQFPGFKEV

SEQ ID NO: 15913 - protein, 9 aa, Homo Sapiens
NQIDHEVTV

SEQ ID NO: 15914 - protein, 9 aa, Homo Sapiens
NQIECHPYL

SEQ ID NO: 15915 - protein, 9 aa, Homo Sapiens
NQIKDQIKL

SEQ ID NO: 15916 - protein, 9 aa, Homo Sapiens
NQIKKIENL

SEQ ID NO: 15917 - protein, 9 aa, Homo Sapiens
NQITQLESL

SEQ ID NO: 15918 - protein, 9 aa, Homo Sapiens
NQLDGIHLL

SEQ ID NO: 15919 - protein, 9 aa, Homo Sapiens
NQLDSLMGL

SEQ ID NO: 15920 - protein, 9 aa, Homo Sapiens
NQLEAEIHL

SEQ ID NO: 15921 - protein, 9 aa, Homo Sapiens
NQLKTLQEV

SEQ ID NO: 15922 - protein, 9 aa, Homo Sapiens
NQMPTQPQV

SEQ ID NO: 15923 - protein, 9 aa, Homo Sapiens
NQPGVLIQV

SEQ ID NO: 15924 - protein, 9 aa, Homo Sapiens
NQTPVTLQV

SEQ ID NO: 15925 - protein, 9 aa, Homo Sapiens
NQVEALNNL

SEQ ID NO: 15926 - protein, 9 aa, Homo Sapiens
NQVEIKPEM

SEQ ID NO: 15927 - protein, 9 aa, Homo Sapiens
NQVETLEKL

SEQ ID NO: 15928 - protein, 9 aa, Homo Sapiens
NQVLNLIKA

SEQ ID NO: 15929 - protein, 9 aa, Homo Sapiens
NQVPKLLYL

SEQ ID NO: 15930 - protein, 9 aa, Homo Sapiens
NQYRLIVNV

SEQ ID NO: 15931 - protein, 9 aa, Homo Sapiens
NTAQGFRTV

SEQ ID NO: 15932 - protein, 9 aa, Homo Sapiens
NTCPYVHNI

SEQ ID NO: 15933 - protein, 9 aa, Homo Sapiens
NTIPLFVQL

SEQ ID NO: 15934 - protein, 9 aa, Homo Sapiens
NTPEYMEKI

SEQ ID NO: 15935 - protein, 9 aa, Homo Sapiens
NVIDNLIVA

SEQ ID NO: 15936 - protein, 9 aa, Homo Sapiens
NVIERLQEA

SEQ ID NO: 15937 - protein, 9 aa, Homo Sapiens
NVIKVSVYL

SEQ ID NO: 15938 - protein, 9 aa, Homo Sapiens
NVIPNVANV

SEQ ID NO: 15939 - protein, 9 aa, Homo Sapiens
NVIQTVPNL

SEQ ID NO: 15940 - protein, 9 aa, Homo Sapiens
NVKEMWTEV

SEQ ID NO: 15941 - protein, 9 aa, Homo Sapiens
NVLDHFSEL

SEQ ID NO: 15942 - protein, 9 aa, Homo Sapiens
NVLRDFTCV

SEQ ID NO: 15943 - protein, 9 aa, Homo Sapiens
NVPDSFNEV

SEQ ID NO: 15944 - protein, 9 aa, Homo Sapiens
NVPSHLPQV

SEQ ID NO: 15945 - protein, 9 aa, Homo Sapiens
NVTEYVVRV

SEQ ID NO: 15946 - protein, 9 aa, Homo Sapiens
NVVDNLVVV

SEQ ID NO: 15947 - protein, 9 aa, Homo Sapiens
NVVDVFHAV

SEQ ID NO: 15948 - protein, 9 aa, Homo Sapiens
NVVLEIPAA

SEQ ID NO: 15949 - protein, 9 aa, Homo Sapiens
NVVNRLTSV

SEQ ID NO: 15950 - protein, 9 aa, Homo Sapiens
PDPKLLEKV

SEQ ID NO: 15951 - protein, 9 aa, Homo Sapiens
PKFLTEVLL

SEQ ID NO: 15952 - protein, 9 aa, Homo Sapiens
PRFIKIIEV

SEQ ID NO: 15953 - protein, 9 aa, Homo Sapiens
PSIVHRKCF

SEQ ID NO: 15954 - protein, 9 aa, Homo Sapiens
QALSELHTV

SEQ ID NO: 15955 - protein, 9 aa, Homo Sapiens
QALSPLLSV

SEQ ID NO: 15956 - protein, 9 aa, Homo Sapiens
QAPQPQSSL

SEQ ID NO: 15957 - protein, 9 aa, Homo Sapiens
QGIGKLASV

SEQ ID NO: 15958 - protein, 9 aa, Homo Sapiens
QIIRELQVL

SEQ ID NO: 15959 - protein, 9 aa, Homo Sapiens
QILDGIHYL

SEQ ID NO: 15960 - protein, 9 aa, Homo Sapiens
QILDGVHYL

SEQ ID NO: 15961 - protein, 9 aa, Homo Sapiens
QILEDTHKV

SEQ ID NO: 15962 - protein, 9 aa, Homo Sapiens
QILEGVHFL

SEQ ID NO: 15963 - protein, 9 aa, Homo Sapiens
QILEGVHYL

SEQ ID NO: 15964 - protein, 9 aa, Homo Sapiens
QILVQVKEV

SEQ ID NO: 15965 - protein, 9 aa, Homo Sapiens
QIPQVLNQV

SEQ ID NO: 15966 - protein, 9 aa, Homo Sapiens
QIVEHLEEL

SEQ ID NO: 15967 - protein, 9 aa, Homo Sapiens
QIVERVIAV

SEQ ID NO: 15968 - protein, 9 aa, Homo Sapiens
QLAPVFQRV

SEQ ID NO: 15969 - protein, 9 aa, Homo Sapiens
QLAQFVHEV

SEQ ID NO: 15970 - protein, 9 aa, Homo Sapiens
QLIDIIHTA

SEQ ID NO: 15971 - protein, 9 aa, Homo Sapiens
QLIDKVWQL

SEQ ID NO: 15972 - protein, 9 aa, Homo Sapiens
QLIPKLIFL

SEQ ID NO: 15973 - protein, 9 aa, Homo Sapiens
QLIRDMVNV

SEQ ID NO: 15974 - protein, 9 aa, Homo Sapiens
QLLAILPEA

SEQ ID NO: 15975 - protein, 9 aa, Homo Sapiens
QLLDQVEQI

SEQ ID NO: 15976 - protein, 9 aa, Homo Sapiens
QLLEKVPTL

SEQ ID NO: 15977 - protein, 9 aa, Homo Sapiens
QLLPLLEKV

SEQ ID NO: 15978 - protein, 9 aa, Homo Sapiens
QLPELFHKI

SEQ ID NO: 15979 - protein, 9 aa, Homo Sapiens
QLREAFEQL

SEQ ID NO: 15980 - protein, 9 aa, Homo Sapiens
QLSPRLLEV

SEQ ID NO: 15981 - protein, 9 aa, Homo Sapiens
QLVDIIEKV

SEQ ID NO: 15982 - protein, 9 aa, Homo Sapiens
QLVEQVEQI

SEQ ID NO: 15983 - protein, 9 aa, Homo Sapiens
QLVPALAKV

SEQ ID NO: 15984 - protein, 9 aa, Homo Sapiens
QLVRDLLEV

SEQ ID NO: 15985 - protein, 9 aa, Homo Sapiens
QMISRIEYI

SEQ ID NO: 15986 - protein, 9 aa, Homo Sapiens
QMISRIEYV

SEQ ID NO: 15987 - protein, 9 aa, Homo Sapiens
QMVKELQEI

SEQ ID NO: 15988 - protein, 9 aa, Homo Sapiens
QQHPAFSGV

SEQ ID NO: 15989 - protein, 9 aa, Homo Sapiens
QQIAYEIHL

SEQ ID NO: 15990 - protein, 9 aa, Homo Sapiens
QQIDRVVEV

SEQ ID NO: 15991 - protein, 9 aa, Homo Sapiens
QQIGKVVQV

SEQ ID NO: 15992 - protein, 9 aa, Homo Sapiens
QQIKELEKL

SEQ ID NO: 15993 - protein, 9 aa, Homo Sapiens
QQIKKLEEL

SEQ ID NO: 15994 - protein, 9 aa, Homo Sapiens
QQINKLEEL

SEQ ID NO: 15995 - protein, 9 aa, Homo Sapiens
QQVQRLPFL

SEQ ID NO: 15996 - protein, 9 aa, Homo Sapiens
QQYNSFVSL

SEQ ID NO: 15997 - protein, 9 aa, Homo Sapiens
QSLEYLEQV

SEQ ID NO: 15998 - protein, 9 aa, Homo Sapiens
QTHSVFVNV

SEQ ID NO: 15999 - protein, 9 aa, Homo Sapiens
QTISALIKA

SEQ ID NO: 16000 - protein, 9 aa, Homo Sapiens
QTLSQLPQV

SEQ ID NO: 16001 - protein, 9 aa, Homo Sapiens
QTPEFFQDV

SEQ ID NO: 16002 - protein, 9 aa, Homo Sapiens
QTPQRLLEV

SEQ ID NO: 16003 - protein, 9 aa, Homo Sapiens
QVAFDFTKV

SEQ ID NO: 16004 - protein, 9 aa, Homo Sapiens
QVASTLKQV

SEQ ID NO: 16005 - protein, 9 aa, Homo Sapiens
QVCAIIERV

SEQ ID NO: 16006 - protein, 9 aa, Homo Sapiens
QVEQQLANI

SEQ ID NO: 16007 - protein, 9 aa, Homo Sapiens
QVIEKFEAL

SEQ ID NO: 16008 - protein, 9 aa, Homo Sapiens
QVIPQFQTV

SEQ ID NO: 16009 - protein, 9 aa, Homo Sapiens
QVIPQLQTV

SEQ ID NO: 16010 - protein, 9 aa, Homo Sapiens
QVIPVLPQV

SEQ ID NO: 16011 - protein, 9 aa, Homo Sapiens
QVIQSLIAL

SEQ ID NO: 16012 - protein, 9 aa, Homo Sapiens
QVLEDFPTI

SEQ ID NO: 16013 - protein, 9 aa, Homo Sapiens
QVLEELTEL

SEQ ID NO: 16014 - protein, 9 aa, Homo Sapiens
QVLGAIERA

SEQ ID NO: 16015 - protein, 9 aa, Homo Sapiens
QVLGKIERA

SEQ ID NO: 16016 - protein, 9 aa, Homo Sapiens
QVLGRVNLV

SEQ ID NO: 16017 - protein, 9 aa, Homo Sapiens
QVLKDLVKV

SEQ ID NO: 16018 - protein, 9 aa, Homo Sapiens
QVLPHLLEV

SEQ ID NO: 16019 - protein, 9 aa, Homo Sapiens
QVLSEVSRV

SEQ ID NO: 16020 - protein, 9 aa, Homo Sapiens
QVMDEVIKV

SEQ ID NO: 16021 - protein, 9 aa, Homo Sapiens
QVMGKVPTI

SEQ ID NO: 16022 - protein, 9 aa, Homo Sapiens
QVMKFIEKA

SEQ ID NO: 16023 - protein, 9 aa, Homo Sapiens
QVNDAFTHV

SEQ ID NO: 16024 - protein, 9 aa, Homo Sapiens
QVPDDLPNV

SEQ ID NO: 16025 - protein, 9 aa, Homo Sapiens
QVPEKLDVV

SEQ ID NO: 16026 - protein, 9 aa, Homo Sapiens
QVTPEFRTV

SEQ ID NO: 16027 - protein, 9 aa, Homo Sapiens
QVVPVLVHL

SEQ ID NO: 16028 - protein, 9 aa, Homo Sapiens
QVVVLLHDV

SEQ ID NO: 16029 - protein, 9 aa, Homo Sapiens
RAADVLVYL

SEQ ID NO: 16030 - protein, 9 aa, Homo Sapiens
RAAKKLWKV

SEQ ID NO: 16031 - protein, 9 aa, Homo Sapiens
RAIELLEKL

SEQ ID NO: 16032 - protein, 9 aa, Homo Sapiens
RAIPELTKL

SEQ ID NO: 16033 - protein, 9 aa, Homo Sapiens
RALDVNVAL

SEQ ID NO: 16034 - protein, 9 aa, Homo Sapiens
RAVEELHKL

SEQ ID NO: 16035 - protein, 9 aa, Homo Sapiens
RETLLTLRI

SEQ ID NO: 16036 - protein, 9 aa, Homo Sapiens
RIADQFLGA

SEQ ID NO: 16037 - protein, 9 aa, Homo Sapiens
RIADSFQVI

SEQ ID NO: 16038 - protein, 9 aa, Homo Sapiens
RIAELLTEL

SEQ ID NO: 16039 - protein, 9 aa, Homo Sapiens
RICPIDITL

SEQ ID NO: 16040 - protein, 9 aa, Homo Sapiens
RIFLEFERV

SEQ ID NO: 16041 - protein, 9 aa, Homo Sapiens
RIFQTLLEV

SEQ ID NO: 16042 - protein, 9 aa, Homo Sapiens
RIIDCAFTV

SEQ ID NO: 16043 - protein, 9 aa, Homo Sapiens
RIIDTVAQV

SEQ ID NO: 16044 - protein, 9 aa, Homo Sapiens
RIIDVVYNA

SEQ ID NO: 16045 - protein, 9 aa, Homo Sapiens
RIKDEFQLL

SEQ ID NO: 16046 - protein, 9 aa, Homo Sapiens
RIPAYFVTV

SEQ ID NO: 16047 - protein, 9 aa, Homo Sapiens
RIPEKVFQA

SEQ ID NO: 16048 - protein, 9 aa, Homo Sapiens
RIPIAVSGV

SEQ ID NO: 16049 - protein, 9 aa, Homo Sapiens
RIQSKLYRA

SEQ ID NO: 16050 - protein, 9 aa, Homo Sapiens
RIVDGMFAV

SEQ ID NO: 16051 - protein, 9 aa, Homo Sapiens
RIVDILLKV

SEQ ID NO: 16052 - protein, 9 aa, Homo Sapiens
RIVPVDIYI

SEQ ID NO: 16053 - protein, 9 aa, Homo Sapiens
RIYKYIHKV

SEQ ID NO: 16054 - protein, 9 aa, Homo Sapiens
RLAQHITYV

SEQ ID NO: 16055 - protein, 9 aa, Homo Sapiens
RLDEAFDFV

SEQ ID NO: 16056 - protein, 9 aa, Homo Sapiens
RLFEGNALL

SEQ ID NO: 16057 - protein, 9 aa, Homo Sapiens
RLFHSFEEL

SEQ ID NO: 16058 - protein, 9 aa, Homo Sapiens
RLIEETISI

SEQ ID NO: 16059 - protein, 9 aa, Homo Sapiens
RLIESLFTI

SEQ ID NO: 16060 - protein, 9 aa, Homo Sapiens
RLIPTLVSI

SEQ ID NO: 16061 - protein, 9 aa, Homo Sapiens
RLISKFDTV

SEQ ID NO: 16062 - protein, 9 aa, Homo Sapiens
RLKEAFDYI

SEQ ID NO: 16063 - protein, 9 aa, Homo Sapiens
RLLDGAFKL

SEQ ID NO: 16064 - protein, 9 aa, Homo Sapiens
RLLDYVATV

SEQ ID NO: 16065 - protein, 9 aa, Homo Sapiens
RLLDYVVNI

SEQ ID NO: 16066 - protein, 9 aa, Homo Sapiens
RLLENMTEV

SEQ ID NO: 16067 - protein, 9 aa, Homo Sapiens
RLMNDMTAV

SEQ ID NO: 16068 - protein, 9 aa, Homo Sapiens
RLMNETTAV

SEQ ID NO: 16069 - protein, 9 aa, Homo Sapiens
RLPDLIKEV

SEQ ID NO: 16070 - protein, 9 aa, Homo Sapiens
RLPEAIEEV

SEQ ID NO: 16071 - protein, 9 aa, Homo Sapiens
RLPEIYIQL

SEQ ID NO: 16072 - protein, 9 aa, Homo Sapiens
RLQDAIAKV

SEQ ID NO: 16073 - protein, 9 aa, Homo Sapiens
RLQEEINEV

SEQ ID NO: 16074 - protein, 9 aa, Homo Sapiens
RLQEVTHSV

SEQ ID NO: 16075 - protein, 9 aa, Homo Sapiens
RLQGELQAV

SEQ ID NO: 16076 - protein, 9 aa, Homo Sapiens
RLTDYISKV

SEQ ID NO: 16077 - protein, 9 aa, Homo Sapiens
RLTEEFQNV

SEQ ID NO: 16078 - protein, 9 aa, Homo Sapiens
RLTPKLMEV

SEQ ID NO: 16079 - protein, 9 aa, Homo Sapiens
RLVPFLTEL

SEQ ID NO: 16080 - protein, 9 aa, Homo Sapiens
RMFLSFPTT

SEQ ID NO: 16081 - protein, 9 aa, Homo Sapiens
RMLHFLTAV

SEQ ID NO: 16082 - protein, 9 aa, Homo Sapiens
RMLIKLLEV

SEQ ID NO: 16083 - protein, 9 aa, Homo Sapiens
RMLPHAPGV

SEQ ID NO: 16084 - protein, 9 aa, Homo Sapiens
RQADKVWRL

SEQ ID NO: 16085 - protein, 9 aa, Homo Sapiens
RQEDLIMKV

SEQ ID NO: 16086 - protein, 9 aa, Homo Sapiens
RQHEIVLKV

SEQ ID NO: 16087 - protein, 9 aa, Homo Sapiens
RQIDKIQCA

SEQ ID NO: 16088 - protein, 9 aa, Homo Sapiens
RQIDQFLVV

SEQ ID NO: 16089 - protein, 9 aa, Homo Sapiens
RQIEYEYKL

SEQ ID NO: 16090 - protein, 9 aa, Homo Sapiens
RQLDSMIQL

SEQ ID NO: 16091 - protein, 9 aa, Homo Sapiens
RQLDTETNL

SEQ ID NO: 16092 - protein, 9 aa, Homo Sapiens
RQLEAIVRI

SEQ ID NO: 16093 - protein, 9 aa, Homo Sapiens
RQLEKLKEV

SEQ ID NO: 16094 - protein, 9 aa, Homo Sapiens
RQLESLIRL

SEQ ID NO: 16095 - protein, 9 aa, Homo Sapiens
RQLESMIRL

SEQ ID NO: 16096 - protein, 9 aa, Homo Sapiens
RQLSALHRA

SEQ ID NO: 16097 - protein, 9 aa, Homo Sapiens
RQVDVVITC

SEQ ID NO: 16098 - protein, 9 aa, Homo Sapiens
RQVTGVTRV

SEQ ID NO: 16099 - protein, 9 aa, Homo Sapiens
RSINKLIRI

SEQ ID NO: 16100 - protein, 9 aa, Homo Sapiens
RSVPHLQKV

SEQ ID NO: 16101 - protein, 9 aa, Homo Sapiens
RTFEEFQEL

SEQ ID NO: 16102 - protein, 9 aa, Homo Sapiens
RTFEKIEEV

SEQ ID NO: 16103 - protein, 9 aa, Homo Sapiens
RTIEYLEEV

SEQ ID NO: 16104 - protein, 9 aa, Homo Sapiens
RTLAEIAKV

SEQ ID NO: 16105 - protein, 9 aa, Homo Sapiens
RTLDEAVGV

SEQ ID NO: 16106 - protein, 9 aa, Homo Sapiens
RTLDFDPLL

SEQ ID NO: 16107 - protein, 9 aa, Homo Sapiens
RTLETLIRL

SEQ ID NO: 16108 - protein, 9 aa, Homo Sapiens
RTMENLVEL

SEQ ID NO: 16109 - protein, 9 aa, Homo Sapiens
RTNSTFNQV

SEQ ID NO: 16110 - protein, 9 aa, Homo Sapiens
RTPEGLYQV

SEQ ID NO: 16111 - protein, 9 aa, Homo Sapiens
RTVEKTWKL

SEQ ID NO: 16112 - protein, 9 aa, Homo Sapiens
RTVELFYDV

SEQ ID NO: 16113 - protein, 9 aa, Homo Sapiens
RTVPVFESV

SEQ ID NO: 16114 - protein, 9 aa, Homo Sapiens
RVCEIQATL

SEQ ID NO: 16115 - protein, 9 aa, Homo Sapiens
RVDKNAPTV

SEQ ID NO: 16116 - protein, 9 aa, Homo Sapiens
RVDPVNFKL

SEQ ID NO: 16117 - protein, 9 aa, Homo Sapiens
RVEPVTTSV

SEQ ID NO: 16118 - protein, 9 aa, Homo Sapiens
RVFENIVAV

SEQ ID NO: 16119 - protein, 9 aa, Homo Sapiens
RVFKQFVQA

SEQ ID NO: 16120 - protein, 9 aa, Homo Sapiens
RVHDYDMRV

SEQ ID NO: 16121 - protein, 9 aa, Homo Sapiens
RVIDLRAEL

SEQ ID NO: 16122 - protein, 9 aa, Homo Sapiens
RVIDYAVKI

SEQ ID NO: 16123 - protein, 9 aa, Homo Sapiens
RVIDYILDL

SEQ ID NO: 16124 - protein, 9 aa, Homo Sapiens
RVIEPFSRV

SEQ ID NO: 16125 - protein, 9 aa, Homo Sapiens
RVIGTLEEV

SEQ ID NO: 16126 - protein, 9 aa, Homo Sapiens
RVIVEVCEV

SEQ ID NO: 16127 - protein, 9 aa, Homo Sapiens
RVLDLAEQV

SEQ ID NO: 16128 - protein, 9 aa, Homo Sapiens
RVLDNIKAV

SEQ ID NO: 16129 - protein, 9 aa, Homo Sapiens
RVLDTNIQL

SEQ ID NO: 16130 - protein, 9 aa, Homo Sapiens
RVLEELETL

SEQ ID NO: 16131 - protein, 9 aa, Homo Sapiens
RVLELIPQI

SEQ ID NO: 16132 - protein, 9 aa, Homo Sapiens
RVLEMLEAL

SEQ ID NO: 16133 - protein, 9 aa, Homo Sapiens
RVLEVVNHV

SEQ ID NO: 16134 - protein, 9 aa, Homo Sapiens
RVLKEFHQA

SEQ ID NO: 16135 - protein, 9 aa, Homo Sapiens
RVMELFFTV

SEQ ID NO: 16136 - protein, 9 aa, Homo Sapiens
RVMEYINRL

SEQ ID NO: 16137 - protein, 9 aa, Homo Sapiens
RVNKAFVNV

SEQ ID NO: 16138 - protein, 9 aa, Homo Sapiens
RVQDLFCSV

SEQ ID NO: 16139 - protein, 9 aa, Homo Sapiens
RVTECLTTV

SEQ ID NO: 16140 - protein, 9 aa, Homo Sapiens
RVTNVKVTL

SEQ ID NO: 16141 - protein, 9 aa, Homo Sapiens
RVTVVFSTV

SEQ ID NO: 16142 - protein, 9 aa, Homo Sapiens
RVVDLITNL

SEQ ID NO: 16143 - protein, 9 aa, Homo Sapiens
RVVDLLNQA

SEQ ID NO: 16144 - protein, 9 aa, Homo Sapiens
RVVDYLTKL

SEQ ID NO: 16145 - protein, 9 aa, Homo Sapiens
RVVEKFLKI

SEQ ID NO: 16146 - protein, 9 aa, Homo Sapiens
RVYEEFTKV

SEQ ID NO: 16147 - protein, 9 aa, Homo Sapiens
SAAHAIVSV

SEQ ID NO: 16148 - protein, 9 aa, Homo Sapiens
SAFDHFASV

SEQ ID NO: 16149 - protein, 9 aa, Homo Sapiens
SAHKYFPVV

SEQ ID NO: 16150 - protein, 9 aa, Homo Sapiens
SAIKELDTL

SEQ ID NO: 16151 - protein, 9 aa, Homo Sapiens
SALEELVNV

SEQ ID NO: 16152 - protein, 9 aa, Homo Sapiens
SALHRIIEV

SEQ ID NO: 16153 - protein, 9 aa, Homo Sapiens
SALRVNPAL

SEQ ID NO: 16154 - protein, 9 aa, Homo Sapiens
SAMEVVPAL

SEQ ID NO: 16155 - protein, 9 aa, Homo Sapiens
SASGPLHSV

SEQ ID NO: 16156 - protein, 9 aa, Homo Sapiens
SAVCKLDSV

SEQ ID NO: 16157 - protein, 9 aa, Homo Sapiens
SAVFHLEHA

SEQ ID NO: 16158 - protein, 9 aa, Homo Sapiens
SAVPKVMKV

SEQ ID NO: 16159 - protein, 9 aa, Homo Sapiens
SAVTNIPHV

SEQ ID NO: 16160 - protein, 9 aa, Homo Sapiens
SGLLKVWQV

SEQ ID NO: 16161 - protein, 9 aa, Homo Sapiens
SIAAVLPKV

SEQ ID NO: 16162 - protein, 9 aa, Homo Sapiens
SIAGIFKEV

SEQ ID NO: 16163 - protein, 9 aa, Homo Sapiens
SIAPRMMSV

SEQ ID NO: 16164 - protein, 9 aa, Homo Sapiens
SIIDEFLHI

SEQ ID NO: 16165 - protein, 9 aa, Homo Sapiens
SIIGRLLEV

SEQ ID NO: 16166 - protein, 9 aa, Homo Sapiens
SIIKKLAAL

SEQ ID NO: 16167 - protein, 9 aa, Homo Sapiens
SIIQRLLEV

SEQ ID NO: 16168 - protein, 9 aa, Homo Sapiens
SILEHQIQV

SEQ ID NO: 16169 - protein, 9 aa, Homo Sapiens
SILEKFIRV

SEQ ID NO: 16170 - protein, 9 aa, Homo Sapiens
SILGKFAVV

SEQ ID NO: 16171 - protein, 9 aa, Homo Sapiens
SILHDVVEV

SEQ ID NO: 16172 - protein, 9 aa, Homo Sapiens
SILKKVLEA

SEQ ID NO: 16173 - protein, 9 aa, Homo Sapiens
SILQTLILV

SEQ ID NO: 16174 - protein, 9 aa, Homo Sapiens
SILRHVAEV

SEQ ID NO: 16175 - protein, 9 aa, Homo Sapiens
SIMKNLRRV

SEQ ID NO: 16176 - protein, 9 aa, Homo Sapiens
SINSRFAKV

SEQ ID NO: 16177 - protein, 9 aa, Homo Sapiens
SIPHEVPQI

SEQ ID NO: 16178 - protein, 9 aa, Homo Sapiens
SITSELHAV

SEQ ID NO: 16179 - protein, 9 aa, Homo Sapiens
SIVNHLEFL

SEQ ID NO: 16180 - protein, 9 aa, Homo Sapiens
SLAQYLINV

SEQ ID NO: 16181 - protein, 9 aa, Homo Sapiens
SLHSKFIKV

SEQ ID NO: 16182 - protein, 9 aa, Homo Sapiens
SLHSKFIRV

SEQ ID NO: 16183 - protein, 9 aa, Homo Sapiens
SLIEKIPTA

SEQ ID NO: 16184 - protein, 9 aa, Homo Sapiens
SLIEKLWQT

SEQ ID NO: 16185 - protein, 9 aa, Homo Sapiens
SLIEKVTQL

SEQ ID NO: 16186 - protein, 9 aa, Homo Sapiens
SLIEKYFSV

SEQ ID NO: 16187 - protein, 9 aa, Homo Sapiens
SLIFKLEEL

SEQ ID NO: 16188 - protein, 9 aa, Homo Sapiens
SLIGHLQTL

SEQ ID NO: 16189 - protein, 9 aa, Homo Sapiens
SLIKKIKDV

SEQ ID NO: 16190 - protein, 9 aa, Homo Sapiens
SLIKQIPRI

SEQ ID NO: 16191 - protein, 9 aa, Homo Sapiens
SLIRIVPVV

SEQ ID NO: 16192 - protein, 9 aa, Homo Sapiens
SLIRNLEQL

SEQ ID NO: 16193 - protein, 9 aa, Homo Sapiens
SLITLIEKV

SEQ ID NO: 16194 - protein, 9 aa, Homo Sapiens
SLITRLLEV

SEQ ID NO: 16195 - protein, 9 aa, Homo Sapiens
SLLDCTFRL

SEQ ID NO: 16196 - protein, 9 aa, Homo Sapiens
SLLDIIEKV

SEQ ID NO: 16197 - protein, 9 aa, Homo Sapiens
SLLEHLSHV

SEQ ID NO: 16198 - protein, 9 aa, Homo Sapiens
SLLENIAKA

SEQ ID NO: 16199 - protein, 9 aa, Homo Sapiens
SLLGHLMIV

SEQ ID NO: 16200 - protein, 9 aa, Homo Sapiens
SLLKRLRKA

SEQ ID NO: 16201 - protein, 9 aa, Homo Sapiens
SLLPFLKAV

SEQ ID NO: 16202 - protein, 9 aa, Homo Sapiens
SLLQTLYKV

SEQ ID NO: 16203 - protein, 9 aa, Homo Sapiens
SLLRHLEKV

SEQ ID NO: 16204 - protein, 9 aa, Homo Sapiens
SLLRRKLAK

SEQ ID NO: 16205 - protein, 9 aa, Homo Sapiens
SLLYNVPAV

SEQ ID NO: 16206 - protein, 9 aa, Homo Sapiens
SLMKDFPGA

SEQ ID NO: 16207 - protein, 9 aa, Homo Sapiens
SLPDHLPSV

SEQ ID NO: 16208 - protein, 9 aa, Homo Sapiens
SLPDIKVYL

SEQ ID NO: 16209 - protein, 9 aa, Homo Sapiens
SLPEELNRV

SEQ ID NO: 16210 - protein, 9 aa, Homo Sapiens
SLPEILKEV

SEQ ID NO: 16211 - protein, 9 aa, Homo Sapiens
SLPKEQPAV

SEQ ID NO: 16212 - protein, 9 aa, Homo Sapiens
SLPKKLALL

SEQ ID NO: 16213 - protein, 9 aa, Homo Sapiens
SLPKKLECI

SEQ ID NO: 16214 - protein, 9 aa, Homo Sapiens
SLQEKLWAI

SEQ ID NO: 16215 - protein, 9 aa, Homo Sapiens
SLVDEFKEL

SEQ ID NO: 16216 - protein, 9 aa, Homo Sapiens
SLVEQLTMV

SEQ ID NO: 16217 - protein, 9 aa, Homo Sapiens
SLVGKLEGT

SEQ ID NO: 16218 - protein, 9 aa, Homo Sapiens
SMLDDLRNV

SEQ ID NO: 16219 - protein, 9 aa, Homo Sapiens
SQAQTLHKV

SEQ ID NO: 16220 - protein, 9 aa, Homo Sapiens
SQCPHIVRI

SEQ ID NO: 16221 - protein, 9 aa, Homo Sapiens
SQCQKLWKL

SEQ ID NO: 16222 - protein, 9 aa, Homo Sapiens
SQDENYHHL

SEQ ID NO: 16223 - protein, 9 aa, Homo Sapiens
SQDEVRENI

SEQ ID NO: 16224 - protein, 9 aa, Homo Sapiens
SQDPEFHKV

SEQ ID NO: 16225 - protein, 9 aa, Homo Sapiens
SQDPGTHVV

SEQ ID NO: 16226 - protein, 9 aa, Homo Sapiens
SQEGRPVQV

SEQ ID NO: 16227 - protein, 9 aa, Homo Sapiens
SQEPVAHTV

SEQ ID NO: 16228 - protein, 9 aa, Homo Sapiens
SQFGTVEKA

SEQ ID NO: 16229 - protein, 9 aa, Homo Sapiens
SQFNKEILL

SEQ ID NO: 16230 - protein, 9 aa, Homo Sapiens
SQFPEEILL

SEQ ID NO: 16231 - protein, 9 aa, Homo Sapiens
SQFPGAITL

SEQ ID NO: 16232 - protein, 9 aa, Homo Sapiens
SQFPTPEAV

SEQ ID NO: 16233 - protein, 9 aa, Homo Sapiens
SQFSGKITV

SEQ ID NO: 16234 - protein, 9 aa, Homo Sapiens
SQHEEFLEL

SEQ ID NO: 16235 - protein, 9 aa, Homo Sapiens
SQHGVFSEA

SEQ ID NO: 16236 - protein, 9 aa, Homo Sapiens
SQHGVIIQL

SEQ ID NO: 16237 - protein, 9 aa, Homo Sapiens
SQIDQQNSV

SEQ ID NO: 16238 - protein, 9 aa, Homo Sapiens
SQIEADFRL

SEQ ID NO: 16239 - protein, 9 aa, Homo Sapiens
SQIHDIVLV

SEQ ID NO: 16240 - protein, 9 aa, Homo Sapiens
SQIKSLCNL

SEQ ID NO: 16241 - protein, 9 aa, Homo Sapiens
SQIKYAAKV

SEQ ID NO: 16242 - protein, 9 aa, Homo Sapiens
SQINKFLYL

SEQ ID NO: 16243 - protein, 9 aa, Homo Sapiens
SQIPAQPSV

SEQ ID NO: 16244 - protein, 9 aa, Homo Sapiens
SQIQEFKEA

SEQ ID NO: 16245 - protein, 9 aa, Homo Sapiens
SQIQKVEPA

SEQ ID NO: 16246 - protein, 9 aa, Homo Sapiens
SQIRETQQL

SEQ ID NO: 16247 - protein, 9 aa, Homo Sapiens
SQISQPICL

SEQ ID NO: 16248 - protein, 9 aa, Homo Sapiens
SQITSLVTL

SEQ ID NO: 16249 - protein, 9 aa, Homo Sapiens
SQIYPVVCV

SEQ ID NO: 16250 - protein, 9 aa, Homo Sapiens
SQLDIQIKA

SEQ ID NO: 16251 - protein, 9 aa, Homo Sapiens
SQLDRTVCI

SEQ ID NO: 16252 - protein, 9 aa, Homo Sapiens
SQLDTLIQV

SEQ ID NO: 16253 - protein, 9 aa, Homo Sapiens
SQLDVPFKV

SEQ ID NO: 16254 - protein, 9 aa, Homo Sapiens
SQLEDAIRL

SEQ ID NO: 16255 - protein, 9 aa, Homo Sapiens
SQLKWLDRV

SEQ ID NO: 16256 - protein, 9 aa, Homo Sapiens
SQLNIWIRV

SEQ ID NO: 16257 - protein, 9 aa, Homo Sapiens
SQLPNFWKL

SEQ ID NO: 16258 - protein, 9 aa, Homo Sapiens
SQLVACTKV

SEQ ID NO: 16259 - protein, 9 aa, Homo Sapiens
SQLWKLPGL

SEQ ID NO: 16260 - protein, 9 aa, Homo Sapiens
SQMPTVIYV

SEQ ID NO: 16261 - protein, 9 aa, Homo Sapiens
SQPEKVYTL

SEQ ID NO: 16262 - protein, 9 aa, Homo Sapiens
SQPGTFPAV

SEQ ID NO: 16263 - protein, 9 aa, Homo Sapiens
SQPPVQVSV

SEQ ID NO: 16264 - protein, 9 aa, Homo Sapiens
SQSKNFMNV

SEQ ID NO: 16265 - protein, 9 aa, Homo Sapiens
SQSSLIHLV

SEQ ID NO: 16266 - protein, 9 aa, Homo Sapiens
SQTDFSQLL

SEQ ID NO: 16267 - protein, 9 aa, Homo Sapiens
SQTFVNPHV

SEQ ID NO: 16268 - protein, 9 aa, Homo Sapiens
SQTKVVELL

SEQ ID NO: 16269 - protein, 9 aa, Homo Sapiens
SQTSVAERL

SEQ ID NO: 16270 - protein, 9 aa, Homo Sapiens
SQTTVYEKL

SEQ ID NO: 16271 - protein, 9 aa, Homo Sapiens
SQVALLEQV

SEQ ID NO: 16272 - protein, 9 aa, Homo Sapiens
SQVDQLLNI

SEQ ID NO: 16273 - protein, 9 aa, Homo Sapiens
SQVDRLVAL

SEQ ID NO: 16274 - protein, 9 aa, Homo Sapiens
SQVDVAVKI

SEQ ID NO: 16275 - protein, 9 aa, Homo Sapiens
SQVEDLERV

SEQ ID NO: 16276 - protein, 9 aa, Homo Sapiens
SQVEGEHQL

SEQ ID NO: 16277 - protein, 9 aa, Homo Sapiens
SQVEILQRV

SEQ ID NO: 16278 - protein, 9 aa, Homo Sapiens
SQVEPLPSL

SEQ ID NO: 16279 - protein, 9 aa, Homo Sapiens
SQVFKLYTA

SEQ ID NO: 16280 - protein, 9 aa, Homo Sapiens
SQVPEVTTV

SEQ ID NO: 16281 - protein, 9 aa, Homo Sapiens
SQVPHLPVL

SEQ ID NO: 16282 - protein, 9 aa, Homo Sapiens
SQVTVAVRV

SEQ ID NO: 16283 - protein, 9 aa, Homo Sapiens
SQWDSPMRV

SEQ ID NO: 16284 - protein, 9 aa, Homo Sapiens
SQWEDIHVV

SEQ ID NO: 16285 - protein, 9 aa, Homo Sapiens
SQYPEIIFL

SEQ ID NO: 16286 - protein, 9 aa, Homo Sapiens
SQYPFPVTL

SEQ ID NO: 16287 - protein, 9 aa, Homo Sapiens
SSAPGLTSV

SEQ ID NO: 16288 - protein, 9 aa, Homo Sapiens
SSIEHLTTL

SEQ ID NO: 16289 - protein, 9 aa, Homo Sapiens
STAAKIMGV

SEQ ID NO: 16290 - protein, 9 aa, Homo Sapiens
STHEFLHEV

SEQ ID NO: 16291 - protein, 9 aa, Homo Sapiens
STIAILNSV

SEQ ID NO: 16292 - protein, 9 aa, Homo Sapiens
STIEEFSYI

SEQ ID NO: 16293 - protein, 9 aa, Homo Sapiens
STIKEVAQA

SEQ ID NO: 16294 - protein, 9 aa, Homo Sapiens
STIRLLTSL

SEQ ID NO: 16295 - protein, 9 aa, Homo Sapiens
STIVQVLEV

SEQ ID NO: 16296 - protein, 9 aa, Homo Sapiens
STLHLVLRL

SEQ ID NO: 16297 - protein, 9 aa, Homo Sapiens
STLPDVTEV

SEQ ID NO: 16298 - protein, 9 aa, Homo Sapiens
STLVQVQQV

SEQ ID NO: 16299 - protein, 9 aa, Homo Sapiens
STTPYLQSV

SEQ ID NO: 16300 - protein, 9 aa, Homo Sapiens
STVEKLYAA

SEQ ID NO: 16301 - protein, 9 aa, Homo Sapiens
STVFHVPDV

SEQ ID NO: 16302 - protein, 9 aa, Homo Sapiens
STVKVLIRL

SEQ ID NO: 16303 - protein, 9 aa, Homo Sapiens
STYKFFEVI

SEQ ID NO: 16304 - protein, 9 aa, Homo Sapiens
SVAAQLTGV

SEQ ID NO: 16305 - protein, 9 aa, Homo Sapiens
SVADYFKQI

SEQ ID NO: 16306 - protein, 9 aa, Homo Sapiens
SVAEKLSKL

SEQ ID NO: 16307 - protein, 9 aa, Homo Sapiens
SVAESLLQV

SEQ ID NO: 16308 - protein, 9 aa, Homo Sapiens
SVAESLNYV

SEQ ID NO: 16309 - protein, 9 aa, Homo Sapiens
SVAGSVERV

SEQ ID NO: 16310 - protein, 9 aa, Homo Sapiens
SVALVIHNV

SEQ ID NO: 16311 - protein, 9 aa, Homo Sapiens
SVAPEFRRL

SEQ ID NO: 16312 - protein, 9 aa, Homo Sapiens
SVASSVKGV

SEQ ID NO: 16313 - protein, 9 aa, Homo Sapiens
SVATKLTAV

SEQ ID NO: 16314 - protein, 9 aa, Homo Sapiens
SVDSHFQEV

SEQ ID NO: 16315 - protein, 9 aa, Homo Sapiens
SVFAGVVGV

SEQ ID NO: 16316 - protein, 9 aa, Homo Sapiens
SVFKDFYEL

SEQ ID NO: 16317 - protein, 9 aa, Homo Sapiens
SVFKGCLTL

SEQ ID NO: 16318 - protein, 9 aa, Homo Sapiens
SVHKGFAFV

SEQ ID NO: 16319 - protein, 9 aa, Homo Sapiens
SVIDHIHLI

SEQ ID NO: 16320 - protein, 9 aa, Homo Sapiens
SVIEQIVYV

SEQ ID NO: 16321 - protein, 9 aa, Homo Sapiens
SVIGSLNGV

SEQ ID NO: 16322 - protein, 9 aa, Homo Sapiens
SVIGVSPAV

SEQ ID NO: 16323 - protein, 9 aa, Homo Sapiens
SVIKELRKA

SEQ ID NO: 16324 - protein, 9 aa, Homo Sapiens
SVIKELRQL

SEQ ID NO: 16325 - protein, 9 aa, Homo Sapiens
SVINEINKI

SEQ ID NO: 16326 - protein, 9 aa, Homo Sapiens
SVIPQIQKV

SEQ ID NO: 16327 - protein, 9 aa, Homo Sapiens
SVIPVINKI

SEQ ID NO: 16328 - protein, 9 aa, Homo Sapiens
SVIQKFVLL

SEQ ID NO: 16329 - protein, 9 aa, Homo Sapiens
SVIQNLRTV

SEQ ID NO: 16330 - protein, 9 aa, Homo Sapiens
SVIQVFQQL

SEQ ID NO: 16331 - protein, 9 aa, Homo Sapiens
SVIRKIPAL

SEQ ID NO: 16332 - protein, 9 aa, Homo Sapiens
SVISHLLRV

SEQ ID NO: 16333 - protein, 9 aa, Homo Sapiens
SVITQVFHV

SEQ ID NO: 16334 - protein, 9 aa, Homo Sapiens
SVIYTIEAV

SEQ ID NO: 16335 - protein, 9 aa, Homo Sapiens
SVLDDFYTA

SEQ ID NO: 16336 - protein, 9 aa, Homo Sapiens
SVLDQKILL

SEQ ID NO: 16337 - protein, 9 aa, Homo Sapiens
SVLDSTAKV

SEQ ID NO: 16338 - protein, 9 aa, Homo Sapiens
SVLEDFYTA

SEQ ID NO: 16339 - protein, 9 aa, Homo Sapiens
SVLGAITSV

SEQ ID NO: 16340 - protein, 9 aa, Homo Sapiens
SVLGKIWKL

SEQ ID NO: 16341 - protein, 9 aa, Homo Sapiens
SVLGKVNEI

SEQ ID NO: 16342 - protein, 9 aa, Homo Sapiens
SVLKDVSKV

SEQ ID NO: 16343 - protein, 9 aa, Homo Sapiens
SVLKNVPGL

SEQ ID NO: 16344 - protein, 9 aa, Homo Sapiens
SVLKSIQEV

SEQ ID NO: 16345 - protein, 9 aa, Homo Sapiens
SVLKSLVEI

SEQ ID NO: 16346 - protein, 9 aa, Homo Sapiens
SVLKSTPQV

SEQ ID NO: 16347 - protein, 9 aa, Homo Sapiens
SVLLVVQKV

SEQ ID NO: 16348 - protein, 9 aa, Homo Sapiens
SVLNVLHSL

SEQ ID NO: 16349 - protein, 9 aa, Homo Sapiens
SVLQSIEKI

SEQ ID NO: 16350 - protein, 9 aa, Homo Sapiens
SVLVKLLEV

SEQ ID NO: 16351 - protein, 9 aa, Homo Sapiens
SVMEYVTAV

SEQ ID NO: 16352 - protein, 9 aa, Homo Sapiens
SVMGNIIHV

SEQ ID NO: 16353 - protein, 9 aa, Homo Sapiens
SVMSILPKI

SEQ ID NO: 16354 - protein, 9 aa, Homo Sapiens
SVPAKLPEI

SEQ ID NO: 16355 - protein, 9 aa, Homo Sapiens
SVPATVPSI

SEQ ID NO: 16356 - protein, 9 aa, Homo Sapiens
SVPDTVHHV

SEQ ID NO: 16357 - protein, 9 aa, Homo Sapiens
SVPELCHHV

SEQ ID NO: 16358 - protein, 9 aa, Homo Sapiens
SVPIDLQKV

SEQ ID NO: 16359 - protein, 9 aa, Homo Sapiens
SVPIEIPTI

SEQ ID NO: 16360 - protein, 9 aa, Homo Sapiens
SVPKELVAL

SEQ ID NO: 16361 - protein, 9 aa, Homo Sapiens
SVPLKVPGL

SEQ ID NO: 16362 - protein, 9 aa, Homo Sapiens
SVQEFFTDV

SEQ ID NO: 16363 - protein, 9 aa, Homo Sapiens
SVQRSFTQV

SEQ ID NO: 16364 - protein, 9 aa, Homo Sapiens
SVSSVNPSV

SEQ ID NO: 16365 - protein, 9 aa, Homo Sapiens
SVTFVAEQV

SEQ ID NO: 16366 - protein, 9 aa, Homo Sapiens
SVTSHIYQV

SEQ ID NO: 16367 - protein, 9 aa, Homo Sapiens
SVTTVNKKL

SEQ ID NO: 16368 - protein, 9 aa, Homo Sapiens
SVVDGTPLV

SEQ ID NO: 16369 - protein, 9 aa, Homo Sapiens
SVVDHFNRI

SEQ ID NO: 16370 - protein, 9 aa, Homo Sapiens
SVVDIKLLL

SEQ ID NO: 16371 - protein, 9 aa, Homo Sapiens
SVVDLTCRL

SEQ ID NO: 16372 - protein, 9 aa, Homo Sapiens
SVVESVFKL

SEQ ID NO: 16373 - protein, 9 aa, Homo Sapiens
SVVGHDVSV

SEQ ID NO: 16374 - protein, 9 aa, Homo Sapiens
SVVGPVKGV

SEQ ID NO: 16375 - protein, 9 aa, Homo Sapiens
SVVKVLTEL

SEQ ID NO: 16376 - protein, 9 aa, Homo Sapiens
SVVPDVRSV

SEQ ID NO: 16377 - protein, 9 aa, Homo Sapiens
SVVQGTLGV

SEQ ID NO: 16378 - protein, 9 aa, Homo Sapiens
SVVSFLLRV

SEQ ID NO: 16379 - protein, 9 aa, Homo Sapiens
SVWTKVEGV

SEQ ID NO: 16380 - protein, 9 aa, Homo Sapiens
SVYGKLRKV

SEQ ID NO: 16381 - protein, 9 aa, Homo Sapiens
SVYPNGHFV

SEQ ID NO: 16382 - protein, 9 aa, Homo Sapiens
TAAEKLHKV

SEQ ID NO: 16383 - protein, 9 aa, Homo Sapiens
TAIELIPSV

SEQ ID NO: 16384 - protein, 9 aa, Homo Sapiens
TAIHNFPTV

SEQ ID NO: 16385 - protein, 9 aa, Homo Sapiens
TAIKMIPGV

SEQ ID NO: 16386 - protein, 9 aa, Homo Sapiens
TALKDVVKV

SEQ ID NO: 16387 - protein, 9 aa, Homo Sapiens
TALLKIEGV

SEQ ID NO: 16388 - protein, 9 aa, Homo Sapiens
TIDPSNPMV

SEQ ID NO: 16389 - protein, 9 aa, Homo Sapiens
TIHVGFDAV

SEQ ID NO: 16390 - protein, 9 aa, Homo Sapiens
TILEKCFKV

SEQ ID NO: 16391 - protein, 9 aa, Homo Sapiens
TILKRLFRV

SEQ ID NO: 16392 - protein, 9 aa, Homo Sapiens
TILPKVMQV

SEQ ID NO: 16393 - protein, 9 aa, Homo Sapiens
TILRLLQQV

SEQ ID NO: 16394 - protein, 9 aa, Homo Sapiens
TIMPKDIQL

SEQ ID NO: 16395 - protein, 9 aa, Homo Sapiens
TIPEAFRGV

SEQ ID NO: 16396 - protein, 9 aa, Homo Sapiens
TIPEIIIKV

SEQ ID NO: 16397 - protein, 9 aa, Homo Sapiens
TIPEILPKL

SEQ ID NO: 16398 - protein, 9 aa, Homo Sapiens
TIVDKVKEV

SEQ ID NO: 16399 - protein, 9 aa, Homo Sapiens
TIVEMLHKA

SEQ ID NO: 16400 - protein, 9 aa, Homo Sapiens
TIYKDFVYI

SEQ ID NO: 16401 - protein, 9 aa, Homo Sapiens
TLADLVHHV

SEQ ID NO: 16402 - protein, 9 aa, Homo Sapiens
TLADVLYHV

SEQ ID NO: 16403 - protein, 9 aa, Homo Sapiens
TLALKFENA

SEQ ID NO: 16404 - protein, 9 aa, Homo Sapiens
TLCDVILMV

SEQ ID NO: 16405 - protein, 9 aa, Homo Sapiens
TLCDVTLRV

SEQ ID NO: 16406 - protein, 9 aa, Homo Sapiens
TLFGTFHVA

SEQ ID NO: 16407 - protein, 9 aa, Homo Sapiens
TLIEDILGV

SEQ ID NO: 16408 - protein, 9 aa, Homo Sapiens
TLIEELKAL

SEQ ID NO: 16409 - protein, 9 aa, Homo Sapiens
TLIEVMPKI

SEQ ID NO: 16410 - protein, 9 aa, Homo Sapiens
TLISELVQA

SEQ ID NO: 16411 - protein, 9 aa, Homo Sapiens
TLLGHLDYI

SEQ ID NO: 16412 - protein, 9 aa, Homo Sapiens
TLLKDAAKV

SEQ ID NO: 16413 - protein, 9 aa, Homo Sapiens
TLLKKVWKV

SEQ ID NO: 16414 - protein, 9 aa, Homo Sapiens
TLLKQLKEA

SEQ ID NO: 16415 - protein, 9 aa, Homo Sapiens
TLLNVIKSV

SEQ ID NO: 16416 - protein, 9 aa, Homo Sapiens
TLLRLLYEA

SEQ ID NO: 16417 - protein, 9 aa, Homo Sapiens
TLMIKFEEA

SEQ ID NO: 16418 - protein, 9 aa, Homo Sapiens
TLPEIFEAA

SEQ ID NO: 16419 - protein, 9 aa, Homo Sapiens
TLPVAFKVV

SEQ ID NO: 16420 - protein, 9 aa, Homo Sapiens
TLQEFLERI

SEQ ID NO: 16421 - protein, 9 aa, Homo Sapiens
TLVDEVFRI

SEQ ID NO: 16422 - protein, 9 aa, Homo Sapiens
TLVEAIKQV

SEQ ID NO: 16423 - protein, 9 aa, Homo Sapiens
TLVYHVVGV

SEQ ID NO: 16424 - protein, 9 aa, Homo Sapiens
TMIGEIAAA

SEQ ID NO: 16425 - protein, 9 aa, Homo Sapiens
TQAPPLHTA

SEQ ID NO: 16426 - protein, 9 aa, Homo Sapiens
TQCELLTQL

SEQ ID NO: 16427 - protein, 9 aa, Homo Sapiens
TQDGTPITV

SEQ ID NO: 16428 - protein, 9 aa, Homo Sapiens
TQDTQLITV

SEQ ID NO: 16429 - protein, 9 aa, Homo Sapiens
TQIDHYVGI

SEQ ID NO: 16430 - protein, 9 aa, Homo Sapiens
TQIKHFESL

SEQ ID NO: 16431 - protein, 9 aa, Homo Sapiens
TQILSVPKV

SEQ ID NO: 16432 - protein, 9 aa, Homo Sapiens
TQLDRAHGV

SEQ ID NO: 16433 - protein, 9 aa, Homo Sapiens
TQLESSWEL

SEQ ID NO: 16434 - protein, 9 aa, Homo Sapiens
TQLNMFQTL

SEQ ID NO: 16435 - protein, 9 aa, Homo Sapiens
TQLQTTQSV

SEQ ID NO: 16436 - protein, 9 aa, Homo Sapiens
TQMIKAWQV

SEQ ID NO: 16437 - protein, 9 aa, Homo Sapiens
TQTAVITRI

SEQ ID NO: 16438 - protein, 9 aa, Homo Sapiens
TQVELLTRL

SEQ ID NO: 16439 - protein, 9 aa, Homo Sapiens
TQVTALIKL

SEQ ID NO: 16440 - protein, 9 aa, Homo Sapiens
TTARAFAVV

SEQ ID NO: 16441 - protein, 9 aa, Homo Sapiens
TTDGKLPEV

SEQ ID NO: 16442 - protein, 9 aa, Homo Sapiens
TTISKVSQV

SEQ ID NO: 16443 - protein, 9 aa, Homo Sapiens
TTISRFEAL

SEQ ID NO: 16444 - protein, 9 aa, Homo Sapiens
TTLGHLEKA

SEQ ID NO: 16445 - protein, 9 aa, Homo Sapiens
TTLPGLLTV

SEQ ID NO: 16446 - protein, 9 aa, Homo Sapiens
TTTFIDPRL

SEQ ID NO: 16447 - protein, 9 aa, Homo Sapiens
TTVDHFWGL

SEQ ID NO: 16448 - protein, 9 aa, Homo Sapiens
TTVKKFFSA

SEQ ID NO: 16449 - protein, 9 aa, Homo Sapiens
TTVPTVHHV

SEQ ID NO: 16450 - protein, 9 aa, Homo Sapiens
TTVQKVARV

SEQ ID NO: 16451 - protein, 9 aa, Homo Sapiens
TTVSSLHQA

SEQ ID NO: 16452 - protein, 9 aa, Homo Sapiens
TVADHIQKV

SEQ ID NO: 16453 - protein, 9 aa, Homo Sapiens
TVADKIHSV

SEQ ID NO: 16454 - protein, 9 aa, Homo Sapiens
TVADTFEKV

SEQ ID NO: 16455 - protein, 9 aa, Homo Sapiens
TVAEKVDAV

SEQ ID NO: 16456 - protein, 9 aa, Homo Sapiens
TVAPFNPTV

SEQ ID NO: 16457 - protein, 9 aa, Homo Sapiens
TVCHVVIVV

SEQ ID NO: 16458 - protein, 9 aa, Homo Sapiens
TVFEHTFHV

SEQ ID NO: 16459 - protein, 9 aa, Homo Sapiens
TVFGNLHQA

SEQ ID NO: 16460 - protein, 9 aa, Homo Sapiens
TVFSHAQTV

SEQ ID NO: 16461 - protein, 9 aa, Homo Sapiens
TVHDKFLAL

SEQ ID NO: 16462 - protein, 9 aa, Homo Sapiens
TVIAKVNNV

SEQ ID NO: 16463 - protein, 9 aa, Homo Sapiens
TVIATNILL

SEQ ID NO: 16464 - protein, 9 aa, Homo Sapiens
TVIDQIPFL

SEQ ID NO: 16465 - protein, 9 aa, Homo Sapiens
TVIENIHTI

SEQ ID NO: 16466 - protein, 9 aa, Homo Sapiens
TVIPLNERL

SEQ ID NO: 16467 - protein, 9 aa, Homo Sapiens
TVIQFLERI

SEQ ID NO: 16468 - protein, 9 aa, Homo Sapiens
TVISILNTI

SEQ ID NO: 16469 - protein, 9 aa, Homo Sapiens
TVLDKTLSV

SEQ ID NO: 16470 - protein, 9 aa, Homo Sapiens
TVLEAVHDL

SEQ ID NO: 16471 - protein, 9 aa, Homo Sapiens
TVLEKVYEL

SEQ ID NO: 16472 - protein, 9 aa, Homo Sapiens
TVLERVEGA

SEQ ID NO: 16473 - protein, 9 aa, Homo Sapiens
TVLGKIWKL

SEQ ID NO: 16474 - protein, 9 aa, Homo Sapiens
TVLKKVSGV

SEQ ID NO: 16475 - protein, 9 aa, Homo Sapiens
TVLPFVSTV

SEQ ID NO: 16476 - protein, 9 aa, Homo Sapiens
TVLQELINV

SEQ ID NO: 16477 - protein, 9 aa, Homo Sapiens
TVLQQIDSV

SEQ ID NO: 16478 - protein, 9 aa, Homo Sapiens
TVMDEIHTV

SEQ ID NO: 16479 - protein, 9 aa, Homo Sapiens
TVMGKIFAV

SEQ ID NO: 16480 - protein, 9 aa, Homo Sapiens
TVMGRIATL

SEQ ID NO: 16481 - protein, 9 aa, Homo Sapiens
TVPVKIDKV

SEQ ID NO: 16482 - protein, 9 aa, Homo Sapiens
TVRELFEEL

SEQ ID NO: 16483 - protein, 9 aa, Homo Sapiens
TVREQCEQL

SEQ ID NO: 16484 - protein, 9 aa, Homo Sapiens
TVSPDRLEL

SEQ ID NO: 16485 - protein, 9 aa, Homo Sapiens
TVTGKLVHA

SEQ ID NO: 16486 - protein, 9 aa, Homo Sapiens
TVTNAVVTV

SEQ ID NO: 16487 - protein, 9 aa, Homo Sapiens
TVVAAIQAV

SEQ ID NO: 16488 - protein, 9 aa, Homo Sapiens
TVVERLVKV

SEQ ID NO: 16489 - protein, 9 aa, Homo Sapiens
TVVGKTYGL

SEQ ID NO: 16490 - protein, 9 aa, Homo Sapiens
TVVGRLEGL

SEQ ID NO: 16491 - protein, 9 aa, Homo Sapiens
TVVKAISGV

SEQ ID NO: 16492 - protein, 9 aa, Homo Sapiens
TVVMYLHHV

SEQ ID NO: 16493 - protein, 9 aa, Homo Sapiens
TVVNFLIRV

SEQ ID NO: 16494 - protein, 9 aa, Homo Sapiens
TVVPWDHAL

SEQ ID NO: 16495 - protein, 9 aa, Homo Sapiens
TVYEGFISA

SEQ ID NO: 16496 - protein, 9 aa, Homo Sapiens
TVYRELPCV

SEQ ID NO: 16497 - protein, 9 aa, Homo Sapiens
VAGPSFETV

SEQ ID NO: 16498 - protein, 9 aa, Homo Sapiens
VAIAGLMEV

SEQ ID NO: 16499 - protein, 9 aa, Homo Sapiens
VAIEHLDKI

SEQ ID NO: 16500 - protein, 9 aa, Homo Sapiens
VALDKVIEI

SEQ ID NO: 16501 - protein, 9 aa, Homo Sapiens
VAPLPRSAL

SEQ ID NO: 16502 - protein, 9 aa, Homo Sapiens
VATWVDETL

SEQ ID NO: 16503 - protein, 9 aa, Homo Sapiens
VAYEEFEKV

SEQ ID NO: 16504 - protein, 9 aa, Homo Sapiens
VGLKDRSIL

SEQ ID NO: 16505 - protein, 9 aa, Homo Sapiens
VGLVLMEGV

SEQ ID NO: 16506 - protein, 9 aa, Homo Sapiens
VIAEILRGV

SEQ ID NO: 16507 - protein, 9 aa, Homo Sapiens
VIFTKFDEV

SEQ ID NO: 16508 - protein, 9 aa, Homo Sapiens
VIIEKTYSL

SEQ ID NO: 16509 - protein, 9 aa, Homo Sapiens
VIIKGLEEI

SEQ ID NO: 16510 - protein, 9 aa, Homo Sapiens
VIIKYLESL

SEQ ID NO: 16511 - protein, 9 aa, Homo Sapiens
VIINQIYEA

SEQ ID NO: 16512 - protein, 9 aa, Homo Sapiens
VIIPLLHTV

SEQ ID NO: 16513 - protein, 9 aa, Homo Sapiens
VIIRTLLQA

SEQ ID NO: 16514 - protein, 9 aa, Homo Sapiens
VILPTVHEV

SEQ ID NO: 16515 - protein, 9 aa, Homo Sapiens
VILQNIHLV

SEQ ID NO: 16516 - protein, 9 aa, Homo Sapiens
VIPEKFQHI

SEQ ID NO: 16517 - protein, 9 aa, Homo Sapiens
VIPGKVEEV

SEQ ID NO: 16518 - protein, 9 aa, Homo Sapiens
VITETVVEV

SEQ ID NO: 16519 - protein, 9 aa, Homo Sapiens
VIVELIYKV

SEQ ID NO: 16520 - protein, 9 aa, Homo Sapiens
VIWKALIHL

SEQ ID NO: 16521 - protein, 9 aa, Homo Sapiens
VLAYFLPEA

SEQ ID NO: 16522 - protein, 9 aa, Homo Sapiens
VLDDKLVFV

SEQ ID NO: 16523 - protein, 9 aa, Homo Sapiens
VLDSFCEGL

SEQ ID NO: 16524 - protein, 9 aa, Homo Sapiens
VLDSVDVRL

SEQ ID NO: 16525 - protein, 9 aa, Homo Sapiens
VLFGLLREV

SEQ ID NO: 16526 - protein, 9 aa, Homo Sapiens
VLIANLEKL

SEQ ID NO: 16527 - protein, 9 aa, Homo Sapiens
VLIKWFPEV

SEQ ID NO: 16528 - protein, 9 aa, Homo Sapiens
VLIPKLPQL

SEQ ID NO: 16529 - protein, 9 aa, Homo Sapiens
VLIRELWNT

SEQ ID NO: 16530 - protein, 9 aa, Homo Sapiens
VLKVFLENV

SEQ ID NO: 16531 - protein, 9 aa, Homo Sapiens
VLLGHIFYV

SEQ ID NO: 16532 - protein, 9 aa, Homo Sapiens
VLLGKVYVV

SEQ ID NO: 16533 - protein, 9 aa, Homo Sapiens
VLMDRLPSL

SEQ ID NO: 16534 - protein, 9 aa, Homo Sapiens
VLMTEDIKL

SEQ ID NO: 16535 - protein, 9 aa, Homo Sapiens
VLNEYFHNV

SEQ ID NO: 16536 - protein, 9 aa, Homo Sapiens
VLPAEFFEV

SEQ ID NO: 16537 - protein, 9 aa, Homo Sapiens
VLPDDLSGV

SEQ ID NO: 16538 - protein, 9 aa, Homo Sapiens
VLQGKLAEV

SEQ ID NO: 16539 - protein, 9 aa, Homo Sapiens
VLWDRTFSL

SEQ ID NO: 16540 - protein, 9 aa, Homo Sapiens
VMAPRTLVL

SEQ ID NO: 16541 - protein, 9 aa, Homo Sapiens
VMPEAVPEV

SEQ ID NO: 16542 - protein, 9 aa, Homo Sapiens
VQADAPHGV

SEQ ID NO: 16543 - protein, 9 aa, Homo Sapiens
VQASHFEGL

SEQ ID NO: 16544 - protein, 9 aa, Homo Sapiens
VQDEFLEKL

SEQ ID NO: 16545 - protein, 9 aa, Homo Sapiens
VQDENVRGV

SEQ ID NO: 16546 - protein, 9 aa, Homo Sapiens
VQDRFEVNV

SEQ ID NO: 16547 - protein, 9 aa, Homo Sapiens
VQIEEKLLL

SEQ ID NO: 16548 - protein, 9 aa, Homo Sapiens
VQIGDIVTV

SEQ ID NO: 16549 - protein, 9 aa, Homo Sapiens
VQIPFFAKL

SEQ ID NO: 16550 - protein, 9 aa, Homo Sapiens
VQLGYSVLS

SEQ ID NO: 16551 - protein, 9 aa, Homo Sapiens
VQNDTLLQV

SEQ ID NO: 16552 - protein, 9 aa, Homo Sapiens
VQPEAQAKV

SEQ ID NO: 16553 - protein, 9 aa, Homo Sapiens
VQSGLRILL

SEQ ID NO: 16554 - protein, 9 aa, Homo Sapiens
VQSNRILGV

SEQ ID NO: 16555 - protein, 9 aa, Homo Sapiens
VQTDVLVRV

SEQ ID NO: 16556 - protein, 9 aa, Homo Sapiens
VQTDYVPLL

SEQ ID NO: 16557 - protein, 9 aa, Homo Sapiens
VQTEVNREL

SEQ ID NO: 16558 - protein, 9 aa, Homo Sapiens
VQTNDLKEV

SEQ ID NO: 16559 - protein, 9 aa, Homo Sapiens
VQVEDIVFL

SEQ ID NO: 16560 - protein, 9 aa, Homo Sapiens
VQVPVPVTV

SEQ ID NO: 16561 - protein, 9 aa, Homo Sapiens
VQYNEPLKV

SEQ ID NO: 16562 - protein, 9 aa, Homo Sapiens
VSTEVDARL

SEQ ID NO: 16563 - protein, 9 aa, Homo Sapiens
VTAGKVPEV

SEQ ID NO: 16564 - protein, 9 aa, Homo Sapiens
VTIRLLETI

SEQ ID NO: 16565 - protein, 9 aa, Homo Sapiens
VTITGIVKV

SEQ ID NO: 16566 - protein, 9 aa, Homo Sapiens
VTPKEFREI

SEQ ID NO: 16567 - protein, 9 aa, Homo Sapiens
VTTAVTEKV

SEQ ID NO: 16568 - protein, 9 aa, Homo Sapiens
VTVKGVTQV

SEQ ID NO: 16569 - protein, 9 aa, Homo Sapiens
VTYPGELLL

SEQ ID NO: 16570 - protein, 9 aa, Homo Sapiens
VVADETPAV

SEQ ID NO: 16571 - protein, 9 aa, Homo Sapiens
VVAEELENV

SEQ ID NO: 16572 - protein, 9 aa, Homo Sapiens
VVAGRFIEV

SEQ ID NO: 16573 - protein, 9 aa, Homo Sapiens
VVCGLIFRL

SEQ ID NO: 16574 - protein, 9 aa, Homo Sapiens
VVDAVVTQV

SEQ ID NO: 16575 - protein, 9 aa, Homo Sapiens
VVDEKLPGL

SEQ ID NO: 16576 - protein, 9 aa, Homo Sapiens
VVDGAFKEV

SEQ ID NO: 16577 - protein, 9 aa, Homo Sapiens
VVDPNDPQM

SEQ ID NO: 16578 - protein, 9 aa, Homo Sapiens
VVHDGFEGL

SEQ ID NO: 16579 - protein, 9 aa, Homo Sapiens
VVIKKLNEI

SEQ ID NO: 16580 - protein, 9 aa, Homo Sapiens
VVLEEIPKL

SEQ ID NO: 16581 - protein, 9 aa, Homo Sapiens
VVLPLELKL

SEQ ID NO: 16582 - protein, 9 aa, Homo Sapiens
VVLPTLAVV

SEQ ID NO: 16583 - protein, 9 aa, Homo Sapiens
VVMEELLKV

SEQ ID NO: 16584 - protein, 9 aa, Homo Sapiens
VVMETANRV

SEQ ID NO: 16585 - protein, 9 aa, Homo Sapiens
VVMNVVHQL

SEQ ID NO: 16586 - protein, 9 aa, Homo Sapiens
VVPAALKVV

SEQ ID NO: 16587 - protein, 9 aa, Homo Sapiens
VVPDKISEV

SEQ ID NO: 16588 - protein, 9 aa, Homo Sapiens
VVPEVIFKI

SEQ ID NO: 16589 - protein, 9 aa, Homo Sapiens
VVPQQLLTV

SEQ ID NO: 16590 - protein, 9 aa, Homo Sapiens
VVQPLLVSV

SEQ ID NO: 16591 - protein, 9 aa, Homo Sapiens
VVSEGVPRI

SEQ ID NO: 16592 - protein, 9 aa, Homo Sapiens
VVTGGVQSV

SEQ ID NO: 16593 - protein, 9 aa, Homo Sapiens
VVVDPIQSV

SEQ ID NO: 16594 - protein, 9 aa, Homo Sapiens
VVVGDLVEV

SEQ ID NO: 16595 - protein, 9 aa, Homo Sapiens
WLAEKLPTL

SEQ ID NO: 16596 - protein, 9 aa, Homo Sapiens
WLVDHVYAI

SEQ ID NO: 16597 - protein, 9 aa, Homo Sapiens
YAAELIERV

SEQ ID NO: 16598 - protein, 9 aa, Homo Sapiens
YAAEMIPKL

SEQ ID NO: 16599 - protein, 9 aa, Homo Sapiens
YAFNMKATV

SEQ ID NO: 16600 - protein, 9 aa, Homo Sapiens
YAFPKAVSV

SEQ ID NO: 16601 - protein, 9 aa, Homo Sapiens
YAFPKSITV

SEQ ID NO: 16602 - protein, 9 aa, Homo Sapiens
YAIEVDPVL

SEQ ID NO: 16603 - protein, 9 aa, Homo Sapiens
YAIHGVLEV

SEQ ID NO: 16604 - protein, 9 aa, Homo Sapiens
YAIKNIHGV

SEQ ID NO: 16605 - protein, 9 aa, Homo Sapiens
YAITTLHNL

SEQ ID NO: 16606 - protein, 9 aa, Homo Sapiens
YALNHTLSV

SEQ ID NO: 16607 - protein, 9 aa, Homo Sapiens
YAYDGKDYI

SEQ ID NO: 16608 - protein, 9 aa, Homo Sapiens
YGAEALERM

SEQ ID NO: 16609 - protein, 9 aa, Homo Sapiens
YGIPRLEKI

SEQ ID NO: 16610 - protein, 9 aa, Homo Sapiens
YGLDKIEFL

SEQ ID NO: 16611 - protein, 9 aa, Homo Sapiens
YGLPVVVKL

SEQ ID NO: 16612 - protein, 9 aa, Homo Sapiens
YGMERVWCV

SEQ ID NO: 16613 - protein, 9 aa, Homo Sapiens
YGVTTIVRV

SEQ ID NO: 16614 - protein, 9 aa, Homo Sapiens
YIDHGDPQV

SEQ ID NO: 16615 - protein, 9 aa, Homo Sapiens
YIFDNCHEL

SEQ ID NO: 16616 - protein, 9 aa, Homo Sapiens
YIHVHFLEV

SEQ ID NO: 16617 - protein, 9 aa, Homo Sapiens
YIIEVNARL

SEQ ID NO: 16618 - protein, 9 aa, Homo Sapiens
YIITEIPSL

SEQ ID NO: 16619 - protein, 9 aa, Homo Sapiens
YILLEDPQL

SEQ ID NO: 16620 - protein, 9 aa, Homo Sapiens
YIPSVLHDV

SEQ ID NO: 16621 - protein, 9 aa, Homo Sapiens
YIPTELDQV

SEQ ID NO: 16622 - protein, 9 aa, Homo Sapiens
YIPTFICSV

SEQ ID NO: 16623 - protein, 9 aa, Homo Sapiens
YIVDLLTHL

SEQ ID NO: 16624 - protein, 9 aa, Homo Sapiens
YIYMHFGEV

SEQ ID NO: 16625 - protein, 9 aa, Homo Sapiens
YLDFTNPKV

SEQ ID NO: 16626 - protein, 9 aa, Homo Sapiens
YLHSQVVSV

SEQ ID NO: 16627 - protein, 9 aa, Homo Sapiens
YLINEIDRI

SEQ ID NO: 16628 - protein, 9 aa, Homo Sapiens
YLIPLLERL

SEQ ID NO: 16629 - protein, 9 aa, Homo Sapiens
YLITLLEHL

SEQ ID NO: 16630 - protein, 9 aa, Homo Sapiens
YLKDFFSNV

SEQ ID NO: 16631 - protein, 9 aa, Homo Sapiens
YLLDLHSYL

SEQ ID NO: 16632 - protein, 9 aa, Homo Sapiens
YLLDQHILI

SEQ ID NO: 16633 - protein, 9 aa, Homo Sapiens
YLLESVNKL

SEQ ID NO: 16634 - protein, 9 aa, Homo Sapiens
YLLPAIVHI

SEQ ID NO: 16635 - protein, 9 aa, Homo Sapiens
YLPAVFEEV

SEQ ID NO: 16636 - protein, 9 aa, Homo Sapiens
YLPPGFLSA

SEQ ID NO: 16637 - protein, 9 aa, Homo Sapiens
YLPTKLFQA

SEQ ID NO: 16638 - protein, 9 aa, Homo Sapiens
YLPVKIEQV

SEQ ID NO: 16639 - protein, 9 aa, Homo Sapiens
YLPYPIHQV

SEQ ID NO: 16640 - protein, 9 aa, Homo Sapiens
YLSEEVQAV

SEQ ID NO: 16641 - protein, 9 aa, Homo Sapiens
YLSPDLSKV

SEQ ID NO: 16642 - protein, 9 aa, Homo Sapiens
YLSPKLWAL

SEQ ID NO: 16643 - protein, 9 aa, Homo Sapiens
YLTDRVMTV

SEQ ID NO: 16644 - protein, 9 aa, Homo Sapiens
YLTHDSPSV

SEQ ID NO: 16645 - protein, 9 aa, Homo Sapiens
YLTKKFAEL

SEQ ID NO: 16646 - protein, 9 aa, Homo Sapiens
YLVEDIQHI

SEQ ID NO: 16647 - protein, 9 aa, Homo Sapiens
YLVKIFEEL

SEQ ID NO: 16648 - protein, 9 aa, Homo Sapiens
YLVPELDGV

SEQ ID NO: 16649 - protein, 9 aa, Homo Sapiens
YLVVKIEKV

SEQ ID NO: 16650 - protein, 9 aa, Homo Sapiens
YMAPEVVEA

SEQ ID NO: 16651 - protein, 9 aa, Homo Sapiens
YMIAHITGL

SEQ ID NO: 16652 - protein, 9 aa, Homo Sapiens
YQDLLNVKM

SEQ ID NO: 16653 - protein, 9 aa, Homo Sapiens
YQDTHPERL

SEQ ID NO: 16654 - protein, 9 aa, Homo Sapiens
YQDTPGVKM

SEQ ID NO: 16655 - protein, 9 aa, Homo Sapiens
YQFENFPGL

SEQ ID NO: 16656 - protein, 9 aa, Homo Sapiens
YQFGEIRTI

SEQ ID NO: 16657 - protein, 9 aa, Homo Sapiens
YQHGIFQSI

SEQ ID NO: 16658 - protein, 9 aa, Homo Sapiens
YQIDKLIKT

SEQ ID NO: 16659 - protein, 9 aa, Homo Sapiens
YQLGELVKV

SEQ ID NO: 16660 - protein, 9 aa, Homo Sapiens
YQLSKEYTL

SEQ ID NO: 16661 - protein, 9 aa, Homo Sapiens
YQPYEIPAV

SEQ ID NO: 16662 - protein, 9 aa, Homo Sapiens
YQSELELRV

SEQ ID NO: 16663 - protein, 9 aa, Homo Sapiens
YQTALHLAV

SEQ ID NO: 16664 - protein, 9 aa, Homo Sapiens
YQTEIGQTL

SEQ ID NO: 16665 - protein, 9 aa, Homo Sapiens
YQTEKGITV

SEQ ID NO: 16666 - protein, 9 aa, Homo Sapiens
YQTPFNKEV

SEQ ID NO: 16667 - protein, 9 aa, Homo Sapiens
YQTPLELKL

SEQ ID NO: 16668 - protein, 9 aa, Homo Sapiens
YQTPLHLAV

SEQ ID NO: 16669 - protein, 9 aa, Homo Sapiens
YQVGVHYEL

SEQ ID NO: 16670 - protein, 9 aa, Homo Sapiens
YQYPVIIHL

SEQ ID NO: 16671 - protein, 9 aa, Homo Sapiens
YSFHKFHYL

SEQ ID NO: 16672 - protein, 9 aa, Homo Sapiens
YSLEKVFGI

SEQ ID NO: 16673 - protein, 9 aa, Homo Sapiens
YSVDRLYEL

SEQ ID NO: 16674 - protein, 9 aa, Homo Sapiens
YTIDSDWRF

SEQ ID NO: 16675 - protein, 9 aa, Homo Sapiens
YTIPLAIKL

SEQ ID NO: 16676 - protein, 9 aa, Homo Sapiens
YTLREVDTV

SEQ ID NO: 16677 - protein, 9 aa, Homo Sapiens
YTMEELHQL

SEQ ID NO: 16678 - protein, 9 aa, Homo Sapiens
YTSDHFETI

SEQ ID NO: 16679 - protein, 9 aa, Homo Sapiens
YTSGTFRTV

SEQ ID NO: 16680 - protein, 9 aa, Homo Sapiens
YTSPDFLYV

SEQ ID NO: 16681 - protein, 9 aa, Homo Sapiens
YTSPVNPAV

SEQ ID NO: 16682 - protein, 9 aa, Homo Sapiens
YTTDRVMTV

SEQ ID NO: 16683 - protein, 9 aa, Homo Sapiens
YTVEDIQRL

SEQ ID NO: 16684 - protein, 9 aa, Homo Sapiens
YTWEEVFRV

SEQ ID NO: 16685 - protein, 9 aa, Homo Sapiens
YVDPLDPSF

SEQ ID NO: 16686 - protein, 9 aa, Homo Sapiens
YVDPVNKVL

SEQ ID NO: 16687 - protein, 9 aa, Homo Sapiens
YVEPLKLYL

SEQ ID NO: 16688 - protein, 9 aa, Homo Sapiens
YVFPGVTRL

SEQ ID NO: 16689 - protein, 9 aa, Homo Sapiens
YVIGGFDGL

SEQ ID NO: 16690 - protein, 9 aa, Homo Sapiens
YVINVTTHL

SEQ ID NO: 16691 - protein, 9 aa, Homo Sapiens
YVLDDLIVA

SEQ ID NO: 16692 - protein, 9 aa, Homo Sapiens
YVLDLAAKV

SEQ ID NO: 16693 - protein, 9 aa, Homo Sapiens
YVLEGLKSV

SEQ ID NO: 16694 - protein, 9 aa, Homo Sapiens
YVLPEVSKV

SEQ ID NO: 16695 - protein, 9 aa, Homo Sapiens
YVPETVYRV

SEQ ID NO: 16696 - protein, 9 aa, Homo Sapiens
YVPPELITL

SEQ ID NO: 16697 - protein, 9 aa, Homo Sapiens
YVPTSYVEV

SEQ ID NO: 16698 - protein, 9 aa, Homo Sapiens
YVSEILEKV

SEQ ID NO: 16699 - protein, 9 aa, Homo Sapiens
YVSGELEHV

SEQ ID NO: 16700 - protein, 9 aa, Homo Sapiens
YVTEELPQL

SEQ ID NO: 16701 - protein, 9 aa, Homo Sapiens
YVTPVNRNV

SEQ ID NO: 16702 - protein, 9 aa, Homo Sapiens
YVTSVILHI

SEQ ID NO: 16703 - protein, 9 aa, Homo Sapiens
YVVPFVAKV

SEQ ID NO: 16704 - protein, 9 aa, Homo Sapiens
YVYEYLLHV

SEQ ID NO: 16705 - protein, 10 aa, Homo Sapiens
AAFEFDIHQV

SEQ ID NO: 16706 - protein, 10 aa, Homo Sapiens
AAFYHHLPAA

SEQ ID NO: 16707 - protein, 10 aa, Homo Sapiens
AALDFKLAAA

SEQ ID NO: 16708 - protein, 10 aa, Homo Sapiens
AATGGGIVRV

SEQ ID NO: 16709 - protein, 10 aa, Homo Sapiens
AIDPHLLLSV

SEQ ID NO: 16710 - protein, 10 aa, Homo Sapiens
AIIDGKIFCV

SEQ ID NO: 16711 - protein, 10 aa, Homo Sapiens
ALCEENMRGV

SEQ ID NO: 16712 - protein, 10 aa, Homo Sapiens
ALIDEQILCV

SEQ ID NO: 16713 - protein, 10 aa, Homo Sapiens
ALMAHAMEEV

SEQ ID NO: 16714 - protein, 10 aa, Homo Sapiens
ALPDQGIAKA

SEQ ID NO: 16715 - protein, 10 aa, Homo Sapiens
ALPEILFAKV

SEQ ID NO: 16716 - protein, 10 aa, Homo Sapiens
ALSKEGIVAL

SEQ ID NO: 16717 - protein, 10 aa, Homo Sapiens
ALYPGQLVQL

SEQ ID NO: 16718 - protein, 10 aa, Homo Sapiens
AMFDHIPVGV

SEQ ID NO: 16719 - protein, 10 aa, Homo Sapiens
AQAELQQHDV

SEQ ID NO: 16720 - protein, 10 aa, Homo Sapiens
AQDEERQASL

SEQ ID NO: 16721 - protein, 10 aa, Homo Sapiens
AQDEHLITFF

SEQ ID NO: 16722 - protein, 10 aa, Homo Sapiens
AQFPRFSPVL

SEQ ID NO: 16723 - protein, 10 aa, Homo Sapiens
AQHDPLLTGV

SEQ ID NO: 16724 - protein, 10 aa, Homo Sapiens
AQIEDLQVKL

SEQ ID NO: 16725 - protein, 10 aa, Homo Sapiens
AQMDYYGTRL

SEQ ID NO: 16726 - protein, 10 aa, Homo Sapiens
AQWDIGIAHA

SEQ ID NO: 16727 - protein, 10 aa, Homo Sapiens
AQYEHDLEVA

SEQ ID NO: 16728 - protein, 10 aa, Homo Sapiens
ASFNDTFVHV

SEQ ID NO: 16729 - protein, 10 aa, Homo Sapiens
ASLDKFLANV

SEQ ID NO: 16730 - protein, 10 aa, Homo Sapiens
ATPEGIFLRV

SEQ ID NO: 16731 - protein, 10 aa, Homo Sapiens
ATYDKLCKEV

SEQ ID NO: 16732 - protein, 10 aa, Homo Sapiens
AVFDKTLAEL

SEQ ID NO: 16733 - protein, 10 aa, Homo Sapiens
AVFKGKFKEG

SEQ ID NO: 16734 - protein, 10 aa, Homo Sapiens
AVFPDDMPTL

SEQ ID NO: 16735 - protein, 10 aa, Homo Sapiens
AVIDVGINRV

SEQ ID NO: 16736 - protein, 10 aa, Homo Sapiens
AVIEKFAPIK

SEQ ID NO: 16737 - protein, 10 aa, Homo Sapiens
AVLDGRELRV

SEQ ID NO: 16738 - protein, 10 aa, Homo Sapiens
AVLDKEIIQL

SEQ ID NO: 16739 - protein, 10 aa, Homo Sapiens
AVLPEMENQV

SEQ ID NO: 16740 - protein, 10 aa, Homo Sapiens
AVPDEIPPLE

SEQ ID NO: 16741 - protein, 10 aa, Homo Sapiens
AVPEKLQPLL

SEQ ID NO: 16742 - protein, 10 aa, Homo Sapiens
AVVDGAFKEV

SEQ ID NO: 16743 - protein, 10 aa, Homo Sapiens
AVYEGHVSCV

SEQ ID NO: 16744 - protein, 10 aa, Homo Sapiens
FAAPEKDIFL

SEQ ID NO: 16745 - protein, 10 aa, Homo Sapiens
FAFESDLHSL

SEQ ID NO: 16746 - protein, 10 aa, Homo Sapiens
FAYDGKDYLT

SEQ ID NO: 16747 - protein, 10 aa, Homo Sapiens
FGYPFRLNEA

SEQ ID NO: 16748 - protein, 10 aa, Homo Sapiens
FIASKGVKLV

SEQ ID NO: 16749 - protein, 10 aa, Homo Sapiens
FICDYELHEL

SEQ ID NO: 16750 - protein, 10 aa, Homo Sapiens
FICPVVGLEM

SEQ ID NO: 16751 - protein, 10 aa, Homo Sapiens
FIFDVHVHEV

SEQ ID NO: 16752 - protein, 10 aa, Homo Sapiens
FIFEKKLAQA

SEQ ID NO: 16753 - protein, 10 aa, Homo Sapiens
FILNGDFERL

SEQ ID NO: 16754 - protein, 10 aa, Homo Sapiens
FIMEGTLTRV

SEQ ID NO: 16755 - protein, 10 aa, Homo Sapiens
FISGAGILRL

SEQ ID NO: 16756 - protein, 10 aa, Homo Sapiens
FIYHGEVPQA

SEQ ID NO: 16757 - protein, 10 aa, Homo Sapiens
FLFDGSPTYV

SEQ ID NO: 16758 - protein, 10 aa, Homo Sapiens
FLLGPRLVLA

SEQ ID NO: 16759 - protein, 10 aa, Homo Sapiens
FLLPHPGLKV

SEQ ID NO: 16760 - protein, 10 aa, Homo Sapiens
FLLPHPGLQV

SEQ ID NO: 16761 - protein, 10 aa, Homo Sapiens
FLLPIKTVGV

SEQ ID NO: 16762 - protein, 10 aa, Homo Sapiens
FLPSHSLDTV

SEQ ID NO: 16763 - protein, 10 aa, Homo Sapiens
FLQEGDLISA

SEQ ID NO: 16764 - protein, 10 aa, Homo Sapiens
FLYTGEGDTV

SEQ ID NO: 16765 - protein, 10 aa, Homo Sapiens
FMFDEKLVTV

SEQ ID NO: 16766 - protein, 10 aa, Homo Sapiens
FQVKEVDVGL

SEQ ID NO: 16767 - protein, 10 aa, Homo Sapiens
FQYESKVFYL

SEQ ID NO: 16768 - protein, 10 aa, Homo Sapiens
FSWEGAFQHV

SEQ ID NO: 16769 - protein, 10 aa, Homo Sapiens
FTIPEAFRGV

SEQ ID NO: 16770 - protein, 10 aa, Homo Sapiens
FTPDVKVWEV

SEQ ID NO: 16771 - protein, 10 aa, Homo Sapiens
FTSDRGFQFV

SEQ ID NO: 16772 - protein, 10 aa, Homo Sapiens
FVADEELVHL

SEQ ID NO: 16773 - protein, 10 aa, Homo Sapiens
FVADEGICYL

SEQ ID NO: 16774 - protein, 10 aa, Homo Sapiens
FVDKTVLPFV

SEQ ID NO: 16775 - protein, 10 aa, Homo Sapiens
FVDPNGKISL

SEQ ID NO: 16776 - protein, 10 aa, Homo Sapiens
FVDPSQDHAL

SEQ ID NO: 16777 - protein, 10 aa, Homo Sapiens
FVEDTECRTL

SEQ ID NO: 16778 - protein, 10 aa, Homo Sapiens
FVLDEADEML

SEQ ID NO: 16779 - protein, 10 aa, Homo Sapiens
FVLHSPGMSV

SEQ ID NO: 16780 - protein, 10 aa, Homo Sapiens
FVYPLDFART

SEQ ID NO: 16781 - protein, 10 aa, Homo Sapiens
GIFPKSFIHI

SEQ ID NO: 16782 - protein, 10 aa, Homo Sapiens
GIFSAEFLKV

SEQ ID NO: 16783 - protein, 10 aa, Homo Sapiens
GLAGVKIAEV

SEQ ID NO: 16784 - protein, 10 aa, Homo Sapiens
GLIGVGLINV

SEQ ID NO: 16785 - protein, 10 aa, Homo Sapiens
GLPRFGIEMV

SEQ ID NO: 16786 - protein, 10 aa, Homo Sapiens
GLSTEGIYRV

SEQ ID NO: 16787 - protein, 10 aa, Homo Sapiens
GPPPPPGKPQ

SEQ ID NO: 16788 - protein, 10 aa, Homo Sapiens
GQIEDLKIHL

SEQ ID NO: 16789 - protein, 10 aa, Homo Sapiens
GQWSQGLISA

SEQ ID NO: 16790 - protein, 10 aa, Homo Sapiens
GQYEPHFDFA

SEQ ID NO: 16791 - protein, 10 aa, Homo Sapiens
GVFEGKLNVI

SEQ ID NO: 16792 - protein, 10 aa, Homo Sapiens
GVFPDNFVKL

SEQ ID NO: 16793 - protein, 10 aa, Homo Sapiens
GVIAEILRGV

SEQ ID NO: 16794 - protein, 10 aa, Homo Sapiens
GVIDGHIYAV

SEQ ID NO: 16795 - protein, 10 aa, Homo Sapiens
GVIDLIFEKA

SEQ ID NO: 16796 - protein, 10 aa, Homo Sapiens
GVIGGDNIRL

SEQ ID NO: 16797 - protein, 10 aa, Homo Sapiens
GVLDSVDVRL

SEQ ID NO: 16798 - protein, 10 aa, Homo Sapiens
GVLFHNLPSL

SEQ ID NO: 16799 - protein, 10 aa, Homo Sapiens
GVLKVFLENV

SEQ ID NO: 16800 - protein, 10 aa, Homo Sapiens
GVPSTAIREI

SEQ ID NO: 16801 - protein, 10 aa, Homo Sapiens
HGFAGYFETV

SEQ ID NO: 16802 - protein, 10 aa, Homo Sapiens
HIYHQHFDSV

SEQ ID NO: 16803 - protein, 10 aa, Homo Sapiens
HLPGSSNSPA

SEQ ID NO: 16804 - protein, 10 aa, Homo Sapiens
HLPSDFTPAV

SEQ ID NO: 16805 - protein, 10 aa, Homo Sapiens
HLYEEKFESI

SEQ ID NO: 16806 - protein, 10 aa, Homo Sapiens
HQLENLSNFI

SEQ ID NO: 16807 - protein, 10 aa, Homo Sapiens
HTLGDAHIYL

SEQ ID NO: 16808 - protein, 10 aa, Homo Sapiens
HVLDVIHEVL

SEQ ID NO: 16809 - protein, 10 aa, Homo Sapiens
IIMLEALERV

SEQ ID NO: 16810 - protein, 10 aa, Homo Sapiens
ILAPCKLETV

SEQ ID NO: 16811 - protein, 10 aa, Homo Sapiens
ILITGGIVAT

SEQ ID NO: 16812 - protein, 10 aa, Homo Sapiens
ITFPGCFTNT

SEQ ID NO: 16813 - protein, 10 aa, Homo Sapiens
IVDKSGVVRV

SEQ ID NO: 16814 - protein, 10 aa, Homo Sapiens
IVPDLDLQQV

SEQ ID NO: 16815 - protein, 10 aa, Homo Sapiens
KAIRDGVIEA

SEQ ID NO: 16816 - protein, 10 aa, Homo Sapiens
KALPDSMVSV

SEQ ID NO: 16817 - protein, 10 aa, Homo Sapiens
KAYQELLATV

SEQ ID NO: 16818 - protein, 10 aa, Homo Sapiens
KAYYHLLEQV

SEQ ID NO: 16819 - protein, 10 aa, Homo Sapiens
KIADFGLARV

SEQ ID NO: 16820 - protein, 10 aa, Homo Sapiens
KICDFGLARV

SEQ ID NO: 16821 - protein, 10 aa, Homo Sapiens
KIDEHHFVAV

SEQ ID NO: 16822 - protein, 10 aa, Homo Sapiens
KIFDEILVNA

SEQ ID NO: 16823 - protein, 10 aa, Homo Sapiens
KIFSGVFVKV

SEQ ID NO: 16824 - protein, 10 aa, Homo Sapiens
KIGDFGLATV

SEQ ID NO: 16825 - protein, 10 aa, Homo Sapiens
KIIETDFEKA

SEQ ID NO: 16826 - protein, 10 aa, Homo Sapiens
KIIYIVHDEV

SEQ ID NO: 16827 - protein, 10 aa, Homo Sapiens
KLFNGTFLKA

SEQ ID NO: 16828 - protein, 10 aa, Homo Sapiens
KLHDVELHQV

SEQ ID NO: 16829 - protein, 10 aa, Homo Sapiens
KLIEKLDIKL

SEQ ID NO: 16830 - protein, 10 aa, Homo Sapiens
KLLDEAIQAV

SEQ ID NO: 16831 - protein, 10 aa, Homo Sapiens
KLLDPEDISV

SEQ ID NO: 16832 - protein, 10 aa, Homo Sapiens
KLLEVNGVAL

SEQ ID NO: 16833 - protein, 10 aa, Homo Sapiens
KLLVSGFWGV

SEQ ID NO: 16834 - protein, 10 aa, Homo Sapiens
KLVEFDFLGA

SEQ ID NO: 16835 - protein, 10 aa, Homo Sapiens
KLYDIDVAKV

SEQ ID NO: 16836 - protein, 10 aa, Homo Sapiens
KMIEDLQNEL

SEQ ID NO: 16837 - protein, 10 aa, Homo Sapiens
KMYEEFLSKV

SEQ ID NO: 16838 - protein, 10 aa, Homo Sapiens
KQFDDVLIYL

SEQ ID NO: 16839 - protein, 10 aa, Homo Sapiens
KQFEPNDFYL

SEQ ID NO: 16840 - protein, 10 aa, Homo Sapiens
KQLDDLKVEL

SEQ ID NO: 16841 - protein, 10 aa, Homo Sapiens
KQLEETNLQL

SEQ ID NO: 16842 - protein, 10 aa, Homo Sapiens
KQMEQISQFL

SEQ ID NO: 16843 - protein, 10 aa, Homo Sapiens
KQVDLENVWL

SEQ ID NO: 16844 - protein, 10 aa, Homo Sapiens
KSIDFPLTKV

SEQ ID NO: 16845 - protein, 10 aa, Homo Sapiens
KTIEDDLVSA

SEQ ID NO: 16846 - protein, 10 aa, Homo Sapiens
KTIEDTLMTV

SEQ ID NO: 16847 - protein, 10 aa, Homo Sapiens
KTIEGITVTV

SEQ ID NO: 16848 - protein, 10 aa, Homo Sapiens
KTLQEFLERI

SEQ ID NO: 16849 - protein, 10 aa, Homo Sapiens
KTLTGKTITL

SEQ ID NO: 16850 - protein, 10 aa, Homo Sapiens
KTMEDTLMTV

SEQ ID NO: 16851 - protein, 10 aa, Homo Sapiens
KTYEAALETI

SEQ ID NO: 16852 - protein, 10 aa, Homo Sapiens
KVAGRVIVEV

SEQ ID NO: 16853 - protein, 10 aa, Homo Sapiens
KVFDPVPVGV

SEQ ID NO: 16854 - protein, 10 aa, Homo Sapiens
KVFELDLVTL

SEQ ID NO: 16855 - protein, 10 aa, Homo Sapiens
KVGNFKFIYV

SEQ ID NO: 16856 - protein, 10 aa, Homo Sapiens
KVIEAIRVEL

SEQ ID NO: 16857 - protein, 10 aa, Homo Sapiens
KVLDIMPLTL

SEQ ID NO: 16858 - protein, 10 aa, Homo Sapiens
KVLDQKEHRL

SEQ ID NO: 16859 - protein, 10 aa, Homo Sapiens
KVLDSFCEGL

SEQ ID NO: 16860 - protein, 10 aa, Homo Sapiens
KVLEDCNIVL

SEQ ID NO: 16861 - protein, 10 aa, Homo Sapiens
KVLEFERVYL

SEQ ID NO: 16862 - protein, 10 aa, Homo Sapiens
KVLGEAMTGI

SEQ ID NO: 16863 - protein, 10 aa, Homo Sapiens
KVSNSGITRV

SEQ ID NO: 16864 - protein, 10 aa, Homo Sapiens
KVVEDGILKL

SEQ ID NO: 16865 - protein, 10 aa, Homo Sapiens
LADPSAFVAA

SEQ ID NO: 16866 - protein, 10 aa, Homo Sapiens
LAFEEEFGRV

SEQ ID NO: 16867 - protein, 10 aa, Homo Sapiens
LFLHAGIVLP

SEQ ID NO: 16868 - protein, 10 aa, Homo Sapiens
LIFPKEFETA

SEQ ID NO: 16869 - protein, 10 aa, Homo Sapiens
LILEGNDIEL

SEQ ID NO: 16870 - protein, 10 aa, Homo Sapiens
LILPHVDIQL

SEQ ID NO: 16871 - protein, 10 aa, Homo Sapiens
LIPDEVFDAV

SEQ ID NO: 16872 - protein, 10 aa, Homo Sapiens
LLLDVPTAAV

SEQ ID NO: 16873 - protein, 10 aa, Homo Sapiens
LLPELRDWGV

SEQ ID NO: 16874 - protein, 10 aa, Homo Sapiens
LLPSEGIVHL

SEQ ID NO: 16875 - protein, 10 aa, Homo Sapiens
LNGQKLLEQV

SEQ ID NO: 16876 - protein, 10 aa, Homo Sapiens
LQIEDFEARI

SEQ ID NO: 16877 - protein, 10 aa, Homo Sapiens
LTIEDGIFEV

SEQ ID NO: 16878 - protein, 10 aa, Homo Sapiens
LTNQEDLPEV

SEQ ID NO: 16879 - protein, 10 aa, Homo Sapiens
LVYEGQLSQA

SEQ ID NO: 16880 - protein, 10 aa, Homo Sapiens
LVYQEPIPTA

SEQ ID NO: 16881 - protein, 10 aa, Homo Sapiens
MQAERIFSEV

SEQ ID NO: 16882 - protein, 10 aa, Homo Sapiens
MQLEDLKQQL

SEQ ID NO: 16883 - protein, 10 aa, Homo Sapiens
MVLLGVLGSL

SEQ ID NO: 16884 - protein, 10 aa, Homo Sapiens
MVLSSPLALA

SEQ ID NO: 16885 - protein, 10 aa, Homo Sapiens
MVVQDGIVKA

SEQ ID NO: 16886 - protein, 10 aa, Homo Sapiens
NIFQLPFKHV

SEQ ID NO: 16887 - protein, 10 aa, Homo Sapiens
NITDKGIIAL

SEQ ID NO: 16888 - protein, 10 aa, Homo Sapiens
NQAKDSIVSV

SEQ ID NO: 16889 - protein, 10 aa, Homo Sapiens
NQIGAKFWEV

SEQ ID NO: 16890 - protein, 10 aa, Homo Sapiens
NQWDGTQHGV

SEQ ID NO: 16891 - protein, 10 aa, Homo Sapiens
NVPEGLLATV

SEQ ID NO: 16892 - protein, 10 aa, Homo Sapiens
QGVVTTLENV

SEQ ID NO: 16893 - protein, 10 aa, Homo Sapiens
QIFNGTFVKL

SEQ ID NO: 16894 - protein, 10 aa, Homo Sapiens
QLEEEGITFV

SEQ ID NO: 16895 - protein, 10 aa, Homo Sapiens
QQFQEPFVAV

SEQ ID NO: 16896 - protein, 10 aa, Homo Sapiens
QSLAGGIIGV

SEQ ID NO: 16897 - protein, 10 aa, Homo Sapiens
QVFPGLLERV

SEQ ID NO: 16898 - protein, 10 aa, Homo Sapiens
QVMPGNIVFV

SEQ ID NO: 16899 - protein, 10 aa, Homo Sapiens
QVVDEKLPGL

SEQ ID NO: 16900 - protein, 10 aa, Homo Sapiens
QVYRGALQKV

SEQ ID NO: 16901 - protein, 10 aa, Homo Sapiens
RAFHPDLEFV

SEQ ID NO: 16902 - protein, 10 aa, Homo Sapiens
RIIDSLFNTV

SEQ ID NO: 16903 - protein, 10 aa, Homo Sapiens
RLLDEEISRV

SEQ ID NO: 16904 - protein, 10 aa, Homo Sapiens
RLLDLENIQI

SEQ ID NO: 16905 - protein, 10 aa, Homo Sapiens
RLLSEDFVSV

SEQ ID NO: 16906 - protein, 10 aa, Homo Sapiens
RLPEHVTVQV

SEQ ID NO: 16907 - protein, 10 aa, Homo Sapiens
RLYDGLFKVI

SEQ ID NO: 16908 - protein, 10 aa, Homo Sapiens
RLYPAFMEGI

SEQ ID NO: 16909 - protein, 10 aa, Homo Sapiens
RLYPEGLAQL

SEQ ID NO: 16910 - protein, 10 aa, Homo Sapiens
RLYPWGVVEV

SEQ ID NO: 16911 - protein, 10 aa, Homo Sapiens
RMFDGKFVVA

SEQ ID NO: 16912 - protein, 10 aa, Homo Sapiens
RQPDSGISSI

SEQ ID NO: 16913 - protein, 10 aa, Homo Sapiens
RQVEDLQATF

SEQ ID NO: 16914 - protein, 10 aa, Homo Sapiens
RQYPWGVAEV

SEQ ID NO: 16915 - protein, 10 aa, Homo Sapiens
RSYDFEFMQV

SEQ ID NO: 16916 - protein, 10 aa, Homo Sapiens
RTADGEFMAV

SEQ ID NO: 16917 - protein, 10 aa, Homo Sapiens
RTVEAFLKEA

SEQ ID NO: 16918 - protein, 10 aa, Homo Sapiens
RVAEVIFPTA

SEQ ID NO: 16919 - protein, 10 aa, Homo Sapiens
RVAQLEQVYI

SEQ ID NO: 16920 - protein, 10 aa, Homo Sapiens
RVFIGNLNTL

SEQ ID NO: 16921 - protein, 10 aa, Homo Sapiens
RVIQKALESI

SEQ ID NO: 16922 - protein, 10 aa, Homo Sapiens
RVLDFDPMAV

SEQ ID NO: 16923 - protein, 10 aa, Homo Sapiens
RVLEKLGVTV

SEQ ID NO: 16924 - protein, 10 aa, Homo Sapiens
RVLGENAIAV

SEQ ID NO: 16925 - protein, 10 aa, Homo Sapiens
RVLGPKIEAV

SEQ ID NO: 16926 - protein, 10 aa, Homo Sapiens
RVPSDPFTGV

SEQ ID NO: 16927 - protein, 10 aa, Homo Sapiens
RVVDELDNQM

SEQ ID NO: 16928 - protein, 10 aa, Homo Sapiens
SIIGKKGESV

SEQ ID NO: 16929 - protein, 10 aa, Homo Sapiens
SIPDFPMHLA

SEQ ID NO: 16930 - protein, 10 aa, Homo Sapiens
SIPEGALVAV

SEQ ID NO: 16931 - protein, 10 aa, Homo Sapiens
SIYNGDMEKI

SEQ ID NO: 16932 - protein, 10 aa, Homo Sapiens
SLADLQNDEV

SEQ ID NO: 16933 - protein, 10 aa, Homo Sapiens
SLAELKGFEV

SEQ ID NO: 16934 - protein, 10 aa, Homo Sapiens
SLFAGGMLRV

SEQ ID NO: 16935 - protein, 10 aa, Homo Sapiens
SLINVGLISV

SEQ ID NO: 16936 - protein, 10 aa, Homo Sapiens
SLLDRFLATV

SEQ ID NO: 16937 - protein, 10 aa, Homo Sapiens
SLLGGDVVSV

SEQ ID NO: 16938 - protein, 10 aa, Homo Sapiens
SLPDFGISYV

SEQ ID NO: 16939 - protein, 10 aa, Homo Sapiens
SLVAVELEKV

SEQ ID NO: 16940 - protein, 10 aa, Homo Sapiens
SQFQQEFPSL

SEQ ID NO: 16941 - protein, 10 aa, Homo Sapiens
SQIEDVRLFL

SEQ ID NO: 16942 - protein, 10 aa, Homo Sapiens
SQVDDLKAKL

SEQ ID NO: 16943 - protein, 10 aa, Homo Sapiens
SQVDRLVALA

SEQ ID NO: 16944 - protein, 10 aa, Homo Sapiens
SQYEEQFVTL

SEQ ID NO: 16945 - protein, 10 aa, Homo Sapiens
STLDGSLHAV

SEQ ID NO: 16946 - protein, 10 aa, Homo Sapiens
SVCDIQLNQV

SEQ ID NO: 16947 - protein, 10 aa, Homo Sapiens
SVCSKAFVNV

SEQ ID NO: 16948 - protein, 10 aa, Homo Sapiens
SVFGGKNIHV

SEQ ID NO: 16949 - protein, 10 aa, Homo Sapiens
SVLDDKLVFV

SEQ ID NO: 16950 - protein, 10 aa, Homo Sapiens
SVLDEEIAKA

SEQ ID NO: 16951 - protein, 10 aa, Homo Sapiens
SVLGQAMEKV

SEQ ID NO: 16952 - protein, 10 aa, Homo Sapiens
SVPEDLTVHV

SEQ ID NO: 16953 - protein, 10 aa, Homo Sapiens
SVTSEGIKAV

SEQ ID NO: 16954 - protein, 10 aa, Homo Sapiens
SVVTGGVQSV

SEQ ID NO: 16955 - protein, 10 aa, Homo Sapiens
TLITDGMRSV

SEQ ID NO: 16956 - protein, 10 aa, Homo Sapiens
TLPKLGVHKV

SEQ ID NO: 16957 - protein, 10 aa, Homo Sapiens
TLQKEGVIGV

SEQ ID NO: 16958 - protein, 10 aa, Homo Sapiens
TLTEEGVIKV

SEQ ID NO: 16959 - protein, 10 aa, Homo Sapiens
TLYERGFENI

SEQ ID NO: 16960 - protein, 10 aa, Homo Sapiens
TQLGPPYHIL

SEQ ID NO: 16961 - protein, 10 aa, Homo Sapiens
TQYERDFERI

SEQ ID NO: 16962 - protein, 10 aa, Homo Sapiens
TTLDEKIEKV

SEQ ID NO: 16963 - protein, 10 aa, Homo Sapiens
TTLEGHLAKV

SEQ ID NO: 16964 - protein, 10 aa, Homo Sapiens
TTVGKGVTTV

SEQ ID NO: 16965 - protein, 10 aa, Homo Sapiens
TTYEGIFKTL

SEQ ID NO: 16966 - protein, 10 aa, Homo Sapiens
TVFDEAIRAV

SEQ ID NO: 16967 - protein, 10 aa, Homo Sapiens
TVFGTALNYV

SEQ ID NO: 16968 - protein, 10 aa, Homo Sapiens
TVFSKSFEQV

SEQ ID NO: 16969 - protein, 10 aa, Homo Sapiens
TVFTDHMLTV

SEQ ID NO: 16970 - protein, 10 aa, Homo Sapiens
TVLDIHDNQL

SEQ ID NO: 16971 - protein, 10 aa, Homo Sapiens
TVLEEIGNRV

SEQ ID NO: 16972 - protein, 10 aa, Homo Sapiens
TVLKAQFPSV

SEQ ID NO: 16973 - protein, 10 aa, Homo Sapiens
TVMDSKIVQV

SEQ ID NO: 16974 - protein, 10 aa, Homo Sapiens
TVMGAEIRHV

SEQ ID NO: 16975 - protein, 10 aa, Homo Sapiens
TVMPEDLVEA

SEQ ID NO: 16976 - protein, 10 aa, Homo Sapiens
TVTITGIVKV

SEQ ID NO: 16977 - protein, 10 aa, Homo Sapiens
TVYPGLMITA

SEQ ID NO: 16978 - protein, 10 aa, Homo Sapiens
TVYSHLFDHV

SEQ ID NO: 16979 - protein, 10 aa, Homo Sapiens
VILEGELERA

SEQ ID NO: 16980 - protein, 10 aa, Homo Sapiens
VLFDDELLMV

SEQ ID NO: 16981 - protein, 10 aa, Homo Sapiens
VLIGEFLEKV

SEQ ID NO: 16982 - protein, 10 aa, Homo Sapiens
VLLKARLVPA

SEQ ID NO: 16983 - protein, 10 aa, Homo Sapiens
VLSAADKGNV

SEQ ID NO: 16984 - protein, 10 aa, Homo Sapiens
VQLDLTGIFM

SEQ ID NO: 16985 - protein, 10 aa, Homo Sapiens
VQLEATEWRL

SEQ ID NO: 16986 - protein, 10 aa, Homo Sapiens
VQLPDGGWGL

SEQ ID NO: 16987 - protein, 10 aa, Homo Sapiens
VQWENSFVSV

SEQ ID NO: 16988 - protein, 10 aa, Homo Sapiens
VTAPSGILDV

SEQ ID NO: 16989 - protein, 10 aa, Homo Sapiens
VVAAAAAEAK

SEQ ID NO: 16990 - protein, 10 aa, Homo Sapiens
VVAPDNLKQV

SEQ ID NO: 16991 - protein, 10 aa, Homo Sapiens
VVDPNDPQML

SEQ ID NO: 16992 - protein, 10 aa, Homo Sapiens
VVFDCKFIET

SEQ ID NO: 16993 - protein, 10 aa, Homo Sapiens
VVINFDFPKL

SEQ ID NO: 16994 - protein, 10 aa, Homo Sapiens
VVIPGKVEEV

SEQ ID NO: 16995 - protein, 10 aa, Homo Sapiens
VVSPSSFENV

SEQ ID NO: 16996 - protein, 10 aa, Homo Sapiens
VVVDLGLIRV

SEQ ID NO: 16997 - protein, 10 aa, Homo Sapiens
YAAPGGLIGV

SEQ ID NO: 16998 - protein, 10 aa, Homo Sapiens
YAFDLKCDSV

SEQ ID NO: 16999 - protein, 10 aa, Homo Sapiens
YAVELVNDSL

SEQ ID NO: 17000 - protein, 10 aa, Homo Sapiens
YAYDGKDYIA

SEQ ID NO: 17001 - protein, 10 aa, Homo Sapiens
YIDPSGFVKA

SEQ ID NO: 17002 - protein, 10 aa, Homo Sapiens
YIIEQGVCYL

SEQ ID NO: 17003 - protein, 10 aa, Homo Sapiens
YIPGRQIIEV

SEQ ID NO: 17004 - protein, 10 aa, Homo Sapiens
YIYDKDMEII

SEQ ID NO: 17005 - protein, 10 aa, Homo Sapiens
YLPESSFIGA

SEQ ID NO: 17006 - protein, 10 aa, Homo Sapiens
YLTNEGIQYL

SEQ ID NO: 17007 - protein, 10 aa, Homo Sapiens
YMFPDTMLQA

SEQ ID NO: 17008 - protein, 10 aa, Homo Sapiens
YQAPDIDVQL

SEQ ID NO: 17009 - protein, 10 aa, Homo Sapiens
YTFSEPFHLI

SEQ ID NO: 17010 - protein, 10 aa, Homo Sapiens
YTVEDLATQL

SEQ ID NO: 17011 - protein, 10 aa, Homo Sapiens
YTYEELLNRV

SEQ ID NO: 17012 - protein, 10 aa, Homo Sapiens
YVFEGKMLEA

SEQ ID NO: 17013 - protein, 10 aa, Homo Sapiens
YVMEYRELFL

SEQ ID NO: 17014 - protein, 10 aa, Homo Sapiens
YVPDFVLQGI

SEQ ID NO: 17015 - protein, 10 aa, Homo Sapiens
YVPHEILRKV

SEQ ID NO: 17016 - protein, 11 aa, Homo Sapiens
AALEEADKMFL

SEQ ID NO: 17017 - protein, 11 aa, Homo Sapiens
AAVPGKTFVNI

SEQ ID NO: 17018 - protein, 11 aa, Homo Sapiens
ADINGLRQVLD

SEQ ID NO: 17019 - protein, 11 aa, Homo Sapiens
AEQRGELAIKD

SEQ ID NO: 17020 - protein, 11 aa, Homo Sapiens
ALADKELLPSV

SEQ ID NO: 17021 - protein, 11 aa, Homo Sapiens
AQAEVYKELRL

SEQ ID NO: 17022 - protein, 11 aa, Homo Sapiens
AQFHPTEDLVV

SEQ ID NO: 17023 - protein, 11 aa, Homo Sapiens
AQIDSNIAHTV

SEQ ID NO: 17024 - protein, 11 aa, Homo Sapiens
AQIEAKFYEEV

SEQ ID NO: 17025 - protein, 11 aa, Homo Sapiens
AQLDPEALGNI

SEQ ID NO: 17026 - protein, 11 aa, Homo Sapiens
ASQVPNPAAAA

SEQ ID NO: 17027 - protein, 11 aa, Homo Sapiens
ATAAGDVIKAA

SEQ ID NO: 17028 - protein, 11 aa, Homo Sapiens
ATADDIRALLI

SEQ ID NO: 17029 - protein, 11 aa, Homo Sapiens
ATVGGGTVIGV

SEQ ID NO: 17030 - protein, 11 aa, Homo Sapiens
AVADFDECIRL

SEQ ID NO: 17031 - protein, 11 aa, Homo Sapiens
AVALERTFVGA

SEQ ID NO: 17032 - protein, 11 aa, Homo Sapiens
AVEAKKTYVRD

SEQ ID NO: 17033 - protein, 11 aa, Homo Sapiens
AVIHEAPAVLL

SEQ ID NO: 17034 - protein, 11 aa, Homo Sapiens
AVPEGDWFCTV

SEQ ID NO: 17035 - protein, 11 aa, Homo Sapiens
AVVDEGDVVEV

SEQ ID NO: 17036 - protein, 11 aa, Homo Sapiens
FAEDVGSNKGA

SEQ ID NO: 17037 - protein, 11 aa, Homo Sapiens
FAYDGKDYLTL

SEQ ID NO: 17038 - protein, 11 aa, Homo Sapiens
FIIQGLRSVGA

SEQ ID NO: 17039 - protein, 11 aa, Homo Sapiens
FIPLPSAVVQA

SEQ ID NO: 17040 - protein, 11 aa, Homo Sapiens
FLADPSAFVAA

SEQ ID NO: 17041 - protein, 11 aa, Homo Sapiens
FLASESLIKQI

SEQ ID NO: 17042 - protein, 11 aa, Homo Sapiens
FLPDPSALQNL

SEQ ID NO: 17043 - protein, 11 aa, Homo Sapiens
FLPETRIMTSV

SEQ ID NO: 17044 - protein, 11 aa, Homo Sapiens
FLTDSNNIKEV

SEQ ID NO: 17045 - protein, 11 aa, Homo Sapiens
FQDEVAKAQQL

SEQ ID NO: 17046 - protein, 11 aa, Homo Sapiens
FQVENDQERFL

SEQ ID NO: 17047 - protein, 11 aa, Homo Sapiens
FTIDEELVQRV

SEQ ID NO: 17048 - protein, 11 aa, Homo Sapiens
FTVPLSTEAAL

SEQ ID NO: 17049 - protein, 11 aa, Homo Sapiens
FVLDHEDGLNL

SEQ ID NO: 17050 - protein, 11 aa, Homo Sapiens
FVTEGSHFVEA

SEQ ID NO: 17051 - protein, 11 aa, Homo Sapiens
FVYPLDFARTR

SEQ ID NO: 17052 - protein, 11 aa, Homo Sapiens
GIAASGHFICV

SEQ ID NO: 17053 - protein, 11 aa, Homo Sapiens
GLADASLLKKV

SEQ ID NO: 17054 - protein, 11 aa, Homo Sapiens
GLADNTVIAKV

SEQ ID NO: 17055 - protein, 11 aa, Homo Sapiens
GPPPPPPGKPQ

SEQ ID NO: 17056 - protein, 11 aa, Homo Sapiens
GQLDTPGVHNV

SEQ ID NO: 17057 - protein, 11 aa, Homo Sapiens
GVAESIHLWEV

SEQ ID NO: 17058 - protein, 11 aa, Homo Sapiens
GVAGGSILKGV

SEQ ID NO: 17059 - protein, 11 aa, Homo Sapiens
GVIGGGVFQAI

SEQ ID NO: 17060 - protein, 11 aa, Homo Sapiens
GVLSSDGVWRV

SEQ ID NO: 17061 - protein, 11 aa, Homo Sapiens
GVPNASVIMQV

SEQ ID NO: 17062 - protein, 11 aa, Homo Sapiens
GVVDPRAISVL

SEQ ID NO: 17063 - protein, 11 aa, Homo Sapiens
GVVEGKALSEL

SEQ ID NO: 17064 - protein, 11 aa, Homo Sapiens
GVYNGKTFNQV

SEQ ID NO: 17065 - protein, 11 aa, Homo Sapiens
HQIEAVDGEEL

SEQ ID NO: 17066 - protein, 11 aa, Homo Sapiens
HQIPEFDNLYL

SEQ ID NO: 17067 - protein, 11 aa, Homo Sapiens
HVYDGKFLARV

SEQ ID NO: 17068 - protein, 11 aa, Homo Sapiens
IILEEGKEILV

SEQ ID NO: 17069 - protein, 11 aa, Homo Sapiens
ILAPAGSLPKI

SEQ ID NO: 17070 - protein, 11 aa, Homo Sapiens
ILLPEPSIRSV

SEQ ID NO: 17071 - protein, 11 aa, Homo Sapiens
IQEEEDEKQRL

SEQ ID NO: 17072 - protein, 11 aa, Homo Sapiens
IQLPSEKAIFL

SEQ ID NO: 17073 - protein, 11 aa, Homo Sapiens
IQWESTRPVLA

SEQ ID NO: 17074 - protein, 11 aa, Homo Sapiens
IQYIPTELDQV

SEQ ID NO: 17075 - protein, 11 aa, Homo Sapiens
ITLPEGSVISL

SEQ ID NO: 17076 - protein, 11 aa, Homo Sapiens
ITPENLPQILL

SEQ ID NO: 17077 - protein, 11 aa, Homo Sapiens
IVPKEEGVISV

SEQ ID NO: 17078 - protein, 11 aa, Homo Sapiens
IVSTEKTILAV

SEQ ID NO: 17079 - protein, 11 aa, Homo Sapiens
KAINQGGLTSV

SEQ ID NO: 17080 - protein, 11 aa, Homo Sapiens
KALDDTQVKTV

SEQ ID NO: 17081 - protein, 11 aa, Homo Sapiens
KAMTEDGFLAV

SEQ ID NO: 17082 - protein, 11 aa, Homo Sapiens
KIIDEDGLLNL

SEQ ID NO: 17083 - protein, 11 aa, Homo Sapiens
KIMTEKELLAV

SEQ ID NO: 17084 - protein, 11 aa, Homo Sapiens
KLADDVDLEQV

SEQ ID NO: 17085 - protein, 11 aa, Homo Sapiens
KMADEDALRKI

SEQ ID NO: 17086 - protein, 11 aa, Homo Sapiens
KMDASLGNLFA

SEQ ID NO: 17087 - protein, 11 aa, Homo Sapiens
KQIDELDILRL

SEQ ID NO: 17088 - protein, 11 aa, Homo Sapiens
KQLEAIDQLHL

SEQ ID NO: 17089 - protein, 11 aa, Homo Sapiens
KQLSDTSIIAV

SEQ ID NO: 17090 - protein, 11 aa, Homo Sapiens
KQVEEIFNLKF

SEQ ID NO: 17091 - protein, 11 aa, Homo Sapiens
KSADEVLFTGV

SEQ ID NO: 17092 - protein, 11 aa, Homo Sapiens
KTAAEDAIRNL

SEQ ID NO: 17093 - protein, 11 aa, Homo Sapiens
KTSESSTILVV

SEQ ID NO: 17094 - protein, 11 aa, Homo Sapiens
KTVEGRELQSV

SEQ ID NO: 17095 - protein, 11 aa, Homo Sapiens
KVFPSEITDTV

SEQ ID NO: 17096 - protein, 11 aa, Homo Sapiens
KVIDPATATSV

SEQ ID NO: 17097 - protein, 11 aa, Homo Sapiens
KVLEPSETLVV

SEQ ID NO: 17098 - protein, 11 aa, Homo Sapiens
KVPEELVFASL

SEQ ID NO: 17099 - protein, 11 aa, Homo Sapiens
KVVDVVRNLVF

SEQ ID NO: 17100 - protein, 11 aa, Homo Sapiens
KVVEDIEYLKF

SEQ ID NO: 17101 - protein, 11 aa, Homo Sapiens
LLDPNVKSIFV

SEQ ID NO: 17102 - protein, 11 aa, Homo Sapiens
LLIDDKGTIKL

SEQ ID NO: 17103 - protein, 11 aa, Homo Sapiens
LLLPDQPPYHL

SEQ ID NO: 17104 - protein, 11 aa, Homo Sapiens
LQLDPAQIYRV

SEQ ID NO: 17105 - protein, 11 aa, Homo Sapiens
LSLSSETKPKL

SEQ ID NO: 17106 - protein, 11 aa, Homo Sapiens
LTAPEDVFSKL

SEQ ID NO: 17107 - protein, 11 aa, Homo Sapiens
LVYPEELKPVL

SEQ ID NO: 17108 - protein, 11 aa, Homo Sapiens
NLPDEEIFQQL

SEQ ID NO: 17109 - protein, 11 aa, Homo Sapiens
NQIEDNDDFQL

SEQ ID NO: 17110 - protein, 11 aa, Homo Sapiens
NQQLPIESQMV

SEQ ID NO: 17111 - protein, 11 aa, Homo Sapiens
QQIGEKIFASI

SEQ ID NO: 17112 - protein, 11 aa, Homo Sapiens
QQIPASDTQQL

SEQ ID NO: 17113 - protein, 11 aa, Homo Sapiens
QQLDSKFLEQV

SEQ ID NO: 17114 - protein, 11 aa, Homo Sapiens
QQMKDIEKLRL

SEQ ID NO: 17115 - protein, 11 aa, Homo Sapiens
QTAPEEAFIKL

SEQ ID NO: 17116 - protein, 11 aa, Homo Sapiens
QVHGTITGVDV

SEQ ID NO: 17117 - protein, 11 aa, Homo Sapiens
QVISQAAVVHA

SEQ ID NO: 17118 - protein, 11 aa, Homo Sapiens
QVLEDFPTISL

SEQ ID NO: 17119 - protein, 11 aa, Homo Sapiens
QVPEEQVLNAA

SEQ ID NO: 17120 - protein, 11 aa, Homo Sapiens
RGLDDIKDLKV

SEQ ID NO: 17121 - protein, 11 aa, Homo Sapiens
RIFGESIMIGV

SEQ ID NO: 17122 - protein, 11 aa, Homo Sapiens
RILDIDIPMSV

SEQ ID NO: 17123 - protein, 11 aa, Homo Sapiens
RLLPPGAVVAV

SEQ ID NO: 17124 - protein, 11 aa, Homo Sapiens
RLPPDTLLQQV

SEQ ID NO: 17125 - protein, 11 aa, Homo Sapiens
RLVQGSILKKV

SEQ ID NO: 17126 - protein, 11 aa, Homo Sapiens
RQLEEEGITFV

SEQ ID NO: 17127 - protein, 11 aa, Homo Sapiens
RTFDETVSTYV

SEQ ID NO: 17128 - protein, 11 aa, Homo Sapiens
RTIGVITKLDL

SEQ ID NO: 17129 - protein, 11 aa, Homo Sapiens
RVAGAAKLVVA

SEQ ID NO: 17130 - protein, 11 aa, Homo Sapiens
RVIDDSLVVGV

SEQ ID NO: 17131 - protein, 11 aa, Homo Sapiens
RVLPGQAVTGV

SEQ ID NO: 17132 - protein, 11 aa, Homo Sapiens
RVLPPSALQSV

SEQ ID NO: 17133 - protein, 11 aa, Homo Sapiens
RVMEKGSLKCA

SEQ ID NO: 17134 - protein, 11 aa, Homo Sapiens
SALPDIKVLTL

SEQ ID NO: 17135 - protein, 11 aa, Homo Sapiens
SLLGDDALVQV

SEQ ID NO: 17136 - protein, 11 aa, Homo Sapiens
SLMEESGICKV

SEQ ID NO: 17137 - protein, 11 aa, Homo Sapiens
SMLAEDAIKAA

SEQ ID NO: 17138 - protein, 11 aa, Homo Sapiens
SQADCAVLIVA

SEQ ID NO: 17139 - protein, 11 aa, Homo Sapiens
SQIDPSSIERA

SEQ ID NO: 17140 - protein, 11 aa, Homo Sapiens
SQITAIEAQHL

SEQ ID NO: 17141 - protein, 11 aa, Homo Sapiens
SQLDISDPYKV

SEQ ID NO: 17142 - protein, 11 aa, Homo Sapiens
SQLDISEPYKV

SEQ ID NO: 17143 - protein, 11 aa, Homo Sapiens
SQLDSPKALYL

SEQ ID NO: 17144 - protein, 11 aa, Homo Sapiens
SQLPPLREIIL

SEQ ID NO: 17145 - protein, 11 aa, Homo Sapiens
STLTEEGVIKV

SEQ ID NO: 17146 - protein, 11 aa, Homo Sapiens
SVAEGRALMSV

SEQ ID NO: 17147 - protein, 11 aa, Homo Sapiens
SVAPDTINNHV

SEQ ID NO: 17148 - protein, 11 aa, Homo Sapiens
SVAPKNALVQL

SEQ ID NO: 17149 - protein, 11 aa, Homo Sapiens
SVAPSPAVDKA

SEQ ID NO: 17150 - protein, 11 aa, Homo Sapiens
SVIPVINKIDL

SEQ ID NO: 17151 - protein, 11 aa, Homo Sapiens
SVLDDNKLLTL

SEQ ID NO: 17152 - protein, 11 aa, Homo Sapiens
SVPESTVLKKV

SEQ ID NO: 17153 - protein, 11 aa, Homo Sapiens
SVPKEHILPSL

SEQ ID NO: 17154 - protein, 11 aa, Homo Sapiens
SVPNKDVFQEL

SEQ ID NO: 17155 - protein, 11 aa, Homo Sapiens
SVVSPSSFENV

SEQ ID NO: 17156 - protein, 11 aa, Homo Sapiens
SVYDGHGGEEV

SEQ ID NO: 17157 - protein, 11 aa, Homo Sapiens
TIAEGLTLAQV

SEQ ID NO: 17158 - protein, 11 aa, Homo Sapiens
TIIDLPGITRV

SEQ ID NO: 17159 - protein, 11 aa, Homo Sapiens
TLIDLPGITKV

SEQ ID NO: 17160 - protein, 11 aa, Homo Sapiens
TMAKESSIIGV

SEQ ID NO: 17161 - protein, 11 aa, Homo Sapiens
TQFGGKRPFGV

SEQ ID NO: 17162 - protein, 11 aa, Homo Sapiens
TQVEASEESAL

SEQ ID NO: 17163 - protein, 11 aa, Homo Sapiens
TVATENEVFRV

SEQ ID NO: 17164 - protein, 11 aa, Homo Sapiens
TVISEDSVVKA

SEQ ID NO: 17165 - protein, 11 aa, Homo Sapiens
TVLAIDAIHQL

SEQ ID NO: 17166 - protein, 11 aa, Homo Sapiens
TVPKPDVVVQV

SEQ ID NO: 17167 - protein, 11 aa, Homo Sapiens
TVVEDGSLPQV

SEQ ID NO: 17168 - protein, 11 aa, Homo Sapiens
VIIDDHPEVTV

SEQ ID NO: 17169 - protein, 11 aa, Homo Sapiens
VIPEPSKLPYI

SEQ ID NO: 17170 - protein, 11 aa, Homo Sapiens
VLLPEGGITAI

SEQ ID NO: 17171 - protein, 11 aa, Homo Sapiens
VQCETLEDLKI

SEQ ID NO: 17172 - protein, 11 aa, Homo Sapiens
VQDELHSVLGL

SEQ ID NO: 17173 - protein, 11 aa, Homo Sapiens
VQIDDSYLVEA

SEQ ID NO: 17174 - protein, 11 aa, Homo Sapiens
VQPNGKIFKKV

SEQ ID NO: 17175 - protein, 11 aa, Homo Sapiens
VVAESEALQSL

SEQ ID NO: 17176 - protein, 11 aa, Homo Sapiens
VVLENEAVRAA

SEQ ID NO: 17177 - protein, 11 aa, Homo Sapiens
VVLGEFGVRNV

SEQ ID NO: 17178 - protein, 11 aa, Homo Sapiens
VVVNDMEQLRL

SEQ ID NO: 17179 - protein, 11 aa, Homo Sapiens
YALEEHENQRL

SEQ ID NO: 17180 - protein, 11 aa, Homo Sapiens
YAYDGKDYIAL

SEQ ID NO: 17181 - protein, 11 aa, Homo Sapiens
YGAEALERMFL

SEQ ID NO: 17182 - protein, 11 aa, Homo Sapiens
YGIKDDVFLSV

SEQ ID NO: 17183 - protein, 11 aa, Homo Sapiens
YLASDEITTVR

SEQ ID NO: 17184 - protein, 11 aa, Homo Sapiens
YQFNPMESIKL

SEQ ID NO: 17185 - protein, 11 aa, Homo Sapiens
YQIDPDACFSA

SEQ ID NO: 17186 - protein, 11 aa, Homo Sapiens
YQLDPTASISA

SEQ ID NO: 17187 - protein, 11 aa, Homo Sapiens
YQLEIPENFTT

SEQ ID NO: 17188 - protein, 11 aa, Homo Sapiens
YQVEGMEWLRM

SEQ ID NO: 17189 - protein, 11 aa, Homo Sapiens
YVEDGKGIRRV

SEQ ID NO: 17190 - protein, 11 aa, Homo Sapiens
YVIDPIKGLKL

SEQ ID NO: 17191 - protein, 11 aa, Homo Sapiens
YVIDSTDEERL

SEQ ID NO: 17192 - protein, 8 aa, Homo Sapiens
ALPNVYEV

SEQ ID NO: 17193 - protein, 8 aa, Homo Sapiens
AVDLYKSL

SEQ ID NO: 17194 - protein, 8 aa, Homo Sapiens
AVPPIWSV

SEQ ID NO: 17195 - protein, 8 aa, Homo Sapiens
FLDDPQAV

SEQ ID NO: 17196 - protein, 8 aa, Homo Sapiens
FLDKPTLL

SEQ ID NO: 17197 - protein, 8 aa, Homo Sapiens
FLDPPHML

SEQ ID NO: 17198 - protein, 8 aa, Homo Sapiens
FLDVYYNL

SEQ ID NO: 17199 - protein, 8 aa, Homo Sapiens
FLPLLHHM

SEQ ID NO: 17200 - protein, 8 aa, Homo Sapiens
FLPNPVAV

SEQ ID NO: 17201 - protein, 8 aa, Homo Sapiens
FVPPVFVV

SEQ ID NO: 17202 - protein, 8 aa, Homo Sapiens
GLPPVFGL

SEQ ID NO: 17203 - protein, 8 aa, Homo Sapiens
IIPEGTWI

SEQ ID NO: 17204 - protein, 8 aa, Homo Sapiens
IIPPLFTV

SEQ ID NO: 17205 - protein, 8 aa, Homo Sapiens
ILDEVISL

SEQ ID NO: 17206 - protein, 8 aa, Homo Sapiens
ILKKCFKI

SEQ ID NO: 17207 - protein, 8 aa, Homo Sapiens
ILPPLLQL

SEQ ID NO: 17208 - protein, 8 aa, Homo Sapiens
ILPPPVHV

SEQ ID NO: 17209 - protein, 8 aa, Homo Sapiens
KLPDVYGV

SEQ ID NO: 17210 - protein, 8 aa, Homo Sapiens
KLPELWAL

SEQ ID NO: 17211 - protein, 8 aa, Homo Sapiens
KLPGVYEV

SEQ ID NO: 17212 - protein, 8 aa, Homo Sapiens
KLPPLPAV

SEQ ID NO: 17213 - protein, 8 aa, Homo Sapiens
KLWDPFSL

SEQ ID NO: 17214 - protein, 8 aa, Homo Sapiens
LAFCFITF

SEQ ID NO: 17215 - protein, 8 aa, Homo Sapiens
LEPDELAG

SEQ ID NO: 17216 - protein, 8 aa, Homo Sapiens
LLPPAFHL

SEQ ID NO: 17217 - protein, 8 aa, Homo Sapiens
LLPPIVKL

SEQ ID NO: 17218 - protein, 8 aa, Homo Sapiens
LLPPPTLL

SEQ ID NO: 17219 - protein, 8 aa, Homo Sapiens
LLPPTVSL

SEQ ID NO: 17220 - protein, 8 aa, Homo Sapiens
LLPPVFNI

SEQ ID NO: 17221 - protein, 8 aa, Homo Sapiens
LLVTWKQV

SEQ ID NO: 17222 - protein, 8 aa, Homo Sapiens
LMEHIHKL

SEQ ID NO: 17223 - protein, 8 aa, Homo Sapiens
PLGYEIQL

SEQ ID NO: 17224 - protein, 8 aa, Homo Sapiens
RLPELARV

SEQ ID NO: 17225 - protein, 8 aa, Homo Sapiens
SQPPVFKV

SEQ ID NO: 17226 - protein, 8 aa, Homo Sapiens
TEDELQDK

SEQ ID NO: 17227 - protein, 8 aa, Homo Sapiens
TTPPIWHL

SEQ ID NO: 17228 - protein, 8 aa, Homo Sapiens
VLPPTVYL

SEQ ID NO: 17229 - protein, 8 aa, Homo Sapiens
YLDEGFLL

SEQ ID NO: 17230 - protein, 9 aa, Homo Sapiens
AADEVFSHI

SEQ ID NO: 17231 - protein, 9 aa, Homo Sapiens
AADEVLAVL

SEQ ID NO: 17232 - protein, 9 aa, Homo Sapiens
AAPDIVPAL

SEQ ID NO: 17233 - protein, 9 aa, Homo Sapiens
AAPGGLIGV

SEQ ID NO: 17234 - protein, 9 aa, Homo Sapiens
AAPPAFPEV

SEQ ID NO: 17235 - protein, 9 aa, Homo Sapiens
AAPPEMYEV

SEQ ID NO: 17236 - protein, 9 aa, Homo Sapiens
AAPPNFHFV

SEQ ID NO: 17237 - protein, 9 aa, Homo Sapiens
AAPPPSVTV

SEQ ID NO: 17238 - protein, 9 aa, Homo Sapiens
AAPPTLPLV

SEQ ID NO: 17239 - protein, 9 aa, Homo Sapiens
AGDPVILYV

SEQ ID NO: 17240 - protein, 9 aa, Homo Sapiens
AIAPIIAAV

SEQ ID NO: 17241 - protein, 9 aa, Homo Sapiens
AIDAIFLTT

SEQ ID NO: 17242 - protein, 9 aa, Homo Sapiens
AIDDIYFQA

SEQ ID NO: 17243 - protein, 9 aa, Homo Sapiens
AIDDVDIDL

SEQ ID NO: 17244 - protein, 9 aa, Homo Sapiens
AIDEISKSL

SEQ ID NO: 17245 - protein, 9 aa, Homo Sapiens
AIDEISLFL

SEQ ID NO: 17246 - protein, 9 aa, Homo Sapiens
AIDEISQQL

SEQ ID NO: 17247 - protein, 9 aa, Homo Sapiens
AIDLIVQHV

SEQ ID NO: 17248 - protein, 9 aa, Homo Sapiens
AIDNQYTPL

SEQ ID NO: 17249 - protein, 9 aa, Homo Sapiens
AIDSLRDLR

SEQ ID NO: 17250 - protein, 9 aa, Homo Sapiens
AIEDLVKFV

SEQ ID NO: 17251 - protein, 9 aa, Homo Sapiens
AIEDTIFYL

SEQ ID NO: 17252 - protein, 9 aa, Homo Sapiens
AIFAVMSRV

SEQ ID NO: 17253 - protein, 9 aa, Homo Sapiens
AIIALFHLL

SEQ ID NO: 17254 - protein, 9 aa, Homo Sapiens
AIIDKYIKL

SEQ ID NO: 17255 - protein, 9 aa, Homo Sapiens
AIIEYMPLL

SEQ ID NO: 17256 - protein, 9 aa, Homo Sapiens
AIIGVLLNL

SEQ ID NO: 17257 - protein, 9 aa, Homo Sapiens
AILEKMPLV

SEQ ID NO: 17258 - protein, 9 aa, Homo Sapiens
AIMDIVIKV

SEQ ID NO: 17259 - protein, 9 aa, Homo Sapiens
AINPKLLQL

SEQ ID NO: 17260 - protein, 9 aa, Homo Sapiens
AIPENLPPL

SEQ ID NO: 17261 - protein, 9 aa, Homo Sapiens
AIPGVVEKV

SEQ ID NO: 17262 - protein, 9 aa, Homo Sapiens
AIQDKLFQV

SEQ ID NO: 17263 - protein, 9 aa, Homo Sapiens
AIVDKVPSV

SEQ ID NO: 17264 - protein, 9 aa, Homo Sapiens
AIVRSLPSV

SEQ ID NO: 17265 - protein, 9 aa, Homo Sapiens
AIYHVIMSV

SEQ ID NO: 17266 - protein, 9 aa, Homo Sapiens
ALAEALKEV

SEQ ID NO: 17267 - protein, 9 aa, Homo Sapiens
ALAEEVEQV

SEQ ID NO: 17268 - protein, 9 aa, Homo Sapiens
ALAEKFKEL

SEQ ID NO: 17269 - protein, 9 aa, Homo Sapiens
ALANQIPTV

SEQ ID NO: 17270 - protein, 9 aa, Homo Sapiens
ALATLIHQV

SEQ ID NO: 17271 - protein, 9 aa, Homo Sapiens
ALDATHQQL

SEQ ID NO: 17272 - protein, 9 aa, Homo Sapiens
ALDDEFITV

SEQ ID NO: 17273 - protein, 9 aa, Homo Sapiens
ALDDFSISV

SEQ ID NO: 17274 - protein, 9 aa, Homo Sapiens
ALDDFYKML

SEQ ID NO: 17275 - protein, 9 aa, Homo Sapiens
ALDDIIYRA

SEQ ID NO: 17276 - protein, 9 aa, Homo Sapiens
ALDDLIDTL

SEQ ID NO: 17277 - protein, 9 aa, Homo Sapiens
ALDDMISTL

SEQ ID NO: 17278 - protein, 9 aa, Homo Sapiens
ALDDRPQVL

SEQ ID NO: 17279 - protein, 9 aa, Homo Sapiens
ALDEEYLKV

SEQ ID NO: 17280 - protein, 9 aa, Homo Sapiens
ALDEFATKL

SEQ ID NO: 17281 - protein, 9 aa, Homo Sapiens
ALDEFFDIM

SEQ ID NO: 17282 - protein, 9 aa, Homo Sapiens
ALDEIAWLF

SEQ ID NO: 17283 - protein, 9 aa, Homo Sapiens
ALDENMDLL

SEQ ID NO: 17284 - protein, 9 aa, Homo Sapiens
ALDEPTTNL

SEQ ID NO: 17285 - protein, 9 aa, Homo Sapiens
ALDEQLVQV

SEQ ID NO: 17286 - protein, 9 aa, Homo Sapiens
ALDERSTIL

SEQ ID NO: 17287 - protein, 9 aa, Homo Sapiens
ALDEVFTKV

SEQ ID NO: 17288 - protein, 9 aa, Homo Sapiens
ALDEVIFSL

SEQ ID NO: 17289 - protein, 9 aa, Homo Sapiens
ALDEVVLKF

SEQ ID NO: 17290 - protein, 9 aa, Homo Sapiens
ALDGAWLMV

SEQ ID NO: 17291 - protein, 9 aa, Homo Sapiens
ALDGFLFVV

SEQ ID NO: 17292 - protein, 9 aa, Homo Sapiens
ALDGFVMVL

SEQ ID NO: 17293 - protein, 9 aa, Homo Sapiens
ALDHMVEYV

SEQ ID NO: 17294 - protein, 9 aa, Homo Sapiens
ALDILITNV

SEQ ID NO: 17295 - protein, 9 aa, Homo Sapiens
ALDKATVLL

SEQ ID NO: 17296 - protein, 9 aa, Homo Sapiens
ALDKIFNKV

SEQ ID NO: 17297 - protein, 9 aa, Homo Sapiens
ALDKITASL

SEQ ID NO: 17298 - protein, 9 aa, Homo Sapiens
ALDKVIEIV

SEQ ID NO: 17299 - protein, 9 aa, Homo Sapiens
ALDKWTNQL

SEQ ID NO: 17300 - protein, 9 aa, Homo Sapiens
ALDLKTLYL

SEQ ID NO: 17301 - protein, 9 aa, Homo Sapiens
ALDNDNYNL

SEQ ID NO: 17302 - protein, 9 aa, Homo Sapiens
ALDNFLDKL

SEQ ID NO: 17303 - protein, 9 aa, Homo Sapiens
ALDNGLFTL

SEQ ID NO: 17304 - protein, 9 aa, Homo Sapiens
ALDNNPLLL

SEQ ID NO: 17305 - protein, 9 aa, Homo Sapiens
ALDNVDARM

SEQ ID NO: 17306 - protein, 9 aa, Homo Sapiens
ALDPADQHL

SEQ ID NO: 17307 - protein, 9 aa, Homo Sapiens
ALDPASISV

SEQ ID NO: 17308 - protein, 9 aa, Homo Sapiens
ALDPMSVLL

SEQ ID NO: 17309 - protein, 9 aa, Homo Sapiens
ALDPNIATL

SEQ ID NO: 17310 - protein, 9 aa, Homo Sapiens
ALDPPGPTL

SEQ ID NO: 17311 - protein, 9 aa, Homo Sapiens
ALDQAYMRI

SEQ ID NO: 17312 - protein, 9 aa, Homo Sapiens
ALDQEIIEV

SEQ ID NO: 17313 - protein, 9 aa, Homo Sapiens
ALDQFLEGI

SEQ ID NO: 17314 - protein, 9 aa, Homo Sapiens
ALDREVQYL

SEQ ID NO: 17315 - protein, 9 aa, Homo Sapiens
ALDRIVEYL

SEQ ID NO: 17316 - protein, 9 aa, Homo Sapiens
ALDSAYKEL

SEQ ID NO: 17317 - protein, 9 aa, Homo Sapiens
ALDSGFNSV

SEQ ID NO: 17318 - protein, 9 aa, Homo Sapiens
ALDSKANNL

SEQ ID NO: 17319 - protein, 9 aa, Homo Sapiens
ALDSLVLQM

SEQ ID NO: 17320 - protein, 9 aa, Homo Sapiens
ALDTGWNEL

SEQ ID NO: 17321 - protein, 9 aa, Homo Sapiens
ALDTINILL

SEQ ID NO: 17322 - protein, 9 aa, Homo Sapiens
ALDTSNVMV

SEQ ID NO: 17323 - protein, 9 aa, Homo Sapiens
ALDTTRHEL

SEQ ID NO: 17324 - protein, 9 aa, Homo Sapiens
ALDTVWREL

SEQ ID NO: 17325 - protein, 9 aa, Homo Sapiens
ALDVMVSTF

SEQ ID NO: 17326 - protein, 9 aa, Homo Sapiens
ALDVPHAEL

SEQ ID NO: 17327 - protein, 9 aa, Homo Sapiens
ALDVPNTML

SEQ ID NO: 17328 - protein, 9 aa, Homo Sapiens
ALDVSFNKF

SEQ ID NO: 17329 - protein, 9 aa, Homo Sapiens
ALDVSHNLL

SEQ ID NO: 17330 - protein, 9 aa, Homo Sapiens
ALDWVTKKL

SEQ ID NO: 17331 - protein, 9 aa, Homo Sapiens
ALDYIVPCM

SEQ ID NO: 17332 - protein, 9 aa, Homo Sapiens
ALDYLQVSL

SEQ ID NO: 17333 - protein, 9 aa, Homo Sapiens
ALDYRPLYL

SEQ ID NO: 17334 - protein, 9 aa, Homo Sapiens
ALEAVVISV

SEQ ID NO: 17335 - protein, 9 aa, Homo Sapiens
ALEDMFDAL

SEQ ID NO: 17336 - protein, 9 aa, Homo Sapiens
ALEDRVWEL

SEQ ID NO: 17337 - protein, 9 aa, Homo Sapiens
ALEEELAGL

SEQ ID NO: 17338 - protein, 9 aa, Homo Sapiens
ALEEITKNM

SEQ ID NO: 17339 - protein, 9 aa, Homo Sapiens
ALEELTKAL

SEQ ID NO: 17340 - protein, 9 aa, Homo Sapiens
ALEEYVICV

SEQ ID NO: 17341 - protein, 9 aa, Homo Sapiens
ALESFLKQV

SEQ ID NO: 17342 - protein, 9 aa, Homo Sapiens
ALEVLVKGV

SEQ ID NO: 17343 - protein, 9 aa, Homo Sapiens
ALFDAQAQV

SEQ ID NO: 17344 - protein, 9 aa, Homo Sapiens
ALFEEVPEL

SEQ ID NO: 17345 - protein, 9 aa, Homo Sapiens
ALFGALFLA

SEQ ID NO: 17346 - protein, 9 aa, Homo Sapiens
ALFPSTAQA

SEQ ID NO: 17347 - protein, 9 aa, Homo Sapiens
ALFVKTKEV

SEQ ID NO: 17348 - protein, 9 aa, Homo Sapiens
ALHDILTEI

SEQ ID NO: 17349 - protein, 9 aa, Homo Sapiens
ALHDQLFYL

SEQ ID NO: 17350 - protein, 9 aa, Homo Sapiens
ALHEIYSYI

SEQ ID NO: 17351 - protein, 9 aa, Homo Sapiens
ALIEKLVEL

SEQ ID NO: 17352 - protein, 9 aa, Homo Sapiens
ALIQQATTV

SEQ ID NO: 17353 - protein, 9 aa, Homo Sapiens
ALITRIFGV

SEQ ID NO: 17354 - protein, 9 aa, Homo Sapiens
ALLDKLYAL

SEQ ID NO: 17355 - protein, 9 aa, Homo Sapiens
ALLDRIVSV

SEQ ID NO: 17356 - protein, 9 aa, Homo Sapiens
ALLELLHEL

SEQ ID NO: 17357 - protein, 9 aa, Homo Sapiens
ALLETVNRL

SEQ ID NO: 17358 - protein, 9 aa, Homo Sapiens
ALLNILSEV

SEQ ID NO: 17359 - protein, 9 aa, Homo Sapiens
ALLPYFVYV

SEQ ID NO: 17360 - protein, 9 aa, Homo Sapiens
ALLTYLEQV

SEQ ID NO: 17361 - protein, 9 aa, Homo Sapiens
ALMADMVYV

SEQ ID NO: 17362 - protein, 9 aa, Homo Sapiens
ALMPVLNQV

SEQ ID NO: 17363 - protein, 9 aa, Homo Sapiens
ALNEKLVNL

SEQ ID NO: 17364 - protein, 9 aa, Homo Sapiens
ALNELLQHV

SEQ ID NO: 17365 - protein, 9 aa, Homo Sapiens
ALNENINQV

SEQ ID NO: 17366 - protein, 9 aa, Homo Sapiens
ALNEQIARL

SEQ ID NO: 17367 - protein, 9 aa, Homo Sapiens
ALPATVWSL

SEQ ID NO: 17368 - protein, 9 aa, Homo Sapiens
ALPDSMVSV

SEQ ID NO: 17369 - protein, 9 aa, Homo Sapiens
ALPDWCEQL

SEQ ID NO: 17370 - protein, 9 aa, Homo Sapiens
ALPEAIAAL

SEQ ID NO: 17371 - protein, 9 aa, Homo Sapiens
ALPEDLVEV

SEQ ID NO: 17372 - protein, 9 aa, Homo Sapiens
ALPEEVQEL

SEQ ID NO: 17373 - protein, 9 aa, Homo Sapiens
ALPEMEIHL

SEQ ID NO: 17374 - protein, 9 aa, Homo Sapiens
ALPENPPAI

SEQ ID NO: 17375 - protein, 9 aa, Homo Sapiens
ALPENVILV

SEQ ID NO: 17376 - protein, 9 aa, Homo Sapiens
ALPEVLAVI

SEQ ID NO: 17377 - protein, 9 aa, Homo Sapiens
ALPGATVTL

SEQ ID NO: 17378 - protein, 9 aa, Homo Sapiens
ALPGKPPFL

SEQ ID NO: 17379 - protein, 9 aa, Homo Sapiens
ALPGPPAQL

SEQ ID NO: 17380 - protein, 9 aa, Homo Sapiens
ALPGVAVSM

SEQ ID NO: 17381 - protein, 9 aa, Homo Sapiens
ALPGVGPKM

SEQ ID NO: 17382 - protein, 9 aa, Homo Sapiens
ALPHVVPTL

SEQ ID NO: 17383 - protein, 9 aa, Homo Sapiens
ALPKIILAV

SEQ ID NO: 17384 - protein, 9 aa, Homo Sapiens
ALPNGVPKA

SEQ ID NO: 17385 - protein, 9 aa, Homo Sapiens
ALPNVYEVI

SEQ ID NO: 17386 - protein, 9 aa, Homo Sapiens
ALPPDLSYI

SEQ ID NO: 17387 - protein, 9 aa, Homo Sapiens
ALPPKPRFL

SEQ ID NO: 17388 - protein, 9 aa, Homo Sapiens
ALPPPPPAA

SEQ ID NO: 17389 - protein, 9 aa, Homo Sapiens
ALPPVLTTV

SEQ ID NO: 17390 - protein, 9 aa, Homo Sapiens
ALPPYAPKL

SEQ ID NO: 17391 - protein, 9 aa, Homo Sapiens
ALPQEFAAL

SEQ ID NO: 17392 - protein, 9 aa, Homo Sapiens
ALPQFFNNV

SEQ ID NO: 17393 - protein, 9 aa, Homo Sapiens
ALPRLLPAL

SEQ ID NO: 17394 - protein, 9 aa, Homo Sapiens
ALPTASPGL

SEQ ID NO: 17395 - protein, 9 aa, Homo Sapiens
ALPTLIPSV

SEQ ID NO: 17396 - protein, 9 aa, Homo Sapiens
ALPTVLVGV

SEQ ID NO: 17397 - protein, 9 aa, Homo Sapiens
ALPVKLIGM

SEQ ID NO: 17398 - protein, 9 aa, Homo Sapiens
ALPVSLPQI

SEQ ID NO: 17399 - protein, 9 aa, Homo Sapiens
ALQEKLWNV

SEQ ID NO: 17400 - protein, 9 aa, Homo Sapiens
ALQEMVHQV

SEQ ID NO: 17401 - protein, 9 aa, Homo Sapiens
ALSDIFQAV

SEQ ID NO: 17402 - protein, 9 aa, Homo Sapiens
ALSEKIVSV

SEQ ID NO: 17403 - protein, 9 aa, Homo Sapiens
ALSFKTGIA

SEQ ID NO: 17404 - protein, 9 aa, Homo Sapiens
ALTPVVVTL

SEQ ID NO: 17405 - protein, 9 aa, Homo Sapiens
ALWDKLFNL

SEQ ID NO: 17406 - protein, 9 aa, Homo Sapiens
ALWEALLNT

SEQ ID NO: 17407 - protein, 9 aa, Homo Sapiens
ALWGFFPVL

SEQ ID NO: 17408 - protein, 9 aa, Homo Sapiens
ALWSLPLYL

SEQ ID NO: 17409 - protein, 9 aa, Homo Sapiens
ALYAVIEKA

SEQ ID NO: 17410 - protein, 9 aa, Homo Sapiens
ALYPVLEKA

SEQ ID NO: 17411 - protein, 9 aa, Homo Sapiens
ALYPVVSAA

SEQ ID NO: 17412 - protein, 9 aa, Homo Sapiens
ALYVAVVNV

SEQ ID NO: 17413 - protein, 9 aa, Homo Sapiens
AMDLIISTL

SEQ ID NO: 17414 - protein, 9 aa, Homo Sapiens
AMDPAVPNM

SEQ ID NO: 17415 - protein, 9 aa, Homo Sapiens
AMDPIAELL

SEQ ID NO: 17416 - protein, 9 aa, Homo Sapiens
AMDSVLHTL

SEQ ID NO: 17417 - protein, 9 aa, Homo Sapiens
AMDVVYALK

SEQ ID NO: 17418 - protein, 9 aa, Homo Sapiens
AMFENFVSV

SEQ ID NO: 17419 - protein, 9 aa, Homo Sapiens
AMINRFQFV

SEQ ID NO: 17420 - protein, 9 aa, Homo Sapiens
AMNDILAQV

SEQ ID NO: 17421 - protein, 9 aa, Homo Sapiens
AMPDSPAEV

SEQ ID NO: 17422 - protein, 9 aa, Homo Sapiens
AMPQPVPTA

SEQ ID NO: 17423 - protein, 9 aa, Homo Sapiens
AMPQTVYGV

SEQ ID NO: 17424 - protein, 9 aa, Homo Sapiens
AMPSWFDII

SEQ ID NO: 17425 - protein, 9 aa, Homo Sapiens
AMQDRYMEV

SEQ ID NO: 17426 - protein, 9 aa, Homo Sapiens
AQPPWLPGL

SEQ ID NO: 17427 - protein, 9 aa, Homo Sapiens
AQPVGFLTV

SEQ ID NO: 17428 - protein, 9 aa, Homo Sapiens
ASPPLITNV

SEQ ID NO: 17429 - protein, 9 aa, Homo Sapiens
ATDAILATL

SEQ ID NO: 17430 - protein, 9 aa, Homo Sapiens
ATDDSLHQL

SEQ ID NO: 17431 - protein, 9 aa, Homo Sapiens
ATDNIILTV

SEQ ID NO: 17432 - protein, 9 aa, Homo Sapiens
ATDPVYKTV

SEQ ID NO: 17433 - protein, 9 aa, Homo Sapiens
ATMPVVPSV

SEQ ID NO: 17434 - protein, 9 aa, Homo Sapiens
ATPHPFPAV

SEQ ID NO: 17435 - protein, 9 aa, Homo Sapiens
ATPMPTPSV

SEQ ID NO: 17436 - protein, 9 aa, Homo Sapiens
AVDAAIAAL

SEQ ID NO: 17437 - protein, 9 aa, Homo Sapiens
AVDAFFTAV

SEQ ID NO: 17438 - protein, 9 aa, Homo Sapiens
AVDAIFTRI

SEQ ID NO: 17439 - protein, 9 aa, Homo Sapiens
AVDAIMLEL

SEQ ID NO: 17440 - protein, 9 aa, Homo Sapiens
AVDALIDSM

SEQ ID NO: 17441 - protein, 9 aa, Homo Sapiens
AVDAVEEFL

SEQ ID NO: 17442 - protein, 9 aa, Homo Sapiens
AVDAVIAEL

SEQ ID NO: 17443 - protein, 9 aa, Homo Sapiens
AVDDFIEKL

SEQ ID NO: 17444 - protein, 9 aa, Homo Sapiens
AVDDIMVTL

SEQ ID NO: 17445 - protein, 9 aa, Homo Sapiens
AVDDVPFSI

SEQ ID NO: 17446 - protein, 9 aa, Homo Sapiens
AVDEAVILL

SEQ ID NO: 17447 - protein, 9 aa, Homo Sapiens
AVDEFLLLL

SEQ ID NO: 17448 - protein, 9 aa, Homo Sapiens
AVDEFYSKI

SEQ ID NO: 17449 - protein, 9 aa, Homo Sapiens
AVDELFTSL

SEQ ID NO: 17450 - protein, 9 aa, Homo Sapiens
AVDEVVLKF

SEQ ID NO: 17451 - protein, 9 aa, Homo Sapiens
AVDGHFLCL

SEQ ID NO: 17452 - protein, 9 aa, Homo Sapiens
AVDGISLHL

SEQ ID NO: 17453 - protein, 9 aa, Homo Sapiens
AVDGVIFQL

SEQ ID NO: 17454 - protein, 9 aa, Homo Sapiens
AVDGVIISL

SEQ ID NO: 17455 - protein, 9 aa, Homo Sapiens
AVDMVVTEV

SEQ ID NO: 17456 - protein, 9 aa, Homo Sapiens
AVDNILLKL

SEQ ID NO: 17457 - protein, 9 aa, Homo Sapiens
AVDNLVERL

SEQ ID NO: 17458 - protein, 9 aa, Homo Sapiens
AVDNVAHTI

SEQ ID NO: 17459 - protein, 9 aa, Homo Sapiens
AVDPGLPSV

SEQ ID NO: 17460 - protein, 9 aa, Homo Sapiens
AVDPLLALL

SEQ ID NO: 17461 - protein, 9 aa, Homo Sapiens
AVDQVIKAV

SEQ ID NO: 17462 - protein, 9 aa, Homo Sapiens
AVDRAITHL

SEQ ID NO: 17463 - protein, 9 aa, Homo Sapiens
AVDSVLVKL

SEQ ID NO: 17464 - protein, 9 aa, Homo Sapiens
AVDSVVSLL

SEQ ID NO: 17465 - protein, 9 aa, Homo Sapiens
AVDTIVAIM

SEQ ID NO: 17466 - protein, 9 aa, Homo Sapiens
AVDVVAIGL

SEQ ID NO: 17467 - protein, 9 aa, Homo Sapiens
AVDWIFSHI

SEQ ID NO: 17468 - protein, 9 aa, Homo Sapiens
AVDWLHELL

SEQ ID NO: 17469 - protein, 9 aa, Homo Sapiens
AVDYFFVEL

SEQ ID NO: 17470 - protein, 9 aa, Homo Sapiens
AVDYITVAL

SEQ ID NO: 17471 - protein, 9 aa, Homo Sapiens
AVDYVIRHL

SEQ ID NO: 17472 - protein, 9 aa, Homo Sapiens
AVEAIVKNV

SEQ ID NO: 17473 - protein, 9 aa, Homo Sapiens
AVFGLTTCI

SEQ ID NO: 17474 - protein, 9 aa, Homo Sapiens
AVFPHLTVV

SEQ ID NO: 17475 - protein, 9 aa, Homo Sapiens
AVHETLVAV

SEQ ID NO: 17476 - protein, 9 aa, Homo Sapiens
AVHKLLTLI

SEQ ID NO: 17477 - protein, 9 aa, Homo Sapiens
AVLDVLLCL

SEQ ID NO: 17478 - protein, 9 aa, Homo Sapiens
AVMDTLVSV

SEQ ID NO: 17479 - protein, 9 aa, Homo Sapiens
AVPATLPEL

SEQ ID NO: 17480 - protein, 9 aa, Homo Sapiens
AVPAVLPSF

SEQ ID NO: 17481 - protein, 9 aa, Homo Sapiens
AVPEVAVYL

SEQ ID NO: 17482 - protein, 9 aa, Homo Sapiens
AVPFSLDSV

SEQ ID NO: 17483 - protein, 9 aa, Homo Sapiens
AVPPPPAPL

SEQ ID NO: 17484 - protein, 9 aa, Homo Sapiens
AVPSWFVRV

SEQ ID NO: 17485 - protein, 9 aa, Homo Sapiens
AVVAHAYYL

SEQ ID NO: 17486 - protein, 9 aa, Homo Sapiens
AVVAPTSTV

SEQ ID NO: 17487 - protein, 9 aa, Homo Sapiens
AVVEFLTSV

SEQ ID NO: 17488 - protein, 9 aa, Homo Sapiens
AVVPPVNGV

SEQ ID NO: 17489 - protein, 9 aa, Homo Sapiens
CLEKEVAAL

SEQ ID NO: 17490 - protein, 9 aa, Homo Sapiens
CLPPLVPAI

SEQ ID NO: 17491 - protein, 9 aa, Homo Sapiens
CLYEIYPEL

SEQ ID NO: 17492 - protein, 9 aa, Homo Sapiens
DLDDLYVHL

SEQ ID NO: 17493 - protein, 9 aa, Homo Sapiens
EIKDKTAEL

SEQ ID NO: 17494 - protein, 9 aa, Homo Sapiens
ELDKIYETL

SEQ ID NO: 17495 - protein, 9 aa, Homo Sapiens
ELDNMFVHL

SEQ ID NO: 17496 - protein, 9 aa, Homo Sapiens
ELPDYYLTI

SEQ ID NO: 17497 - protein, 9 aa, Homo Sapiens
ELPKYLPAL

SEQ ID NO: 17498 - protein, 9 aa, Homo Sapiens
EMPSVFQNV

SEQ ID NO: 17499 - protein, 9 aa, Homo Sapiens
ETLDPGPPL

SEQ ID NO: 17500 - protein, 9 aa, Homo Sapiens
EVDDILAAV

SEQ ID NO: 17501 - protein, 9 aa, Homo Sapiens
EVISKLYAV

SEQ ID NO: 17502 - protein, 9 aa, Homo Sapiens
FADAVQELL

SEQ ID NO: 17503 - protein, 9 aa, Homo Sapiens
FADGVILLL

SEQ ID NO: 17504 - protein, 9 aa, Homo Sapiens
FADGVYLVL

SEQ ID NO: 17505 - protein, 9 aa, Homo Sapiens
FADPIAANL

SEQ ID NO: 17506 - protein, 9 aa, Homo Sapiens
FAIPMIHAV

SEQ ID NO: 17507 - protein, 9 aa, Homo Sapiens
FAPGDLPEL

SEQ ID NO: 17508 - protein, 9 aa, Homo Sapiens
FAPPQPVAA

SEQ ID NO: 17509 - protein, 9 aa, Homo Sapiens
FASPTQVFF

SEQ ID NO: 17510 - protein, 9 aa, Homo Sapiens
FAVTEYPTL

SEQ ID NO: 17511 - protein, 9 aa, Homo Sapiens
FGPAKLPRL

SEQ ID NO: 17512 - protein, 9 aa, Homo Sapiens
FGPPIPKGV

SEQ ID NO: 17513 - protein, 9 aa, Homo Sapiens
FGVPLIVHV

SEQ ID NO: 17514 - protein, 9 aa, Homo Sapiens
FIDAVYKLL

SEQ ID NO: 17515 - protein, 9 aa, Homo Sapiens
FIDDANYSV

SEQ ID NO: 17516 - protein, 9 aa, Homo Sapiens
FIDDIELMF

SEQ ID NO: 17517 - protein, 9 aa, Homo Sapiens
FIDDLPQEI

SEQ ID NO: 17518 - protein, 9 aa, Homo Sapiens
FIDDVVSAV

SEQ ID NO: 17519 - protein, 9 aa, Homo Sapiens
FIDEAYVEV

SEQ ID NO: 17520 - protein, 9 aa, Homo Sapiens
FIDEELEKM

SEQ ID NO: 17521 - protein, 9 aa, Homo Sapiens
FIDEYVETV

SEQ ID NO: 17522 - protein, 9 aa, Homo Sapiens
FIDFTYVRV

SEQ ID NO: 17523 - protein, 9 aa, Homo Sapiens
FIDGHFVEM

SEQ ID NO: 17524 - protein, 9 aa, Homo Sapiens
FIDGNVESL

SEQ ID NO: 17525 - protein, 9 aa, Homo Sapiens
FIDIVVENL

SEQ ID NO: 17526 - protein, 9 aa, Homo Sapiens
FIDKNNDLL

SEQ ID NO: 17527 - protein, 9 aa, Homo Sapiens
FIDKQLELL

SEQ ID NO: 17528 - protein, 9 aa, Homo Sapiens
FIDNLDERL

SEQ ID NO: 17529 - protein, 9 aa, Homo Sapiens
FIDQQQFYL

SEQ ID NO: 17530 - protein, 9 aa, Homo Sapiens
FIDSVLVKI

SEQ ID NO: 17531 - protein, 9 aa, Homo Sapiens
FIDTAQHML

SEQ ID NO: 17532 - protein, 9 aa, Homo Sapiens
FIDTLHHTL

SEQ ID NO: 17533 - protein, 9 aa, Homo Sapiens
FIDVGGYKL

SEQ ID NO: 17534 - protein, 9 aa, Homo Sapiens
FIEDIVKLI

SEQ ID NO: 17535 - protein, 9 aa, Homo Sapiens
FIEDYLKRV

SEQ ID NO: 17536 - protein, 9 aa, Homo Sapiens
FIFSDTHEL

SEQ ID NO: 17537 - protein, 9 aa, Homo Sapiens
FIHQHFVEV

SEQ ID NO: 17538 - protein, 9 aa, Homo Sapiens
FIIQGLRSV

SEQ ID NO: 17539 - protein, 9 aa, Homo Sapiens
FILDFYEKV

SEQ ID NO: 17540 - protein, 9 aa, Homo Sapiens
FILEKIEYL

SEQ ID NO: 17541 - protein, 9 aa, Homo Sapiens
FILGPSHHV

SEQ ID NO: 17542 - protein, 9 aa, Homo Sapiens
FILPIGATV

SEQ ID NO: 17543 - protein, 9 aa, Homo Sapiens
FINEKKYHL

SEQ ID NO: 17544 - protein, 9 aa, Homo Sapiens
FINELITEL

SEQ ID NO: 17545 - protein, 9 aa, Homo Sapiens
FINIVVHSV

SEQ ID NO: 17546 - protein, 9 aa, Homo Sapiens
FINPPIGTV

SEQ ID NO: 17547 - protein, 9 aa, Homo Sapiens
FIPDQPFRV

SEQ ID NO: 17548 - protein, 9 aa, Homo Sapiens
FIPLPFAEA

SEQ ID NO: 17549 - protein, 9 aa, Homo Sapiens
FIPPAFTNV

SEQ ID NO: 17550 - protein, 9 aa, Homo Sapiens
FIQSIISTV

SEQ ID NO: 17551 - protein, 9 aa, Homo Sapiens
FISEFEHRV

SEQ ID NO: 17552 - protein, 9 aa, Homo Sapiens
FISNVKTAL

SEQ ID NO: 17553 - protein, 9 aa, Homo Sapiens
FIVEETLPL

SEQ ID NO: 17554 - protein, 9 aa, Homo Sapiens
FIWPMLIHI

SEQ ID NO: 17555 - protein, 9 aa, Homo Sapiens
FLAHIYTEL

SEQ ID NO: 17556 - protein, 9 aa, Homo Sapiens
FLANVSTVL

SEQ ID NO: 17557 - protein, 9 aa, Homo Sapiens
FLDALIVSM

SEQ ID NO: 17558 - protein, 9 aa, Homo Sapiens
FLDAPAVRV

SEQ ID NO: 17559 - protein, 9 aa, Homo Sapiens
FLDASGAKL

SEQ ID NO: 17560 - protein, 9 aa, Homo Sapiens
FLDDFIACV

SEQ ID NO: 17561 - protein, 9 aa, Homo Sapiens
FLDDLFVFM

SEQ ID NO: 17562 - protein, 9 aa, Homo Sapiens
FLDDLGLKF

SEQ ID NO: 17563 - protein, 9 aa, Homo Sapiens
FLDDLSQKL

SEQ ID NO: 17564 - protein, 9 aa, Homo Sapiens
FLDDNQIIT

SEQ ID NO: 17565 - protein, 9 aa, Homo Sapiens
FLDDPIWRG

SEQ ID NO: 17566 - protein, 9 aa, Homo Sapiens
FLDDQETRL

SEQ ID NO: 17567 - protein, 9 aa, Homo Sapiens
FLDDSTLRF

SEQ ID NO: 17568 - protein, 9 aa, Homo Sapiens
FLDDVVHSL

SEQ ID NO: 17569 - protein, 9 aa, Homo Sapiens
FLDEDDMSL

SEQ ID NO: 17570 - protein, 9 aa, Homo Sapiens
FLDEEVKLI

SEQ ID NO: 17571 - protein, 9 aa, Homo Sapiens
FLDEFVTFL

SEQ ID NO: 17572 - protein, 9 aa, Homo Sapiens
FLDEKTHEL

SEQ ID NO: 17573 - protein, 9 aa, Homo Sapiens
FLDELAQKL

SEQ ID NO: 17574 - protein, 9 aa, Homo Sapiens
FLDENVHFA

SEQ ID NO: 17575 - protein, 9 aa, Homo Sapiens
FLDENVHFF

SEQ ID NO: 17576 - protein, 9 aa, Homo Sapiens
FLDEPTNHL

SEQ ID NO: 17577 - protein, 9 aa, Homo Sapiens
FLDERTPRL

SEQ ID NO: 17578 - protein, 9 aa, Homo Sapiens
FLDEWLYKF

SEQ ID NO: 17579 - protein, 9 aa, Homo Sapiens
FLDFAPHYF

SEQ ID NO: 17580 - protein, 9 aa, Homo Sapiens
FLDFLWHNM

SEQ ID NO: 17581 - protein, 9 aa, Homo Sapiens
FLDGIYKTI

SEQ ID NO: 17582 - protein, 9 aa, Homo Sapiens
FLDGNELTL

SEQ ID NO: 17583 - protein, 9 aa, Homo Sapiens
FLDGNEMTL

SEQ ID NO: 17584 - protein, 9 aa, Homo Sapiens
FLDGYVSQL

SEQ ID NO: 17585 - protein, 9 aa, Homo Sapiens
FLDHEMVFL

SEQ ID NO: 17586 - protein, 9 aa, Homo Sapiens
FLDHIIASV

SEQ ID NO: 17587 - protein, 9 aa, Homo Sapiens
FLDHLYVGI

SEQ ID NO: 17588 - protein, 9 aa, Homo Sapiens
FLDHVMYTI

SEQ ID NO: 17589 - protein, 9 aa, Homo Sapiens
FLDHVRTSF

SEQ ID NO: 17590 - protein, 9 aa, Homo Sapiens
FLDISRPKM

SEQ ID NO: 17591 - protein, 9 aa, Homo Sapiens
FLDKELTGL

SEQ ID NO: 17592 - protein, 9 aa, Homo Sapiens
FLDKILVKL

SEQ ID NO: 17593 - protein, 9 aa, Homo Sapiens
FLDKQGFYV

SEQ ID NO: 17594 - protein, 9 aa, Homo Sapiens
FLDKVANGL

SEQ ID NO: 17595 - protein, 9 aa, Homo Sapiens
FLDLGPPGI

SEQ ID NO: 17596 - protein, 9 aa, Homo Sapiens
FLDLGYNRL

SEQ ID NO: 17597 - protein, 9 aa, Homo Sapiens
FLDLLQERI

SEQ ID NO: 17598 - protein, 9 aa, Homo Sapiens
FLDLPEPLL

SEQ ID NO: 17599 - protein, 9 aa, Homo Sapiens
FLDLPVDTL

SEQ ID NO: 17600 - protein, 9 aa, Homo Sapiens
FLDLTQLEL

SEQ ID NO: 17601 - protein, 9 aa, Homo Sapiens
FLDMNFQSL

SEQ ID NO: 17602 - protein, 9 aa, Homo Sapiens
FLDMTNWNL

SEQ ID NO: 17603 - protein, 9 aa, Homo Sapiens
FLDNERHEV

SEQ ID NO: 17604 - protein, 9 aa, Homo Sapiens
FLDNLHINL

SEQ ID NO: 17605 - protein, 9 aa, Homo Sapiens
FLDNMFHVL

SEQ ID NO: 17606 - protein, 9 aa, Homo Sapiens
FLDNSFEKV

SEQ ID NO: 17607 - protein, 9 aa, Homo Sapiens
FLDNSLDTV

SEQ ID NO: 17608 - protein, 9 aa, Homo Sapiens
FLDPDMYSL

SEQ ID NO: 17609 - protein, 9 aa, Homo Sapiens
FLDPGGPMM

SEQ ID NO: 17610 - protein, 9 aa, Homo Sapiens
FLDPIMSTL

SEQ ID NO: 17611 - protein, 9 aa, Homo Sapiens
FLDPITGTF

SEQ ID NO: 17612 - protein, 9 aa, Homo Sapiens
FLDQHGHNL

SEQ ID NO: 17613 - protein, 9 aa, Homo Sapiens
FLDQHPFSF

SEQ ID NO: 17614 - protein, 9 aa, Homo Sapiens
FLDQQAILF

SEQ ID NO: 17615 - protein, 9 aa, Homo Sapiens
FLDQVAHKL

SEQ ID NO: 17616 - protein, 9 aa, Homo Sapiens
FLDQVTGFL

SEQ ID NO: 17617 - protein, 9 aa, Homo Sapiens
FLDRESIKL

SEQ ID NO: 17618 - protein, 9 aa, Homo Sapiens
FLDRPQQWL

SEQ ID NO: 17619 - protein, 9 aa, Homo Sapiens
FLDSAYFRL

SEQ ID NO: 17620 - protein, 9 aa, Homo Sapiens
FLDSELSML

SEQ ID NO: 17621 - protein, 9 aa, Homo Sapiens
FLDSEVSEL

SEQ ID NO: 17622 - protein, 9 aa, Homo Sapiens
FLDSLIYGA

SEQ ID NO: 17623 - protein, 9 aa, Homo Sapiens
FLDSLRDLI

SEQ ID NO: 17624 - protein, 9 aa, Homo Sapiens
FLDSQTATF

SEQ ID NO: 17625 - protein, 9 aa, Homo Sapiens
FLDSSTLQL

SEQ ID NO: 17626 - protein, 9 aa, Homo Sapiens
FLDSTSPLL

SEQ ID NO: 17627 - protein, 9 aa, Homo Sapiens
FLDTIATRF

SEQ ID NO: 17628 - protein, 9 aa, Homo Sapiens
FLDTIKSNL

SEQ ID NO: 17629 - protein, 9 aa, Homo Sapiens
FLDTLKDLI

SEQ ID NO: 17630 - protein, 9 aa, Homo Sapiens
FLDTLLEEL

SEQ ID NO: 17631 - protein, 9 aa, Homo Sapiens
FLDVDFEKL

SEQ ID NO: 17632 - protein, 9 aa, Homo Sapiens
FLDWPQGTF

SEQ ID NO: 17633 - protein, 9 aa, Homo Sapiens
FLDYQLDEL

SEQ ID NO: 17634 - protein, 9 aa, Homo Sapiens
FLDYTTDNM

SEQ ID NO: 17635 - protein, 9 aa, Homo Sapiens
FLEDLVPYL

SEQ ID NO: 17636 - protein, 9 aa, Homo Sapiens
FLEEEVYPL

SEQ ID NO: 17637 - protein, 9 aa, Homo Sapiens
FLEEISPHL

SEQ ID NO: 17638 - protein, 9 aa, Homo Sapiens
FLEENISEV

SEQ ID NO: 17639 - protein, 9 aa, Homo Sapiens
FLEEYTSQL

SEQ ID NO: 17640 - protein, 9 aa, Homo Sapiens
FLEKLLPPV

SEQ ID NO: 17641 - protein, 9 aa, Homo Sapiens
FLENEHQQL

SEQ ID NO: 17642 - protein, 9 aa, Homo Sapiens
FLESCPPDL

SEQ ID NO: 17643 - protein, 9 aa, Homo Sapiens
FLETNVPLL

SEQ ID NO: 17644 - protein, 9 aa, Homo Sapiens
FLFDHLLTL

SEQ ID NO: 17645 - protein, 9 aa, Homo Sapiens
FLFDRPMHV

SEQ ID NO: 17646 - protein, 9 aa, Homo Sapiens
FLFDTQHFI

SEQ ID NO: 17647 - protein, 9 aa, Homo Sapiens
FLFEDFSKA

SEQ ID NO: 17648 - protein, 9 aa, Homo Sapiens
FLFELPSRL

SEQ ID NO: 17649 - protein, 9 aa, Homo Sapiens
FLFEPVVKA

SEQ ID NO: 17650 - protein, 9 aa, Homo Sapiens
FLFGEVHKA

SEQ ID NO: 17651 - protein, 9 aa, Homo Sapiens
FLFLDRTYV

SEQ ID NO: 17652 - protein, 9 aa, Homo Sapiens
FLFNTENKL

SEQ ID NO: 17653 - protein, 9 aa, Homo Sapiens
FLFPVYPLI

SEQ ID NO: 17654 - protein, 9 aa, Homo Sapiens
FLFSKFIEL

SEQ ID NO: 17655 - protein, 9 aa, Homo Sapiens
FLGDPPPGL

SEQ ID NO: 17656 - protein, 9 aa, Homo Sapiens
FLGEKIASV

SEQ ID NO: 17657 - protein, 9 aa, Homo Sapiens
FLGIHVFLV

SEQ ID NO: 17658 - protein, 9 aa, Homo Sapiens
FLHEATARL

SEQ ID NO: 17659 - protein, 9 aa, Homo Sapiens
FLHEATVRL

SEQ ID NO: 17660 - protein, 9 aa, Homo Sapiens
FLHEVLWEL

SEQ ID NO: 17661 - protein, 9 aa, Homo Sapiens
FLIAQLPKL

SEQ ID NO: 17662 - protein, 9 aa, Homo Sapiens
FLIEEQKIV

SEQ ID NO: 17663 - protein, 9 aa, Homo Sapiens
FLIGQGAHV

SEQ ID NO: 17664 - protein, 9 aa, Homo Sapiens
FLINFIHTL

SEQ ID NO: 17665 - protein, 9 aa, Homo Sapiens
FLIPIYHQV

SEQ ID NO: 17666 - protein, 9 aa, Homo Sapiens
FLIPKFFEL

SEQ ID NO: 17667 - protein, 9 aa, Homo Sapiens
FLKDKFVEI

SEQ ID NO: 17668 - protein, 9 aa, Homo Sapiens
FLLDKKIGV

SEQ ID NO: 17669 - protein, 9 aa, Homo Sapiens
FLLEKGYEV

SEQ ID NO: 17670 - protein, 9 aa, Homo Sapiens
FLLEKPFSV

SEQ ID NO: 17671 - protein, 9 aa, Homo Sapiens
FLLETVVRV

SEQ ID NO: 17672 - protein, 9 aa, Homo Sapiens
FLLHIQQQV

SEQ ID NO: 17673 - protein, 9 aa, Homo Sapiens
FLLPILSQI

SEQ ID NO: 17674 - protein, 9 aa, Homo Sapiens
FLLPKFHGV

SEQ ID NO: 17675 - protein, 9 aa, Homo Sapiens
FLLPMFERL

SEQ ID NO: 17676 - protein, 9 aa, Homo Sapiens
FLLPVIMRA

SEQ ID NO: 17677 - protein, 9 aa, Homo Sapiens
FLLPVINEM

SEQ ID NO: 17678 - protein, 9 aa, Homo Sapiens
FLLQHQTFL

SEQ ID NO: 17679 - protein, 9 aa, Homo Sapiens
FLLVTEVHL

SEQ ID NO: 17680 - protein, 9 aa, Homo Sapiens
FLMDFIHQV

SEQ ID NO: 17681 - protein, 9 aa, Homo Sapiens
FLMNEVIKL

SEQ ID NO: 17682 - protein, 9 aa, Homo Sapiens
FLNDEVWNL

SEQ ID NO: 17683 - protein, 9 aa, Homo Sapiens
FLNDIFERI

SEQ ID NO: 17684 - protein, 9 aa, Homo Sapiens
FLNDPGHLL

SEQ ID NO: 17685 - protein, 9 aa, Homo Sapiens
FLNKEITSV

SEQ ID NO: 17686 - protein, 9 aa, Homo Sapiens
FLPAGIVAV

SEQ ID NO: 17687 - protein, 9 aa, Homo Sapiens
FLPALITAV

SEQ ID NO: 17688 - protein, 9 aa, Homo Sapiens
FLPDHPIVL

SEQ ID NO: 17689 - protein, 9 aa, Homo Sapiens
FLPDLQITM

SEQ ID NO: 17690 - protein, 9 aa, Homo Sapiens
FLPEAFDFI

SEQ ID NO: 17691 - protein, 9 aa, Homo Sapiens
FLPEALDFV

SEQ ID NO: 17692 - protein, 9 aa, Homo Sapiens
FLPEAPAEL

SEQ ID NO: 17693 - protein, 9 aa, Homo Sapiens
FLPEEFMKT

SEQ ID NO: 17694 - protein, 9 aa, Homo Sapiens
FLPEEQDRL

SEQ ID NO: 17695 - protein, 9 aa, Homo Sapiens
FLPEGVNKL

SEQ ID NO: 17696 - protein, 9 aa, Homo Sapiens
FLPEPMGTA

SEQ ID NO: 17697 - protein, 9 aa, Homo Sapiens
FLPESVAVV

SEQ ID NO: 17698 - protein, 9 aa, Homo Sapiens
FLPESYLLL

SEQ ID NO: 17699 - protein, 9 aa, Homo Sapiens
FLPEVIYKM

SEQ ID NO: 17700 - protein, 9 aa, Homo Sapiens
FLPFLTTEV

SEQ ID NO: 17701 - protein, 9 aa, Homo Sapiens
FLPFPLPLF

SEQ ID NO: 17702 - protein, 9 aa, Homo Sapiens
FLPFSFEHI

SEQ ID NO: 17703 - protein, 9 aa, Homo Sapiens
FLPHELPLL

SEQ ID NO: 17704 - protein, 9 aa, Homo Sapiens
FLPLHYDYL

SEQ ID NO: 17705 - protein, 9 aa, Homo Sapiens
FLPLIHVYL

SEQ ID NO: 17706 - protein, 9 aa, Homo Sapiens
FLPLIVNTV

SEQ ID NO: 17707 - protein, 9 aa, Homo Sapiens
FLPLKWSLA

SEQ ID NO: 17708 - protein, 9 aa, Homo Sapiens
FLPLPVVQL

SEQ ID NO: 17709 - protein, 9 aa, Homo Sapiens
FLPNAPKAL

SEQ ID NO: 17710 - protein, 9 aa, Homo Sapiens
FLPPAQVTV

SEQ ID NO: 17711 - protein, 9 aa, Homo Sapiens
FLPPEVNQL

SEQ ID NO: 17712 - protein, 9 aa, Homo Sapiens
FLPPFPAHL

SEQ ID NO: 17713 - protein, 9 aa, Homo Sapiens
FLPPGDFLV

SEQ ID NO: 17714 - protein, 9 aa, Homo Sapiens
FLPPLPTSV

SEQ ID NO: 17715 - protein, 9 aa, Homo Sapiens
FLPPNMQGL

SEQ ID NO: 17716 - protein, 9 aa, Homo Sapiens
FLPPPFPPP

SEQ ID NO: 17717 - protein, 9 aa, Homo Sapiens
FLPPSFPIV

SEQ ID NO: 17718 - protein, 9 aa, Homo Sapiens
FLPPVLLKL

SEQ ID NO: 17719 - protein, 9 aa, Homo Sapiens
FLPPYTFQI

SEQ ID NO: 17720 - protein, 9 aa, Homo Sapiens
FLPQEEPVV

SEQ ID NO: 17721 - protein, 9 aa, Homo Sapiens
FLPQIEAAL

SEQ ID NO: 17722 - protein, 9 aa, Homo Sapiens
FLPQKIIYL

SEQ ID NO: 17723 - protein, 9 aa, Homo Sapiens
FLPQVVVTV

SEQ ID NO: 17724 - protein, 9 aa, Homo Sapiens
FLPRKFPSL

SEQ ID NO: 17725 - protein, 9 aa, Homo Sapiens
FLPSANEHL

SEQ ID NO: 17726 - protein, 9 aa, Homo Sapiens
FLPSHYNYL

SEQ ID NO: 17727 - protein, 9 aa, Homo Sapiens
FLPSYIIDV

SEQ ID NO: 17728 - protein, 9 aa, Homo Sapiens
FLPTILNQL

SEQ ID NO: 17729 - protein, 9 aa, Homo Sapiens
FLPTLLHQA

SEQ ID NO: 17730 - protein, 9 aa, Homo Sapiens
FLPTTGTKL

SEQ ID NO: 17731 - protein, 9 aa, Homo Sapiens
FLPVGFVTL

SEQ ID NO: 17732 - protein, 9 aa, Homo Sapiens
FLPVKLIFV

SEQ ID NO: 17733 - protein, 9 aa, Homo Sapiens
FLQDTIEEM

SEQ ID NO: 17734 - protein, 9 aa, Homo Sapiens
FLQEQLVEL

SEQ ID NO: 17735 - protein, 9 aa, Homo Sapiens
FLQPELVKL

SEQ ID NO: 17736 - protein, 9 aa, Homo Sapiens
FLQRFIDPL

SEQ ID NO: 17737 - protein, 9 aa, Homo Sapiens
FLREYFERL

SEQ ID NO: 17738 - protein, 9 aa, Homo Sapiens
FLSELQYYL

SEQ ID NO: 17739 - protein, 9 aa, Homo Sapiens
FLSELTQQL

SEQ ID NO: 17740 - protein, 9 aa, Homo Sapiens
FLSEVFAQL

SEQ ID NO: 17741 - protein, 9 aa, Homo Sapiens
FLSSVIQNL

SEQ ID NO: 17742 - protein, 9 aa, Homo Sapiens
FLTAVAHRL

SEQ ID NO: 17743 - protein, 9 aa, Homo Sapiens
FLTEFINYI

SEQ ID NO: 17744 - protein, 9 aa, Homo Sapiens
FLTEINSTV

SEQ ID NO: 17745 - protein, 9 aa, Homo Sapiens
FLVDIMEHL

SEQ ID NO: 17746 - protein, 9 aa, Homo Sapiens
FLVDKYEIL

SEQ ID NO: 17747 - protein, 9 aa, Homo Sapiens
FLVHNVKEL

SEQ ID NO: 17748 - protein, 9 aa, Homo Sapiens
FLVPTFEQL

SEQ ID NO: 17749 - protein, 9 aa, Homo Sapiens
FLVTVIHTL

SEQ ID NO: 17750 - protein, 9 aa, Homo Sapiens
FLWEAESHA

SEQ ID NO: 17751 - protein, 9 aa, Homo Sapiens
FLWERPTLL

SEQ ID NO: 17752 - protein, 9 aa, Homo Sapiens
FLYDDNQRV

SEQ ID NO: 17753 - protein, 9 aa, Homo Sapiens
FLYNPLTRV

SEQ ID NO: 17754 - protein, 9 aa, Homo Sapiens
FLYPFLHTV

SEQ ID NO: 17755 - protein, 9 aa, Homo Sapiens
FLYPFPLAL

SEQ ID NO: 17756 - protein, 9 aa, Homo Sapiens
FMDESTQCF

SEQ ID NO: 17757 - protein, 9 aa, Homo Sapiens
FMDGIQISL

SEQ ID NO: 17758 - protein, 9 aa, Homo Sapiens
FMDSVIFTL

SEQ ID NO: 17759 - protein, 9 aa, Homo Sapiens
FMLSISPRL

SEQ ID NO: 17760 - protein, 9 aa, Homo Sapiens
FMMPQSLGV

SEQ ID NO: 17761 - protein, 9 aa, Homo Sapiens
FMNPHLISV

SEQ ID NO: 17762 - protein, 9 aa, Homo Sapiens
FMSEYLIEL

SEQ ID NO: 17763 - protein, 9 aa, Homo Sapiens
FMVEKGPTL

SEQ ID NO: 17764 - protein, 9 aa, Homo Sapiens
FQDDDQTRV

SEQ ID NO: 17765 - protein, 9 aa, Homo Sapiens
FQDEINWRL

SEQ ID NO: 17766 - protein, 9 aa, Homo Sapiens
FQDIIWVKL

SEQ ID NO: 17767 - protein, 9 aa, Homo Sapiens
FQDPVPLTV

SEQ ID NO: 17768 - protein, 9 aa, Homo Sapiens
FQDQVLDLL

SEQ ID NO: 17769 - protein, 9 aa, Homo Sapiens
FQDSVFNDL

SEQ ID NO: 17770 - protein, 9 aa, Homo Sapiens
FQVDEIYTV

SEQ ID NO: 17771 - protein, 9 aa, Homo Sapiens
FSDEILLHI

SEQ ID NO: 17772 - protein, 9 aa, Homo Sapiens
FSDEIRHNL

SEQ ID NO: 17773 - protein, 9 aa, Homo Sapiens
FSPEDSPSV

SEQ ID NO: 17774 - protein, 9 aa, Homo Sapiens
FTDDQWLNV

SEQ ID NO: 17775 - protein, 9 aa, Homo Sapiens
FTDERIFML

SEQ ID NO: 17776 - protein, 9 aa, Homo Sapiens
FTDGITNKL

SEQ ID NO: 17777 - protein, 9 aa, Homo Sapiens
FTDIVTVQV

SEQ ID NO: 17778 - protein, 9 aa, Homo Sapiens
FVDAITELL

SEQ ID NO: 17779 - protein, 9 aa, Homo Sapiens
FVDATKERL

SEQ ID NO: 17780 - protein, 9 aa, Homo Sapiens
FVDDQQTFF

SEQ ID NO: 17781 - protein, 9 aa, Homo Sapiens
FVDDYTVRV

SEQ ID NO: 17782 - protein, 9 aa, Homo Sapiens
FVDEFLTYL

SEQ ID NO: 17783 - protein, 9 aa, Homo Sapiens
FVDEGIKTL

SEQ ID NO: 17784 - protein, 9 aa, Homo Sapiens
FVDEGKATV

SEQ ID NO: 17785 - protein, 9 aa, Homo Sapiens
FVDEILTSL

SEQ ID NO: 17786 - protein, 9 aa, Homo Sapiens
FVDELRITL

SEQ ID NO: 17787 - protein, 9 aa, Homo Sapiens
FVDESHIRM

SEQ ID NO: 17788 - protein, 9 aa, Homo Sapiens
FVDGLHEKL

SEQ ID NO: 17789 - protein, 9 aa, Homo Sapiens
FVDGLNFSL

SEQ ID NO: 17790 - protein, 9 aa, Homo Sapiens
FVDGLTFKV

SEQ ID NO: 17791 - protein, 9 aa, Homo Sapiens
FVDIVDAKL

SEQ ID NO: 17792 - protein, 9 aa, Homo Sapiens
FVDIVKVLL

SEQ ID NO: 17793 - protein, 9 aa, Homo Sapiens
FVDKLFESL

SEQ ID NO: 17794 - protein, 9 aa, Homo Sapiens
FVDKYSISL

SEQ ID NO: 17795 - protein, 9 aa, Homo Sapiens
FVDLEPTVI

SEQ ID NO: 17796 - protein, 9 aa, Homo Sapiens
FVDLIIKHI

SEQ ID NO: 17797 - protein, 9 aa, Homo Sapiens
FVDPAQITM

SEQ ID NO: 17798 - protein, 9 aa, Homo Sapiens
FVDPVLNQL

SEQ ID NO: 17799 - protein, 9 aa, Homo Sapiens
FVDQLVEGL

SEQ ID NO: 17800 - protein, 9 aa, Homo Sapiens
FVDRGFYSV

SEQ ID NO: 17801 - protein, 9 aa, Homo Sapiens
FVEEEEHFL

SEQ ID NO: 17802 - protein, 9 aa, Homo Sapiens
FVEETVYLL

SEQ ID NO: 17803 - protein, 9 aa, Homo Sapiens
FVEGVVKKV

SEQ ID NO: 17804 - protein, 9 aa, Homo Sapiens
FVEPFVILL

SEQ ID NO: 17805 - protein, 9 aa, Homo Sapiens
FVHDLVLYL

SEQ ID NO: 17806 - protein, 9 aa, Homo Sapiens
FVIAELVNV

SEQ ID NO: 17807 - protein, 9 aa, Homo Sapiens
FVIDLQTRL

SEQ ID NO: 17808 - protein, 9 aa, Homo Sapiens
FVLDKVPFL

SEQ ID NO: 17809 - protein, 9 aa, Homo Sapiens
FVLPELPSV

SEQ ID NO: 17810 - protein, 9 aa, Homo Sapiens
FVLPILQKL

SEQ ID NO: 17811 - protein, 9 aa, Homo Sapiens
FVLPVATQI

SEQ ID NO: 17812 - protein, 9 aa, Homo Sapiens
FVMETFVHL

SEQ ID NO: 17813 - protein, 9 aa, Homo Sapiens
FVNDIFERI

SEQ ID NO: 17814 - protein, 9 aa, Homo Sapiens
FVNEIISRI

SEQ ID NO: 17815 - protein, 9 aa, Homo Sapiens
FVPAPWLSV

SEQ ID NO: 17816 - protein, 9 aa, Homo Sapiens
FVPDTPVGV

SEQ ID NO: 17817 - protein, 9 aa, Homo Sapiens
FVPEIFHRI

SEQ ID NO: 17818 - protein, 9 aa, Homo Sapiens
FVPEKNFRV

SEQ ID NO: 17819 - protein, 9 aa, Homo Sapiens
FVPPTFKSV

SEQ ID NO: 17820 - protein, 9 aa, Homo Sapiens
GADAIYDHI

SEQ ID NO: 17821 - protein, 9 aa, Homo Sapiens
GAPDFLAHV

SEQ ID NO: 17822 - protein, 9 aa, Homo Sapiens
GAPVYLAAV

SEQ ID NO: 17823 - protein, 9 aa, Homo Sapiens
GIDDLHISL

SEQ ID NO: 17824 - protein, 9 aa, Homo Sapiens
GIDRIISQV

SEQ ID NO: 17825 - protein, 9 aa, Homo Sapiens
GIIDAFHQI

SEQ ID NO: 17826 - protein, 9 aa, Homo Sapiens
GIMKKAYEL

SEQ ID NO: 17827 - protein, 9 aa, Homo Sapiens
GIPDALPTV

SEQ ID NO: 17828 - protein, 9 aa, Homo Sapiens
GIVGVFVKL

SEQ ID NO: 17829 - protein, 9 aa, Homo Sapiens
GLDAIITQL

SEQ ID NO: 17830 - protein, 9 aa, Homo Sapiens
GLDAIVTQL

SEQ ID NO: 17831 - protein, 9 aa, Homo Sapiens
GLDALKVTV

SEQ ID NO: 17832 - protein, 9 aa, Homo Sapiens
GLDDIQTLI

SEQ ID NO: 17833 - protein, 9 aa, Homo Sapiens
GLDDLLLFL

SEQ ID NO: 17834 - protein, 9 aa, Homo Sapiens
GLDDMKANL

SEQ ID NO: 17835 - protein, 9 aa, Homo Sapiens
GLDDVITDL

SEQ ID NO: 17836 - protein, 9 aa, Homo Sapiens
GLDEAFSRL

SEQ ID NO: 17837 - protein, 9 aa, Homo Sapiens
GLDEALYNV

SEQ ID NO: 17838 - protein, 9 aa, Homo Sapiens
GLDELFVQV

SEQ ID NO: 17839 - protein, 9 aa, Homo Sapiens
GLDESKAKL

SEQ ID NO: 17840 - protein, 9 aa, Homo Sapiens
GLDEVVRLL

SEQ ID NO: 17841 - protein, 9 aa, Homo Sapiens
GLDGPPPTV

SEQ ID NO: 17842 - protein, 9 aa, Homo Sapiens
GLDHIVDKV

SEQ ID NO: 17843 - protein, 9 aa, Homo Sapiens
GLDIITNKV

SEQ ID NO: 17844 - protein, 9 aa, Homo Sapiens
GLDIPTVQV

SEQ ID NO: 17845 - protein, 9 aa, Homo Sapiens
GLDISSPGM

SEQ ID NO: 17846 - protein, 9 aa, Homo Sapiens
GLDLISVRL

SEQ ID NO: 17847 - protein, 9 aa, Homo Sapiens
GLDNETHFL

SEQ ID NO: 17848 - protein, 9 aa, Homo Sapiens
GLDNINVFL

SEQ ID NO: 17849 - protein, 9 aa, Homo Sapiens
GLDNLYKKV

SEQ ID NO: 17850 - protein, 9 aa, Homo Sapiens
GLDPARVNV

SEQ ID NO: 17851 - protein, 9 aa, Homo Sapiens
GLDQQFAGL

SEQ ID NO: 17852 - protein, 9 aa, Homo Sapiens
GLDRLNVTV

SEQ ID NO: 17853 - protein, 9 aa, Homo Sapiens
GLDSFYEYL

SEQ ID NO: 17854 - protein, 9 aa, Homo Sapiens
GLDTILQNL

SEQ ID NO: 17855 - protein, 9 aa, Homo Sapiens
GLDTVVALL

SEQ ID NO: 17856 - protein, 9 aa, Homo Sapiens
GLFPTSHSV

SEQ ID NO: 17857 - protein, 9 aa, Homo Sapiens
GLFTVFTGV

SEQ ID NO: 17858 - protein, 9 aa, Homo Sapiens
GLIDKVNEL

SEQ ID NO: 17859 - protein, 9 aa, Homo Sapiens
GLIDVHVHL

SEQ ID NO: 17860 - protein, 9 aa, Homo Sapiens
GLIEILKKV

SEQ ID NO: 17861 - protein, 9 aa, Homo Sapiens
GLIEKFYVI

SEQ ID NO: 17862 - protein, 9 aa, Homo Sapiens
GLKEGIPAL

SEQ ID NO: 17863 - protein, 9 aa, Homo Sapiens
GLLEIVTSV

SEQ ID NO: 17864 - protein, 9 aa, Homo Sapiens
GLLGYLHFV

SEQ ID NO: 17865 - protein, 9 aa, Homo Sapiens
GLLSIFTKV

SEQ ID NO: 17866 - protein, 9 aa, Homo Sapiens
GLMRKVPRV

SEQ ID NO: 17867 - protein, 9 aa, Homo Sapiens
GLNEEIARV

SEQ ID NO: 17868 - protein, 9 aa, Homo Sapiens
GLPDNISSV

SEQ ID NO: 17869 - protein, 9 aa, Homo Sapiens
GLPEAPPFL

SEQ ID NO: 17870 - protein, 9 aa, Homo Sapiens
GLPEITPKL

SEQ ID NO: 17871 - protein, 9 aa, Homo Sapiens
GLPELVIQL

SEQ ID NO: 17872 - protein, 9 aa, Homo Sapiens
GLPGVMPNI

SEQ ID NO: 17873 - protein, 9 aa, Homo Sapiens
GLPHWVPAL

SEQ ID NO: 17874 - protein, 9 aa, Homo Sapiens
GLPKKFVDI

SEQ ID NO: 17875 - protein, 9 aa, Homo Sapiens
GLPPAMQKV

SEQ ID NO: 17876 - protein, 9 aa, Homo Sapiens
GLPSDFHTA

SEQ ID NO: 17877 - protein, 9 aa, Homo Sapiens
GLPSFLTEV

SEQ ID NO: 17878 - protein, 9 aa, Homo Sapiens
GLPTRLPEI

SEQ ID NO: 17879 - protein, 9 aa, Homo Sapiens
GLPTSVPQI

SEQ ID NO: 17880 - protein, 9 aa, Homo Sapiens
GLPWRFEEL

SEQ ID NO: 17881 - protein, 9 aa, Homo Sapiens
GLSAFLHAI

SEQ ID NO: 17882 - protein, 9 aa, Homo Sapiens
GLVPFLVSV

SEQ ID NO: 17883 - protein, 9 aa, Homo Sapiens
GLWEEAYRV

SEQ ID NO: 17884 - protein, 9 aa, Homo Sapiens
GLWPVYEGV

SEQ ID NO: 17885 - protein, 9 aa, Homo Sapiens
GLYELVWRV

SEQ ID NO: 17886 - protein, 9 aa, Homo Sapiens
GMDDIFSHI

SEQ ID NO: 17887 - protein, 9 aa, Homo Sapiens
GMDEVYNLF

SEQ ID NO: 17888 - protein, 9 aa, Homo Sapiens
GMDLVVKTV

SEQ ID NO: 17889 - protein, 9 aa, Homo Sapiens
GMPDFLEKL

SEQ ID NO: 17890 - protein, 9 aa, Homo Sapiens
GMPGALPSL

SEQ ID NO: 17891 - protein, 9 aa, Homo Sapiens
GMYIFLHTV

SEQ ID NO: 17892 - protein, 9 aa, Homo Sapiens
GQIEVVPEV

SEQ ID NO: 17893 - protein, 9 aa, Homo Sapiens
GVDDAFYTL

SEQ ID NO: 17894 - protein, 9 aa, Homo Sapiens
GVDDLDFFI

SEQ ID NO: 17895 - protein, 9 aa, Homo Sapiens
GVDNIFILV

SEQ ID NO: 17896 - protein, 9 aa, Homo Sapiens
GVIATIAFL

SEQ ID NO: 17897 - protein, 9 aa, Homo Sapiens
GVIELYVKL

SEQ ID NO: 17898 - protein, 9 aa, Homo Sapiens
GVPQALFGV

SEQ ID NO: 17899 - protein, 9 aa, Homo Sapiens
HEKIWFDKF

SEQ ID NO: 17900 - protein, 9 aa, Homo Sapiens
HIDAVSLLL

SEQ ID NO: 17901 - protein, 9 aa, Homo Sapiens
HIDETYLMF

SEQ ID NO: 17902 - protein, 9 aa, Homo Sapiens
HIDNFLEQL

SEQ ID NO: 17903 - protein, 9 aa, Homo Sapiens
HIDSFIENL

SEQ ID NO: 17904 - protein, 9 aa, Homo Sapiens
HIDTILHVL

SEQ ID NO: 17905 - protein, 9 aa, Homo Sapiens
HIDTVINAL

SEQ ID NO: 17906 - protein, 9 aa, Homo Sapiens
HIDVITAEM

SEQ ID NO: 17907 - protein, 9 aa, Homo Sapiens
HIIENIVAV

SEQ ID NO: 17908 - protein, 9 aa, Homo Sapiens
HIPDVITYL

SEQ ID NO: 17909 - protein, 9 aa, Homo Sapiens
HIPEVYLIV

SEQ ID NO: 17910 - protein, 9 aa, Homo Sapiens
HIWDPLTNV

SEQ ID NO: 17911 - protein, 9 aa, Homo Sapiens
HLDATKLLL

SEQ ID NO: 17912 - protein, 9 aa, Homo Sapiens
HLDDILQHV

SEQ ID NO: 17913 - protein, 9 aa, Homo Sapiens
HLDDLFFTL

SEQ ID NO: 17914 - protein, 9 aa, Homo Sapiens
HLDDQMTLL

SEQ ID NO: 17915 - protein, 9 aa, Homo Sapiens
HLDEAIHVL

SEQ ID NO: 17916 - protein, 9 aa, Homo Sapiens
HLDEARTLL

SEQ ID NO: 17917 - protein, 9 aa, Homo Sapiens
HLDEDQQEL

SEQ ID NO: 17918 - protein, 9 aa, Homo Sapiens
HLDEVFLEL

SEQ ID NO: 17919 - protein, 9 aa, Homo Sapiens
HLDGIVQVL

SEQ ID NO: 17920 - protein, 9 aa, Homo Sapiens
HLDGVHVVF

SEQ ID NO: 17921 - protein, 9 aa, Homo Sapiens
HLDMVLPEV

SEQ ID NO: 17922 - protein, 9 aa, Homo Sapiens
HLDNISNNL

SEQ ID NO: 17923 - protein, 9 aa, Homo Sapiens
HLDPGPIYM

SEQ ID NO: 17924 - protein, 9 aa, Homo Sapiens
HLDQIIPRM

SEQ ID NO: 17925 - protein, 9 aa, Homo Sapiens
HLDRTMYLL

SEQ ID NO: 17926 - protein, 9 aa, Homo Sapiens
HLDSMNVSL

SEQ ID NO: 17927 - protein, 9 aa, Homo Sapiens
HLDVQPAAL

SEQ ID NO: 17928 - protein, 9 aa, Homo Sapiens
HLDYITEKL

SEQ ID NO: 17929 - protein, 9 aa, Homo Sapiens
HLFDAFVSV

SEQ ID NO: 17930 - protein, 9 aa, Homo Sapiens
HLFETISQA

SEQ ID NO: 17931 - protein, 9 aa, Homo Sapiens
HLIEPLANA

SEQ ID NO: 17932 - protein, 9 aa, Homo Sapiens
HLLDIYIQL

SEQ ID NO: 17933 - protein, 9 aa, Homo Sapiens
HLPDMHSEL

SEQ ID NO: 17934 - protein, 9 aa, Homo Sapiens
HLPDVCVNL

SEQ ID NO: 17935 - protein, 9 aa, Homo Sapiens
HLPEQAFYM

SEQ ID NO: 17936 - protein, 9 aa, Homo Sapiens
HLPLPGPTL

SEQ ID NO: 17937 - protein, 9 aa, Homo Sapiens
HLPPPPKLL

SEQ ID NO: 17938 - protein, 9 aa, Homo Sapiens
HLPPTFHAV

SEQ ID NO: 17939 - protein, 9 aa, Homo Sapiens
HLPYLFHVV

SEQ ID NO: 17940 - protein, 9 aa, Homo Sapiens
HLWAELVFL

SEQ ID NO: 17941 - protein, 9 aa, Homo Sapiens
HMDTFIETF

SEQ ID NO: 17942 - protein, 9 aa, Homo Sapiens
HMMPDLPNV

SEQ ID NO: 17943 - protein, 9 aa, Homo Sapiens
HVDDVSSAL

SEQ ID NO: 17944 - protein, 9 aa, Homo Sapiens
HVDEFIDEL

SEQ ID NO: 17945 - protein, 9 aa, Homo Sapiens
HVDEIKEFL

SEQ ID NO: 17946 - protein, 9 aa, Homo Sapiens
HVDGVAVTL

SEQ ID NO: 17947 - protein, 9 aa, Homo Sapiens
HVDKLYQKL

SEQ ID NO: 17948 - protein, 9 aa, Homo Sapiens
HVDPGPTPI

SEQ ID NO: 17949 - protein, 9 aa, Homo Sapiens
HVIEKMHHV

SEQ ID NO: 17950 - protein, 9 aa, Homo Sapiens
HVLDVIHEV

SEQ ID NO: 17951 - protein, 9 aa, Homo Sapiens
HYGPGWVSM

SEQ ID NO: 17952 - protein, 9 aa, Homo Sapiens
IADNVFLFL

SEQ ID NO: 17953 - protein, 9 aa, Homo Sapiens
IAPPEAEGV

SEQ ID NO: 17954 - protein, 9 aa, Homo Sapiens
IAPPVPLKA

SEQ ID NO: 17955 - protein, 9 aa, Homo Sapiens
IDAPGHRDF

SEQ ID NO: 17956 - protein, 9 aa, Homo Sapiens
IIDDALVRL

SEQ ID NO: 17957 - protein, 9 aa, Homo Sapiens
IIDDKPIGL

SEQ ID NO: 17958 - protein, 9 aa, Homo Sapiens
IIDDNHAIV

SEQ ID NO: 17959 - protein, 9 aa, Homo Sapiens
IIDDTIFNL

SEQ ID NO: 17960 - protein, 9 aa, Homo Sapiens
IIDDVDSFL

SEQ ID NO: 17961 - protein, 9 aa, Homo Sapiens
IIDDVMKEL

SEQ ID NO: 17962 - protein, 9 aa, Homo Sapiens
IIDEADRMI

SEQ ID NO: 17963 - protein, 9 aa, Homo Sapiens
IIDEFEQKL

SEQ ID NO: 17964 - protein, 9 aa, Homo Sapiens
IIDEFIYQF

SEQ ID NO: 17965 - protein, 9 aa, Homo Sapiens
IIDEITPKL

SEQ ID NO: 17966 - protein, 9 aa, Homo Sapiens
IIDEKGPVM

SEQ ID NO: 17967 - protein, 9 aa, Homo Sapiens
IIDEKKYYL

SEQ ID NO: 17968 - protein, 9 aa, Homo Sapiens
IIDELIKKL

SEQ ID NO: 17969 - protein, 9 aa, Homo Sapiens
IIDEQPLIF

SEQ ID NO: 17970 - protein, 9 aa, Homo Sapiens
IIDETMAQL

SEQ ID NO: 17971 - protein, 9 aa, Homo Sapiens
IIDEVVNKF

SEQ ID NO: 17972 - protein, 9 aa, Homo Sapiens
IIDGKIFCV

SEQ ID NO: 17973 - protein, 9 aa, Homo Sapiens
IIDGLFMEI

SEQ ID NO: 17974 - protein, 9 aa, Homo Sapiens
IIDGVIQMV

SEQ ID NO: 17975 - protein, 9 aa, Homo Sapiens
IIDGVKVQV

SEQ ID NO: 17976 - protein, 9 aa, Homo Sapiens
IIDLVLDRI

SEQ ID NO: 17977 - protein, 9 aa, Homo Sapiens
IIDNILQRI

SEQ ID NO: 17978 - protein, 9 aa, Homo Sapiens
IIDPVALEI

SEQ ID NO: 17979 - protein, 9 aa, Homo Sapiens
IIDQIQDAL

SEQ ID NO: 17980 - protein, 9 aa, Homo Sapiens
IIDQVNPEL

SEQ ID NO: 17981 - protein, 9 aa, Homo Sapiens
IIDSLFNTV

SEQ ID NO: 17982 - protein, 9 aa, Homo Sapiens
IIDTLITKL

SEQ ID NO: 17983 - protein, 9 aa, Homo Sapiens
IIEDKTFGL

SEQ ID NO: 17984 - protein, 9 aa, Homo Sapiens
IIEENIPEL

SEQ ID NO: 17985 - protein, 9 aa, Homo Sapiens
IIFVPVPQL

SEQ ID NO: 17986 - protein, 9 aa, Homo Sapiens
IIIDSVPEV

SEQ ID NO: 17987 - protein, 9 aa, Homo Sapiens
IIIPEIQKV

SEQ ID NO: 17988 - protein, 9 aa, Homo Sapiens
IILDEIHLL

SEQ ID NO: 17989 - protein, 9 aa, Homo Sapiens
IINEPTAAA

SEQ ID NO: 17990 - protein, 9 aa, Homo Sapiens
IIPDKVWAV

SEQ ID NO: 17991 - protein, 9 aa, Homo Sapiens
IIVDIFHGL

SEQ ID NO: 17992 - protein, 9 aa, Homo Sapiens
IKEPIWETL

SEQ ID NO: 17993 - protein, 9 aa, Homo Sapiens
ILDAAGANL

SEQ ID NO: 17994 - protein, 9 aa, Homo Sapiens
ILDACTFAL

SEQ ID NO: 17995 - protein, 9 aa, Homo Sapiens
ILDAGGHNV

SEQ ID NO: 17996 - protein, 9 aa, Homo Sapiens
ILDAVVVVV

SEQ ID NO: 17997 - protein, 9 aa, Homo Sapiens
ILDCIYNEV

SEQ ID NO: 17998 - protein, 9 aa, Homo Sapiens
ILDDFRMHF

SEQ ID NO: 17999 - protein, 9 aa, Homo Sapiens
ILDDIFASL

SEQ ID NO: 18000 - protein, 9 aa, Homo Sapiens
ILDDIGHGV

SEQ ID NO: 18001 - protein, 9 aa, Homo Sapiens
ILDDIIASV

SEQ ID NO: 18002 - protein, 9 aa, Homo Sapiens
ILDDLFLHT

SEQ ID NO: 18003 - protein, 9 aa, Homo Sapiens
ILDDPGKKV

SEQ ID NO: 18004 - protein, 9 aa, Homo Sapiens
ILDDSALYL

SEQ ID NO: 18005 - protein, 9 aa, Homo Sapiens
ILDDSHLLV

SEQ ID NO: 18006 - protein, 9 aa, Homo Sapiens
ILDDSPKEI

SEQ ID NO: 18007 - protein, 9 aa, Homo Sapiens
ILDDVAMVL

SEQ ID NO: 18008 - protein, 9 aa, Homo Sapiens
ILDEADKLL

SEQ ID NO: 18009 - protein, 9 aa, Homo Sapiens
ILDEAERSL

SEQ ID NO: 18010 - protein, 9 aa, Homo Sapiens
ILDEATSAL

SEQ ID NO: 18011 - protein, 9 aa, Homo Sapiens
ILDEEKFNV

SEQ ID NO: 18012 - protein, 9 aa, Homo Sapiens
ILDELAEKL

SEQ ID NO: 18013 - protein, 9 aa, Homo Sapiens
ILDELVKSL

SEQ ID NO: 18014 - protein, 9 aa, Homo Sapiens
ILDEMSHKL

SEQ ID NO: 18015 - protein, 9 aa, Homo Sapiens
ILDEPTNHL

SEQ ID NO: 18016 - protein, 9 aa, Homo Sapiens
ILDEPTNNL

SEQ ID NO: 18017 - protein, 9 aa, Homo Sapiens
ILDEQGRTV

SEQ ID NO: 18018 - protein, 9 aa, Homo Sapiens
ILDEQLYSF

SEQ ID NO: 18019 - protein, 9 aa, Homo Sapiens
ILDESHERV

SEQ ID NO: 18020 - protein, 9 aa, Homo Sapiens
ILDETVNSV

SEQ ID NO: 18021 - protein, 9 aa, Homo Sapiens
ILDEVDAAL

SEQ ID NO: 18022 - protein, 9 aa, Homo Sapiens
ILDEVDVHI

SEQ ID NO: 18023 - protein, 9 aa, Homo Sapiens
ILDEVIFKL

SEQ ID NO: 18024 - protein, 9 aa, Homo Sapiens
ILDEVIMGY

SEQ ID NO: 18025 - protein, 9 aa, Homo Sapiens
ILDGIIREL

SEQ ID NO: 18026 - protein, 9 aa, Homo Sapiens
ILDGNQLHI

SEQ ID NO: 18027 - protein, 9 aa, Homo Sapiens
ILDHEVPSL

SEQ ID NO: 18028 - protein, 9 aa, Homo Sapiens
ILDIIFQDF

SEQ ID NO: 18029 - protein, 9 aa, Homo Sapiens
ILDIPFHQV

SEQ ID NO: 18030 - protein, 9 aa, Homo Sapiens
ILDIPTHTI

SEQ ID NO: 18031 - protein, 9 aa, Homo Sapiens
ILDISEHTL

SEQ ID NO: 18032 - protein, 9 aa, Homo Sapiens
ILDISFNLL

SEQ ID NO: 18033 - protein, 9 aa, Homo Sapiens
ILDKEINRL

SEQ ID NO: 18034 - protein, 9 aa, Homo Sapiens
ILDKFTEEV

SEQ ID NO: 18035 - protein, 9 aa, Homo Sapiens
ILDKIVQKV

SEQ ID NO: 18036 - protein, 9 aa, Homo Sapiens
ILDKKVEKV

SEQ ID NO: 18037 - protein, 9 aa, Homo Sapiens
ILDKVLTAM

SEQ ID NO: 18038 - protein, 9 aa, Homo Sapiens
ILDKYPLAV

SEQ ID NO: 18039 - protein, 9 aa, Homo Sapiens
ILDLIQVFV

SEQ ID NO: 18040 - protein, 9 aa, Homo Sapiens
ILDMTAVLL

SEQ ID NO: 18041 - protein, 9 aa, Homo Sapiens
ILDNPVVQL

SEQ ID NO: 18042 - protein, 9 aa, Homo Sapiens
ILDNVQVVL

SEQ ID NO: 18043 - protein, 9 aa, Homo Sapiens
ILDPEGLAL

SEQ ID NO: 18044 - protein, 9 aa, Homo Sapiens
ILDPFILVF

SEQ ID NO: 18045 - protein, 9 aa, Homo Sapiens
ILDPFQYQL

SEQ ID NO: 18046 - protein, 9 aa, Homo Sapiens
ILDPHVVLL

SEQ ID NO: 18047 - protein, 9 aa, Homo Sapiens
ILDPIFKVF

SEQ ID NO: 18048 - protein, 9 aa, Homo Sapiens
ILDQKINEV

SEQ ID NO: 18049 - protein, 9 aa, Homo Sapiens
ILDQVWNIF

SEQ ID NO: 18050 - protein, 9 aa, Homo Sapiens
ILDSHAATL

SEQ ID NO: 18051 - protein, 9 aa, Homo Sapiens
ILDSQTVVL

SEQ ID NO: 18052 - protein, 9 aa, Homo Sapiens
ILDSSPEKL

SEQ ID NO: 18053 - protein, 9 aa, Homo Sapiens
ILDSVASVV

SEQ ID NO: 18054 - protein, 9 aa, Homo Sapiens
ILDTLKTQL

SEQ ID NO: 18055 - protein, 9 aa, Homo Sapiens
ILDTLVFAF

SEQ ID NO: 18056 - protein, 9 aa, Homo Sapiens
ILDTMYPEL

SEQ ID NO: 18057 - protein, 9 aa, Homo Sapiens
ILDVNPQAL

SEQ ID NO: 18058 - protein, 9 aa, Homo Sapiens
ILDVSVKTV

SEQ ID NO: 18059 - protein, 9 aa, Homo Sapiens
ILDVSWNSL

SEQ ID NO: 18060 - protein, 9 aa, Homo Sapiens
ILDVTVVYL

SEQ ID NO: 18061 - protein, 9 aa, Homo Sapiens
ILDWHFANL

SEQ ID NO: 18062 - protein, 9 aa, Homo Sapiens
ILDWKFDRV

SEQ ID NO: 18063 - protein, 9 aa, Homo Sapiens
ILDYSWEKL

SEQ ID NO: 18064 - protein, 9 aa, Homo Sapiens
ILEENIPVL

SEQ ID NO: 18065 - protein, 9 aa, Homo Sapiens
ILEKYIKFV

SEQ ID NO: 18066 - protein, 9 aa, Homo Sapiens
ILGPKPQGV

SEQ ID NO: 18067 - protein, 9 aa, Homo Sapiens
ILHDDEVTV

SEQ ID NO: 18068 - protein, 9 aa, Homo Sapiens
ILHSVTTNL

SEQ ID NO: 18069 - protein, 9 aa, Homo Sapiens
ILHTLLTLV

SEQ ID NO: 18070 - protein, 9 aa, Homo Sapiens
ILIDPFHKA

SEQ ID NO: 18071 - protein, 9 aa, Homo Sapiens
ILIDWLVQV

SEQ ID NO: 18072 - protein, 9 aa, Homo Sapiens
ILIRPLVSV

SEQ ID NO: 18073 - protein, 9 aa, Homo Sapiens
ILLAEVPTM

SEQ ID NO: 18074 - protein, 9 aa, Homo Sapiens
ILMEHIHKL

SEQ ID NO: 18075 - protein, 9 aa, Homo Sapiens
ILMGVLKEV

SEQ ID NO: 18076 - protein, 9 aa, Homo Sapiens
ILNDNINLL

SEQ ID NO: 18077 - protein, 9 aa, Homo Sapiens
ILNEIVNFV

SEQ ID NO: 18078 - protein, 9 aa, Homo Sapiens
ILNPEVVTV

SEQ ID NO: 18079 - protein, 9 aa, Homo Sapiens
ILNPVTTKL

SEQ ID NO: 18080 - protein, 9 aa, Homo Sapiens
ILNTIYEKV

SEQ ID NO: 18081 - protein, 9 aa, Homo Sapiens
ILPDDLPEL

SEQ ID NO: 18082 - protein, 9 aa, Homo Sapiens
ILPDDPRQM

SEQ ID NO: 18083 - protein, 9 aa, Homo Sapiens
ILPDMLKNA

SEQ ID NO: 18084 - protein, 9 aa, Homo Sapiens
ILPDTYQHL

SEQ ID NO: 18085 - protein, 9 aa, Homo Sapiens
ILPEAFSNL

SEQ ID NO: 18086 - protein, 9 aa, Homo Sapiens
ILPEEITNL

SEQ ID NO: 18087 - protein, 9 aa, Homo Sapiens
ILPEELQTL

SEQ ID NO: 18088 - protein, 9 aa, Homo Sapiens
ILPEIIPIL

SEQ ID NO: 18089 - protein, 9 aa, Homo Sapiens
ILPEKVARV

SEQ ID NO: 18090 - protein, 9 aa, Homo Sapiens
ILPEQGLQV

SEQ ID NO: 18091 - protein, 9 aa, Homo Sapiens
ILPERAEEA

SEQ ID NO: 18092 - protein, 9 aa, Homo Sapiens
ILPHSPINV

SEQ ID NO: 18093 - protein, 9 aa, Homo Sapiens
ILPHVDIQL

SEQ ID NO: 18094 - protein, 9 aa, Homo Sapiens
ILPIKFPHL

SEQ ID NO: 18095 - protein, 9 aa, Homo Sapiens
ILPIMFPSL

SEQ ID NO: 18096 - protein, 9 aa, Homo Sapiens
ILPKILQDV

SEQ ID NO: 18097 - protein, 9 aa, Homo Sapiens
ILPKPLTKV

SEQ ID NO: 18098 - protein, 9 aa, Homo Sapiens
ILPKSLISV

SEQ ID NO: 18099 - protein, 9 aa, Homo Sapiens
ILPKYVQQV

SEQ ID NO: 18100 - protein, 9 aa, Homo Sapiens
ILPMSLLSV

SEQ ID NO: 18101 - protein, 9 aa, Homo Sapiens
ILPPDIGKL

SEQ ID NO: 18102 - protein, 9 aa, Homo Sapiens
ILPPFIWTL

SEQ ID NO: 18103 - protein, 9 aa, Homo Sapiens
ILPPSAHEL

SEQ ID NO: 18104 - protein, 9 aa, Homo Sapiens
ILPPTILTL

SEQ ID NO: 18105 - protein, 9 aa, Homo Sapiens
ILPQDLERA

SEQ ID NO: 18106 - protein, 9 aa, Homo Sapiens
ILPQESPAL

SEQ ID NO: 18107 - protein, 9 aa, Homo Sapiens
ILPQHLYNI

SEQ ID NO: 18108 - protein, 9 aa, Homo Sapiens
ILPSDIIQL

SEQ ID NO: 18109 - protein, 9 aa, Homo Sapiens
ILPSNLLTV

SEQ ID NO: 18110 - protein, 9 aa, Homo Sapiens
ILPTLVIKL

SEQ ID NO: 18111 - protein, 9 aa, Homo Sapiens
ILPVPAFNV

SEQ ID NO: 18112 - protein, 9 aa, Homo Sapiens
ILQERIEEM

SEQ ID NO: 18113 - protein, 9 aa, Homo Sapiens
ILSQYITFV

SEQ ID NO: 18114 - protein, 9 aa, Homo Sapiens
ILTDITKGV

SEQ ID NO: 18115 - protein, 9 aa, Homo Sapiens
ILVDTVWAL

SEQ ID NO: 18116 - protein, 9 aa, Homo Sapiens
ILVDWLVQV

SEQ ID NO: 18117 - protein, 9 aa, Homo Sapiens
ILVEKFPFV

SEQ ID NO: 18118 - protein, 9 aa, Homo Sapiens
ILWDTLLRL

SEQ ID NO: 18119 - protein, 9 aa, Homo Sapiens
ILWEHLEIL

SEQ ID NO: 18120 - protein, 9 aa, Homo Sapiens
ILYDKYFSL

SEQ ID NO: 18121 - protein, 9 aa, Homo Sapiens
IMDATNILV

SEQ ID NO: 18122 - protein, 9 aa, Homo Sapiens
IMDDEFQLL

SEQ ID NO: 18123 - protein, 9 aa, Homo Sapiens
IMDDKSLNI

SEQ ID NO: 18124 - protein, 9 aa, Homo Sapiens
IMDHVEESL

SEQ ID NO: 18125 - protein, 9 aa, Homo Sapiens
IMDILNIKI

SEQ ID NO: 18126 - protein, 9 aa, Homo Sapiens
IMDRIYKNV

SEQ ID NO: 18127 - protein, 9 aa, Homo Sapiens
IMDSLFDKL

SEQ ID NO: 18128 - protein, 9 aa, Homo Sapiens
IMDSLFQSF

SEQ ID NO: 18129 - protein, 9 aa, Homo Sapiens
IMEDIILTL

SEQ ID NO: 18130 - protein, 9 aa, Homo Sapiens
IMLEALERV

SEQ ID NO: 18131 - protein, 9 aa, Homo Sapiens
IMPKDIQLA

SEQ ID NO: 18132 - protein, 9 aa, Homo Sapiens
IMPTIFNLI

SEQ ID NO: 18133 - protein, 9 aa, Homo Sapiens
IPPLTQTPV

SEQ ID NO: 18134 - protein, 9 aa, Homo Sapiens
IQDDAVHTL

SEQ ID NO: 18135 - protein, 9 aa, Homo Sapiens
IQDEEFYTL

SEQ ID NO: 18136 - protein, 9 aa, Homo Sapiens
IQDEIVDFL

SEQ ID NO: 18137 - protein, 9 aa, Homo Sapiens
IQPDNIVYV

SEQ ID NO: 18138 - protein, 9 aa, Homo Sapiens
IQPPFVPTL

SEQ ID NO: 18139 - protein, 9 aa, Homo Sapiens
ISDGVIYSI

SEQ ID NO: 18140 - protein, 9 aa, Homo Sapiens
ITDDLHFYV

SEQ ID NO: 18141 - protein, 9 aa, Homo Sapiens
ITPDEFHFV

SEQ ID NO: 18142 - protein, 9 aa, Homo Sapiens
ITPENLPQI

SEQ ID NO: 18143 - protein, 9 aa, Homo Sapiens
ITPEPFHHV

SEQ ID NO: 18144 - protein, 9 aa, Homo Sapiens
ITPQKLPSL

SEQ ID NO: 18145 - protein, 9 aa, Homo Sapiens
ITPQTIHGV

SEQ ID NO: 18146 - protein, 9 aa, Homo Sapiens
IVDAFLQQL

SEQ ID NO: 18147 - protein, 9 aa, Homo Sapiens
IVDAVIEQV

SEQ ID NO: 18148 - protein, 9 aa, Homo Sapiens
IVDDKFFKL

SEQ ID NO: 18149 - protein, 9 aa, Homo Sapiens
IVDDWLNLL

SEQ ID NO: 18150 - protein, 9 aa, Homo Sapiens
IVDEAIYYF

SEQ ID NO: 18151 - protein, 9 aa, Homo Sapiens
IVDELKQEV

SEQ ID NO: 18152 - protein, 9 aa, Homo Sapiens
IVDEPTFKV

SEQ ID NO: 18153 - protein, 9 aa, Homo Sapiens
IVDEVNGLI

SEQ ID NO: 18154 - protein, 9 aa, Homo Sapiens
IVDGVVQSI

SEQ ID NO: 18155 - protein, 9 aa, Homo Sapiens
IVDNVNQAL

SEQ ID NO: 18156 - protein, 9 aa, Homo Sapiens
IVDPFQILV

SEQ ID NO: 18157 - protein, 9 aa, Homo Sapiens
IVDPVDSTL

SEQ ID NO: 18158 - protein, 9 aa, Homo Sapiens
IVDQTIEKV

SEQ ID NO: 18159 - protein, 9 aa, Homo Sapiens
IVDQVMVTL

SEQ ID NO: 18160 - protein, 9 aa, Homo Sapiens
IVDSVFVNL

SEQ ID NO: 18161 - protein, 9 aa, Homo Sapiens
IVHELNTTV

SEQ ID NO: 18162 - protein, 9 aa, Homo Sapiens
IVMEHVVFL

SEQ ID NO: 18163 - protein, 9 aa, Homo Sapiens
IVPHLVPLL

SEQ ID NO: 18164 - protein, 9 aa, Homo Sapiens
IVVDNVPQV

SEQ ID NO: 18165 - protein, 9 aa, Homo Sapiens
KADSVVVLL

SEQ ID NO: 18166 - protein, 9 aa, Homo Sapiens
KAPDFLPLL

SEQ ID NO: 18167 - protein, 9 aa, Homo Sapiens
KDYPFYLTV

SEQ ID NO: 18168 - protein, 9 aa, Homo Sapiens
KGDDVIVFL

SEQ ID NO: 18169 - protein, 9 aa, Homo Sapiens
KHLDVVTLL

SEQ ID NO: 18170 - protein, 9 aa, Homo Sapiens
KIAPNTPQL

SEQ ID NO: 18171 - protein, 9 aa, Homo Sapiens
KIDDFPNEL

SEQ ID NO: 18172 - protein, 9 aa, Homo Sapiens
KIDDILQTL

SEQ ID NO: 18173 - protein, 9 aa, Homo Sapiens
KIDDKPVKI

SEQ ID NO: 18174 - protein, 9 aa, Homo Sapiens
KIDDMMFVL

SEQ ID NO: 18175 - protein, 9 aa, Homo Sapiens
KIDDTIRYL

SEQ ID NO: 18176 - protein, 9 aa, Homo Sapiens
KIDDVLHTL

SEQ ID NO: 18177 - protein, 9 aa, Homo Sapiens
KIDGVEDML

SEQ ID NO: 18178 - protein, 9 aa, Homo Sapiens
KIDHILDAL

SEQ ID NO: 18179 - protein, 9 aa, Homo Sapiens
KIDKFFKQL

SEQ ID NO: 18180 - protein, 9 aa, Homo Sapiens
KIDSILEVV

SEQ ID NO: 18181 - protein, 9 aa, Homo Sapiens
KIDSVAVNI

SEQ ID NO: 18182 - protein, 9 aa, Homo Sapiens
KIDYFLEYF

SEQ ID NO: 18183 - protein, 9 aa, Homo Sapiens
KIEDLIKYL

SEQ ID NO: 18184 - protein, 9 aa, Homo Sapiens
KIIDIQEKV

SEQ ID NO: 18185 - protein, 9 aa, Homo Sapiens
KIIEYSVYL

SEQ ID NO: 18186 - protein, 9 aa, Homo Sapiens
KIISALPQL

SEQ ID NO: 18187 - protein, 9 aa, Homo Sapiens
KILPDLNTV

SEQ ID NO: 18188 - protein, 9 aa, Homo Sapiens
KILPTLEAV

SEQ ID NO: 18189 - protein, 9 aa, Homo Sapiens
KILPVMVTL

SEQ ID NO: 18190 - protein, 9 aa, Homo Sapiens
KILQELPSV

SEQ ID NO: 18191 - protein, 9 aa, Homo Sapiens
KILSELFTV

SEQ ID NO: 18192 - protein, 9 aa, Homo Sapiens
KINDTIYEV

SEQ ID NO: 18193 - protein, 9 aa, Homo Sapiens
KIPTPIVGV

SEQ ID NO: 18194 - protein, 9 aa, Homo Sapiens
KIQEILTQV

SEQ ID NO: 18195 - protein, 9 aa, Homo Sapiens
KIVDFSYSV

SEQ ID NO: 18196 - protein, 9 aa, Homo Sapiens
KIVPIAIQL

SEQ ID NO: 18197 - protein, 9 aa, Homo Sapiens
KIVPVEITI

SEQ ID NO: 18198 - protein, 9 aa, Homo Sapiens
KIVVVTAGV

SEQ ID NO: 18199 - protein, 9 aa, Homo Sapiens
KIWAPTAEA

SEQ ID NO: 18200 - protein, 9 aa, Homo Sapiens
KIYEGAYHV

SEQ ID NO: 18201 - protein, 9 aa, Homo Sapiens
KLDAFVEGV

SEQ ID NO: 18202 - protein, 9 aa, Homo Sapiens
KLDAILKNV

SEQ ID NO: 18203 - protein, 9 aa, Homo Sapiens
KLDDIVQHI

SEQ ID NO: 18204 - protein, 9 aa, Homo Sapiens
KLDDLTQDL

SEQ ID NO: 18205 - protein, 9 aa, Homo Sapiens
KLDDMLSEL

SEQ ID NO: 18206 - protein, 9 aa, Homo Sapiens
KLDDYVYYV

SEQ ID NO: 18207 - protein, 9 aa, Homo Sapiens
KLDEDVKMI

SEQ ID NO: 18208 - protein, 9 aa, Homo Sapiens
KLDEFGEQL

SEQ ID NO: 18209 - protein, 9 aa, Homo Sapiens
KLDEILKEI

SEQ ID NO: 18210 - protein, 9 aa, Homo Sapiens
KLDGLIHRF

SEQ ID NO: 18211 - protein, 9 aa, Homo Sapiens
KLDHVVTII

SEQ ID NO: 18212 - protein, 9 aa, Homo Sapiens
KLDNLMLEL

SEQ ID NO: 18213 - protein, 9 aa, Homo Sapiens
KLDPYVQRL

SEQ ID NO: 18214 - protein, 9 aa, Homo Sapiens
KLDQVLSKV

SEQ ID NO: 18215 - protein, 9 aa, Homo Sapiens
KLDSPRVTV

SEQ ID NO: 18216 - protein, 9 aa, Homo Sapiens
KLDVGNAEV

SEQ ID NO: 18217 - protein, 9 aa, Homo Sapiens
KLDVQFSGL

SEQ ID NO: 18218 - protein, 9 aa, Homo Sapiens
KLDWVEVGL

SEQ ID NO: 18219 - protein, 9 aa, Homo Sapiens
KLEDFIKNL

SEQ ID NO: 18220 - protein, 9 aa, Homo Sapiens
KLEEFVNGL

SEQ ID NO: 18221 - protein, 9 aa, Homo Sapiens
KLEEIIHQI

SEQ ID NO: 18222 - protein, 9 aa, Homo Sapiens
KLFDTQQFL

SEQ ID NO: 18223 - protein, 9 aa, Homo Sapiens
KLFEKVKEV

SEQ ID NO: 18224 - protein, 9 aa, Homo Sapiens
KLFGMIITI

SEQ ID NO: 18225 - protein, 9 aa, Homo Sapiens
KLFNVTSTL

SEQ ID NO: 18226 - protein, 9 aa, Homo Sapiens
KLHGVNINV

SEQ ID NO: 18227 - protein, 9 aa, Homo Sapiens
KLHYVVTEV

SEQ ID NO: 18228 - protein, 9 aa, Homo Sapiens
KLIEELETL

SEQ ID NO: 18229 - protein, 9 aa, Homo Sapiens
KLILLITQV

SEQ ID NO: 18230 - protein, 9 aa, Homo Sapiens
KLISSYYNV

SEQ ID NO: 18231 - protein, 9 aa, Homo Sapiens
KLLAVIHEL

SEQ ID NO: 18232 - protein, 9 aa, Homo Sapiens
KLLDILSYL

SEQ ID NO: 18233 - protein, 9 aa, Homo Sapiens
KLLDLQVRV

SEQ ID NO: 18234 - protein, 9 aa, Homo Sapiens
KLLDVVHPA

SEQ ID NO: 18235 - protein, 9 aa, Homo Sapiens
KLLEKLYKV

SEQ ID NO: 18236 - protein, 9 aa, Homo Sapiens
KLLEVQPQV

SEQ ID NO: 18237 - protein, 9 aa, Homo Sapiens
KLLEVYEQL

SEQ ID NO: 18238 - protein, 9 aa, Homo Sapiens
KLLFWVTEV

SEQ ID NO: 18239 - protein, 9 aa, Homo Sapiens
KLLPQLTYL

SEQ ID NO: 18240 - protein, 9 aa, Homo Sapiens
KLMDHIYAV

SEQ ID NO: 18241 - protein, 9 aa, Homo Sapiens
KLMDQLEAL

SEQ ID NO: 18242 - protein, 9 aa, Homo Sapiens
KLMELLEEI

SEQ ID NO: 18243 - protein, 9 aa, Homo Sapiens
KLMTALVNV

SEQ ID NO: 18244 - protein, 9 aa, Homo Sapiens
KLNAKLAEL

SEQ ID NO: 18245 - protein, 9 aa, Homo Sapiens
KLPAELQEL

SEQ ID NO: 18246 - protein, 9 aa, Homo Sapiens
KLPAPLPGL

SEQ ID NO: 18247 - protein, 9 aa, Homo Sapiens
KLPDGTWNL

SEQ ID NO: 18248 - protein, 9 aa, Homo Sapiens
KLPEDIMKL

SEQ ID NO: 18249 - protein, 9 aa, Homo Sapiens
KLPEISHRL

SEQ ID NO: 18250 - protein, 9 aa, Homo Sapiens
KLPEKWESV

SEQ ID NO: 18251 - protein, 9 aa, Homo Sapiens
KLPEPSASL

SEQ ID NO: 18252 - protein, 9 aa, Homo Sapiens
KLPGEGAAL

SEQ ID NO: 18253 - protein, 9 aa, Homo Sapiens
KLPGLLMTI

SEQ ID NO: 18254 - protein, 9 aa, Homo Sapiens
KLPGLQATV

SEQ ID NO: 18255 - protein, 9 aa, Homo Sapiens
KLPGNISSL

SEQ ID NO: 18256 - protein, 9 aa, Homo Sapiens
KLPIPDPGV

SEQ ID NO: 18257 - protein, 9 aa, Homo Sapiens
KLPKPLEKV

SEQ ID NO: 18258 - protein, 9 aa, Homo Sapiens
KLPNFGFVV

SEQ ID NO: 18259 - protein, 9 aa, Homo Sapiens
KLPPLPLTL

SEQ ID NO: 18260 - protein, 9 aa, Homo Sapiens
KLPPPPPQA

SEQ ID NO: 18261 - protein, 9 aa, Homo Sapiens
KLPSFLANV

SEQ ID NO: 18262 - protein, 9 aa, Homo Sapiens
KLPSNLPQL

SEQ ID NO: 18263 - protein, 9 aa, Homo Sapiens
KLPSTLTGL

SEQ ID NO: 18264 - protein, 9 aa, Homo Sapiens
KLPTPTSSV

SEQ ID NO: 18265 - protein, 9 aa, Homo Sapiens
KLQDQIFNL

SEQ ID NO: 18266 - protein, 9 aa, Homo Sapiens
KLQEFLQTL

SEQ ID NO: 18267 - protein, 9 aa, Homo Sapiens
KLQEKIQEL

SEQ ID NO: 18268 - protein, 9 aa, Homo Sapiens
KLQEQIFHL

SEQ ID NO: 18269 - protein, 9 aa, Homo Sapiens
KLQEVLDYL

SEQ ID NO: 18270 - protein, 9 aa, Homo Sapiens
KLVDCIIEV

SEQ ID NO: 18271 - protein, 9 aa, Homo Sapiens
KLVGEFLEV

SEQ ID NO: 18272 - protein, 9 aa, Homo Sapiens
KLWPEASKV

SEQ ID NO: 18273 - protein, 9 aa, Homo Sapiens
KLWQTPLHV

SEQ ID NO: 18274 - protein, 9 aa, Homo Sapiens
KLWSETFDV

SEQ ID NO: 18275 - protein, 9 aa, Homo Sapiens
KLYSISSQV

SEQ ID NO: 18276 - protein, 9 aa, Homo Sapiens
KMDPIISRV

SEQ ID NO: 18277 - protein, 9 aa, Homo Sapiens
KMDPVAYRV

SEQ ID NO: 18278 - protein, 9 aa, Homo Sapiens
KMDWIFHTI

SEQ ID NO: 18279 - protein, 9 aa, Homo Sapiens
KMDYPEMGL

SEQ ID NO: 18280 - protein, 9 aa, Homo Sapiens
KMPDDVWLV

SEQ ID NO: 18281 - protein, 9 aa, Homo Sapiens
KMPDVELFV

SEQ ID NO: 18282 - protein, 9 aa, Homo Sapiens
KMPEGTFLV

SEQ ID NO: 18283 - protein, 9 aa, Homo Sapiens
KMPEINAKV

SEQ ID NO: 18284 - protein, 9 aa, Homo Sapiens
KMPRLIAKV

SEQ ID NO: 18285 - protein, 9 aa, Homo Sapiens
KQPEDYFYL

SEQ ID NO: 18286 - protein, 9 aa, Homo Sapiens
KSPEGLLGV

SEQ ID NO: 18287 - protein, 9 aa, Homo Sapiens
KSPLNFSTV

SEQ ID NO: 18288 - protein, 9 aa, Homo Sapiens
KTDVVVNSV

SEQ ID NO: 18289 - protein, 9 aa, Homo Sapiens
KVDDARALL

SEQ ID NO: 18290 - protein, 9 aa, Homo Sapiens
KVDEAIALF

SEQ ID NO: 18291 - protein, 9 aa, Homo Sapiens
KVDEIFGQL

SEQ ID NO: 18292 - protein, 9 aa, Homo Sapiens
KVDELTTEI

SEQ ID NO: 18293 - protein, 9 aa, Homo Sapiens
KVDFIFEQV

SEQ ID NO: 18294 - protein, 9 aa, Homo Sapiens
KVDILYNNI

SEQ ID NO: 18295 - protein, 9 aa, Homo Sapiens
KVDKIITPL

SEQ ID NO: 18296 - protein, 9 aa, Homo Sapiens
KVDKLYAGL

SEQ ID NO: 18297 - protein, 9 aa, Homo Sapiens
KVDLAVVEV

SEQ ID NO: 18298 - protein, 9 aa, Homo Sapiens
KVDPLFTEL

SEQ ID NO: 18299 - protein, 9 aa, Homo Sapiens
KVDPMAIVV

SEQ ID NO: 18300 - protein, 9 aa, Homo Sapiens
KVDPSGVSL

SEQ ID NO: 18301 - protein, 9 aa, Homo Sapiens
KVDTVWVNV

SEQ ID NO: 18302 - protein, 9 aa, Homo Sapiens
KVDWLTEKM

SEQ ID NO: 18303 - protein, 9 aa, Homo Sapiens
KVIDEIYRV

SEQ ID NO: 18304 - protein, 9 aa, Homo Sapiens
KVIDYVPGI

SEQ ID NO: 18305 - protein, 9 aa, Homo Sapiens
KVIVRFLTV

SEQ ID NO: 18306 - protein, 9 aa, Homo Sapiens
KVLELQTEL

SEQ ID NO: 18307 - protein, 9 aa, Homo Sapiens
KVLGIVVGV

SEQ ID NO: 18308 - protein, 9 aa, Homo Sapiens
KVPDVLPVL

SEQ ID NO: 18309 - protein, 9 aa, Homo Sapiens
KVPEIEVTV

SEQ ID NO: 18310 - protein, 9 aa, Homo Sapiens
KVPEIISSI

SEQ ID NO: 18311 - protein, 9 aa, Homo Sapiens
KVPEWVDTV

SEQ ID NO: 18312 - protein, 9 aa, Homo Sapiens
KVQEQIFNL

SEQ ID NO: 18313 - protein, 9 aa, Homo Sapiens
KVVALVHAV

SEQ ID NO: 18314 - protein, 9 aa, Homo Sapiens
KVVDVDVKL

SEQ ID NO: 18315 - protein, 9 aa, Homo Sapiens
KVVIFLPQV

SEQ ID NO: 18316 - protein, 9 aa, Homo Sapiens
KVVPTFEAV

SEQ ID NO: 18317 - protein, 9 aa, Homo Sapiens
KVWGNVVTV

SEQ ID NO: 18318 - protein, 9 aa, Homo Sapiens
LADEVITVF

SEQ ID NO: 18319 - protein, 9 aa, Homo Sapiens
LADGIFETL

SEQ ID NO: 18320 - protein, 9 aa, Homo Sapiens
LAPEIVIKV

SEQ ID NO: 18321 - protein, 9 aa, Homo Sapiens
LAPELFVNV

SEQ ID NO: 18322 - protein, 9 aa, Homo Sapiens
LAPNIISQL

SEQ ID NO: 18323 - protein, 9 aa, Homo Sapiens
LAPPASPGI

SEQ ID NO: 18324 - protein, 9 aa, Homo Sapiens
LAPPPPPGL

SEQ ID NO: 18325 - protein, 9 aa, Homo Sapiens
LEDGNFLKL

SEQ ID NO: 18326 - protein, 9 aa, Homo Sapiens
LENDKILQI

SEQ ID NO: 18327 - protein, 9 aa, Homo Sapiens
LGPPPPLRV

SEQ ID NO: 18328 - protein, 9 aa, Homo Sapiens
LIDDILEKI

SEQ ID NO: 18329 - protein, 9 aa, Homo Sapiens
LIDDLKSEL

SEQ ID NO: 18330 - protein, 9 aa, Homo Sapiens
LIDDLQHCL

SEQ ID NO: 18331 - protein, 9 aa, Homo Sapiens
LIDDVHRLF

SEQ ID NO: 18332 - protein, 9 aa, Homo Sapiens
LIDEDVYRL

SEQ ID NO: 18333 - protein, 9 aa, Homo Sapiens
LIDEGSHMV

SEQ ID NO: 18334 - protein, 9 aa, Homo Sapiens
LIDELHRHL

SEQ ID NO: 18335 - protein, 9 aa, Homo Sapiens
LIDELNQAL

SEQ ID NO: 18336 - protein, 9 aa, Homo Sapiens
LIDEMVNTI

SEQ ID NO: 18337 - protein, 9 aa, Homo Sapiens
LIDEPSAYL

SEQ ID NO: 18338 - protein, 9 aa, Homo Sapiens
LIDEQILCV

SEQ ID NO: 18339 - protein, 9 aa, Homo Sapiens
LIDESVHAL

SEQ ID NO: 18340 - protein, 9 aa, Homo Sapiens
LIDGQVIQL

SEQ ID NO: 18341 - protein, 9 aa, Homo Sapiens
LIDIFIINL

SEQ ID NO: 18342 - protein, 9 aa, Homo Sapiens
LIDKIIEYL

SEQ ID NO: 18343 - protein, 9 aa, Homo Sapiens
LIDNHQVTV

SEQ ID NO: 18344 - protein, 9 aa, Homo Sapiens
LIDPFHKAI

SEQ ID NO: 18345 - protein, 9 aa, Homo Sapiens
LIDPNTLQV

SEQ ID NO: 18346 - protein, 9 aa, Homo Sapiens
LIDQKVYEL

SEQ ID NO: 18347 - protein, 9 aa, Homo Sapiens
LIDTSRHYL

SEQ ID NO: 18348 - protein, 9 aa, Homo Sapiens
LIDYTLEFL

SEQ ID NO: 18349 - protein, 9 aa, Homo Sapiens
LIGEFLEKV

SEQ ID NO: 18350 - protein, 9 aa, Homo Sapiens
LILDPIFKV

SEQ ID NO: 18351 - protein, 9 aa, Homo Sapiens
LILNDFPSV

SEQ ID NO: 18352 - protein, 9 aa, Homo Sapiens
LIPEGPPQV

SEQ ID NO: 18353 - protein, 9 aa, Homo Sapiens
LIPEVFTYF

SEQ ID NO: 18354 - protein, 9 aa, Homo Sapiens
LIPEYLNFI

SEQ ID NO: 18355 - protein, 9 aa, Homo Sapiens
LIPPPGEQL

SEQ ID NO: 18356 - protein, 9 aa, Homo Sapiens
LIPPPLAPI

SEQ ID NO: 18357 - protein, 9 aa, Homo Sapiens
LISESFLTV

SEQ ID NO: 18358 - protein, 9 aa, Homo Sapiens
LITAILVKV

SEQ ID NO: 18359 - protein, 9 aa, Homo Sapiens
LIWPLLSTV

SEQ ID NO: 18360 - protein, 9 aa, Homo Sapiens
LIYEETRGV

SEQ ID NO: 18361 - protein, 9 aa, Homo Sapiens
LLAELLTHL

SEQ ID NO: 18362 - protein, 9 aa, Homo Sapiens
LLASEVPQL

SEQ ID NO: 18363 - protein, 9 aa, Homo Sapiens
LLDAFSIKL

SEQ ID NO: 18364 - protein, 9 aa, Homo Sapiens
LLDAGFLFL

SEQ ID NO: 18365 - protein, 9 aa, Homo Sapiens
LLDALQHEL

SEQ ID NO: 18366 - protein, 9 aa, Homo Sapiens
LLDANFTVV

SEQ ID NO: 18367 - protein, 9 aa, Homo Sapiens
LLDATQHTL

SEQ ID NO: 18368 - protein, 9 aa, Homo Sapiens
LLDAYLLYI

SEQ ID NO: 18369 - protein, 9 aa, Homo Sapiens
LLDDAKARL

SEQ ID NO: 18370 - protein, 9 aa, Homo Sapiens
LLDDIFAQL

SEQ ID NO: 18371 - protein, 9 aa, Homo Sapiens
LLDDIFIRL

SEQ ID NO: 18372 - protein, 9 aa, Homo Sapiens
LLDDKAQAL

SEQ ID NO: 18373 - protein, 9 aa, Homo Sapiens
LLDDNFASI

SEQ ID NO: 18374 - protein, 9 aa, Homo Sapiens
LLDDNRELL

SEQ ID NO: 18375 - protein, 9 aa, Homo Sapiens
LLDDRKLEL

SEQ ID NO: 18376 - protein, 9 aa, Homo Sapiens
LLDDSLVSI

SEQ ID NO: 18377 - protein, 9 aa, Homo Sapiens
LLDDTTVTL

SEQ ID NO: 18378 - protein, 9 aa, Homo Sapiens
LLDEAIQAV

SEQ ID NO: 18379 - protein, 9 aa, Homo Sapiens
LLDEAQVTL

SEQ ID NO: 18380 - protein, 9 aa, Homo Sapiens
LLDEEISRV

SEQ ID NO: 18381 - protein, 9 aa, Homo Sapiens
LLDEFTTKL

SEQ ID NO: 18382 - protein, 9 aa, Homo Sapiens
LLDEFYKLV

SEQ ID NO: 18383 - protein, 9 aa, Homo Sapiens
LLDELVQSL

SEQ ID NO: 18384 - protein, 9 aa, Homo Sapiens
LLDEMKFSL

SEQ ID NO: 18385 - protein, 9 aa, Homo Sapiens
LLDENLLKM

SEQ ID NO: 18386 - protein, 9 aa, Homo Sapiens
LLDEPFLQF

SEQ ID NO: 18387 - protein, 9 aa, Homo Sapiens
LLDEPTNML

SEQ ID NO: 18388 - protein, 9 aa, Homo Sapiens
LLDEQFAVL

SEQ ID NO: 18389 - protein, 9 aa, Homo Sapiens
LLDEQTSLL

SEQ ID NO: 18390 - protein, 9 aa, Homo Sapiens
LLDERLVTL

SEQ ID NO: 18391 - protein, 9 aa, Homo Sapiens
LLDESRPLF

SEQ ID NO: 18392 - protein, 9 aa, Homo Sapiens
LLDEVIQEF

SEQ ID NO: 18393 - protein, 9 aa, Homo Sapiens
LLDEVLHTM

SEQ ID NO: 18394 - protein, 9 aa, Homo Sapiens
LLDEVLNVM

SEQ ID NO: 18395 - protein, 9 aa, Homo Sapiens
LLDEVMKSL

SEQ ID NO: 18396 - protein, 9 aa, Homo Sapiens
LLDFNFEQL

SEQ ID NO: 18397 - protein, 9 aa, Homo Sapiens
LLDFVKPEF

SEQ ID NO: 18398 - protein, 9 aa, Homo Sapiens
LLDGFPRTL

SEQ ID NO: 18399 - protein, 9 aa, Homo Sapiens
LLDGFPRTV

SEQ ID NO: 18400 - protein, 9 aa, Homo Sapiens
LLDGKVLSL

SEQ ID NO: 18401 - protein, 9 aa, Homo Sapiens
LLDGLHEDL

SEQ ID NO: 18402 - protein, 9 aa, Homo Sapiens
LLDGNPFRV

SEQ ID NO: 18403 - protein, 9 aa, Homo Sapiens
LLDGVIFGA

SEQ ID NO: 18404 - protein, 9 aa, Homo Sapiens
LLDGVPVAL

SEQ ID NO: 18405 - protein, 9 aa, Homo Sapiens
LLDGVVEKL

SEQ ID NO: 18406 - protein, 9 aa, Homo Sapiens
LLDHDAFVL

SEQ ID NO: 18407 - protein, 9 aa, Homo Sapiens
LLDHLHLEL

SEQ ID NO: 18408 - protein, 9 aa, Homo Sapiens
LLDHVLLTL

SEQ ID NO: 18409 - protein, 9 aa, Homo Sapiens
LLDKLLIRL

SEQ ID NO: 18410 - protein, 9 aa, Homo Sapiens
LLDKLQTYL

SEQ ID NO: 18411 - protein, 9 aa, Homo Sapiens
LLDKNCHLL

SEQ ID NO: 18412 - protein, 9 aa, Homo Sapiens
LLDKVYSSV

SEQ ID NO: 18413 - protein, 9 aa, Homo Sapiens
LLDKYFGSV

SEQ ID NO: 18414 - protein, 9 aa, Homo Sapiens
LLDLALEGM

SEQ ID NO: 18415 - protein, 9 aa, Homo Sapiens
LLDLHSYLL

SEQ ID NO: 18416 - protein, 9 aa, Homo Sapiens
LLDLMIAKI

SEQ ID NO: 18417 - protein, 9 aa, Homo Sapiens
LLDLSFAYM

SEQ ID NO: 18418 - protein, 9 aa, Homo Sapiens
LLDMPLWYL

SEQ ID NO: 18419 - protein, 9 aa, Homo Sapiens
LLDMSLVKL

SEQ ID NO: 18420 - protein, 9 aa, Homo Sapiens
LLDMSYEQL

SEQ ID NO: 18421 - protein, 9 aa, Homo Sapiens
LLDNDHYAM

SEQ ID NO: 18422 - protein, 9 aa, Homo Sapiens
LLDNIIQHM

SEQ ID NO: 18423 - protein, 9 aa, Homo Sapiens
LLDNTDIHL

SEQ ID NO: 18424 - protein, 9 aa, Homo Sapiens
LLDNVTVLI

SEQ ID NO: 18425 - protein, 9 aa, Homo Sapiens
LLDNVVNCL

SEQ ID NO: 18426 - protein, 9 aa, Homo Sapiens
LLDPASHKL

SEQ ID NO: 18427 - protein, 9 aa, Homo Sapiens
LLDPPRPNL

SEQ ID NO: 18428 - protein, 9 aa, Homo Sapiens
LLDPSVFHV

SEQ ID NO: 18429 - protein, 9 aa, Homo Sapiens
LLDQEINRL

SEQ ID NO: 18430 - protein, 9 aa, Homo Sapiens
LLDQINSTF

SEQ ID NO: 18431 - protein, 9 aa, Homo Sapiens
LLDQSDPGL

SEQ ID NO: 18432 - protein, 9 aa, Homo Sapiens
LLDQVQTVL

SEQ ID NO: 18433 - protein, 9 aa, Homo Sapiens
LLDRFLATV

SEQ ID NO: 18434 - protein, 9 aa, Homo Sapiens
LLDRILPKL

SEQ ID NO: 18435 - protein, 9 aa, Homo Sapiens
LLDRMVHLL

SEQ ID NO: 18436 - protein, 9 aa, Homo Sapiens
LLDRVITNV

SEQ ID NO: 18437 - protein, 9 aa, Homo Sapiens
LLDSAPLNV

SEQ ID NO: 18438 - protein, 9 aa, Homo Sapiens
LLDSCTKLL

SEQ ID NO: 18439 - protein, 9 aa, Homo Sapiens
LLDSGAFHL

SEQ ID NO: 18440 - protein, 9 aa, Homo Sapiens
LLDSMHEVV

SEQ ID NO: 18441 - protein, 9 aa, Homo Sapiens
LLDSPGKVL

SEQ ID NO: 18442 - protein, 9 aa, Homo Sapiens
LLDSPYARV

SEQ ID NO: 18443 - protein, 9 aa, Homo Sapiens
LLDSQSHHL

SEQ ID NO: 18444 - protein, 9 aa, Homo Sapiens
LLDSSHSEL

SEQ ID NO: 18445 - protein, 9 aa, Homo Sapiens
LLDSTQKYL

SEQ ID NO: 18446 - protein, 9 aa, Homo Sapiens
LLDSVEVGL

SEQ ID NO: 18447 - protein, 9 aa, Homo Sapiens
LLDSVLVTL

SEQ ID NO: 18448 - protein, 9 aa, Homo Sapiens
LLDTADVAL

SEQ ID NO: 18449 - protein, 9 aa, Homo Sapiens
LLDTIRDEI

SEQ ID NO: 18450 - protein, 9 aa, Homo Sapiens
LLDTMVDTF

SEQ ID NO: 18451 - protein, 9 aa, Homo Sapiens
LLDTSSVLV

SEQ ID NO: 18452 - protein, 9 aa, Homo Sapiens
LLDTTQKYL

SEQ ID NO: 18453 - protein, 9 aa, Homo Sapiens
LLDTVLVNL

SEQ ID NO: 18454 - protein, 9 aa, Homo Sapiens
LLDTVNNVF

SEQ ID NO: 18455 - protein, 9 aa, Homo Sapiens
LLDTVTMQV

SEQ ID NO: 18456 - protein, 9 aa, Homo Sapiens
LLDTVYKGI

SEQ ID NO: 18457 - protein, 9 aa, Homo Sapiens
LLDVFYNRL

SEQ ID NO: 18458 - protein, 9 aa, Homo Sapiens
LLDVMFSSV

SEQ ID NO: 18459 - protein, 9 aa, Homo Sapiens
LLDVPTAAV

SEQ ID NO: 18460 - protein, 9 aa, Homo Sapiens
LLDVTPLSL

SEQ ID NO: 18461 - protein, 9 aa, Homo Sapiens
LLDVVHPAA

SEQ ID NO: 18462 - protein, 9 aa, Homo Sapiens
LLDYGFYLL

SEQ ID NO: 18463 - protein, 9 aa, Homo Sapiens
LLDYHLNYL

SEQ ID NO: 18464 - protein, 9 aa, Homo Sapiens
LLDYPNNLL

SEQ ID NO: 18465 - protein, 9 aa, Homo Sapiens
LLDYSFQHL

SEQ ID NO: 18466 - protein, 9 aa, Homo Sapiens
LLEDYFVPL

SEQ ID NO: 18467 - protein, 9 aa, Homo Sapiens
LLEEFVFQV

SEQ ID NO: 18468 - protein, 9 aa, Homo Sapiens
LLEEKIASL

SEQ ID NO: 18469 - protein, 9 aa, Homo Sapiens
LLEEQYFEL

SEQ ID NO: 18470 - protein, 9 aa, Homo Sapiens
LLEESIANL

SEQ ID NO: 18471 - protein, 9 aa, Homo Sapiens
LLEPFVHQV

SEQ ID NO: 18472 - protein, 9 aa, Homo Sapiens
LLEQQLWGV

SEQ ID NO: 18473 - protein, 9 aa, Homo Sapiens
LLERAIESL

SEQ ID NO: 18474 - protein, 9 aa, Homo Sapiens
LLEYHIAYL

SEQ ID NO: 18475 - protein, 9 aa, Homo Sapiens
LLFDLIPVV

SEQ ID NO: 18476 - protein, 9 aa, Homo Sapiens
LLFDPLGGV

SEQ ID NO: 18477 - protein, 9 aa, Homo Sapiens
LLFDRPMHV

SEQ ID NO: 18478 - protein, 9 aa, Homo Sapiens
LLFDSVIHL

SEQ ID NO: 18479 - protein, 9 aa, Homo Sapiens
LLFDVHTTL

SEQ ID NO: 18480 - protein, 9 aa, Homo Sapiens
LLFSAFSRA

SEQ ID NO: 18481 - protein, 9 aa, Homo Sapiens
LLGEVLTQL

SEQ ID NO: 18482 - protein, 9 aa, Homo Sapiens
LLGPKPFPL

SEQ ID NO: 18483 - protein, 9 aa, Homo Sapiens
LLGPPPVGV

SEQ ID NO: 18484 - protein, 9 aa, Homo Sapiens
LLHEKLYEL

SEQ ID NO: 18485 - protein, 9 aa, Homo Sapiens
LLHELLTHV

SEQ ID NO: 18486 - protein, 9 aa, Homo Sapiens
LLIAPMPTA

SEQ ID NO: 18487 - protein, 9 aa, Homo Sapiens
LLIDLFKYL

SEQ ID NO: 18488 - protein, 9 aa, Homo Sapiens
LLIGATMQV

SEQ ID NO: 18489 - protein, 9 aa, Homo Sapiens
LLIGHLERV

SEQ ID NO: 18490 - protein, 9 aa, Homo Sapiens
LLIPGLATA

SEQ ID NO: 18491 - protein, 9 aa, Homo Sapiens
LLKDSIVQL

SEQ ID NO: 18492 - protein, 9 aa, Homo Sapiens
LLLAATPGL

SEQ ID NO: 18493 - protein, 9 aa, Homo Sapiens
LLLDRIASV

SEQ ID NO: 18494 - protein, 9 aa, Homo Sapiens
LLLEAVWHL

SEQ ID NO: 18495 - protein, 9 aa, Homo Sapiens
LLLEILHEI

SEQ ID NO: 18496 - protein, 9 aa, Homo Sapiens
LLLNELPSV

SEQ ID NO: 18497 - protein, 9 aa, Homo Sapiens
LLLPILVTV

SEQ ID NO: 18498 - protein, 9 aa, Homo Sapiens
LLLPKLPTL

SEQ ID NO: 18499 - protein, 9 aa, Homo Sapiens
LLMDRVDEM

SEQ ID NO: 18500 - protein, 9 aa, Homo Sapiens
LLMEHIFKL

SEQ ID NO: 18501 - protein, 9 aa, Homo Sapiens
LLMEHIQEI

SEQ ID NO: 18502 - protein, 9 aa, Homo Sapiens
LLNEILEQV

SEQ ID NO: 18503 - protein, 9 aa, Homo Sapiens
LLPAVKVFL

SEQ ID NO: 18504 - protein, 9 aa, Homo Sapiens
LLPAVVMHL

SEQ ID NO: 18505 - protein, 9 aa, Homo Sapiens
LLPDEIADV

SEQ ID NO: 18506 - protein, 9 aa, Homo Sapiens
LLPDHTYSV

SEQ ID NO: 18507 - protein, 9 aa, Homo Sapiens
LLPDIISRL

SEQ ID NO: 18508 - protein, 9 aa, Homo Sapiens
LLPDIVTCV

SEQ ID NO: 18509 - protein, 9 aa, Homo Sapiens
LLPDKWFDI

SEQ ID NO: 18510 - protein, 9 aa, Homo Sapiens
LLPDLAAKA

SEQ ID NO: 18511 - protein, 9 aa, Homo Sapiens
LLPDLIQKV

SEQ ID NO: 18512 - protein, 9 aa, Homo Sapiens
LLPDMEATL

SEQ ID NO: 18513 - protein, 9 aa, Homo Sapiens
LLPDNFIAA

SEQ ID NO: 18514 - protein, 9 aa, Homo Sapiens
LLPDNVHYV

SEQ ID NO: 18515 - protein, 9 aa, Homo Sapiens
LLPDPLYSL

SEQ ID NO: 18516 - protein, 9 aa, Homo Sapiens
LLPDQIEKL

SEQ ID NO: 18517 - protein, 9 aa, Homo Sapiens
LLPDTNVLL

SEQ ID NO: 18518 - protein, 9 aa, Homo Sapiens
LLPDVFDDL

SEQ ID NO: 18519 - protein, 9 aa, Homo Sapiens
LLPEDFLML

SEQ ID NO: 18520 - protein, 9 aa, Homo Sapiens
LLPEDSQKL

SEQ ID NO: 18521 - protein, 9 aa, Homo Sapiens
LLPEEFISL

SEQ ID NO: 18522 - protein, 9 aa, Homo Sapiens
LLPEEQVYL

SEQ ID NO: 18523 - protein, 9 aa, Homo Sapiens
LLPEGPPAI

SEQ ID NO: 18524 - protein, 9 aa, Homo Sapiens
LLPEHFLFL

SEQ ID NO: 18525 - protein, 9 aa, Homo Sapiens
LLPEIMPGL

SEQ ID NO: 18526 - protein, 9 aa, Homo Sapiens
LLPELLSAL

SEQ ID NO: 18527 - protein, 9 aa, Homo Sapiens
LLPENTFIV

SEQ ID NO: 18528 - protein, 9 aa, Homo Sapiens
LLPEPLVSI

SEQ ID NO: 18529 - protein, 9 aa, Homo Sapiens
LLPERPSYL

SEQ ID NO: 18530 - protein, 9 aa, Homo Sapiens
LLPESIPFL

SEQ ID NO: 18531 - protein, 9 aa, Homo Sapiens
LLPEVEAYL

SEQ ID NO: 18532 - protein, 9 aa, Homo Sapiens
LLPEYHQRV

SEQ ID NO: 18533 - protein, 9 aa, Homo Sapiens
LLPEYLPYA

SEQ ID NO: 18534 - protein, 9 aa, Homo Sapiens
LLPGFLQAV

SEQ ID NO: 18535 - protein, 9 aa, Homo Sapiens
LLPGLLKTI

SEQ ID NO: 18536 - protein, 9 aa, Homo Sapiens
LLPGPVTLV

SEQ ID NO: 18537 - protein, 9 aa, Homo Sapiens
LLPGVIKTV

SEQ ID NO: 18538 - protein, 9 aa, Homo Sapiens
LLPHILPLL

SEQ ID NO: 18539 - protein, 9 aa, Homo Sapiens
LLPHLLPAL

SEQ ID NO: 18540 - protein, 9 aa, Homo Sapiens
LLPHPGLKV

SEQ ID NO: 18541 - protein, 9 aa, Homo Sapiens
LLPHPGLQV

SEQ ID NO: 18542 - protein, 9 aa, Homo Sapiens
LLPIILTAL

SEQ ID NO: 18543 - protein, 9 aa, Homo Sapiens
LLPIKTVGV

SEQ ID NO: 18544 - protein, 9 aa, Homo Sapiens
LLPIYAVTV

SEQ ID NO: 18545 - protein, 9 aa, Homo Sapiens
LLPKAMIEV

SEQ ID NO: 18546 - protein, 9 aa, Homo Sapiens
LLPKEIVKV

SEQ ID NO: 18547 - protein, 9 aa, Homo Sapiens
LLPKHPHLV

SEQ ID NO: 18548 - protein, 9 aa, Homo Sapiens
LLPLFLAQL

SEQ ID NO: 18549 - protein, 9 aa, Homo Sapiens
LLPLLIQTV

SEQ ID NO: 18550 - protein, 9 aa, Homo Sapiens
LLPLPFEEL

SEQ ID NO: 18551 - protein, 9 aa, Homo Sapiens
LLPNAVYKV

SEQ ID NO: 18552 - protein, 9 aa, Homo Sapiens
LLPPAPPHA

SEQ ID NO: 18553 - protein, 9 aa, Homo Sapiens
LLPPLLHTL

SEQ ID NO: 18554 - protein, 9 aa, Homo Sapiens
LLPPPGSCA

SEQ ID NO: 18555 - protein, 9 aa, Homo Sapiens
LLPPPHQGL

SEQ ID NO: 18556 - protein, 9 aa, Homo Sapiens
LLPPPMKEL

SEQ ID NO: 18557 - protein, 9 aa, Homo Sapiens
LLPPPPCPA

SEQ ID NO: 18558 - protein, 9 aa, Homo Sapiens
LLPPPPQML

SEQ ID NO: 18559 - protein, 9 aa, Homo Sapiens
LLPPPPSSL

SEQ ID NO: 18560 - protein, 9 aa, Homo Sapiens
LLPPVTLAA

SEQ ID NO: 18561 - protein, 9 aa, Homo Sapiens
LLPPVVWLL

SEQ ID NO: 18562 - protein, 9 aa, Homo Sapiens
LLPPWVIYL

SEQ ID NO: 18563 - protein, 9 aa, Homo Sapiens
LLPPYICQL

SEQ ID NO: 18564 - protein, 9 aa, Homo Sapiens
LLPQDVHLL

SEQ ID NO: 18565 - protein, 9 aa, Homo Sapiens
LLPQGLPGL

SEQ ID NO: 18566 - protein, 9 aa, Homo Sapiens
LLPQIFVKM

SEQ ID NO: 18567 - protein, 9 aa, Homo Sapiens
LLPQILENL

SEQ ID NO: 18568 - protein, 9 aa, Homo Sapiens
LLPQQLPEC

SEQ ID NO: 18569 - protein, 9 aa, Homo Sapiens
LLPQQSYSL

SEQ ID NO: 18570 - protein, 9 aa, Homo Sapiens
LLPSDVARL

SEQ ID NO: 18571 - protein, 9 aa, Homo Sapiens
LLPSEVPAL

SEQ ID NO: 18572 - protein, 9 aa, Homo Sapiens
LLPSKLASV

SEQ ID NO: 18573 - protein, 9 aa, Homo Sapiens
LLPSPTPGL

SEQ ID NO: 18574 - protein, 9 aa, Homo Sapiens
LLPSVRQEV

SEQ ID NO: 18575 - protein, 9 aa, Homo Sapiens
LLPTAPTTV

SEQ ID NO: 18576 - protein, 9 aa, Homo Sapiens
LLPTGVFQV

SEQ ID NO: 18577 - protein, 9 aa, Homo Sapiens
LLPTIVEKV

SEQ ID NO: 18578 - protein, 9 aa, Homo Sapiens
LLPVITKEL

SEQ ID NO: 18579 - protein, 9 aa, Homo Sapiens
LLPVPVPAV

SEQ ID NO: 18580 - protein, 9 aa, Homo Sapiens
LLPYVLENV

SEQ ID NO: 18581 - protein, 9 aa, Homo Sapiens
LLQDIILQV

SEQ ID NO: 18582 - protein, 9 aa, Homo Sapiens
LLQDKQFEL

SEQ ID NO: 18583 - protein, 9 aa, Homo Sapiens
LLQPVTPSL

SEQ ID NO: 18584 - protein, 9 aa, Homo Sapiens
LLQQRLEEL

SEQ ID NO: 18585 - protein, 9 aa, Homo Sapiens
LLREKVEFL

SEQ ID NO: 18586 - protein, 9 aa, Homo Sapiens
LLRLPTPTV

SEQ ID NO: 18587 - protein, 9 aa, Homo Sapiens
LLSAEPVPA

SEQ ID NO: 18588 - protein, 9 aa, Homo Sapiens
LLSEILHLL

SEQ ID NO: 18589 - protein, 9 aa, Homo Sapiens
LLTDILVFL

SEQ ID NO: 18590 - protein, 9 aa, Homo Sapiens
LLTEQIHSL

SEQ ID NO: 18591 - protein, 9 aa, Homo Sapiens
LLVDEFLKV

SEQ ID NO: 18592 - protein, 9 aa, Homo Sapiens
LLVDYYVKI

SEQ ID NO: 18593 - protein, 9 aa, Homo Sapiens
LLVGFVHYL

SEQ ID NO: 18594 - protein, 9 aa, Homo Sapiens
LLVPVICQI

SEQ ID NO: 18595 - protein, 9 aa, Homo Sapiens
LLWDYVYQL

SEQ ID NO: 18596 - protein, 9 aa, Homo Sapiens
LLWGDLIWL

SEQ ID NO: 18597 - protein, 9 aa, Homo Sapiens
LLWKSGPVV

SEQ ID NO: 18598 - protein, 9 aa, Homo Sapiens
LLYDNVPGA

SEQ ID NO: 18599 - protein, 9 aa, Homo Sapiens
LLYENITFV

SEQ ID NO: 18600 - protein, 9 aa, Homo Sapiens
LLYEQYAIV

SEQ ID NO: 18601 - protein, 9 aa, Homo Sapiens
LLYGHTVTV

SEQ ID NO: 18602 - protein, 9 aa, Homo Sapiens
LLYGKYVSV

SEQ ID NO: 18603 - protein, 9 aa, Homo Sapiens
LLYHYWIAV

SEQ ID NO: 18604 - protein, 9 aa, Homo Sapiens
LMDAIQTNF

SEQ ID NO: 18605 - protein, 9 aa, Homo Sapiens
LMDESVLKF

SEQ ID NO: 18606 - protein, 9 aa, Homo Sapiens
LMDEVIKSM

SEQ ID NO: 18607 - protein, 9 aa, Homo Sapiens
LMDLDVEQL

SEQ ID NO: 18608 - protein, 9 aa, Homo Sapiens
LMDNPTLYL

SEQ ID NO: 18609 - protein, 9 aa, Homo Sapiens
LMDSIVKNV

SEQ ID NO: 18610 - protein, 9 aa, Homo Sapiens
LMDSNLPRL

SEQ ID NO: 18611 - protein, 9 aa, Homo Sapiens
LMDWIEAQI

SEQ ID NO: 18612 - protein, 9 aa, Homo Sapiens
LMNPMVPGL

SEQ ID NO: 18613 - protein, 9 aa, Homo Sapiens
LMPATLARA

SEQ ID NO: 18614 - protein, 9 aa, Homo Sapiens
LMPMPSLGF

SEQ ID NO: 18615 - protein, 9 aa, Homo Sapiens
LMPQVLTTL

SEQ ID NO: 18616 - protein, 9 aa, Homo Sapiens
LMPWVQETL

SEQ ID NO: 18617 - protein, 9 aa, Homo Sapiens
LMQTEFHHV

SEQ ID NO: 18618 - protein, 9 aa, Homo Sapiens
LMTDVLVFL

SEQ ID NO: 18619 - protein, 9 aa, Homo Sapiens
LMVDHVTEV

SEQ ID NO: 18620 - protein, 9 aa, Homo Sapiens
LMVPVFVVL

SEQ ID NO: 18621 - protein, 9 aa, Homo Sapiens
LMYPYIFHV

SEQ ID NO: 18622 - protein, 9 aa, Homo Sapiens
LQDDFYLNL

SEQ ID NO: 18623 - protein, 9 aa, Homo Sapiens
LQDDIPTTF

SEQ ID NO: 18624 - protein, 9 aa, Homo Sapiens
LQDELFELL

SEQ ID NO: 18625 - protein, 9 aa, Homo Sapiens
LQNDLYITV

SEQ ID NO: 18626 - protein, 9 aa, Homo Sapiens
LQPDKVPEI

SEQ ID NO: 18627 - protein, 9 aa, Homo Sapiens
LRDEFLVKI

SEQ ID NO: 18628 - protein, 9 aa, Homo Sapiens
LSDNIFTHF

SEQ ID NO: 18629 - protein, 9 aa, Homo Sapiens
LSDPIVNTL

SEQ ID NO: 18630 - protein, 9 aa, Homo Sapiens
LSPDYLPAM

SEQ ID NO: 18631 - protein, 9 aa, Homo Sapiens
LSPEFFTSV

SEQ ID NO: 18632 - protein, 9 aa, Homo Sapiens
LSPGLLPHL

SEQ ID NO: 18633 - protein, 9 aa, Homo Sapiens
LTDNVMITV

SEQ ID NO: 18634 - protein, 9 aa, Homo Sapiens
LTDQTLIYL

SEQ ID NO: 18635 - protein, 9 aa, Homo Sapiens
LTDTFYYRL

SEQ ID NO: 18636 - protein, 9 aa, Homo Sapiens
LTPKLFHEV

SEQ ID NO: 18637 - protein, 9 aa, Homo Sapiens
LTPVRLPSI

SEQ ID NO: 18638 - protein, 9 aa, Homo Sapiens
LVDAIHNQL

SEQ ID NO: 18639 - protein, 9 aa, Homo Sapiens
LVDDFRIRL

SEQ ID NO: 18640 - protein, 9 aa, Homo Sapiens
LVDDHFVEL

SEQ ID NO: 18641 - protein, 9 aa, Homo Sapiens
LVDDLVDSL

SEQ ID NO: 18642 - protein, 9 aa, Homo Sapiens
LVDDNYFYL

SEQ ID NO: 18643 - protein, 9 aa, Homo Sapiens
LVDDSVNNV

SEQ ID NO: 18644 - protein, 9 aa, Homo Sapiens
LVDDYTFNV

SEQ ID NO: 18645 - protein, 9 aa, Homo Sapiens
LVDEAKNYL

SEQ ID NO: 18646 - protein, 9 aa, Homo Sapiens
LVDEIMMTL

SEQ ID NO: 18647 - protein, 9 aa, Homo Sapiens
LVDENFTEL

SEQ ID NO: 18648 - protein, 9 aa, Homo Sapiens
LVDENQFTL

SEQ ID NO: 18649 - protein, 9 aa, Homo Sapiens
LVDEPLLKL

SEQ ID NO: 18650 - protein, 9 aa, Homo Sapiens
LVDEVMLTL

SEQ ID NO: 18651 - protein, 9 aa, Homo Sapiens
LVDFVIHFM

SEQ ID NO: 18652 - protein, 9 aa, Homo Sapiens
LVDGPCTQV

SEQ ID NO: 18653 - protein, 9 aa, Homo Sapiens
LVDGQIFCL

SEQ ID NO: 18654 - protein, 9 aa, Homo Sapiens
LVDHLNVGV

SEQ ID NO: 18655 - protein, 9 aa, Homo Sapiens
LVDMVNDGV

SEQ ID NO: 18656 - protein, 9 aa, Homo Sapiens
LVDNIQQHF

SEQ ID NO: 18657 - protein, 9 aa, Homo Sapiens
LVDPHFAQV

SEQ ID NO: 18658 - protein, 9 aa, Homo Sapiens
LVDPLNMHV

SEQ ID NO: 18659 - protein, 9 aa, Homo Sapiens
LVDQRELYL

SEQ ID NO: 18660 - protein, 9 aa, Homo Sapiens
LVDSTVVHI

SEQ ID NO: 18661 - protein, 9 aa, Homo Sapiens
LVDSVLDVV

SEQ ID NO: 18662 - protein, 9 aa, Homo Sapiens
LVDTNFINF

SEQ ID NO: 18663 - protein, 9 aa, Homo Sapiens
LVDTSYKTL

SEQ ID NO: 18664 - protein, 9 aa, Homo Sapiens
LVDVIEDKL

SEQ ID NO: 18665 - protein, 9 aa, Homo Sapiens
LVEINKILL

SEQ ID NO: 18666 - protein, 9 aa, Homo Sapiens
LVELALPQL

SEQ ID NO: 18667 - protein, 9 aa, Homo Sapiens
LVFEGIMEV

SEQ ID NO: 18668 - protein, 9 aa, Homo Sapiens
LVFRPITTV

SEQ ID NO: 18669 - protein, 9 aa, Homo Sapiens
LVIARLPSV

SEQ ID NO: 18670 - protein, 9 aa, Homo Sapiens
LVIDVIHEV

SEQ ID NO: 18671 - protein, 9 aa, Homo Sapiens
LVLPVLVFL

SEQ ID NO: 18672 - protein, 9 aa, Homo Sapiens
LVNEKFWKV

SEQ ID NO: 18673 - protein, 9 aa, Homo Sapiens
LVPDVVNEV

SEQ ID NO: 18674 - protein, 9 aa, Homo Sapiens
LVPGHLDQV

SEQ ID NO: 18675 - protein, 9 aa, Homo Sapiens
LVPPTPAEI

SEQ ID NO: 18676 - protein, 9 aa, Homo Sapiens
LVPSDFLSV

SEQ ID NO: 18677 - protein, 9 aa, Homo Sapiens
LVQDILLNV

SEQ ID NO: 18678 - protein, 9 aa, Homo Sapiens
LVSDLLSEL

SEQ ID NO: 18679 - protein, 9 aa, Homo Sapiens
LVYEAIIMV

SEQ ID NO: 18680 - protein, 9 aa, Homo Sapiens
MAPPTIPSA

SEQ ID NO: 18681 - protein, 9 aa, Homo Sapiens
MAPTLLPEL

SEQ ID NO: 18682 - protein, 9 aa, Homo Sapiens
MIDDTYQCL

SEQ ID NO: 18683 - protein, 9 aa, Homo Sapiens
MIDMPVERM

SEQ ID NO: 18684 - protein, 9 aa, Homo Sapiens
MIDNVILLI

SEQ ID NO: 18685 - protein, 9 aa, Homo Sapiens
MIDPDIYLL

SEQ ID NO: 18686 - protein, 9 aa, Homo Sapiens
MIDPPRAAV

SEQ ID NO: 18687 - protein, 9 aa, Homo Sapiens
MIIENFEAL

SEQ ID NO: 18688 - protein, 9 aa, Homo Sapiens
MIPTFTALL

SEQ ID NO: 18689 - protein, 9 aa, Homo Sapiens
MLAEKLPNL

SEQ ID NO: 18690 - protein, 9 aa, Homo Sapiens
MLDAALATL

SEQ ID NO: 18691 - protein, 9 aa, Homo Sapiens
MLDAAVIKM

SEQ ID NO: 18692 - protein, 9 aa, Homo Sapiens
MLDAIPMML

SEQ ID NO: 18693 - protein, 9 aa, Homo Sapiens
MLDEILEDV

SEQ ID NO: 18694 - protein, 9 aa, Homo Sapiens
MLDEILLQL

SEQ ID NO: 18695 - protein, 9 aa, Homo Sapiens
MLDEMKDNL

SEQ ID NO: 18696 - protein, 9 aa, Homo Sapiens
MLDEPTNHL

SEQ ID NO: 18697 - protein, 9 aa, Homo Sapiens
MLDKLVDGL

SEQ ID NO: 18698 - protein, 9 aa, Homo Sapiens
MLDNSFERL

SEQ ID NO: 18699 - protein, 9 aa, Homo Sapiens
MLDPLEVHL

SEQ ID NO: 18700 - protein, 9 aa, Homo Sapiens
MLDQINSCL

SEQ ID NO: 18701 - protein, 9 aa, Homo Sapiens
MLDSLRIYL

SEQ ID NO: 18702 - protein, 9 aa, Homo Sapiens
MLDSTFSIL

SEQ ID NO: 18703 - protein, 9 aa, Homo Sapiens
MLDSVEKLL

SEQ ID NO: 18704 - protein, 9 aa, Homo Sapiens
MLEEVFHNL

SEQ ID NO: 18705 - protein, 9 aa, Homo Sapiens
MLFDKFRSV

SEQ ID NO: 18706 - protein, 9 aa, Homo Sapiens
MLFGHPLLV

SEQ ID NO: 18707 - protein, 9 aa, Homo Sapiens
MLFGTYMKV

SEQ ID NO: 18708 - protein, 9 aa, Homo Sapiens
MLFSIRSFV

SEQ ID NO: 18709 - protein, 9 aa, Homo Sapiens
MLGERLFPL

SEQ ID NO: 18710 - protein, 9 aa, Homo Sapiens
MLGIPALLL

SEQ ID NO: 18711 - protein, 9 aa, Homo Sapiens
MLHSVTLFL

SEQ ID NO: 18712 - protein, 9 aa, Homo Sapiens
MLIEVIEKL

SEQ ID NO: 18713 - protein, 9 aa, Homo Sapiens
MLIGEIFEL

SEQ ID NO: 18714 - protein, 9 aa, Homo Sapiens
MLLDVMHTV

SEQ ID NO: 18715 - protein, 9 aa, Homo Sapiens
MLPASLIQA

SEQ ID NO: 18716 - protein, 9 aa, Homo Sapiens
MLPATPWGV

SEQ ID NO: 18717 - protein, 9 aa, Homo Sapiens
MLPDQEYKV

SEQ ID NO: 18718 - protein, 9 aa, Homo Sapiens
MLPEFYKTV

SEQ ID NO: 18719 - protein, 9 aa, Homo Sapiens
MLPEKLRPL

SEQ ID NO: 18720 - protein, 9 aa, Homo Sapiens
MLPENVAYL

SEQ ID NO: 18721 - protein, 9 aa, Homo Sapiens
MLPGFLHRL

SEQ ID NO: 18722 - protein, 9 aa, Homo Sapiens
MLPGILSQL

SEQ ID NO: 18723 - protein, 9 aa, Homo Sapiens
MLPGLALLL

SEQ ID NO: 18724 - protein, 9 aa, Homo Sapiens
MLPKDIAKL

SEQ ID NO: 18725 - protein, 9 aa, Homo Sapiens
MLPLLLTAV

SEQ ID NO: 18726 - protein, 9 aa, Homo Sapiens
MLPPPPLTA

SEQ ID NO: 18727 - protein, 9 aa, Homo Sapiens
MLPPVLTHL

SEQ ID NO: 18728 - protein, 9 aa, Homo Sapiens
MLPSILNQL

SEQ ID NO: 18729 - protein, 9 aa, Homo Sapiens
MLPSILVLL

SEQ ID NO: 18730 - protein, 9 aa, Homo Sapiens
MLPVRLATA

SEQ ID NO: 18731 - protein, 9 aa, Homo Sapiens
MLQPYMPTV

SEQ ID NO: 18732 - protein, 9 aa, Homo Sapiens
MLYEFFVKV

SEQ ID NO: 18733 - protein, 9 aa, Homo Sapiens
MMDRIVTGL

SEQ ID NO: 18734 - protein, 9 aa, Homo Sapiens
MMDSLFLKL

SEQ ID NO: 18735 - protein, 9 aa, Homo Sapiens
MMDTVISLL

SEQ ID NO: 18736 - protein, 9 aa, Homo Sapiens
MMLDDLLQL

SEQ ID NO: 18737 - protein, 9 aa, Homo Sapiens
MMPAVFHTV

SEQ ID NO: 18738 - protein, 9 aa, Homo Sapiens
MMPDGTLGL

SEQ ID NO: 18739 - protein, 9 aa, Homo Sapiens
MMPKYLNFV

SEQ ID NO: 18740 - protein, 9 aa, Homo Sapiens
MMPLKVWEL

SEQ ID NO: 18741 - protein, 9 aa, Homo Sapiens
MMPPPPAAM

SEQ ID NO: 18742 - protein, 9 aa, Homo Sapiens
MMPPPPMGM

SEQ ID NO: 18743 - protein, 9 aa, Homo Sapiens
MMPPPVGMV

SEQ ID NO: 18744 - protein, 9 aa, Homo Sapiens
MMPSRFDDL

SEQ ID NO: 18745 - protein, 9 aa, Homo Sapiens
MMPTRFEDL

SEQ ID NO: 18746 - protein, 9 aa, Homo Sapiens
MMVGDLLEV

SEQ ID NO: 18747 - protein, 9 aa, Homo Sapiens
MQPWALPTV

SEQ ID NO: 18748 - protein, 9 aa, Homo Sapiens
MTDEIFHDV

SEQ ID NO: 18749 - protein, 9 aa, Homo Sapiens
MVAPAVASV

SEQ ID NO: 18750 - protein, 9 aa, Homo Sapiens
MVDDRLVTM

SEQ ID NO: 18751 - protein, 9 aa, Homo Sapiens
MVDDVFYIV

SEQ ID NO: 18752 - protein, 9 aa, Homo Sapiens
MVDELFAEI

SEQ ID NO: 18753 - protein, 9 aa, Homo Sapiens
MVDERTDYL

SEQ ID NO: 18754 - protein, 9 aa, Homo Sapiens
MVDGKPVNL

SEQ ID NO: 18755 - protein, 9 aa, Homo Sapiens
MVDGLRITF

SEQ ID NO: 18756 - protein, 9 aa, Homo Sapiens
MVDPFHTLF

SEQ ID NO: 18757 - protein, 9 aa, Homo Sapiens
MVDSKPVNL

SEQ ID NO: 18758 - protein, 9 aa, Homo Sapiens
MVDTFLQKL

SEQ ID NO: 18759 - protein, 9 aa, Homo Sapiens
MVDVIFADV

SEQ ID NO: 18760 - protein, 9 aa, Homo Sapiens
MVDVIWRQL

SEQ ID NO: 18761 - protein, 9 aa, Homo Sapiens
MVPEDVPRL

SEQ ID NO: 18762 - protein, 9 aa, Homo Sapiens
MVVDIVQEL

SEQ ID NO: 18763 - protein, 9 aa, Homo Sapiens
MVWEGLNVV

SEQ ID NO: 18764 - protein, 9 aa, Homo Sapiens
NADAIVVKL

SEQ ID NO: 18765 - protein, 9 aa, Homo Sapiens
NAPKWVPSL

SEQ ID NO: 18766 - protein, 9 aa, Homo Sapiens
NGPELLPRV

SEQ ID NO: 18767 - protein, 9 aa, Homo Sapiens
NIDDVVRFL

SEQ ID NO: 18768 - protein, 9 aa, Homo Sapiens
NIDEAITLL

SEQ ID NO: 18769 - protein, 9 aa, Homo Sapiens
NIDEAYKIL

SEQ ID NO: 18770 - protein, 9 aa, Homo Sapiens
NIDEIYKAL

SEQ ID NO: 18771 - protein, 9 aa, Homo Sapiens
NIDELITFL

SEQ ID NO: 18772 - protein, 9 aa, Homo Sapiens
NIDEVVNKI

SEQ ID NO: 18773 - protein, 9 aa, Homo Sapiens
NIDHLLLNL

SEQ ID NO: 18774 - protein, 9 aa, Homo Sapiens
NIDLVVKEL

SEQ ID NO: 18775 - protein, 9 aa, Homo Sapiens
NIDNVPLLV

SEQ ID NO: 18776 - protein, 9 aa, Homo Sapiens
NIDSIFIVL

SEQ ID NO: 18777 - protein, 9 aa, Homo Sapiens
NIDSIIQRL

SEQ ID NO: 18778 - protein, 9 aa, Homo Sapiens
NIDTFIEHL

SEQ ID NO: 18779 - protein, 9 aa, Homo Sapiens
NIDTIYDRF

SEQ ID NO: 18780 - protein, 9 aa, Homo Sapiens
NIFPYPVGV

SEQ ID NO: 18781 - protein, 9 aa, Homo Sapiens
NIIPRFVQV

SEQ ID NO: 18782 - protein, 9 aa, Homo Sapiens
NIIPYITNV

SEQ ID NO: 18783 - protein, 9 aa, Homo Sapiens
NIPEITPFL

SEQ ID NO: 18784 - protein, 9 aa, Homo Sapiens
NIPLPLGTV

SEQ ID NO: 18785 - protein, 9 aa, Homo Sapiens
NIPVHLPNI

SEQ ID NO: 18786 - protein, 9 aa, Homo Sapiens
NIVEKLREV

SEQ ID NO: 18787 - protein, 9 aa, Homo Sapiens
NIVERVKEV

SEQ ID NO: 18788 - protein, 9 aa, Homo Sapiens
NIVPVIAKA

SEQ ID NO: 18789 - protein, 9 aa, Homo Sapiens
NIYAVKTAV

SEQ ID NO: 18790 - protein, 9 aa, Homo Sapiens
NLDAAVYQV

SEQ ID NO: 18791 - protein, 9 aa, Homo Sapiens
NLDALLNQL

SEQ ID NO: 18792 - protein, 9 aa, Homo Sapiens
NLDALTQHL

SEQ ID NO: 18793 - protein, 9 aa, Homo Sapiens
NLDDIYHFM

SEQ ID NO: 18794 - protein, 9 aa, Homo Sapiens
NLDDVGVRL

SEQ ID NO: 18795 - protein, 9 aa, Homo Sapiens
NLDELSMGL

SEQ ID NO: 18796 - protein, 9 aa, Homo Sapiens
NLDEVFKVM

SEQ ID NO: 18797 - protein, 9 aa, Homo Sapiens
NLDFVLSFL

SEQ ID NO: 18798 - protein, 9 aa, Homo Sapiens
NLDHVYNRL

SEQ ID NO: 18799 - protein, 9 aa, Homo Sapiens
NLDIVIIGI

SEQ ID NO: 18800 - protein, 9 aa, Homo Sapiens
NLDKAFEKL

SEQ ID NO: 18801 - protein, 9 aa, Homo Sapiens
NLDKLYHGL

SEQ ID NO: 18802 - protein, 9 aa, Homo Sapiens
NLDKVVEYL

SEQ ID NO: 18803 - protein, 9 aa, Homo Sapiens
NLDLAVLEL

SEQ ID NO: 18804 - protein, 9 aa, Homo Sapiens
NLDNAFAHV

SEQ ID NO: 18805 - protein, 9 aa, Homo Sapiens
NLDNPIQTV

SEQ ID NO: 18806 - protein, 9 aa, Homo Sapiens
NLDPAVHEV

SEQ ID NO: 18807 - protein, 9 aa, Homo Sapiens
NLDPIALKL

SEQ ID NO: 18808 - protein, 9 aa, Homo Sapiens
NLDPLVYLL

SEQ ID NO: 18809 - protein, 9 aa, Homo Sapiens
NLDRFYQQV

SEQ ID NO: 18810 - protein, 9 aa, Homo Sapiens
NLDRLIQNV

SEQ ID NO: 18811 - protein, 9 aa, Homo Sapiens
NLDSIIGRL

SEQ ID NO: 18812 - protein, 9 aa, Homo Sapiens
NLDYAILKL

SEQ ID NO: 18813 - protein, 9 aa, Homo Sapiens
NLFEWHFTV

SEQ ID NO: 18814 - protein, 9 aa, Homo Sapiens
NLFHYLTEV

SEQ ID NO: 18815 - protein, 9 aa, Homo Sapiens
NLFPPMLTV

SEQ ID NO: 18816 - protein, 9 aa, Homo Sapiens
NLHEVYETA

SEQ ID NO: 18817 - protein, 9 aa, Homo Sapiens
NLLDLLTEV

SEQ ID NO: 18818 - protein, 9 aa, Homo Sapiens
NLLKLIAEV

SEQ ID NO: 18819 - protein, 9 aa, Homo Sapiens
NLPAATFQV

SEQ ID NO: 18820 - protein, 9 aa, Homo Sapiens
NLPDEIYHV

SEQ ID NO: 18821 - protein, 9 aa, Homo Sapiens
NLPDIVSKV

SEQ ID NO: 18822 - protein, 9 aa, Homo Sapiens
NLPEELRKV

SEQ ID NO: 18823 - protein, 9 aa, Homo Sapiens
NLPEETNEL

SEQ ID NO: 18824 - protein, 9 aa, Homo Sapiens
NLPEETNEM

SEQ ID NO: 18825 - protein, 9 aa, Homo Sapiens
NLPELKTAV

SEQ ID NO: 18826 - protein, 9 aa, Homo Sapiens
NLPEQFHRA

SEQ ID NO: 18827 - protein, 9 aa, Homo Sapiens
NLPGVLPAL

SEQ ID NO: 18828 - protein, 9 aa, Homo Sapiens
NLPLPIPTV

SEQ ID NO: 18829 - protein, 9 aa, Homo Sapiens
NLPPDLVNV

SEQ ID NO: 18830 - protein, 9 aa, Homo Sapiens
NLPPHIIRL

SEQ ID NO: 18831 - protein, 9 aa, Homo Sapiens
NLPSILLKV

SEQ ID NO: 18832 - protein, 9 aa, Homo Sapiens
NLPSPSPTV

SEQ ID NO: 18833 - protein, 9 aa, Homo Sapiens
NLPTFLVEL

SEQ ID NO: 18834 - protein, 9 aa, Homo Sapiens
NLPTIFVYL

SEQ ID NO: 18835 - protein, 9 aa, Homo Sapiens
NLPTILVEI

SEQ ID NO: 18836 - protein, 9 aa, Homo Sapiens
NLPVFQPGV

SEQ ID NO: 18837 - protein, 9 aa, Homo Sapiens
NLPWKFEHI

SEQ ID NO: 18838 - protein, 9 aa, Homo Sapiens
NLPWYLPSA

SEQ ID NO: 18839 - protein, 9 aa, Homo Sapiens
NLWSLVAKV

SEQ ID NO: 18840 - protein, 9 aa, Homo Sapiens
NLYPFVKTV

SEQ ID NO: 18841 - protein, 9 aa, Homo Sapiens
NMDDVIYYV

SEQ ID NO: 18842 - protein, 9 aa, Homo Sapiens
NMDFVFDRM

SEQ ID NO: 18843 - protein, 9 aa, Homo Sapiens
NMDKIYIVM

SEQ ID NO: 18844 - protein, 9 aa, Homo Sapiens
NMDSVFKEL

SEQ ID NO: 18845 - protein, 9 aa, Homo Sapiens
NMDWVSTQL

SEQ ID NO: 18846 - protein, 9 aa, Homo Sapiens
NMLPQIFRV

SEQ ID NO: 18847 - protein, 9 aa, Homo Sapiens
NMPPVPHGM

SEQ ID NO: 18848 - protein, 9 aa, Homo Sapiens
NMPVSFEVI

SEQ ID NO: 18849 - protein, 9 aa, Homo Sapiens
NMVAKVDEV

SEQ ID NO: 18850 - protein, 9 aa, Homo Sapiens
NMVDIIHSV

SEQ ID NO: 18851 - protein, 9 aa, Homo Sapiens
NMYGKVVTV

SEQ ID NO: 18852 - protein, 9 aa, Homo Sapiens
NQPGVLIQV

SEQ ID NO: 18853 - protein, 9 aa, Homo Sapiens
NVDAIVVSV

SEQ ID NO: 18854 - protein, 9 aa, Homo Sapiens
NVDAVISKI

SEQ ID NO: 18855 - protein, 9 aa, Homo Sapiens
NVDEAVLHF

SEQ ID NO: 18856 - protein, 9 aa, Homo Sapiens
NVDEGIYQL

SEQ ID NO: 18857 - protein, 9 aa, Homo Sapiens
NVDEIFLKL

SEQ ID NO: 18858 - protein, 9 aa, Homo Sapiens
NVDGHLYEL

SEQ ID NO: 18859 - protein, 9 aa, Homo Sapiens
NVDGLLVQL

SEQ ID NO: 18860 - protein, 9 aa, Homo Sapiens
NVDKVFFDL

SEQ ID NO: 18861 - protein, 9 aa, Homo Sapiens
NVDNQAVLL

SEQ ID NO: 18862 - protein, 9 aa, Homo Sapiens
NVDQAFHEL

SEQ ID NO: 18863 - protein, 9 aa, Homo Sapiens
NVDQAVATL

SEQ ID NO: 18864 - protein, 9 aa, Homo Sapiens
NVDRVFQEV

SEQ ID NO: 18865 - protein, 9 aa, Homo Sapiens
NVDSLITRL

SEQ ID NO: 18866 - protein, 9 aa, Homo Sapiens
NVDTPVSTL

SEQ ID NO: 18867 - protein, 9 aa, Homo Sapiens
NVDTVLMEL

SEQ ID NO: 18868 - protein, 9 aa, Homo Sapiens
NVDYIIQEL

SEQ ID NO: 18869 - protein, 9 aa, Homo Sapiens
NVPDSFNEV

SEQ ID NO: 18870 - protein, 9 aa, Homo Sapiens
NVPDVYTQI

SEQ ID NO: 18871 - protein, 9 aa, Homo Sapiens
NVPEIMPKL

SEQ ID NO: 18872 - protein, 9 aa, Homo Sapiens
NVPGEIVES

SEQ ID NO: 18873 - protein, 9 aa, Homo Sapiens
NVPGLYIAV

SEQ ID NO: 18874 - protein, 9 aa, Homo Sapiens
NVPYPLPKI

SEQ ID NO: 18875 - protein, 9 aa, Homo Sapiens
NVVDVFHAV

SEQ ID NO: 18876 - protein, 9 aa, Homo Sapiens
PLWESGPTV

SEQ ID NO: 18877 - protein, 9 aa, Homo Sapiens
PSSVPLLAW

SEQ ID NO: 18878 - protein, 9 aa, Homo Sapiens
QAPDIDVQL

SEQ ID NO: 18879 - protein, 9 aa, Homo Sapiens
QAPGVITGV

SEQ ID NO: 18880 - protein, 9 aa, Homo Sapiens
QAPGVLPSA

SEQ ID NO: 18881 - protein, 9 aa, Homo Sapiens
QAPQVLPQV

SEQ ID NO: 18882 - protein, 9 aa, Homo Sapiens
QEQNQEQPI

SEQ ID NO: 18883 - protein, 9 aa, Homo Sapiens
QIDDLYSTI

SEQ ID NO: 18884 - protein, 9 aa, Homo Sapiens
QIDDVTIKI

SEQ ID NO: 18885 - protein, 9 aa, Homo Sapiens
QIDEVLSHF

SEQ ID NO: 18886 - protein, 9 aa, Homo Sapiens
QIDGLISQL

SEQ ID NO: 18887 - protein, 9 aa, Homo Sapiens
QIDSIHLLL

SEQ ID NO: 18888 - protein, 9 aa, Homo Sapiens
QLAELLPSV

SEQ ID NO: 18889 - protein, 9 aa, Homo Sapiens
QLAPVFQRV

SEQ ID NO: 18890 - protein, 9 aa, Homo Sapiens
QLDDLKVEL

SEQ ID NO: 18891 - protein, 9 aa, Homo Sapiens
QLDDQYSRF

SEQ ID NO: 18892 - protein, 9 aa, Homo Sapiens
QLDDSILNI

SEQ ID NO: 18893 - protein, 9 aa, Homo Sapiens
QLDDVFRQL

SEQ ID NO: 18894 - protein, 9 aa, Homo Sapiens
QLDELMAHL

SEQ ID NO: 18895 - protein, 9 aa, Homo Sapiens
QLDEVRQAM

SEQ ID NO: 18896 - protein, 9 aa, Homo Sapiens
QLDGDPKEV

SEQ ID NO: 18897 - protein, 9 aa, Homo Sapiens
QLDGIHVTI

SEQ ID NO: 18898 - protein, 9 aa, Homo Sapiens
QLDGVRTGL

SEQ ID NO: 18899 - protein, 9 aa, Homo Sapiens
QLDIIIHSL

SEQ ID NO: 18900 - protein, 9 aa, Homo Sapiens
QLDLVVKYL

SEQ ID NO: 18901 - protein, 9 aa, Homo Sapiens
QLDPLFERV

SEQ ID NO: 18902 - protein, 9 aa, Homo Sapiens
QLDPLPTTL

SEQ ID NO: 18903 - protein, 9 aa, Homo Sapiens
QLDPLVVEL

SEQ ID NO: 18904 - protein, 9 aa, Homo Sapiens
QLDQVTAKL

SEQ ID NO: 18905 - protein, 9 aa, Homo Sapiens
QLDRIIAKL

SEQ ID NO: 18906 - protein, 9 aa, Homo Sapiens
QLDSAVKNL

SEQ ID NO: 18907 - protein, 9 aa, Homo Sapiens
QLDSHVHAV

SEQ ID NO: 18908 - protein, 9 aa, Homo Sapiens
QLDSVRVWL

SEQ ID NO: 18909 - protein, 9 aa, Homo Sapiens
QLDVPVVKV

SEQ ID NO: 18910 - protein, 9 aa, Homo Sapiens
QLEGFFLHL

SEQ ID NO: 18911 - protein, 9 aa, Homo Sapiens
QLFEDLVYL

SEQ ID NO: 18912 - protein, 9 aa, Homo Sapiens
QLIDKVWQL

SEQ ID NO: 18913 - protein, 9 aa, Homo Sapiens
QLMEQVAQL

SEQ ID NO: 18914 - protein, 9 aa, Homo Sapiens
QLNEKVAQL

SEQ ID NO: 18915 - protein, 9 aa, Homo Sapiens
QLPDIYPDL

SEQ ID NO: 18916 - protein, 9 aa, Homo Sapiens
QLPDLLLQA

SEQ ID NO: 18917 - protein, 9 aa, Homo Sapiens
QLPEGASAV

SEQ ID NO: 18918 - protein, 9 aa, Homo Sapiens
QLPEKVEYV

SEQ ID NO: 18919 - protein, 9 aa, Homo Sapiens
QLPELFHKI

SEQ ID NO: 18920 - protein, 9 aa, Homo Sapiens
QLPEPLPGL

SEQ ID NO: 18921 - protein, 9 aa, Homo Sapiens
QLPEQPLFL

SEQ ID NO: 18922 - protein, 9 aa, Homo Sapiens
QLPNFAFSV

SEQ ID NO: 18923 - protein, 9 aa, Homo Sapiens
QLPNHVVNV

SEQ ID NO: 18924 - protein, 9 aa, Homo Sapiens
QLPNKAVEV

SEQ ID NO: 18925 - protein, 9 aa, Homo Sapiens
QLRDFYFSV

SEQ ID NO: 18926 - protein, 9 aa, Homo Sapiens
QLSEVFIQL

SEQ ID NO: 18927 - protein, 9 aa, Homo Sapiens
QLSPVLLYL

SEQ ID NO: 18928 - protein, 9 aa, Homo Sapiens
QLVDIIEKV

SEQ ID NO: 18929 - protein, 9 aa, Homo Sapiens
QLVPALAKV

SEQ ID NO: 18930 - protein, 9 aa, Homo Sapiens
QLWNIFNQV

SEQ ID NO: 18931 - protein, 9 aa, Homo Sapiens
QLWNNYFHL

SEQ ID NO: 18932 - protein, 9 aa, Homo Sapiens
QMDDLRAQI

SEQ ID NO: 18933 - protein, 9 aa, Homo Sapiens
QMDIIVSEV

SEQ ID NO: 18934 - protein, 9 aa, Homo Sapiens
QMPETTETV

SEQ ID NO: 18935 - protein, 9 aa, Homo Sapiens
QMPSFLQSV

SEQ ID NO: 18936 - protein, 9 aa, Homo Sapiens
QPHQPLPPT

SEQ ID NO: 18937 - protein, 9 aa, Homo Sapiens
QQPDLLPSA

SEQ ID NO: 18938 - protein, 9 aa, Homo Sapiens
QTHSVFVNV

SEQ ID NO: 18939 - protein, 9 aa, Homo Sapiens
QVDAQLLTV

SEQ ID NO: 18940 - protein, 9 aa, Homo Sapiens
QVDDIRSFL

SEQ ID NO: 18941 - protein, 9 aa, Homo Sapiens
QVDDLKAKL

SEQ ID NO: 18942 - protein, 9 aa, Homo Sapiens
QVDEFRFLL

SEQ ID NO: 18943 - protein, 9 aa, Homo Sapiens
QVDEVVDIM

SEQ ID NO: 18944 - protein, 9 aa, Homo Sapiens
QVDHVFREV

SEQ ID NO: 18945 - protein, 9 aa, Homo Sapiens
QVDPDTHLL

SEQ ID NO: 18946 - protein, 9 aa, Homo Sapiens
QVDSINALL

SEQ ID NO: 18947 - protein, 9 aa, Homo Sapiens
QVDSLIMQI

SEQ ID NO: 18948 - protein, 9 aa, Homo Sapiens
QVEDLEVKI

SEQ ID NO: 18949 - protein, 9 aa, Homo Sapiens
QVIPVLPQV

SEQ ID NO: 18950 - protein, 9 aa, Homo Sapiens
QVPDDLPNV

SEQ ID NO: 18951 - protein, 9 aa, Homo Sapiens
QVPEKLDVV

SEQ ID NO: 18952 - protein, 9 aa, Homo Sapiens
QVPEPPPKV

SEQ ID NO: 18953 - protein, 9 aa, Homo Sapiens
RAPEFLPEV

SEQ ID NO: 18954 - protein, 9 aa, Homo Sapiens
REVIAGPLL

SEQ ID NO: 18955 - protein, 9 aa, Homo Sapiens
RGPASVPSV

SEQ ID NO: 18956 - protein, 9 aa, Homo Sapiens
RIAELLTEL

SEQ ID NO: 18957 - protein, 9 aa, Homo Sapiens
RIDAFVQSL

SEQ ID NO: 18958 - protein, 9 aa, Homo Sapiens
RIDAVTPTL

SEQ ID NO: 18959 - protein, 9 aa, Homo Sapiens
RIDDLQMVL

SEQ ID NO: 18960 - protein, 9 aa, Homo Sapiens
RIDEIASNL

SEQ ID NO: 18961 - protein, 9 aa, Homo Sapiens
RIDEINKEL

SEQ ID NO: 18962 - protein, 9 aa, Homo Sapiens
RIDGVLIRM

SEQ ID NO: 18963 - protein, 9 aa, Homo Sapiens
RIDGVSLLV

SEQ ID NO: 18964 - protein, 9 aa, Homo Sapiens
RIDQVNQLL

SEQ ID NO: 18965 - protein, 9 aa, Homo Sapiens
RIFNESTSV

SEQ ID NO: 18966 - protein, 9 aa, Homo Sapiens
RIFQTLLEV

SEQ ID NO: 18967 - protein, 9 aa, Homo Sapiens
RIIEAAHQV

SEQ ID NO: 18968 - protein, 9 aa, Homo Sapiens
RILDYVINL

SEQ ID NO: 18969 - protein, 9 aa, Homo Sapiens
RIMEFTTTL

SEQ ID NO: 18970 - protein, 9 aa, Homo Sapiens
RIPAIFSPA

SEQ ID NO: 18971 - protein, 9 aa, Homo Sapiens
RIPAYFVTV

SEQ ID NO: 18972 - protein, 9 aa, Homo Sapiens
RIPIAVSGV

SEQ ID NO: 18973 - protein, 9 aa, Homo Sapiens
RISDVHFSV

SEQ ID NO: 18974 - protein, 9 aa, Homo Sapiens
RIVDVYENL

SEQ ID NO: 18975 - protein, 9 aa, Homo Sapiens
RIWDPVLSV

SEQ ID NO: 18976 - protein, 9 aa, Homo Sapiens
RKYPTLLEV

SEQ ID NO: 18977 - protein, 9 aa, Homo Sapiens
RLAPDYDAL

SEQ ID NO: 18978 - protein, 9 aa, Homo Sapiens
RLDAMFRAF

SEQ ID NO: 18979 - protein, 9 aa, Homo Sapiens
RLDAVLQRI

SEQ ID NO: 18980 - protein, 9 aa, Homo Sapiens
RLDDAIHVL

SEQ ID NO: 18981 - protein, 9 aa, Homo Sapiens
RLDDVSNDV

SEQ ID NO: 18982 - protein, 9 aa, Homo Sapiens
RLDEAAQRL

SEQ ID NO: 18983 - protein, 9 aa, Homo Sapiens
RLDEAFDFV

SEQ ID NO: 18984 - protein, 9 aa, Homo Sapiens
RLDEARQML

SEQ ID NO: 18985 - protein, 9 aa, Homo Sapiens
RLDEILSRI

SEQ ID NO: 18986 - protein, 9 aa, Homo Sapiens
RLDETIQAI

SEQ ID NO: 18987 - protein, 9 aa, Homo Sapiens
RLDEVLRTL

SEQ ID NO: 18988 - protein, 9 aa, Homo Sapiens
RLDEVPASL

SEQ ID NO: 18989 - protein, 9 aa, Homo Sapiens
RLDFVLTSL

SEQ ID NO: 18990 - protein, 9 aa, Homo Sapiens
RLDIVHENL

SEQ ID NO: 18991 - protein, 9 aa, Homo Sapiens
RLDLIAQQM

SEQ ID NO: 18992 - protein, 9 aa, Homo Sapiens
RLDLIYPMV

SEQ ID NO: 18993 - protein, 9 aa, Homo Sapiens
RLDLLITYL

SEQ ID NO: 18994 - protein, 9 aa, Homo Sapiens
RLDNGQVGL

SEQ ID NO: 18995 - protein, 9 aa, Homo Sapiens
RLDNITQVM

SEQ ID NO: 18996 - protein, 9 aa, Homo Sapiens
RLDNLKAHL

SEQ ID NO: 18997 - protein, 9 aa, Homo Sapiens
RLDPHPELL

SEQ ID NO: 18998 - protein, 9 aa, Homo Sapiens
RLDPTAVNI

SEQ ID NO: 18999 - protein, 9 aa, Homo Sapiens
RLDQVEQEL

SEQ ID NO: 19000 - protein, 9 aa, Homo Sapiens
RLDSFLSQL

SEQ ID NO: 19001 - protein, 9 aa, Homo Sapiens
RLDWPIERL

SEQ ID NO: 19002 - protein, 9 aa, Homo Sapiens
RLDWPVRTL

SEQ ID NO: 19003 - protein, 9 aa, Homo Sapiens
RLFDWLVSV

SEQ ID NO: 19004 - protein, 9 aa, Homo Sapiens
RLGPVPPGL

SEQ ID NO: 19005 - protein, 9 aa, Homo Sapiens
RLIAQRYLL

SEQ ID NO: 19006 - protein, 9 aa, Homo Sapiens
RLIESLFTI

SEQ ID NO: 19007 - protein, 9 aa, Homo Sapiens
RLISKFDTV

SEQ ID NO: 19008 - protein, 9 aa, Homo Sapiens
RLLDYVATV

SEQ ID NO: 19009 - protein, 9 aa, Homo Sapiens
RLLENMTEV

SEQ ID NO: 19010 - protein, 9 aa, Homo Sapiens
RLNEAAVTV

SEQ ID NO: 19011 - protein, 9 aa, Homo Sapiens
RLPAWQPIL

SEQ ID NO: 19012 - protein, 9 aa, Homo Sapiens
RLPDGFTQL

SEQ ID NO: 19013 - protein, 9 aa, Homo Sapiens
RLPDGWSQV

SEQ ID NO: 19014 - protein, 9 aa, Homo Sapiens
RLPDLIKEV

SEQ ID NO: 19015 - protein, 9 aa, Homo Sapiens
RLPDPFAKI

SEQ ID NO: 19016 - protein, 9 aa, Homo Sapiens
RLPDQFSKL

SEQ ID NO: 19017 - protein, 9 aa, Homo Sapiens
RLPEAIEEV

SEQ ID NO: 19018 - protein, 9 aa, Homo Sapiens
RLPEIYIQL

SEQ ID NO: 19019 - protein, 9 aa, Homo Sapiens
RLPEPTTRL

SEQ ID NO: 19020 - protein, 9 aa, Homo Sapiens
RLPEQPVDV

SEQ ID NO: 19021 - protein, 9 aa, Homo Sapiens
RLPESVERL

SEQ ID NO: 19022 - protein, 9 aa, Homo Sapiens
RLPFLFTLV

SEQ ID NO: 19023 - protein, 9 aa, Homo Sapiens
RLPGIPITV

SEQ ID NO: 19024 - protein, 9 aa, Homo Sapiens
RLPGPLGTV

SEQ ID NO: 19025 - protein, 9 aa, Homo Sapiens
RLPLISVAL

SEQ ID NO: 19026 - protein, 9 aa, Homo Sapiens
RLPPATLTL

SEQ ID NO: 19027 - protein, 9 aa, Homo Sapiens
RLPPDFFGV

SEQ ID NO: 19028 - protein, 9 aa, Homo Sapiens
RLPPGFNDV

SEQ ID NO: 19029 - protein, 9 aa, Homo Sapiens
RLPPGPAGL

SEQ ID NO: 19030 - protein, 9 aa, Homo Sapiens
RLPPLLSPL

SEQ ID NO: 19031 - protein, 9 aa, Homo Sapiens
RLPPPFPGL

SEQ ID NO: 19032 - protein, 9 aa, Homo Sapiens
RLPTRLPEI

SEQ ID NO: 19033 - protein, 9 aa, Homo Sapiens
RLPWVNPYM

SEQ ID NO: 19034 - protein, 9 aa, Homo Sapiens
RLQDAIAKV

SEQ ID NO: 19035 - protein, 9 aa, Homo Sapiens
RLQEEINEV

SEQ ID NO: 19036 - protein, 9 aa, Homo Sapiens
RLQEEVHLL

SEQ ID NO: 19037 - protein, 9 aa, Homo Sapiens
RLQEFIDEV

SEQ ID NO: 19038 - protein, 9 aa, Homo Sapiens
RLTEEFQNV

SEQ ID NO: 19039 - protein, 9 aa, Homo Sapiens
RLWEKLTLL

SEQ ID NO: 19040 - protein, 9 aa, Homo Sapiens
RLYHITDQV

SEQ ID NO: 19041 - protein, 9 aa, Homo Sapiens
RMDEEFTKI

SEQ ID NO: 19042 - protein, 9 aa, Homo Sapiens
RMDELFVLI

SEQ ID NO: 19043 - protein, 9 aa, Homo Sapiens
RMLPHAPGV

SEQ ID NO: 19044 - protein, 9 aa, Homo Sapiens
RSDDIYNQV

SEQ ID NO: 19045 - protein, 9 aa, Homo Sapiens
RVDALNDEI

SEQ ID NO: 19046 - protein, 9 aa, Homo Sapiens
RVDAVASKV

SEQ ID NO: 19047 - protein, 9 aa, Homo Sapiens
RVDDIFSDL

SEQ ID NO: 19048 - protein, 9 aa, Homo Sapiens
RVDDLYTLL

SEQ ID NO: 19049 - protein, 9 aa, Homo Sapiens
RVDDVYSVL

SEQ ID NO: 19050 - protein, 9 aa, Homo Sapiens
RVDEEPTTL

SEQ ID NO: 19051 - protein, 9 aa, Homo Sapiens
RVDGLLHQL

SEQ ID NO: 19052 - protein, 9 aa, Homo Sapiens
RVDKITEYL

SEQ ID NO: 19053 - protein, 9 aa, Homo Sapiens
RVDNFVIAL

SEQ ID NO: 19054 - protein, 9 aa, Homo Sapiens
RVDNLAVVM

SEQ ID NO: 19055 - protein, 9 aa, Homo Sapiens
RVDPVYIHL

SEQ ID NO: 19056 - protein, 9 aa, Homo Sapiens
RVDRIILLF

SEQ ID NO: 19057 - protein, 9 aa, Homo Sapiens
RVDSFNEEV

SEQ ID NO: 19058 - protein, 9 aa, Homo Sapiens
RVMELFFTV

SEQ ID NO: 19059 - protein, 9 aa, Homo Sapiens
RVPPPPQSV

SEQ ID NO: 19060 - protein, 9 aa, Homo Sapiens
RVPPVPPNV

SEQ ID NO: 19061 - protein, 9 aa, Homo Sapiens
SAPAVLLYV

SEQ ID NO: 19062 - protein, 9 aa, Homo Sapiens
SAPPPVVSV

SEQ ID NO: 19063 - protein, 9 aa, Homo Sapiens
SFPDSLPEV

SEQ ID NO: 19064 - protein, 9 aa, Homo Sapiens
SFYEHIITV

SEQ ID NO: 19065 - protein, 9 aa, Homo Sapiens
SGPGVVLYL

SEQ ID NO: 19066 - protein, 9 aa, Homo Sapiens
SIAAVLPKV

SEQ ID NO: 19067 - protein, 9 aa, Homo Sapiens
SIAEVVHQL

SEQ ID NO: 19068 - protein, 9 aa, Homo Sapiens
SIDDLPTVL

SEQ ID NO: 19069 - protein, 9 aa, Homo Sapiens
SIDDVDSKL

SEQ ID NO: 19070 - protein, 9 aa, Homo Sapiens
SIDDVVKKL

SEQ ID NO: 19071 - protein, 9 aa, Homo Sapiens
SIDEAYVDL

SEQ ID NO: 19072 - protein, 9 aa, Homo Sapiens
SIDEIVQRV

SEQ ID NO: 19073 - protein, 9 aa, Homo Sapiens
SIDFPLTKV

SEQ ID NO: 19074 - protein, 9 aa, Homo Sapiens
SIDPVPTSI

SEQ ID NO: 19075 - protein, 9 aa, Homo Sapiens
SIDPVTVSI

SEQ ID NO: 19076 - protein, 9 aa, Homo Sapiens
SIDQALAQL

SEQ ID NO: 19077 - protein, 9 aa, Homo Sapiens
SIDQFSIRL

SEQ ID NO: 19078 - protein, 9 aa, Homo Sapiens
SIDRNPPQL

SEQ ID NO: 19079 - protein, 9 aa, Homo Sapiens
SIDTLIFTL

SEQ ID NO: 19080 - protein, 9 aa, Homo Sapiens
SIHDVTFQV

SEQ ID NO: 19081 - protein, 9 aa, Homo Sapiens
SIIEYLPTL

SEQ ID NO: 19082 - protein, 9 aa, Homo Sapiens
SIIGRLLEV

SEQ ID NO: 19083 - protein, 9 aa, Homo Sapiens
SIIPPLFTV

SEQ ID NO: 19084 - protein, 9 aa, Homo Sapiens
SIIQRLLEV

SEQ ID NO: 19085 - protein, 9 aa, Homo Sapiens
SILSLVTKI

SEQ ID NO: 19086 - protein, 9 aa, Homo Sapiens
SIMDYVVFV

SEQ ID NO: 19087 - protein, 9 aa, Homo Sapiens
SIPELQNFL

SEQ ID NO: 19088 - protein, 9 aa, Homo Sapiens
SIPGGPVRL

SEQ ID NO: 19089 - protein, 9 aa, Homo Sapiens
SIPIFLPEV

SEQ ID NO: 19090 - protein, 9 aa, Homo Sapiens
SIPNRIPKI

SEQ ID NO: 19091 - protein, 9 aa, Homo Sapiens
SIPPPPPPA

SEQ ID NO: 19092 - protein, 9 aa, Homo Sapiens
SISDVIAQV

SEQ ID NO: 19093 - protein, 9 aa, Homo Sapiens
SLADLYFRA

SEQ ID NO: 19094 - protein, 9 aa, Homo Sapiens
SLAEFVQSL

SEQ ID NO: 19095 - protein, 9 aa, Homo Sapiens
SLASFIPAV

SEQ ID NO: 19096 - protein, 9 aa, Homo Sapiens
SLDAFLVAL

SEQ ID NO: 19097 - protein, 9 aa, Homo Sapiens
SLDAIIEFL

SEQ ID NO: 19098 - protein, 9 aa, Homo Sapiens
SLDALLSQV

SEQ ID NO: 19099 - protein, 9 aa, Homo Sapiens
SLDAVMPHL

SEQ ID NO: 19100 - protein, 9 aa, Homo Sapiens
SLDDLLQRL

SEQ ID NO: 19101 - protein, 9 aa, Homo Sapiens
SLDDVGEKL

SEQ ID NO: 19102 - protein, 9 aa, Homo Sapiens
SLDDVMDYL

SEQ ID NO: 19103 - protein, 9 aa, Homo Sapiens
SLDEAQFVL

SEQ ID NO: 19104 - protein, 9 aa, Homo Sapiens
SLDEAYLNI

SEQ ID NO: 19105 - protein, 9 aa, Homo Sapiens
SLDEAYRFV

SEQ ID NO: 19106 - protein, 9 aa, Homo Sapiens
SLDEKQNLV

SEQ ID NO: 19107 - protein, 9 aa, Homo Sapiens
SLDEPYEKV

SEQ ID NO: 19108 - protein, 9 aa, Homo Sapiens
SLDEVDHKI

SEQ ID NO: 19109 - protein, 9 aa, Homo Sapiens
SLDFLIELL

SEQ ID NO: 19110 - protein, 9 aa, Homo Sapiens
SLDGFTIQV

SEQ ID NO: 19111 - protein, 9 aa, Homo Sapiens
SLDGKAIKV

SEQ ID NO: 19112 - protein, 9 aa, Homo Sapiens
SLDGRPPSL

SEQ ID NO: 19113 - protein, 9 aa, Homo Sapiens
SLDHDIFQL

SEQ ID NO: 19114 - protein, 9 aa, Homo Sapiens
SLDIPATYL

SEQ ID NO: 19115 - protein, 9 aa, Homo Sapiens
SLDKDIVAL

SEQ ID NO: 19116 - protein, 9 aa, Homo Sapiens
SLDKDPLLL

SEQ ID NO: 19117 - protein, 9 aa, Homo Sapiens
SLDKFYKQV

SEQ ID NO: 19118 - protein, 9 aa, Homo Sapiens
SLDLIYRDL

SEQ ID NO: 19119 - protein, 9 aa, Homo Sapiens
SLDLPHSEL

SEQ ID NO: 19120 - protein, 9 aa, Homo Sapiens
SLDLVAAAL

SEQ ID NO: 19121 - protein, 9 aa, Homo Sapiens
SLDNLKASV

SEQ ID NO: 19122 - protein, 9 aa, Homo Sapiens
SLDPKTNTL

SEQ ID NO: 19123 - protein, 9 aa, Homo Sapiens
SLDPTLPSV

SEQ ID NO: 19124 - protein, 9 aa, Homo Sapiens
SLDQIFETL

SEQ ID NO: 19125 - protein, 9 aa, Homo Sapiens
SLDQLVQAL

SEQ ID NO: 19126 - protein, 9 aa, Homo Sapiens
SLDQPTQTV

SEQ ID NO: 19127 - protein, 9 aa, Homo Sapiens
SLDQSIISF

SEQ ID NO: 19128 - protein, 9 aa, Homo Sapiens
SLDRFYEMF

SEQ ID NO: 19129 - protein, 9 aa, Homo Sapiens
SLDRIFAGF

SEQ ID NO: 19130 - protein, 9 aa, Homo Sapiens
SLDRIYNML

SEQ ID NO: 19131 - protein, 9 aa, Homo Sapiens
SLDRPFTNL

SEQ ID NO: 19132 - protein, 9 aa, Homo Sapiens
SLDSDPWVL

SEQ ID NO: 19133 - protein, 9 aa, Homo Sapiens
SLDSSGFSL

SEQ ID NO: 19134 - protein, 9 aa, Homo Sapiens
SLDSVHLQM

SEQ ID NO: 19135 - protein, 9 aa, Homo Sapiens
SLDTALAEL

SEQ ID NO: 19136 - protein, 9 aa, Homo Sapiens
SLDTEYWKL

SEQ ID NO: 19137 - protein, 9 aa, Homo Sapiens
SLDTQYSKV

SEQ ID NO: 19138 - protein, 9 aa, Homo Sapiens
SLDWHPNNV

SEQ ID NO: 19139 - protein, 9 aa, Homo Sapiens
SLEDFVTCL

SEQ ID NO: 19140 - protein, 9 aa, Homo Sapiens
SLEELIKWL

SEQ ID NO: 19141 - protein, 9 aa, Homo Sapiens
SLENIYKEL

SEQ ID NO: 19142 - protein, 9 aa, Homo Sapiens
SLFDIISKI

SEQ ID NO: 19143 - protein, 9 aa, Homo Sapiens
SLFEEMLQV

SEQ ID NO: 19144 - protein, 9 aa, Homo Sapiens
SLFEGTWYL

SEQ ID NO: 19145 - protein, 9 aa, Homo Sapiens
SLFRVITEV

SEQ ID NO: 19146 - protein, 9 aa, Homo Sapiens
SLFSVIVRV

SEQ ID NO: 19147 - protein, 9 aa, Homo Sapiens
SLHEFLVNL

SEQ ID NO: 19148 - protein, 9 aa, Homo Sapiens
SLHFLILYV

SEQ ID NO: 19149 - protein, 9 aa, Homo Sapiens
SLIDIVTEI

SEQ ID NO: 19150 - protein, 9 aa, Homo Sapiens
SLIDKLYNI

SEQ ID NO: 19151 - protein, 9 aa, Homo Sapiens
SLIDQFFGV

SEQ ID NO: 19152 - protein, 9 aa, Homo Sapiens
SLIEKYFSV

SEQ ID NO: 19153 - protein, 9 aa, Homo Sapiens
SLIEQTTAL

SEQ ID NO: 19154 - protein, 9 aa, Homo Sapiens
SLIEYCIEL

SEQ ID NO: 19155 - protein, 9 aa, Homo Sapiens
SLIGHLQTL

SEQ ID NO: 19156 - protein, 9 aa, Homo Sapiens
SLITRLLEV

SEQ ID NO: 19157 - protein, 9 aa, Homo Sapiens
SLLDIIEKV

SEQ ID NO: 19158 - protein, 9 aa, Homo Sapiens
SLLEHLSHV

SEQ ID NO: 19159 - protein, 9 aa, Homo Sapiens
SLNEYQPKL

SEQ ID NO: 19160 - protein, 9 aa, Homo Sapiens
SLPAGPPGV

SEQ ID NO: 19161 - protein, 9 aa, Homo Sapiens
SLPAKFKKL

SEQ ID NO: 19162 - protein, 9 aa, Homo Sapiens
SLPALLFKA

SEQ ID NO: 19163 - protein, 9 aa, Homo Sapiens
SLPDHLPSV

SEQ ID NO: 19164 - protein, 9 aa, Homo Sapiens
SLPDIKVYL

SEQ ID NO: 19165 - protein, 9 aa, Homo Sapiens
SLPDISAEI

SEQ ID NO: 19166 - protein, 9 aa, Homo Sapiens
SLPDPVLGA

SEQ ID NO: 19167 - protein, 9 aa, Homo Sapiens
SLPEDFYHF

SEQ ID NO: 19168 - protein, 9 aa, Homo Sapiens
SLPEELNRV

SEQ ID NO: 19169 - protein, 9 aa, Homo Sapiens
SLPEELPLL

SEQ ID NO: 19170 - protein, 9 aa, Homo Sapiens
SLPEFQESV

SEQ ID NO: 19171 - protein, 9 aa, Homo Sapiens
SLPEILKEV

SEQ ID NO: 19172 - protein, 9 aa, Homo Sapiens
SLPEIVPPM

SEQ ID NO: 19173 - protein, 9 aa, Homo Sapiens
SLPELTHAL

SEQ ID NO: 19174 - protein, 9 aa, Homo Sapiens
SLPENTVQV

SEQ ID NO: 19175 - protein, 9 aa, Homo Sapiens
SLPEVGTKL

SEQ ID NO: 19176 - protein, 9 aa, Homo Sapiens
SLPFQVANV

SEQ ID NO: 19177 - protein, 9 aa, Homo Sapiens
SLPGNFFYL

SEQ ID NO: 19178 - protein, 9 aa, Homo Sapiens
SLPGTLPVL

SEQ ID NO: 19179 - protein, 9 aa, Homo Sapiens
SLPHQLPEA

SEQ ID NO: 19180 - protein, 9 aa, Homo Sapiens
SLPKDLQAV

SEQ ID NO: 19181 - protein, 9 aa, Homo Sapiens
SLPKKLALL

SEQ ID NO: 19182 - protein, 9 aa, Homo Sapiens
SLPLFIVTL

SEQ ID NO: 19183 - protein, 9 aa, Homo Sapiens
SLPLYFVSA

SEQ ID NO: 19184 - protein, 9 aa, Homo Sapiens
SLPNVFSAL

SEQ ID NO: 19185 - protein, 9 aa, Homo Sapiens
SLPPHILEV

SEQ ID NO: 19186 - protein, 9 aa, Homo Sapiens
SLPPLLAAA

SEQ ID NO: 19187 - protein, 9 aa, Homo Sapiens
SLPPLPRKV

SEQ ID NO: 19188 - protein, 9 aa, Homo Sapiens
SLPPVPPRL

SEQ ID NO: 19189 - protein, 9 aa, Homo Sapiens
SLPRAFPAL

SEQ ID NO: 19190 - protein, 9 aa, Homo Sapiens
SLPRHTFGL

SEQ ID NO: 19191 - protein, 9 aa, Homo Sapiens
SLPSPFLRA

SEQ ID NO: 19192 - protein, 9 aa, Homo Sapiens
SLPSVAVGV

SEQ ID NO: 19193 - protein, 9 aa, Homo Sapiens
SLPVEVQEV

SEQ ID NO: 19194 - protein, 9 aa, Homo Sapiens
SLQDEIQRV

SEQ ID NO: 19195 - protein, 9 aa, Homo Sapiens
SLQEEIAFL

SEQ ID NO: 19196 - protein, 9 aa, Homo Sapiens
SLQEFLAAL

SEQ ID NO: 19197 - protein, 9 aa, Homo Sapiens
SLQEKLWAI

SEQ ID NO: 19198 - protein, 9 aa, Homo Sapiens
SLQETIQSL

SEQ ID NO: 19199 - protein, 9 aa, Homo Sapiens
SLSAIFNNV

SEQ ID NO: 19200 - protein, 9 aa, Homo Sapiens
SLSDTVEKL

SEQ ID NO: 19201 - protein, 9 aa, Homo Sapiens
SLSQVFLHL

SEQ ID NO: 19202 - protein, 9 aa, Homo Sapiens
SLSTVFVVL

SEQ ID NO: 19203 - protein, 9 aa, Homo Sapiens
SLVAILQSV

SEQ ID NO: 19204 - protein, 9 aa, Homo Sapiens
SLVEIILHV

SEQ ID NO: 19205 - protein, 9 aa, Homo Sapiens
SLVEQLTMV

SEQ ID NO: 19206 - protein, 9 aa, Homo Sapiens
SLVPVYVKV

SEQ ID NO: 19207 - protein, 9 aa, Homo Sapiens
SLWPMTFGL

SEQ ID NO: 19208 - protein, 9 aa, Homo Sapiens
SLWSIISKV

SEQ ID NO: 19209 - protein, 9 aa, Homo Sapiens
SLYEMVSRV

SEQ ID NO: 19210 - protein, 9 aa, Homo Sapiens
SLYHVESTV

SEQ ID NO: 19211 - protein, 9 aa, Homo Sapiens
SMDDHKLSL

SEQ ID NO: 19212 - protein, 9 aa, Homo Sapiens
SMDEINKQL

SEQ ID NO: 19213 - protein, 9 aa, Homo Sapiens
SMDFVLLNF

SEQ ID NO: 19214 - protein, 9 aa, Homo Sapiens
SMDHIQAEL

SEQ ID NO: 19215 - protein, 9 aa, Homo Sapiens
SMDPLPVFL

SEQ ID NO: 19216 - protein, 9 aa, Homo Sapiens
SMDSFYKVL

SEQ ID NO: 19217 - protein, 9 aa, Homo Sapiens
SMDSSHVSL

SEQ ID NO: 19218 - protein, 9 aa, Homo Sapiens
SMDTIVGML

SEQ ID NO: 19219 - protein, 9 aa, Homo Sapiens
SMDTLLATL

SEQ ID NO: 19220 - protein, 9 aa, Homo Sapiens
SMEEIFQHL

SEQ ID NO: 19221 - protein, 9 aa, Homo Sapiens
SMMQTLLTV

SEQ ID NO: 19222 - protein, 9 aa, Homo Sapiens
SMPDFDLHL

SEQ ID NO: 19223 - protein, 9 aa, Homo Sapiens
SMPDFDLNL

SEQ ID NO: 19224 - protein, 9 aa, Homo Sapiens
SMPDVDLHL

SEQ ID NO: 19225 - protein, 9 aa, Homo Sapiens
SMPDVDLHV

SEQ ID NO: 19226 - protein, 9 aa, Homo Sapiens
SMPDVELNL

SEQ ID NO: 19227 - protein, 9 aa, Homo Sapiens
SMPEQAHKV

SEQ ID NO: 19228 - protein, 9 aa, Homo Sapiens
SMPLSFPSL

SEQ ID NO: 19229 - protein, 9 aa, Homo Sapiens
SMPPAFPRL

SEQ ID NO: 19230 - protein, 9 aa, Homo Sapiens
SMPPVYPSV

SEQ ID NO: 19231 - protein, 9 aa, Homo Sapiens
SMPSDQYEL

SEQ ID NO: 19232 - protein, 9 aa, Homo Sapiens
SMPSFTARL

SEQ ID NO: 19233 - protein, 9 aa, Homo Sapiens
SMPTQLHSL

SEQ ID NO: 19234 - protein, 9 aa, Homo Sapiens
SMVDVVMLL

SEQ ID NO: 19235 - protein, 9 aa, Homo Sapiens
SQPEKVYTL

SEQ ID NO: 19236 - protein, 9 aa, Homo Sapiens
SQPEVLVPI

SEQ ID NO: 19237 - protein, 9 aa, Homo Sapiens
SQPPVQVSV

SEQ ID NO: 19238 - protein, 9 aa, Homo Sapiens
SQPWEVPFV

SEQ ID NO: 19239 - protein, 9 aa, Homo Sapiens
SSDAVFIQL

SEQ ID NO: 19240 - protein, 9 aa, Homo Sapiens
SSIPPVFQL

SEQ ID NO: 19241 - protein, 9 aa, Homo Sapiens
SSPETLPSL

SEQ ID NO: 19242 - protein, 9 aa, Homo Sapiens
SVDDIVKGI

SEQ ID NO: 19243 - protein, 9 aa, Homo Sapiens
SVDDLVEKL

SEQ ID NO: 19244 - protein, 9 aa, Homo Sapiens
SVDDTIVAL

SEQ ID NO: 19245 - protein, 9 aa, Homo Sapiens
SVDDVLSHF

SEQ ID NO: 19246 - protein, 9 aa, Homo Sapiens
SVDEEFQKL

SEQ ID NO: 19247 - protein, 9 aa, Homo Sapiens
SVDELFAEI

SEQ ID NO: 19248 - protein, 9 aa, Homo Sapiens
SVDELFQKV

SEQ ID NO: 19249 - protein, 9 aa, Homo Sapiens
SVDETTQAM

SEQ ID NO: 19250 - protein, 9 aa, Homo Sapiens
SVDEVARQL

SEQ ID NO: 19251 - protein, 9 aa, Homo Sapiens
SVDEVEISV

SEQ ID NO: 19252 - protein, 9 aa, Homo Sapiens
SVDEVLEML

SEQ ID NO: 19253 - protein, 9 aa, Homo Sapiens
SVDGVIKEV

SEQ ID NO: 19254 - protein, 9 aa, Homo Sapiens
SVDNLFVVV

SEQ ID NO: 19255 - protein, 9 aa, Homo Sapiens
SVDPFYEML

SEQ ID NO: 19256 - protein, 9 aa, Homo Sapiens
SVDPLPAGL

SEQ ID NO: 19257 - protein, 9 aa, Homo Sapiens
SVDPQFLKL

SEQ ID NO: 19258 - protein, 9 aa, Homo Sapiens
SVDPVAADL

SEQ ID NO: 19259 - protein, 9 aa, Homo Sapiens
SVDPVLSIL

SEQ ID NO: 19260 - protein, 9 aa, Homo Sapiens
SVDQISLQV

SEQ ID NO: 19261 - protein, 9 aa, Homo Sapiens
SVDSHFCHL

SEQ ID NO: 19262 - protein, 9 aa, Homo Sapiens
SVDSHFQEV

SEQ ID NO: 19263 - protein, 9 aa, Homo Sapiens
SVDSHFSHL

SEQ ID NO: 19264 - protein, 9 aa, Homo Sapiens
SVDSVLTAL

SEQ ID NO: 19265 - protein, 9 aa, Homo Sapiens
SVDSVSNNL

SEQ ID NO: 19266 - protein, 9 aa, Homo Sapiens
SVEEVLKTV

SEQ ID NO: 19267 - protein, 9 aa, Homo Sapiens
SVIEQIVYV

SEQ ID NO: 19268 - protein, 9 aa, Homo Sapiens
SVIEQLFFV

SEQ ID NO: 19269 - protein, 9 aa, Homo Sapiens
SVISVVSYL

SEQ ID NO: 19270 - protein, 9 aa, Homo Sapiens
SVLDLVVAL

SEQ ID NO: 19271 - protein, 9 aa, Homo Sapiens
SVLEALSGV

SEQ ID NO: 19272 - protein, 9 aa, Homo Sapiens
SVNGVFKEV

SEQ ID NO: 19273 - protein, 9 aa, Homo Sapiens
SVNPYIVKL

SEQ ID NO: 19274 - protein, 9 aa, Homo Sapiens
SVPATVPSI

SEQ ID NO: 19275 - protein, 9 aa, Homo Sapiens
SVPDLAPML

SEQ ID NO: 19276 - protein, 9 aa, Homo Sapiens
SVPDTLPTA

SEQ ID NO: 19277 - protein, 9 aa, Homo Sapiens
SVPDVTHHL

SEQ ID NO: 19278 - protein, 9 aa, Homo Sapiens
SVPHIYIQV

SEQ ID NO: 19279 - protein, 9 aa, Homo Sapiens
SVPMPLPTV

SEQ ID NO: 19280 - protein, 9 aa, Homo Sapiens
SVPPPLTSV

SEQ ID NO: 19281 - protein, 9 aa, Homo Sapiens
SVPQSLPSL

SEQ ID NO: 19282 - protein, 9 aa, Homo Sapiens
SVVDIKLLL

SEQ ID NO: 19283 - protein, 9 aa, Homo Sapiens
SVVDVFAQL

SEQ ID NO: 19284 - protein, 9 aa, Homo Sapiens
SVVEQAWKL

SEQ ID NO: 19285 - protein, 9 aa, Homo Sapiens
SVVESVFKL

SEQ ID NO: 19286 - protein, 9 aa, Homo Sapiens
SVVGPVKGV

SEQ ID NO: 19287 - protein, 9 aa, Homo Sapiens
TADEVHYFL

SEQ ID NO: 19288 - protein, 9 aa, Homo Sapiens
TAPPNAYTV

SEQ ID NO: 19289 - protein, 9 aa, Homo Sapiens
TIDDIAQSL

SEQ ID NO: 19290 - protein, 9 aa, Homo Sapiens
TIDDLEDKL

SEQ ID NO: 19291 - protein, 9 aa, Homo Sapiens
TIDDLEEKL

SEQ ID NO: 19292 - protein, 9 aa, Homo Sapiens
TIDDLIDKL

SEQ ID NO: 19293 - protein, 9 aa, Homo Sapiens
TIDDVVYVI

SEQ ID NO: 19294 - protein, 9 aa, Homo Sapiens
TIDPIPHQL

SEQ ID NO: 19295 - protein, 9 aa, Homo Sapiens
TILEYLTYL

SEQ ID NO: 19296 - protein, 9 aa, Homo Sapiens
TIPEIIIKV

SEQ ID NO: 19297 - protein, 9 aa, Homo Sapiens
TIPEILPKL

SEQ ID NO: 19298 - protein, 9 aa, Homo Sapiens
TISPIIKLL

SEQ ID NO: 19299 - protein, 9 aa, Homo Sapiens
TITDIISAL

SEQ ID NO: 19300 - protein, 9 aa, Homo Sapiens
TLADVLYHV

SEQ ID NO: 19301 - protein, 9 aa, Homo Sapiens
TLDAGNIKL

SEQ ID NO: 19302 - protein, 9 aa, Homo Sapiens
TLDDIKEWL

SEQ ID NO: 19303 - protein, 9 aa, Homo Sapiens
TLDDIMAAV

SEQ ID NO: 19304 - protein, 9 aa, Homo Sapiens
TLDDLIAAV

SEQ ID NO: 19305 - protein, 9 aa, Homo Sapiens
TLDDLYPMM

SEQ ID NO: 19306 - protein, 9 aa, Homo Sapiens
TLDEKIEKV

SEQ ID NO: 19307 - protein, 9 aa, Homo Sapiens
TLDELGIHL

SEQ ID NO: 19308 - protein, 9 aa, Homo Sapiens
TLDEQVLSF

SEQ ID NO: 19309 - protein, 9 aa, Homo Sapiens
TLDEVTVTI

SEQ ID NO: 19310 - protein, 9 aa, Homo Sapiens
TLDGKVQYL

SEQ ID NO: 19311 - protein, 9 aa, Homo Sapiens
TLDGSLHAV

SEQ ID NO: 19312 - protein, 9 aa, Homo Sapiens
TLDGVYPTL

SEQ ID NO: 19313 - protein, 9 aa, Homo Sapiens
TLDKIMILF

SEQ ID NO: 19314 - protein, 9 aa, Homo Sapiens
TLDKSWWTL

SEQ ID NO: 19315 - protein, 9 aa, Homo Sapiens
TLDNIFLCV

SEQ ID NO: 19316 - protein, 9 aa, Homo Sapiens
TLDNILSHI

SEQ ID NO: 19317 - protein, 9 aa, Homo Sapiens
TLDPEPQHL

SEQ ID NO: 19318 - protein, 9 aa, Homo Sapiens
TLDPLISQL

SEQ ID NO: 19319 - protein, 9 aa, Homo Sapiens
TLDPVEKAL

SEQ ID NO: 19320 - protein, 9 aa, Homo Sapiens
TLDQINQEL

SEQ ID NO: 19321 - protein, 9 aa, Homo Sapiens
TLDQTLNEL

SEQ ID NO: 19322 - protein, 9 aa, Homo Sapiens
TLDSFYEML

SEQ ID NO: 19323 - protein, 9 aa, Homo Sapiens
TLDSICDSL

SEQ ID NO: 19324 - protein, 9 aa, Homo Sapiens
TLDSILFLL

SEQ ID NO: 19325 - protein, 9 aa, Homo Sapiens
TLDTIYPVL

SEQ ID NO: 19326 - protein, 9 aa, Homo Sapiens
TLDVITVML

SEQ ID NO: 19327 - protein, 9 aa, Homo Sapiens
TLDVQIQHV

SEQ ID NO: 19328 - protein, 9 aa, Homo Sapiens
TLEDIYNQV

SEQ ID NO: 19329 - protein, 9 aa, Homo Sapiens
TLEEIIFKL

SEQ ID NO: 19330 - protein, 9 aa, Homo Sapiens
TLEEVFIEV

SEQ ID NO: 19331 - protein, 9 aa, Homo Sapiens
TLFNVIKSV

SEQ ID NO: 19332 - protein, 9 aa, Homo Sapiens
TLHSIIISL

SEQ ID NO: 19333 - protein, 9 aa, Homo Sapiens
TLIDLYEQV

SEQ ID NO: 19334 - protein, 9 aa, Homo Sapiens
TLIEDILGV

SEQ ID NO: 19335 - protein, 9 aa, Homo Sapiens
TLIGYFVGL

SEQ ID NO: 19336 - protein, 9 aa, Homo Sapiens
TLISRLPAV

SEQ ID NO: 19337 - protein, 9 aa, Homo Sapiens
TLMDILPRI

SEQ ID NO: 19338 - protein, 9 aa, Homo Sapiens
TLMIKFEEA

SEQ ID NO: 19339 - protein, 9 aa, Homo Sapiens
TLNEKLTAL

SEQ ID NO: 19340 - protein, 9 aa, Homo Sapiens
TLNSFIHVL

SEQ ID NO: 19341 - protein, 9 aa, Homo Sapiens
TLPDLVPQL

SEQ ID NO: 19342 - protein, 9 aa, Homo Sapiens
TLPEAIHFL

SEQ ID NO: 19343 - protein, 9 aa, Homo Sapiens
TLPEDISQL

SEQ ID NO: 19344 - protein, 9 aa, Homo Sapiens
TLPEENYQV

SEQ ID NO: 19345 - protein, 9 aa, Homo Sapiens
TLPELTFLL

SEQ ID NO: 19346 - protein, 9 aa, Homo Sapiens
TLPFQLSSV

SEQ ID NO: 19347 - protein, 9 aa, Homo Sapiens
TLPGHIQAV

SEQ ID NO: 19348 - protein, 9 aa, Homo Sapiens
TLPNIYVTL

SEQ ID NO: 19349 - protein, 9 aa, Homo Sapiens
TLPPESTQV

SEQ ID NO: 19350 - protein, 9 aa, Homo Sapiens
TLPPPPSGL

SEQ ID NO: 19351 - protein, 9 aa, Homo Sapiens
TLPVAFKVV

SEQ ID NO: 19352 - protein, 9 aa, Homo Sapiens
TLPVDFVTA

SEQ ID NO: 19353 - protein, 9 aa, Homo Sapiens
TLPVSFAQL

SEQ ID NO: 19354 - protein, 9 aa, Homo Sapiens
TLPYVAPEL

SEQ ID NO: 19355 - protein, 9 aa, Homo Sapiens
TLQEFLERI

SEQ ID NO: 19356 - protein, 9 aa, Homo Sapiens
TLQEKIHRL

SEQ ID NO: 19357 - protein, 9 aa, Homo Sapiens
TLSDLRVYL

SEQ ID NO: 19358 - protein, 9 aa, Homo Sapiens
TLSDVVVGL

SEQ ID NO: 19359 - protein, 9 aa, Homo Sapiens
TLSERLWGL

SEQ ID NO: 19360 - protein, 9 aa, Homo Sapiens
TLVLTLPTV

SEQ ID NO: 19361 - protein, 9 aa, Homo Sapiens
TLWVDPYEV

SEQ ID NO: 19362 - protein, 9 aa, Homo Sapiens
TLYEAVREV

SEQ ID NO: 19363 - protein, 9 aa, Homo Sapiens
TMDALLARL

SEQ ID NO: 19364 - protein, 9 aa, Homo Sapiens
TMDDFRWAL

SEQ ID NO: 19365 - protein, 9 aa, Homo Sapiens
TMDDLTTAL

SEQ ID NO: 19366 - protein, 9 aa, Homo Sapiens
TMDEFRQHL

SEQ ID NO: 19367 - protein, 9 aa, Homo Sapiens
TMDPFVDRI

SEQ ID NO: 19368 - protein, 9 aa, Homo Sapiens
TMPDLYHLL

SEQ ID NO: 19369 - protein, 9 aa, Homo Sapiens
TMPSDVLEV

SEQ ID NO: 19370 - protein, 9 aa, Homo Sapiens
TMPTSLPNL

SEQ ID NO: 19371 - protein, 9 aa, Homo Sapiens
TPGNRIVYL

SEQ ID NO: 19372 - protein, 9 aa, Homo Sapiens
TQPQRLPQL

SEQ ID NO: 19373 - protein, 9 aa, Homo Sapiens
TTDGVYEGV

SEQ ID NO: 19374 - protein, 9 aa, Homo Sapiens
TVDALVLRF

SEQ ID NO: 19375 - protein, 9 aa, Homo Sapiens
TVDDLQAKL

SEQ ID NO: 19376 - protein, 9 aa, Homo Sapiens
TVDDLVAEI

SEQ ID NO: 19377 - protein, 9 aa, Homo Sapiens
TVDELMMRL

SEQ ID NO: 19378 - protein, 9 aa, Homo Sapiens
TVDEVVQWL

SEQ ID NO: 19379 - protein, 9 aa, Homo Sapiens
TVDKILEAL

SEQ ID NO: 19380 - protein, 9 aa, Homo Sapiens
TVDLVINQL

SEQ ID NO: 19381 - protein, 9 aa, Homo Sapiens
TVDPVIVEA

SEQ ID NO: 19382 - protein, 9 aa, Homo Sapiens
TVDQVLSEV

SEQ ID NO: 19383 - protein, 9 aa, Homo Sapiens
TVFEHTFHV

SEQ ID NO: 19384 - protein, 9 aa, Homo Sapiens
TVIDYFHQL

SEQ ID NO: 19385 - protein, 9 aa, Homo Sapiens
TVLPFVSTV

SEQ ID NO: 19386 - protein, 9 aa, Homo Sapiens
TVNPIIYAL

SEQ ID NO: 19387 - protein, 9 aa, Homo Sapiens
TVPPPPAAA

SEQ ID NO: 19388 - protein, 9 aa, Homo Sapiens
TVPPVFVSV

SEQ ID NO: 19389 - protein, 9 aa, Homo Sapiens
VADAIRTSL

SEQ ID NO: 19390 - protein, 9 aa, Homo Sapiens
VADLVGFLL

SEQ ID NO: 19391 - protein, 9 aa, Homo Sapiens
VADNLAIQL

SEQ ID NO: 19392 - protein, 9 aa, Homo Sapiens
VADQIVTKL

SEQ ID NO: 19393 - protein, 9 aa, Homo Sapiens
VADTVYRAL

SEQ ID NO: 19394 - protein, 9 aa, Homo Sapiens
VADWVYNEL

SEQ ID NO: 19395 - protein, 9 aa, Homo Sapiens
VAPALAPKV

SEQ ID NO: 19396 - protein, 9 aa, Homo Sapiens
VAPDEIPYL

SEQ ID NO: 19397 - protein, 9 aa, Homo Sapiens
VAPEEHPVL

SEQ ID NO: 19398 - protein, 9 aa, Homo Sapiens
VAPESFEYI

SEQ ID NO: 19399 - protein, 9 aa, Homo Sapiens
VAPNDIPLV

SEQ ID NO: 19400 - protein, 9 aa, Homo Sapiens
VAPPKAHEV

SEQ ID NO: 19401 - protein, 9 aa, Homo Sapiens
VAVGVIKAV

SEQ ID NO: 19402 - protein, 9 aa, Homo Sapiens
VETGVLKPG

SEQ ID NO: 19403 - protein, 9 aa, Homo Sapiens
VFRTDLITA

SEQ ID NO: 19404 - protein, 9 aa, Homo Sapiens
VGPEELPVV

SEQ ID NO: 19405 - protein, 9 aa, Homo Sapiens
VIDAVTHAL

SEQ ID NO: 19406 - protein, 9 aa, Homo Sapiens
VIDDLVYSI

SEQ ID NO: 19407 - protein, 9 aa, Homo Sapiens
VIDEIYRVL

SEQ ID NO: 19408 - protein, 9 aa, Homo Sapiens
VIDGHIYAV

SEQ ID NO: 19409 - protein, 9 aa, Homo Sapiens
VIDKLVVHL

SEQ ID NO: 19410 - protein, 9 aa, Homo Sapiens
VIDLITIKL

SEQ ID NO: 19411 - protein, 9 aa, Homo Sapiens
VIDPPAVNL

SEQ ID NO: 19412 - protein, 9 aa, Homo Sapiens
VIDPVPAAV

SEQ ID NO: 19413 - protein, 9 aa, Homo Sapiens
VIDQIAETL

SEQ ID NO: 19414 - protein, 9 aa, Homo Sapiens
VIDQKVYEI

SEQ ID NO: 19415 - protein, 9 aa, Homo Sapiens
VIDRILYKL

SEQ ID NO: 19416 - protein, 9 aa, Homo Sapiens
VIDSLTVKI

SEQ ID NO: 19417 - protein, 9 aa, Homo Sapiens
VIDTPVFEL

SEQ ID NO: 19418 - protein, 9 aa, Homo Sapiens
VIFDLPTTV

SEQ ID NO: 19419 - protein, 9 aa, Homo Sapiens
VIHATVTSV

SEQ ID NO: 19420 - protein, 9 aa, Homo Sapiens
VIIPLLHTV

SEQ ID NO: 19421 - protein, 9 aa, Homo Sapiens
VILDPVHSV

SEQ ID NO: 19422 - protein, 9 aa, Homo Sapiens
VIPEKFQHI

SEQ ID NO: 19423 - protein, 9 aa, Homo Sapiens
VIPGMFKEV

SEQ ID NO: 19424 - protein, 9 aa, Homo Sapiens
VIPTNVPEL

SEQ ID NO: 19425 - protein, 9 aa, Homo Sapiens
VLDAHFLVL

SEQ ID NO: 19426 - protein, 9 aa, Homo Sapiens
VLDAITQEL

SEQ ID NO: 19427 - protein, 9 aa, Homo Sapiens
VLDAMFERI

SEQ ID NO: 19428 - protein, 9 aa, Homo Sapiens
VLDDILEKI

SEQ ID NO: 19429 - protein, 9 aa, Homo Sapiens
VLDDKDYFL

SEQ ID NO: 19430 - protein, 9 aa, Homo Sapiens
VLDDKLVFV

SEQ ID NO: 19431 - protein, 9 aa, Homo Sapiens
VLDDLLYAV

SEQ ID NO: 19432 - protein, 9 aa, Homo Sapiens
VLDDSTAKL

SEQ ID NO: 19433 - protein, 9 aa, Homo Sapiens
VLDDVGHGV

SEQ ID NO: 19434 - protein, 9 aa, Homo Sapiens
VLDEADEML

SEQ ID NO: 19435 - protein, 9 aa, Homo Sapiens
VLDEADKLL

SEQ ID NO: 19436 - protein, 9 aa, Homo Sapiens
VLDEADRMI

SEQ ID NO: 19437 - protein, 9 aa, Homo Sapiens
VLDEADVMI

SEQ ID NO: 19438 - protein, 9 aa, Homo Sapiens
VLDEFYSSL

SEQ ID NO: 19439 - protein, 9 aa, Homo Sapiens
VLDEGKMKL

SEQ ID NO: 19440 - protein, 9 aa, Homo Sapiens
VLDEGSASV

SEQ ID NO: 19441 - protein, 9 aa, Homo Sapiens
VLDEIDAAL

SEQ ID NO: 19442 - protein, 9 aa, Homo Sapiens
VLDELDMEL

SEQ ID NO: 19443 - protein, 9 aa, Homo Sapiens
VLDELGLSL

SEQ ID NO: 19444 - protein, 9 aa, Homo Sapiens
VLDELPPLI

SEQ ID NO: 19445 - protein, 9 aa, Homo Sapiens
VLDEPGQDL

SEQ ID NO: 19446 - protein, 9 aa, Homo Sapiens
VLDEQLNEF

SEQ ID NO: 19447 - protein, 9 aa, Homo Sapiens
VLDEVDQML

SEQ ID NO: 19448 - protein, 9 aa, Homo Sapiens
VLDEVVTVL

SEQ ID NO: 19449 - protein, 9 aa, Homo Sapiens
VLDFIEDYL

SEQ ID NO: 19450 - protein, 9 aa, Homo Sapiens
VLDGLEFKV

SEQ ID NO: 19451 - protein, 9 aa, Homo Sapiens
VLDGLHNEL

SEQ ID NO: 19452 - protein, 9 aa, Homo Sapiens
VLDGLLHGL

SEQ ID NO: 19453 - protein, 9 aa, Homo Sapiens
VLDGLLYVV

SEQ ID NO: 19454 - protein, 9 aa, Homo Sapiens
VLDGRGHLL

SEQ ID NO: 19455 - protein, 9 aa, Homo Sapiens
VLDGTIEYM

SEQ ID NO: 19456 - protein, 9 aa, Homo Sapiens
VLDGVKAEL

SEQ ID NO: 19457 - protein, 9 aa, Homo Sapiens
VLDGVLMEL

SEQ ID NO: 19458 - protein, 9 aa, Homo Sapiens
VLDHSLESL

SEQ ID NO: 19459 - protein, 9 aa, Homo Sapiens
VLDHTYQEL

SEQ ID NO: 19460 - protein, 9 aa, Homo Sapiens
VLDIMPLTL

SEQ ID NO: 19461 - protein, 9 aa, Homo Sapiens
VLDKEIIQL

SEQ ID NO: 19462 - protein, 9 aa, Homo Sapiens
VLDKLLLYL

SEQ ID NO: 19463 - protein, 9 aa, Homo Sapiens
VLDLSWNKL

SEQ ID NO: 19464 - protein, 9 aa, Homo Sapiens
VLDLTYNNL

SEQ ID NO: 19465 - protein, 9 aa, Homo Sapiens
VLDNIKAVF

SEQ ID NO: 19466 - protein, 9 aa, Homo Sapiens
VLDNIPKLL

SEQ ID NO: 19467 - protein, 9 aa, Homo Sapiens
VLDNLLAFV

SEQ ID NO: 19468 - protein, 9 aa, Homo Sapiens
VLDNNSVRL

SEQ ID NO: 19469 - protein, 9 aa, Homo Sapiens
VLDNPHHGF

SEQ ID NO: 19470 - protein, 9 aa, Homo Sapiens
VLDNPTPEM

SEQ ID NO: 19471 - protein, 9 aa, Homo Sapiens
VLDNVKMNL

SEQ ID NO: 19472 - protein, 9 aa, Homo Sapiens
VLDPESVEL

SEQ ID NO: 19473 - protein, 9 aa, Homo Sapiens
VLDPKPPPL

SEQ ID NO: 19474 - protein, 9 aa, Homo Sapiens
VLDQVEARL

SEQ ID NO: 19475 - protein, 9 aa, Homo Sapiens
VLDSAFEQL

SEQ ID NO: 19476 - protein, 9 aa, Homo Sapiens
VLDSFVEKL

SEQ ID NO: 19477 - protein, 9 aa, Homo Sapiens
VLDSIIWAF

SEQ ID NO: 19478 - protein, 9 aa, Homo Sapiens
VLDSLLLTL

SEQ ID NO: 19479 - protein, 9 aa, Homo Sapiens
VLDSLNARM

SEQ ID NO: 19480 - protein, 9 aa, Homo Sapiens
VLDVIHEVL

SEQ ID NO: 19481 - protein, 9 aa, Homo Sapiens
VLEEFVPEI

SEQ ID NO: 19482 - protein, 9 aa, Homo Sapiens
VLEELYKKV

SEQ ID NO: 19483 - protein, 9 aa, Homo Sapiens
VLEEQIERL

SEQ ID NO: 19484 - protein, 9 aa, Homo Sapiens
VLFDVTGQV

SEQ ID NO: 19485 - protein, 9 aa, Homo Sapiens
VLFELKLLL

SEQ ID NO: 19486 - protein, 9 aa, Homo Sapiens
VLFGLLREV

SEQ ID NO: 19487 - protein, 9 aa, Homo Sapiens
VLFGVETHV

SEQ ID NO: 19488 - protein, 9 aa, Homo Sapiens
VLFNKLTYL

SEQ ID NO: 19489 - protein, 9 aa, Homo Sapiens
VLIDYQRNV

SEQ ID NO: 19490 - protein, 9 aa, Homo Sapiens
VLIETLVTL

SEQ ID NO: 19491 - protein, 9 aa, Homo Sapiens
VLIKWFPEV

SEQ ID NO: 19492 - protein, 9 aa, Homo Sapiens
VLIPKLPQL

SEQ ID NO: 19493 - protein, 9 aa, Homo Sapiens
VLISKLPYI

SEQ ID NO: 19494 - protein, 9 aa, Homo Sapiens
VLLGHIFYV

SEQ ID NO: 19495 - protein, 9 aa, Homo Sapiens
VLLSTIHEL

SEQ ID NO: 19496 - protein, 9 aa, Homo Sapiens
VLMDRLPSL

SEQ ID NO: 19497 - protein, 9 aa, Homo Sapiens
VLMEIIAKV

SEQ ID NO: 19498 - protein, 9 aa, Homo Sapiens
VLMEMSYRL

SEQ ID NO: 19499 - protein, 9 aa, Homo Sapiens
VLMENIVYL

SEQ ID NO: 19500 - protein, 9 aa, Homo Sapiens
VLNEYFHNV

SEQ ID NO: 19501 - protein, 9 aa, Homo Sapiens
VLPAEFFEV

SEQ ID NO: 19502 - protein, 9 aa, Homo Sapiens
VLPAFTSNL

SEQ ID NO: 19503 - protein, 9 aa, Homo Sapiens
VLPAVLTRL

SEQ ID NO: 19504 - protein, 9 aa, Homo Sapiens
VLPAVSLEV

SEQ ID NO: 19505 - protein, 9 aa, Homo Sapiens
VLPDEICNL

SEQ ID NO: 19506 - protein, 9 aa, Homo Sapiens
VLPDLVVEI

SEQ ID NO: 19507 - protein, 9 aa, Homo Sapiens
VLPEHLILV

SEQ ID NO: 19508 - protein, 9 aa, Homo Sapiens
VLPESLPVL

SEQ ID NO: 19509 - protein, 9 aa, Homo Sapiens
VLPETCEEL

SEQ ID NO: 19510 - protein, 9 aa, Homo Sapiens
VLPGLIHKV

SEQ ID NO: 19511 - protein, 9 aa, Homo Sapiens
VLPGPVETV

SEQ ID NO: 19512 - protein, 9 aa, Homo Sapiens
VLPKLYVKL

SEQ ID NO: 19513 - protein, 9 aa, Homo Sapiens
VLPLAFTRL

SEQ ID NO: 19514 - protein, 9 aa, Homo Sapiens
VLPNIHPEL

SEQ ID NO: 19515 - protein, 9 aa, Homo Sapiens
VLPNIQAVL

SEQ ID NO: 19516 - protein, 9 aa, Homo Sapiens
VLPNPPQAV

SEQ ID NO: 19517 - protein, 9 aa, Homo Sapiens
VLPPEPVQL

SEQ ID NO: 19518 - protein, 9 aa, Homo Sapiens
VLPPFSTKV

SEQ ID NO: 19519 - protein, 9 aa, Homo Sapiens
VLPPHPQQL

SEQ ID NO: 19520 - protein, 9 aa, Homo Sapiens
VLPPPPTTL

SEQ ID NO: 19521 - protein, 9 aa, Homo Sapiens
VLPPQSQEV

SEQ ID NO: 19522 - protein, 9 aa, Homo Sapiens
VLPSITTEI

SEQ ID NO: 19523 - protein, 9 aa, Homo Sapiens
VLPSIVNEV

SEQ ID NO: 19524 - protein, 9 aa, Homo Sapiens
VLPSNTPNV

SEQ ID NO: 19525 - protein, 9 aa, Homo Sapiens
VLPSPGPAL

SEQ ID NO: 19526 - protein, 9 aa, Homo Sapiens
VLPWVLLTL

SEQ ID NO: 19527 - protein, 9 aa, Homo Sapiens
VLPYLVPKL

SEQ ID NO: 19528 - protein, 9 aa, Homo Sapiens
VLQSVFTSV

SEQ ID NO: 19529 - protein, 9 aa, Homo Sapiens
VLSDIIQNL

SEQ ID NO: 19530 - protein, 9 aa, Homo Sapiens
VLSELLWQV

SEQ ID NO: 19531 - protein, 9 aa, Homo Sapiens
VLVAELVGV

SEQ ID NO: 19532 - protein, 9 aa, Homo Sapiens
VLVDAFSHV

SEQ ID NO: 19533 - protein, 9 aa, Homo Sapiens
VLWDRTFSL

SEQ ID NO: 19534 - protein, 9 aa, Homo Sapiens
VLWIPAFMV

SEQ ID NO: 19535 - protein, 9 aa, Homo Sapiens
VLWKEILFL

SEQ ID NO: 19536 - protein, 9 aa, Homo Sapiens
VLWPESISV

SEQ ID NO: 19537 - protein, 9 aa, Homo Sapiens
VLWSVLQQI

SEQ ID NO: 19538 - protein, 9 aa, Homo Sapiens
VLYDPVVGC

SEQ ID NO: 19539 - protein, 9 aa, Homo Sapiens
VLYELFTYI

SEQ ID NO: 19540 - protein, 9 aa, Homo Sapiens
VLYHVETEV

SEQ ID NO: 19541 - protein, 9 aa, Homo Sapiens
VLYSIAEKV

SEQ ID NO: 19542 - protein, 9 aa, Homo Sapiens
VLYSVMTLV

SEQ ID NO: 19543 - protein, 9 aa, Homo Sapiens
VMAPRTLVL

SEQ ID NO: 19544 - protein, 9 aa, Homo Sapiens
VMDAALLLI

SEQ ID NO: 19545 - protein, 9 aa, Homo Sapiens
VMDEIHTVL

SEQ ID NO: 19546 - protein, 9 aa, Homo Sapiens
VMDKLFDEL

SEQ ID NO: 19547 - protein, 9 aa, Homo Sapiens
VMDKQYEIL

SEQ ID NO: 19548 - protein, 9 aa, Homo Sapiens
VMDLLVLGL

SEQ ID NO: 19549 - protein, 9 aa, Homo Sapiens
VMDLSIVRL

SEQ ID NO: 19550 - protein, 9 aa, Homo Sapiens
VMDSKIVQV

SEQ ID NO: 19551 - protein, 9 aa, Homo Sapiens
VMDVVVKSV

SEQ ID NO: 19552 - protein, 9 aa, Homo Sapiens
VMEDLYNYI

SEQ ID NO: 19553 - protein, 9 aa, Homo Sapiens
VMINQFVLA

SEQ ID NO: 19554 - protein, 9 aa, Homo Sapiens
VMPAGVDKI

SEQ ID NO: 19555 - protein, 9 aa, Homo Sapiens
VMPEAVPEV

SEQ ID NO: 19556 - protein, 9 aa, Homo Sapiens
VMPEDLVEA

SEQ ID NO: 19557 - protein, 9 aa, Homo Sapiens
VMPGNIVFV

SEQ ID NO: 19558 - protein, 9 aa, Homo Sapiens
VMPHANMNV

SEQ ID NO: 19559 - protein, 9 aa, Homo Sapiens
VMPHTTPEL

SEQ ID NO: 19560 - protein, 9 aa, Homo Sapiens
VMPSSFFLL

SEQ ID NO: 19561 - protein, 9 aa, Homo Sapiens
VMYDLITEL

SEQ ID NO: 19562 - protein, 9 aa, Homo Sapiens
VPQLEIVPN

SEQ ID NO: 19563 - protein, 9 aa, Homo Sapiens
VQDEFLEKL

SEQ ID NO: 19564 - protein, 9 aa, Homo Sapiens
VQPEEFVAI

SEQ ID NO: 19565 - protein, 9 aa, Homo Sapiens
VQPEHIQYL

SEQ ID NO: 19566 - protein, 9 aa, Homo Sapiens
VQPIKLARV

SEQ ID NO: 19567 - protein, 9 aa, Homo Sapiens
VQPLELPMV

SEQ ID NO: 19568 - protein, 9 aa, Homo Sapiens
VSDNIIAKL

SEQ ID NO: 19569 - protein, 9 aa, Homo Sapiens
VSPSSFENV

SEQ ID NO: 19570 - protein, 9 aa, Homo Sapiens
VTDAVALRV

SEQ ID NO: 19571 - protein, 9 aa, Homo Sapiens
VTDEVFNFL

SEQ ID NO: 19572 - protein, 9 aa, Homo Sapiens
VVDAIPVFL

SEQ ID NO: 19573 - protein, 9 aa, Homo Sapiens
VVDALNQGL

SEQ ID NO: 19574 - protein, 9 aa, Homo Sapiens
VVDAVVTQV

SEQ ID NO: 19575 - protein, 9 aa, Homo Sapiens
VVDDIVSKL

SEQ ID NO: 19576 - protein, 9 aa, Homo Sapiens
VVDDLLDQI

SEQ ID NO: 19577 - protein, 9 aa, Homo Sapiens
VVDEELSKL

SEQ ID NO: 19578 - protein, 9 aa, Homo Sapiens
VVDEIAAKL

SEQ ID NO: 19579 - protein, 9 aa, Homo Sapiens
VVDEIYFKV

SEQ ID NO: 19580 - protein, 9 aa, Homo Sapiens
VVDEKISAM

SEQ ID NO: 19581 - protein, 9 aa, Homo Sapiens
VVDEKLPGL

SEQ ID NO: 19582 - protein, 9 aa, Homo Sapiens
VVDEVIQNC

SEQ ID NO: 19583 - protein, 9 aa, Homo Sapiens
VVDFVAATL

SEQ ID NO: 19584 - protein, 9 aa, Homo Sapiens
VVDGAFKEV

SEQ ID NO: 19585 - protein, 9 aa, Homo Sapiens
VVDGNFEEV

SEQ ID NO: 19586 - protein, 9 aa, Homo Sapiens
VVDHLLLRL

SEQ ID NO: 19587 - protein, 9 aa, Homo Sapiens
VVDHVFPLL

SEQ ID NO: 19588 - protein, 9 aa, Homo Sapiens
VVDNLLFKL

SEQ ID NO: 19589 - protein, 9 aa, Homo Sapiens
VVDPIVSNF

SEQ ID NO: 19590 - protein, 9 aa, Homo Sapiens
VVDPNQVNV

SEQ ID NO: 19591 - protein, 9 aa, Homo Sapiens
VVDQVVAFL

SEQ ID NO: 19592 - protein, 9 aa, Homo Sapiens
VVDRFVEFL

SEQ ID NO: 19593 - protein, 9 aa, Homo Sapiens
VVDSIMTAL

SEQ ID NO: 19594 - protein, 9 aa, Homo Sapiens
VVDSSNTAL

SEQ ID NO: 19595 - protein, 9 aa, Homo Sapiens
VVDWLYHHV

SEQ ID NO: 19596 - protein, 9 aa, Homo Sapiens
VVDWLYHNV

SEQ ID NO: 19597 - protein, 9 aa, Homo Sapiens
VVDWLYTHV

SEQ ID NO: 19598 - protein, 9 aa, Homo Sapiens
VVFPTITLV

SEQ ID NO: 19599 - protein, 9 aa, Homo Sapiens
VVPAALKVV

SEQ ID NO: 19600 - protein, 9 aa, Homo Sapiens
VVPDKISEV

SEQ ID NO: 19601 - protein, 9 aa, Homo Sapiens
VVPPFLQPE

SEQ ID NO: 19602 - protein, 9 aa, Homo Sapiens
VVPQLFITV

SEQ ID NO: 19603 - protein, 9 aa, Homo Sapiens
VVPQQLLTV

SEQ ID NO: 19604 - protein, 9 aa, Homo Sapiens
VVPSYIPLV

SEQ ID NO: 19605 - protein, 9 aa, Homo Sapiens
VVVDPIQSV

SEQ ID NO: 19606 - protein, 9 aa, Homo Sapiens
VVVGDLVEV

SEQ ID NO: 19607 - protein, 9 aa, Homo Sapiens
VVWGTVIRV

SEQ ID NO: 19608 - protein, 9 aa, Homo Sapiens
WIDDTSAFV

SEQ ID NO: 19609 - protein, 9 aa, Homo Sapiens
WLDDVEERL

SEQ ID NO: 19610 - protein, 9 aa, Homo Sapiens
WLDEVRLTL

SEQ ID NO: 19611 - protein, 9 aa, Homo Sapiens
WLDGSPVTL

SEQ ID NO: 19612 - protein, 9 aa, Homo Sapiens
WLDNIIDLV

SEQ ID NO: 19613 - protein, 9 aa, Homo Sapiens
WLDSVHQLL

SEQ ID NO: 19614 - protein, 9 aa, Homo Sapiens
WLEENVHEV

SEQ ID NO: 19615 - protein, 9 aa, Homo Sapiens
WLPEPGLGL

SEQ ID NO: 19616 - protein, 9 aa, Homo Sapiens
WLPEVMILV

SEQ ID NO: 19617 - protein, 9 aa, Homo Sapiens
WLPNHVVFL

SEQ ID NO: 19618 - protein, 9 aa, Homo Sapiens
WVDDAIWRL

SEQ ID NO: 19619 - protein, 9 aa, Homo Sapiens
WVDEINRHV

SEQ ID NO: 19620 - protein, 9 aa, Homo Sapiens
WVDEMQVQL

SEQ ID NO: 19621 - protein, 9 aa, Homo Sapiens
WVLEPQEGV

SEQ ID NO: 19622 - protein, 9 aa, Homo Sapiens
YADPVTDLL

SEQ ID NO: 19623 - protein, 9 aa, Homo Sapiens
YADQLKEYL

SEQ ID NO: 19624 - protein, 9 aa, Homo Sapiens
YCPEVNVMV

SEQ ID NO: 19625 - protein, 9 aa, Homo Sapiens
YGDEIAIEL

SEQ ID NO: 19626 - protein, 9 aa, Homo Sapiens
YGLPVVVKL

SEQ ID NO: 19627 - protein, 9 aa, Homo Sapiens
YGPGLTHGV

SEQ ID NO: 19628 - protein, 9 aa, Homo Sapiens
YIDAHPETI

SEQ ID NO: 19629 - protein, 9 aa, Homo Sapiens
YIDDITVTT

SEQ ID NO: 19630 - protein, 9 aa, Homo Sapiens
YIDDLVVIL

SEQ ID NO: 19631 - protein, 9 aa, Homo Sapiens
YIDDTLTMV

SEQ ID NO: 19632 - protein, 9 aa, Homo Sapiens
YIDDVFHAL

SEQ ID NO: 19633 - protein, 9 aa, Homo Sapiens
YIDEGRLVL

SEQ ID NO: 19634 - protein, 9 aa, Homo Sapiens
YIDGILIKT

SEQ ID NO: 19635 - protein, 9 aa, Homo Sapiens
YIDHGDPQV

SEQ ID NO: 19636 - protein, 9 aa, Homo Sapiens
YIDKDLEYV

SEQ ID NO: 19637 - protein, 9 aa, Homo Sapiens
YIDKDMIHI

SEQ ID NO: 19638 - protein, 9 aa, Homo Sapiens
YIDKIKKYV

SEQ ID NO: 19639 - protein, 9 aa, Homo Sapiens
YIDLPPPRL

SEQ ID NO: 19640 - protein, 9 aa, Homo Sapiens
YIDNLLVRV

SEQ ID NO: 19641 - protein, 9 aa, Homo Sapiens
YIDQGIAEL

SEQ ID NO: 19642 - protein, 9 aa, Homo Sapiens
YIDQRIHEL

SEQ ID NO: 19643 - protein, 9 aa, Homo Sapiens
YIDRIHIFF

SEQ ID NO: 19644 - protein, 9 aa, Homo Sapiens
YIDRIIVAI

SEQ ID NO: 19645 - protein, 9 aa, Homo Sapiens
YIDRPLPYL

SEQ ID NO: 19646 - protein, 9 aa, Homo Sapiens
YIDSIPKTL

SEQ ID NO: 19647 - protein, 9 aa, Homo Sapiens
YIDTFFEDL

SEQ ID NO: 19648 - protein, 9 aa, Homo Sapiens
YIEDLKKFL

SEQ ID NO: 19649 - protein, 9 aa, Homo Sapiens
YIEEAIEKL

SEQ ID NO: 19650 - protein, 9 aa, Homo Sapiens
YIFEEPFTI

SEQ ID NO: 19651 - protein, 9 aa, Homo Sapiens
YIFQPQQSV

SEQ ID NO: 19652 - protein, 9 aa, Homo Sapiens
YIGEVLVSV

SEQ ID NO: 19653 - protein, 9 aa, Homo Sapiens
YIIDVSQSV

SEQ ID NO: 19654 - protein, 9 aa, Homo Sapiens
YIIEVNARL

SEQ ID NO: 19655 - protein, 9 aa, Homo Sapiens
YIIPVVLFL

SEQ ID NO: 19656 - protein, 9 aa, Homo Sapiens
YIISVKGIK

SEQ ID NO: 19657 - protein, 9 aa, Homo Sapiens
YIMSYISRV

SEQ ID NO: 19658 - protein, 9 aa, Homo Sapiens
YIPHPFLVV

SEQ ID NO: 19659 - protein, 9 aa, Homo Sapiens
YIPSVLHDV

SEQ ID NO: 19660 - protein, 9 aa, Homo Sapiens
YIPSYFDFV

SEQ ID NO: 19661 - protein, 9 aa, Homo Sapiens
YIPTELDQV

SEQ ID NO: 19662 - protein, 9 aa, Homo Sapiens
YIPTFICSV

SEQ ID NO: 19663 - protein, 9 aa, Homo Sapiens
YIVDLLTHL

SEQ ID NO: 19664 - protein, 9 aa, Homo Sapiens
YLADIFTKL

SEQ ID NO: 19665 - protein, 9 aa, Homo Sapiens
YLADLYHFV

SEQ ID NO: 19666 - protein, 9 aa, Homo Sapiens
YLADVTNAL

SEQ ID NO: 19667 - protein, 9 aa, Homo Sapiens
YLDAIKLLL

SEQ ID NO: 19668 - protein, 9 aa, Homo Sapiens
YLDAIRSGL

SEQ ID NO: 19669 - protein, 9 aa, Homo Sapiens
YLDCVMHDL

SEQ ID NO: 19670 - protein, 9 aa, Homo Sapiens
YLDDLLPKL

SEQ ID NO: 19671 - protein, 9 aa, Homo Sapiens
YLDDPDLKY

SEQ ID NO: 19672 - protein, 9 aa, Homo Sapiens
YLDEDTIYH

SEQ ID NO: 19673 - protein, 9 aa, Homo Sapiens
YLDEELMVL

SEQ ID NO: 19674 - protein, 9 aa, Homo Sapiens
YLDEIVKEV

SEQ ID NO: 19675 - protein, 9 aa, Homo Sapiens
YLDEPIKIG

SEQ ID NO: 19676 - protein, 9 aa, Homo Sapiens
YLDEYIARM

SEQ ID NO: 19677 - protein, 9 aa, Homo Sapiens
YLDFTNPKV

SEQ ID NO: 19678 - protein, 9 aa, Homo Sapiens
YLDGVHTVF

SEQ ID NO: 19679 - protein, 9 aa, Homo Sapiens
YLDHFSRAL

SEQ ID NO: 19680 - protein, 9 aa, Homo Sapiens
YLDIINLFL

SEQ ID NO: 19681 - protein, 9 aa, Homo Sapiens
YLDIVKLLL

SEQ ID NO: 19682 - protein, 9 aa, Homo Sapiens
YLDKFIRLL

SEQ ID NO: 19683 - protein, 9 aa, Homo Sapiens
YLDKIRDLL

SEQ ID NO: 19684 - protein, 9 aa, Homo Sapiens
YLDKMNNNI

SEQ ID NO: 19685 - protein, 9 aa, Homo Sapiens
YLDKTFYNL

SEQ ID NO: 19686 - protein, 9 aa, Homo Sapiens
YLDLILNDF

SEQ ID NO: 19687 - protein, 9 aa, Homo Sapiens
YLDLRSFQM

SEQ ID NO: 19688 - protein, 9 aa, Homo Sapiens
YLDNFWPDL

SEQ ID NO: 19689 - protein, 9 aa, Homo Sapiens
YLDNGVVFV

SEQ ID NO: 19690 - protein, 9 aa, Homo Sapiens
YLDNLLVRF

SEQ ID NO: 19691 - protein, 9 aa, Homo Sapiens
YLDPAQRGV

SEQ ID NO: 19692 - protein, 9 aa, Homo Sapiens
YLDPLWHQL

SEQ ID NO: 19693 - protein, 9 aa, Homo Sapiens
YLDPNYQSI

SEQ ID NO: 19694 - protein, 9 aa, Homo Sapiens
YLDPVQRDL

SEQ ID NO: 19695 - protein, 9 aa, Homo Sapiens
YLDQLNHIL

SEQ ID NO: 19696 - protein, 9 aa, Homo Sapiens
YLDQLTQIL

SEQ ID NO: 19697 - protein, 9 aa, Homo Sapiens
YLDQVKIRF

SEQ ID NO: 19698 - protein, 9 aa, Homo Sapiens
YLDQVKLQF

SEQ ID NO: 19699 - protein, 9 aa, Homo Sapiens
YLDRFLAGV

SEQ ID NO: 19700 - protein, 9 aa, Homo Sapiens
YLDRKLLTL

SEQ ID NO: 19701 - protein, 9 aa, Homo Sapiens
YLDSIDCSL

SEQ ID NO: 19702 - protein, 9 aa, Homo Sapiens
YLDSMYIML

SEQ ID NO: 19703 - protein, 9 aa, Homo Sapiens
YLDSPLVRF

SEQ ID NO: 19704 - protein, 9 aa, Homo Sapiens
YLDTINRSV

SEQ ID NO: 19705 - protein, 9 aa, Homo Sapiens
YLDTLYRYA

SEQ ID NO: 19706 - protein, 9 aa, Homo Sapiens
YLDTVCLNM

SEQ ID NO: 19707 - protein, 9 aa, Homo Sapiens
YLDVAEAFL

SEQ ID NO: 19708 - protein, 9 aa, Homo Sapiens
YLDVKFEYL

SEQ ID NO: 19709 - protein, 9 aa, Homo Sapiens
YLDVSVGKI

SEQ ID NO: 19710 - protein, 9 aa, Homo Sapiens
YLDWDVSEL

SEQ ID NO: 19711 - protein, 9 aa, Homo Sapiens
YLDWTIERV

SEQ ID NO: 19712 - protein, 9 aa, Homo Sapiens
YLEAIHNFV

SEQ ID NO: 19713 - protein, 9 aa, Homo Sapiens
YLEDFITNI

SEQ ID NO: 19714 - protein, 9 aa, Homo Sapiens
YLEDILAKL

SEQ ID NO: 19715 - protein, 9 aa, Homo Sapiens
YLEEAAERL

SEQ ID NO: 19716 - protein, 9 aa, Homo Sapiens
YLEEAPKFL

SEQ ID NO: 19717 - protein, 9 aa, Homo Sapiens
YLEEILVRV

SEQ ID NO: 19718 - protein, 9 aa, Homo Sapiens
YLEEPLTQV

SEQ ID NO: 19719 - protein, 9 aa, Homo Sapiens
YLEERLIEL

SEQ ID NO: 19720 - protein, 9 aa, Homo Sapiens
YLEPYLKEV

SEQ ID NO: 19721 - protein, 9 aa, Homo Sapiens
YLEQKVVEL

SEQ ID NO: 19722 - protein, 9 aa, Homo Sapiens
YLEVFSDKF

SEQ ID NO: 19723 - protein, 9 aa, Homo Sapiens
YLFAVNIKL

SEQ ID NO: 19724 - protein, 9 aa, Homo Sapiens
YLFDLPLKV

SEQ ID NO: 19725 - protein, 9 aa, Homo Sapiens
YLFEEIAKI

SEQ ID NO: 19726 - protein, 9 aa, Homo Sapiens
YLFEPVAKA

SEQ ID NO: 19727 - protein, 9 aa, Homo Sapiens
YLFERIKEL

SEQ ID NO: 19728 - protein, 9 aa, Homo Sapiens
YLFERTFNL

SEQ ID NO: 19729 - protein, 9 aa, Homo Sapiens
YLFIVKNEL

SEQ ID NO: 19730 - protein, 9 aa, Homo Sapiens
YLFTIINSL

SEQ ID NO: 19731 - protein, 9 aa, Homo Sapiens
YLFTSPQRV

SEQ ID NO: 19732 - protein, 9 aa, Homo Sapiens
YLGRLAHEV

SEQ ID NO: 19733 - protein, 9 aa, Homo Sapiens
YLHDFLKYL

SEQ ID NO: 19734 - protein, 9 aa, Homo Sapiens
YLHETLETI

SEQ ID NO: 19735 - protein, 9 aa, Homo Sapiens
YLHNQGIGV

SEQ ID NO: 19736 - protein, 9 aa, Homo Sapiens
YLHSQVVSV

SEQ ID NO: 19737 - protein, 9 aa, Homo Sapiens
YLHSYLTYI

SEQ ID NO: 19738 - protein, 9 aa, Homo Sapiens
YLHWLLTNI

SEQ ID NO: 19739 - protein, 9 aa, Homo Sapiens
YLIELIDRV

SEQ ID NO: 19740 - protein, 9 aa, Homo Sapiens
YLITLLEHL

SEQ ID NO: 19741 - protein, 9 aa, Homo Sapiens
YLKDFFSNV

SEQ ID NO: 19742 - protein, 9 aa, Homo Sapiens
YLLDLHSYL

SEQ ID NO: 19743 - protein, 9 aa, Homo Sapiens
YLLDLLRLP

SEQ ID NO: 19744 - protein, 9 aa, Homo Sapiens
YLLDQHILI

SEQ ID NO: 19745 - protein, 9 aa, Homo Sapiens
YLLDRLPEM

SEQ ID NO: 19746 - protein, 9 aa, Homo Sapiens
YLLEKFVAV

SEQ ID NO: 19747 - protein, 9 aa, Homo Sapiens
YLLESVNKL

SEQ ID NO: 19748 - protein, 9 aa, Homo Sapiens
YLLHIFMEA

SEQ ID NO: 19749 - protein, 9 aa, Homo Sapiens
YLLPAIVHI

SEQ ID NO: 19750 - protein, 9 aa, Homo Sapiens
YLMEVTHDL

SEQ ID NO: 19751 - protein, 9 aa, Homo Sapiens
YLNDFTHEI

SEQ ID NO: 19752 - protein, 9 aa, Homo Sapiens
YLNDGLWHM

SEQ ID NO: 19753 - protein, 9 aa, Homo Sapiens
YLNDLHEVL

SEQ ID NO: 19754 - protein, 9 aa, Homo Sapiens
YLNDRVDEL

SEQ ID NO: 19755 - protein, 9 aa, Homo Sapiens
YLNETFSEL

SEQ ID NO: 19756 - protein, 9 aa, Homo Sapiens
YLNHLEPPV

SEQ ID NO: 19757 - protein, 9 aa, Homo Sapiens
YLNVQVKEL

SEQ ID NO: 19758 - protein, 9 aa, Homo Sapiens
YLPDAVKGL

SEQ ID NO: 19759 - protein, 9 aa, Homo Sapiens
YLPDIQERL

SEQ ID NO: 19760 - protein, 9 aa, Homo Sapiens
YLPDKLPKV

SEQ ID NO: 19761 - protein, 9 aa, Homo Sapiens
YLPEDFIRV

SEQ ID NO: 19762 - protein, 9 aa, Homo Sapiens
YLPEELAAL

SEQ ID NO: 19763 - protein, 9 aa, Homo Sapiens
YLPEWKENI

SEQ ID NO: 19764 - protein, 9 aa, Homo Sapiens
YLPFIMELL

SEQ ID NO: 19765 - protein, 9 aa, Homo Sapiens
YLPGGTTGL

SEQ ID NO: 19766 - protein, 9 aa, Homo Sapiens
YLPGLFYRV

SEQ ID NO: 19767 - protein, 9 aa, Homo Sapiens
YLPHAPPFA

SEQ ID NO: 19768 - protein, 9 aa, Homo Sapiens
YLPLYVARL

SEQ ID NO: 19769 - protein, 9 aa, Homo Sapiens
YLPPATQVV

SEQ ID NO: 19770 - protein, 9 aa, Homo Sapiens
YLPPGFLSA

SEQ ID NO: 19771 - protein, 9 aa, Homo Sapiens
YLPPGVIAL

SEQ ID NO: 19772 - protein, 9 aa, Homo Sapiens
YLPPSVASI

SEQ ID NO: 19773 - protein, 9 aa, Homo Sapiens
YLPPTVITI

SEQ ID NO: 19774 - protein, 9 aa, Homo Sapiens
YLPQLFYHL

SEQ ID NO: 19775 - protein, 9 aa, Homo Sapiens
YLPQLIPHM

SEQ ID NO: 19776 - protein, 9 aa, Homo Sapiens
YLPRHSIGL

SEQ ID NO: 19777 - protein, 9 aa, Homo Sapiens
YLPSAILQL

SEQ ID NO: 19778 - protein, 9 aa, Homo Sapiens
YLPSFFTKL

SEQ ID NO: 19779 - protein, 9 aa, Homo Sapiens
YLPSQVSRV

SEQ ID NO: 19780 - protein, 9 aa, Homo Sapiens
YLPSSFPVL

SEQ ID NO: 19781 - protein, 9 aa, Homo Sapiens
YLPTHTSLL

SEQ ID NO: 19782 - protein, 9 aa, Homo Sapiens
YLPTKLAAV

SEQ ID NO: 19783 - protein, 9 aa, Homo Sapiens
YLPTLWVKL

SEQ ID NO: 19784 - protein, 9 aa, Homo Sapiens
YLPVGSHNL

SEQ ID NO: 19785 - protein, 9 aa, Homo Sapiens
YLPVKIEQV

SEQ ID NO: 19786 - protein, 9 aa, Homo Sapiens
YLPYPIHQV

SEQ ID NO: 19787 - protein, 9 aa, Homo Sapiens
YLQDVIMQV

SEQ ID NO: 19788 - protein, 9 aa, Homo Sapiens
YLQEIQTQL

SEQ ID NO: 19789 - protein, 9 aa, Homo Sapiens
YLQEVIDVL

SEQ ID NO: 19790 - protein, 9 aa, Homo Sapiens
YLQPFLAKL

SEQ ID NO: 19791 - protein, 9 aa, Homo Sapiens
YLSAKVEAL

SEQ ID NO: 19792 - protein, 9 aa, Homo Sapiens
YLSDNVHLV

SEQ ID NO: 19793 - protein, 9 aa, Homo Sapiens
YLSDPCPGL

SEQ ID NO: 19794 - protein, 9 aa, Homo Sapiens
YLSEEVQAV

SEQ ID NO: 19795 - protein, 9 aa, Homo Sapiens
YLSELSEHV

SEQ ID NO: 19796 - protein, 9 aa, Homo Sapiens
YLSGIAHFL

SEQ ID NO: 19797 - protein, 9 aa, Homo Sapiens
YLSKIIPAL

SEQ ID NO: 19798 - protein, 9 aa, Homo Sapiens
YLSPKLWAL

SEQ ID NO: 19799 - protein, 9 aa, Homo Sapiens
YLSPTFKEV

SEQ ID NO: 19800 - protein, 9 aa, Homo Sapiens
YLSVKIWDL

SEQ ID NO: 19801 - protein, 9 aa, Homo Sapiens
YLTAEILEL

SEQ ID NO: 19802 - protein, 9 aa, Homo Sapiens
YLTDRVMTV

SEQ ID NO: 19803 - protein, 9 aa, Homo Sapiens
YLTEVFLHV

SEQ ID NO: 19804 - protein, 9 aa, Homo Sapiens
YLTHDSPSV

SEQ ID NO: 19805 - protein, 9 aa, Homo Sapiens
YLTKKFAEL

SEQ ID NO: 19806 - protein, 9 aa, Homo Sapiens
YLTPLILTL

SEQ ID NO: 19807 - protein, 9 aa, Homo Sapiens
YLVEDIQHI

SEQ ID NO: 19808 - protein, 9 aa, Homo Sapiens
YLVNDIYEL

SEQ ID NO: 19809 - protein, 9 aa, Homo Sapiens
YLVPELDGV

SEQ ID NO: 19810 - protein, 9 aa, Homo Sapiens
YLVVKIEKV

SEQ ID NO: 19811 - protein, 9 aa, Homo Sapiens
YLWLKLNQV

SEQ ID NO: 19812 - protein, 9 aa, Homo Sapiens
YLWNLQVKL

SEQ ID NO: 19813 - protein, 9 aa, Homo Sapiens
YLYKYLWRL

SEQ ID NO: 19814 - protein, 9 aa, Homo Sapiens
YLYVRAHGV

SEQ ID NO: 19815 - protein, 9 aa, Homo Sapiens
YMAELIERL

SEQ ID NO: 19816 - protein, 9 aa, Homo Sapiens
YMDAPKAAL

SEQ ID NO: 19817 - protein, 9 aa, Homo Sapiens
YMDNDYAKL

SEQ ID NO: 19818 - protein, 9 aa, Homo Sapiens
YMDQIIEYL

SEQ ID NO: 19819 - protein, 9 aa, Homo Sapiens
YMDTLNIFM

SEQ ID NO: 19820 - protein, 9 aa, Homo Sapiens
YMEEIYHRI

SEQ ID NO: 19821 - protein, 9 aa, Homo Sapiens
YMENFIEHL

SEQ ID NO: 19822 - protein, 9 aa, Homo Sapiens
YMIAHITGL

SEQ ID NO: 19823 - protein, 9 aa, Homo Sapiens
YMNHIMVSV

SEQ ID NO: 19824 - protein, 9 aa, Homo Sapiens
YMPDLHPAA

SEQ ID NO: 19825 - protein, 9 aa, Homo Sapiens
YMPPPYASL

SEQ ID NO: 19826 - protein, 9 aa, Homo Sapiens
YMPPTSEAA

SEQ ID NO: 19827 - protein, 9 aa, Homo Sapiens
YMPQNPHII

SEQ ID NO: 19828 - protein, 9 aa, Homo Sapiens
YMSDSFINV

SEQ ID NO: 19829 - protein, 9 aa, Homo Sapiens
YMSPHPSPL

SEQ ID NO: 19830 - protein, 9 aa, Homo Sapiens
YMVHIQVTL

SEQ ID NO: 19831 - protein, 9 aa, Homo Sapiens
YPFPGPIPN

SEQ ID NO: 19832 - protein, 9 aa, Homo Sapiens
YQPYEIPAV

SEQ ID NO: 19833 - protein, 9 aa, Homo Sapiens
YQVGQLYSV

SEQ ID NO: 19834 - protein, 9 aa, Homo Sapiens
YSDDIPHAL

SEQ ID NO: 19835 - protein, 9 aa, Homo Sapiens
YTDKIMTYL

SEQ ID NO: 19836 - protein, 9 aa, Homo Sapiens
YTPPPPPTA

SEQ ID NO: 19837 - protein, 9 aa, Homo Sapiens
YTWEEVFRV

SEQ ID NO: 19838 - protein, 9 aa, Homo Sapiens
YVDAVGQFL

SEQ ID NO: 19839 - protein, 9 aa, Homo Sapiens
YVDDFGVSV

SEQ ID NO: 19840 - protein, 9 aa, Homo Sapiens
YVDDGLISL

SEQ ID NO: 19841 - protein, 9 aa, Homo Sapiens
YVDDVFLRV

SEQ ID NO: 19842 - protein, 9 aa, Homo Sapiens
YVDDVISRI

SEQ ID NO: 19843 - protein, 9 aa, Homo Sapiens
YVDEVMTRL

SEQ ID NO: 19844 - protein, 9 aa, Homo Sapiens
YVDGSTLQL

SEQ ID NO: 19845 - protein, 9 aa, Homo Sapiens
YVDKFYRSL

SEQ ID NO: 19846 - protein, 9 aa, Homo Sapiens
YVDNRFFTL

SEQ ID NO: 19847 - protein, 9 aa, Homo Sapiens
YVDPVNKVL

SEQ ID NO: 19848 - protein, 9 aa, Homo Sapiens
YVDRGYFSI

SEQ ID NO: 19849 - protein, 9 aa, Homo Sapiens
YVDRVFHAI

SEQ ID NO: 19850 - protein, 9 aa, Homo Sapiens
YVDRVTEFL

SEQ ID NO: 19851 - protein, 9 aa, Homo Sapiens
YVDSIQRKL

SEQ ID NO: 19852 - protein, 9 aa, Homo Sapiens
YVDTAVRHV

SEQ ID NO: 19853 - protein, 9 aa, Homo Sapiens
YVDTLLTML

SEQ ID NO: 19854 - protein, 9 aa, Homo Sapiens
YVDVVKVLL

SEQ ID NO: 19855 - protein, 9 aa, Homo Sapiens
YVEPLKLYL

SEQ ID NO: 19856 - protein, 9 aa, Homo Sapiens
YVFPGVTRL

SEQ ID NO: 19857 - protein, 9 aa, Homo Sapiens
YVINVTTHL

SEQ ID NO: 19858 - protein, 9 aa, Homo Sapiens
YVIPCFDSV

SEQ ID NO: 19859 - protein, 9 aa, Homo Sapiens
YVLDLAAKV

SEQ ID NO: 19860 - protein, 9 aa, Homo Sapiens
YVLPVVSYI

SEQ ID NO: 19861 - protein, 9 aa, Homo Sapiens
YVNLPTIAL

SEQ ID NO: 19862 - protein, 9 aa, Homo Sapiens
YVPATKVFL

SEQ ID NO: 19863 - protein, 9 aa, Homo Sapiens
YVPETVYRV

SEQ ID NO: 19864 - protein, 9 aa, Homo Sapiens
YVPPPFAAA

SEQ ID NO: 19865 - protein, 9 aa, Homo Sapiens
YVPTSYVEV

SEQ ID NO: 19866 - protein, 9 aa, Homo Sapiens
YVSEILEKV

SEQ ID NO: 19867 - protein, 9 aa, Homo Sapiens
YVSPKQFSV

SEQ ID NO: 19868 - protein, 9 aa, Homo Sapiens
YVTEELPQL

SEQ ID NO: 19869 - protein, 9 aa, Homo Sapiens
YVVKETIGV

SEQ ID NO: 19870 - protein, 9 aa, Homo Sapiens
YVVPFVAKV

SEQ ID NO: 19871 - protein, 9 aa, Homo Sapiens
YVWPNVFET

SEQ ID NO: 19872 - protein, 9 aa, Homo Sapiens
YVYEYLLHV

SEQ ID NO: 19873 - protein, 9 aa, Homo Sapiens
YVYKVLKQV

SEQ ID NO: 19874 - protein, 10 aa, Homo Sapiens
AGVAPPPTAG

SEQ ID NO: 19875 - protein, 10 aa, Homo Sapiens
ALDDFSISVL

SEQ ID NO: 19876 - protein, 10 aa, Homo Sapiens
ALDDHHALHL

SEQ ID NO: 19877 - protein, 10 aa, Homo Sapiens
ALDDPTPDYM

SEQ ID NO: 19878 - protein, 10 aa, Homo Sapiens
ALDDVTLPRL

SEQ ID NO: 19879 - protein, 10 aa, Homo Sapiens
ALDEAQGVGL

SEQ ID NO: 19880 - protein, 10 aa, Homo Sapiens
ALDEATKYAL

SEQ ID NO: 19881 - protein, 10 aa, Homo Sapiens
ALDEGDIALL

SEQ ID NO: 19882 - protein, 10 aa, Homo Sapiens
ALDEGRSILL

SEQ ID NO: 19883 - protein, 10 aa, Homo Sapiens
ALDEPLARRF

SEQ ID NO: 19884 - protein, 10 aa, Homo Sapiens
ALDEPPYLTV

SEQ ID NO: 19885 - protein, 10 aa, Homo Sapiens
ALDESHNQNL

SEQ ID NO: 19886 - protein, 10 aa, Homo Sapiens
ALDKIDQQYL

SEQ ID NO: 19887 - protein, 10 aa, Homo Sapiens
ALDLVYGNAL

SEQ ID NO: 19888 - protein, 10 aa, Homo Sapiens
ALDSLSWLLL

SEQ ID NO: 19889 - protein, 10 aa, Homo Sapiens
ALDTGFSLNL

SEQ ID NO: 19890 - protein, 10 aa, Homo Sapiens
ALDTLYIMGL

SEQ ID NO: 19891 - protein, 10 aa, Homo Sapiens
ALDTPVMVHM

SEQ ID NO: 19892 - protein, 10 aa, Homo Sapiens
ALDVANKIGI

SEQ ID NO: 19893 - protein, 10 aa, Homo Sapiens
ALEEADKMFL

SEQ ID NO: 19894 - protein, 10 aa, Homo Sapiens
ALPDIKVLTL

SEQ ID NO: 19895 - protein, 10 aa, Homo Sapiens
ALPDQGIAKA

SEQ ID NO: 19896 - protein, 10 aa, Homo Sapiens
ALPEILFAKV

SEQ ID NO: 19897 - protein, 10 aa, Homo Sapiens
ALPELYFQKV

SEQ ID NO: 19898 - protein, 10 aa, Homo Sapiens
ALPQTLPEIF

SEQ ID NO: 19899 - protein, 10 aa, Homo Sapiens
ALPRLLPALA

SEQ ID NO: 19900 - protein, 10 aa, Homo Sapiens
ALPTIAFAFV

SEQ ID NO: 19901 - protein, 10 aa, Homo Sapiens
ALQDVPLSSV

SEQ ID NO: 19902 - protein, 10 aa, Homo Sapiens
ALWEDEGVRA

SEQ ID NO: 19903 - protein, 10 aa, Homo Sapiens
AMPPPPPQGV

SEQ ID NO: 19904 - protein, 10 aa, Homo Sapiens
ASLDKFLANV

SEQ ID NO: 19905 - protein, 10 aa, Homo Sapiens
ASPGSGIVPV

SEQ ID NO: 19906 - protein, 10 aa, Homo Sapiens
AVDEDRKMYL

SEQ ID NO: 19907 - protein, 10 aa, Homo Sapiens
AVDPNRAVPL

SEQ ID NO: 19908 - protein, 10 aa, Homo Sapiens
AVDPVFQAKM

SEQ ID NO: 19909 - protein, 10 aa, Homo Sapiens
AVDVEGLYTL

SEQ ID NO: 19910 - protein, 10 aa, Homo Sapiens
AVPELPGPSV

SEQ ID NO: 19911 - protein, 10 aa, Homo Sapiens
FADGVYLVLL

SEQ ID NO: 19912 - protein, 10 aa, Homo Sapiens
FADPIYQAGL

SEQ ID NO: 19913 - protein, 10 aa, Homo Sapiens
FAPAVGPALG

SEQ ID NO: 19914 - protein, 10 aa, Homo Sapiens
FAPVNVTTEV

SEQ ID NO: 19915 - protein, 10 aa, Homo Sapiens
FGPEEDTAYL

SEQ ID NO: 19916 - protein, 10 aa, Homo Sapiens
FIDDVVSAVL

SEQ ID NO: 19917 - protein, 10 aa, Homo Sapiens
FIDEGVNIGL

SEQ ID NO: 19918 - protein, 10 aa, Homo Sapiens
FIDKFTPPVV

SEQ ID NO: 19919 - protein, 10 aa, Homo Sapiens
FIPPDGNFRL

SEQ ID NO: 19920 - protein, 10 aa, Homo Sapiens
FLDAVHQNRL

SEQ ID NO: 19921 - protein, 10 aa, Homo Sapiens
FLDDAFRKNL

SEQ ID NO: 19922 - protein, 10 aa, Homo Sapiens
FLDDVFEVKL

SEQ ID NO: 19923 - protein, 10 aa, Homo Sapiens
FLDDVVHSLL

SEQ ID NO: 19924 - protein, 10 aa, Homo Sapiens
FLDEAAARLL

SEQ ID NO: 19925 - protein, 10 aa, Homo Sapiens
FLDEHHSVNF

SEQ ID NO: 19926 - protein, 10 aa, Homo Sapiens
FLDEKTHELL

SEQ ID NO: 19927 - protein, 10 aa, Homo Sapiens
FLDFLTRPEL

SEQ ID NO: 19928 - protein, 10 aa, Homo Sapiens
FLDHIGGTRL

SEQ ID NO: 19929 - protein, 10 aa, Homo Sapiens
FLDHPEIYRS

SEQ ID NO: 19930 - protein, 10 aa, Homo Sapiens
FLDKPEDVLL

SEQ ID NO: 19931 - protein, 10 aa, Homo Sapiens
FLDLIPQDTL

SEQ ID NO: 19932 - protein, 10 aa, Homo Sapiens
FLDLLKDAGL

SEQ ID NO: 19933 - protein, 10 aa, Homo Sapiens
FLDNLHINLL

SEQ ID NO: 19934 - protein, 10 aa, Homo Sapiens
FLDPEIKAFL

SEQ ID NO: 19935 - protein, 10 aa, Homo Sapiens
FLDPPPYETL

SEQ ID NO: 19936 - protein, 10 aa, Homo Sapiens
FLDPPYSRVI

SEQ ID NO: 19937 - protein, 10 aa, Homo Sapiens
FLDPVIKTSF

SEQ ID NO: 19938 - protein, 10 aa, Homo Sapiens
FLDSLPDVKI

SEQ ID NO: 19939 - protein, 10 aa, Homo Sapiens
FLDSPNKYSL

SEQ ID NO: 19940 - protein, 10 aa, Homo Sapiens
FLDTISDFHL

SEQ ID NO: 19941 - protein, 10 aa, Homo Sapiens
FLFDGSPTYV

SEQ ID NO: 19942 - protein, 10 aa, Homo Sapiens
FLIEEQKIVV

SEQ ID NO: 19943 - protein, 10 aa, Homo Sapiens
FLLDGFPRTV

SEQ ID NO: 19944 - protein, 10 aa, Homo Sapiens
FLLEPGNLEV

SEQ ID NO: 19945 - protein, 10 aa, Homo Sapiens
FLLSLRGAGA

SEQ ID NO: 19946 - protein, 10 aa, Homo Sapiens
FLPDEPYIKV

SEQ ID NO: 19947 - protein, 10 aa, Homo Sapiens
FLPDGMEARL

SEQ ID NO: 19948 - protein, 10 aa, Homo Sapiens
FLPDHINIVL

SEQ ID NO: 19949 - protein, 10 aa, Homo Sapiens
FLPEAPAELL

SEQ ID NO: 19950 - protein, 10 aa, Homo Sapiens
FLPEGQDIGA

SEQ ID NO: 19951 - protein, 10 aa, Homo Sapiens
FLPESKIIFL

SEQ ID NO: 19952 - protein, 10 aa, Homo Sapiens
FLPPDPTYTL

SEQ ID NO: 19953 - protein, 10 aa, Homo Sapiens
FLPPEPTYTV

SEQ ID NO: 19954 - protein, 10 aa, Homo Sapiens
FLPPGYKIEV

SEQ ID NO: 19955 - protein, 10 aa, Homo Sapiens
FLPRKFPSLR

SEQ ID NO: 19956 - protein, 10 aa, Homo Sapiens
FLPSHSLDTV

SEQ ID NO: 19957 - protein, 10 aa, Homo Sapiens
FLSEHPNVTL

SEQ ID NO: 19958 - protein, 10 aa, Homo Sapiens
FLWERPTLLV

SEQ ID NO: 19959 - protein, 10 aa, Homo Sapiens
FMDDTSRSII

SEQ ID NO: 19960 - protein, 10 aa, Homo Sapiens
FMDDVGQTLL

SEQ ID NO: 19961 - protein, 10 aa, Homo Sapiens
FMDPGPEGKL

SEQ ID NO: 19962 - protein, 10 aa, Homo Sapiens
FMDTLSDLKM

SEQ ID NO: 19963 - protein, 10 aa, Homo Sapiens
FMFDEKLVTV

SEQ ID NO: 19964 - protein, 10 aa, Homo Sapiens
FVDDETKLTL

SEQ ID NO: 19965 - protein, 10 aa, Homo Sapiens
FVDDGTETHF

SEQ ID NO: 19966 - protein, 10 aa, Homo Sapiens
FVDDVTIEDL

SEQ ID NO: 19967 - protein, 10 aa, Homo Sapiens
FVDEVHAVGL

SEQ ID NO: 19968 - protein, 10 aa, Homo Sapiens
FVDLLDGENL

SEQ ID NO: 19969 - protein, 10 aa, Homo Sapiens
FVDMVARPSM

SEQ ID NO: 19970 - protein, 10 aa, Homo Sapiens
FVDNPVGTGF

SEQ ID NO: 19971 - protein, 10 aa, Homo Sapiens
FVDPNGKISL

SEQ ID NO: 19972 - protein, 10 aa, Homo Sapiens
FVDTDADTRL

SEQ ID NO: 19973 - protein, 10 aa, Homo Sapiens
FVDTDSDIRL

SEQ ID NO: 19974 - protein, 10 aa, Homo Sapiens
FVDTDSDVRL

SEQ ID NO: 19975 - protein, 10 aa, Homo Sapiens
FVDYVAVEQL

SEQ ID NO: 19976 - protein, 10 aa, Homo Sapiens
GIDPPRGVLM

SEQ ID NO: 19977 - protein, 10 aa, Homo Sapiens
GLASRKPLVL

SEQ ID NO: 19978 - protein, 10 aa, Homo Sapiens
GLDDIKDLKV

SEQ ID NO: 19979 - protein, 10 aa, Homo Sapiens
GLDEAKEILL

SEQ ID NO: 19980 - protein, 10 aa, Homo Sapiens
GLDEVIFSYV

SEQ ID NO: 19981 - protein, 10 aa, Homo Sapiens
GLDPNKPPEL

SEQ ID NO: 19982 - protein, 10 aa, Homo Sapiens
GLDPVGRIQM

SEQ ID NO: 19983 - protein, 10 aa, Homo Sapiens
GLDQQYDIYL

SEQ ID NO: 19984 - protein, 10 aa, Homo Sapiens
GLPGPPYHSL

SEQ ID NO: 19985 - protein, 10 aa, Homo Sapiens
GLPRFGIEMV

SEQ ID NO: 19986 - protein, 10 aa, Homo Sapiens
GLYDGPVCEV

SEQ ID NO: 19987 - protein, 10 aa, Homo Sapiens
GVTLDLIEKI

SEQ ID NO: 19988 - protein, 10 aa, Homo Sapiens
HLDEDKHFVV

SEQ ID NO: 19989 - protein, 10 aa, Homo Sapiens
HLDLPSNNNL

SEQ ID NO: 19990 - protein, 10 aa, Homo Sapiens
HLDPSLANYL

SEQ ID NO: 19991 - protein, 10 aa, Homo Sapiens
HLDSMDWLEL

SEQ ID NO: 19992 - protein, 10 aa, Homo Sapiens
HLDYVDTERI

SEQ ID NO: 19993 - protein, 10 aa, Homo Sapiens
HLPEQAFYMV

SEQ ID NO: 19994 - protein, 10 aa, Homo Sapiens
HQPHQPLPPT

SEQ ID NO: 19995 - protein, 10 aa, Homo Sapiens
HVDEFIDELL

SEQ ID NO: 19996 - protein, 10 aa, Homo Sapiens
HVDGIHLHVA

SEQ ID NO: 19997 - protein, 10 aa, Homo Sapiens
IIDAIVDFSS

SEQ ID NO: 19998 - protein, 10 aa, Homo Sapiens
IIDDHPEVTV

SEQ ID NO: 19999 - protein, 10 aa, Homo Sapiens
IIDEDGLLNL

SEQ ID NO: 20000 - protein, 10 aa, Homo Sapiens
IIDNSQGFYV

SEQ ID NO: 20001 - protein, 10 aa, Homo Sapiens
IIDPNHEIEF

SEQ ID NO: 20002 - protein, 10 aa, Homo Sapiens
IIDQHTFEVL

SEQ ID NO: 20003 - protein, 10 aa, Homo Sapiens
IIEENIPELL

SEQ ID NO: 20004 - protein, 10 aa, Homo Sapiens
IIEQLDPVSF

SEQ ID NO: 20005 - protein, 10 aa, Homo Sapiens
IISNPRDIQM

SEQ ID NO: 20006 - protein, 10 aa, Homo Sapiens
ILDACTFALL

SEQ ID NO: 20007 - protein, 10 aa, Homo Sapiens
ILDDLFLHTL

SEQ ID NO: 20008 - protein, 10 aa, Homo Sapiens
ILDDSFIEGV

SEQ ID NO: 20009 - protein, 10 aa, Homo Sapiens
ILDDVSLTHL

SEQ ID NO: 20010 - protein, 10 aa, Homo Sapiens
ILDEAHERTI

SEQ ID NO: 20011 - protein, 10 aa, Homo Sapiens
ILDEDKESTF

SEQ ID NO: 20012 - protein, 10 aa, Homo Sapiens
ILDESDHITM

SEQ ID NO: 20013 - protein, 10 aa, Homo Sapiens
ILDESHERVF

SEQ ID NO: 20014 - protein, 10 aa, Homo Sapiens
ILDETQHLDI

SEQ ID NO: 20015 - protein, 10 aa, Homo Sapiens
ILDGISNIKL

SEQ ID NO: 20016 - protein, 10 aa, Homo Sapiens
ILDKVILPQL

SEQ ID NO: 20017 - protein, 10 aa, Homo Sapiens
ILDNVIQPLV

SEQ ID NO: 20018 - protein, 10 aa, Homo Sapiens
ILDPFILVFL

SEQ ID NO: 20019 - protein, 10 aa, Homo Sapiens
ILDQPYDVNL

SEQ ID NO: 20020 - protein, 10 aa, Homo Sapiens
ILFVITKPDV

SEQ ID NO: 20021 - protein, 10 aa, Homo Sapiens
ILPDDIGAAL

SEQ ID NO: 20022 - protein, 10 aa, Homo Sapiens
ILPDITKDEL

SEQ ID NO: 20023 - protein, 10 aa, Homo Sapiens
ILPEAQDYFL

SEQ ID NO: 20024 - protein, 10 aa, Homo Sapiens
ILPEELQAWV

SEQ ID NO: 20025 - protein, 10 aa, Homo Sapiens
ILPEVENDRL

SEQ ID NO: 20026 - protein, 10 aa, Homo Sapiens
ILPGLSVMGV

SEQ ID NO: 20027 - protein, 10 aa, Homo Sapiens
ILPLMKFLEV

SEQ ID NO: 20028 - protein, 10 aa, Homo Sapiens
ILPPDHLNGV

SEQ ID NO: 20029 - protein, 10 aa, Homo Sapiens
ILPYSFIIGV

SEQ ID NO: 20030 - protein, 10 aa, Homo Sapiens
ILWEHLEQMI

SEQ ID NO: 20031 - protein, 10 aa, Homo Sapiens
ILWQLTGSAA

SEQ ID NO: 20032 - protein, 10 aa, Homo Sapiens
IMDTPGHVNF

SEQ ID NO: 20033 - protein, 10 aa, Homo Sapiens
IMPAFIFEHI

SEQ ID NO: 20034 - protein, 10 aa, Homo Sapiens
IQLTQMSLQL

SEQ ID NO: 20035 - protein, 10 aa, Homo Sapiens
ITPENLPQIL

SEQ ID NO: 20036 - protein, 10 aa, Homo Sapiens
IVDLIHDIQI

SEQ ID NO: 20037 - protein, 10 aa, Homo Sapiens
IVDSFDDMNL

SEQ ID NO: 20038 - protein, 10 aa, Homo Sapiens
IVPDDFETML

SEQ ID NO: 20039 - protein, 10 aa, Homo Sapiens
KIDAFHYVQL

SEQ ID NO: 20040 - protein, 10 aa, Homo Sapiens
KIDDILQTLL

SEQ ID NO: 20041 - protein, 10 aa, Homo Sapiens
KIDEHHFVAV

SEQ ID NO: 20042 - protein, 10 aa, Homo Sapiens
KIDPDLGYSF

SEQ ID NO: 20043 - protein, 10 aa, Homo Sapiens
KIDPDYSVYV

SEQ ID NO: 20044 - protein, 10 aa, Homo Sapiens
KIFDEILVNA

SEQ ID NO: 20045 - protein, 10 aa, Homo Sapiens
KIFSGVFVKV

SEQ ID NO: 20046 - protein, 10 aa, Homo Sapiens
KIIEDLGVHF

SEQ ID NO: 20047 - protein, 10 aa, Homo Sapiens
KLDDIFEPVL

SEQ ID NO: 20048 - protein, 10 aa, Homo Sapiens
KLDDIVQHIY

SEQ ID NO: 20049 - protein, 10 aa, Homo Sapiens
KLDDLYQQKI

SEQ ID NO: 20050 - protein, 10 aa, Homo Sapiens
KLDEALAQYF

SEQ ID NO: 20051 - protein, 10 aa, Homo Sapiens
KLDEIYVAGL

SEQ ID NO: 20052 - protein, 10 aa, Homo Sapiens
KLDFANNVQL

SEQ ID NO: 20053 - protein, 10 aa, Homo Sapiens
KLDSPAGTAL

SEQ ID NO: 20054 - protein, 10 aa, Homo Sapiens
KLEDVLPLAF

SEQ ID NO: 20055 - protein, 10 aa, Homo Sapiens
KLPDLPQNSV

SEQ ID NO: 20056 - protein, 10 aa, Homo Sapiens
KLPEDFAVVF

SEQ ID NO: 20057 - protein, 10 aa, Homo Sapiens
KLPEPLEDGL

SEQ ID NO: 20058 - protein, 10 aa, Homo Sapiens
KLPPVLAIQL

SEQ ID NO: 20059 - protein, 10 aa, Homo Sapiens
KLPWPEWMGV

SEQ ID NO: 20060 - protein, 10 aa, Homo Sapiens
KLQEFELPYV

SEQ ID NO: 20061 - protein, 10 aa, Homo Sapiens
KLWDPFSLEE

SEQ ID NO: 20062 - protein, 10 aa, Homo Sapiens
KLWEMDNMLI

SEQ ID NO: 20063 - protein, 10 aa, Homo Sapiens
KLYNPENIYL

SEQ ID NO: 20064 - protein, 10 aa, Homo Sapiens
KMDEVLYSIA

SEQ ID NO: 20065 - protein, 10 aa, Homo Sapiens
KMIEDLQNEL

SEQ ID NO: 20066 - protein, 10 aa, Homo Sapiens
KMPDFGQVTV

SEQ ID NO: 20067 - protein, 10 aa, Homo Sapiens
KMPEVITIHL

SEQ ID NO: 20068 - protein, 10 aa, Homo Sapiens
KMPSGEFARI

SEQ ID NO: 20069 - protein, 10 aa, Homo Sapiens
KVDDVVKRLL

SEQ ID NO: 20070 - protein, 10 aa, Homo Sapiens
KVDFPTAIGM

SEQ ID NO: 20071 - protein, 10 aa, Homo Sapiens
KVDPLFTELL

SEQ ID NO: 20072 - protein, 10 aa, Homo Sapiens
KVDPVVFVTL

SEQ ID NO: 20073 - protein, 10 aa, Homo Sapiens
KVFDPVPVGV

SEQ ID NO: 20074 - protein, 10 aa, Homo Sapiens
KVPQLEIVPN

SEQ ID NO: 20075 - protein, 10 aa, Homo Sapiens
LAPSHGLVSV

SEQ ID NO: 20076 - protein, 10 aa, Homo Sapiens
LIDDLHSQML

SEQ ID NO: 20077 - protein, 10 aa, Homo Sapiens
LIDENYLDRL

SEQ ID NO: 20078 - protein, 10 aa, Homo Sapiens
LIDESVHALF

SEQ ID NO: 20079 - protein, 10 aa, Homo Sapiens
LIDWINDVLV

SEQ ID NO: 20080 - protein, 10 aa, Homo Sapiens
LIFDQSGTYL

SEQ ID NO: 20081 - protein, 10 aa, Homo Sapiens
LISGVGIFMM

SEQ ID NO: 20082 - protein, 10 aa, Homo Sapiens
LLDADMNIKI

SEQ ID NO: 20083 - protein, 10 aa, Homo Sapiens
LLDDHGHIRI

SEQ ID NO: 20084 - protein, 10 aa, Homo Sapiens
LLDDNMQIRL

SEQ ID NO: 20085 - protein, 10 aa, Homo Sapiens
LLDDRHDSGL

SEQ ID NO: 20086 - protein, 10 aa, Homo Sapiens
LLDDSLVSIF

SEQ ID NO: 20087 - protein, 10 aa, Homo Sapiens
LLDEARNYHL

SEQ ID NO: 20088 - protein, 10 aa, Homo Sapiens
LLDEDLRQTV

SEQ ID NO: 20089 - protein, 10 aa, Homo Sapiens
LLDEEGHIKI

SEQ ID NO: 20090 - protein, 10 aa, Homo Sapiens
LLDEEGTFSL

SEQ ID NO: 20091 - protein, 10 aa, Homo Sapiens
LLDEEVSRTL

SEQ ID NO: 20092 - protein, 10 aa, Homo Sapiens
LLDELTHEFL

SEQ ID NO: 20093 - protein, 10 aa, Homo Sapiens
LLDENGVLKL

SEQ ID NO: 20094 - protein, 10 aa, Homo Sapiens
LLDEPYLDRL

SEQ ID NO: 20095 - protein, 10 aa, Homo Sapiens
LLDEVALEGL

SEQ ID NO: 20096 - protein, 10 aa, Homo Sapiens
LLDHLSIVYV

SEQ ID NO: 20097 - protein, 10 aa, Homo Sapiens
LLDHPNGDGL

SEQ ID NO: 20098 - protein, 10 aa, Homo Sapiens
LLDKLYALGL

SEQ ID NO: 20099 - protein, 10 aa, Homo Sapiens
LLDLPFRVGV

SEQ ID NO: 20100 - protein, 10 aa, Homo Sapiens
LLDNNIGLVL

SEQ ID NO: 20101 - protein, 10 aa, Homo Sapiens
LLDPNIYRTM

SEQ ID NO: 20102 - protein, 10 aa, Homo Sapiens
LLDSGAFHLL

SEQ ID NO: 20103 - protein, 10 aa, Homo Sapiens
LLDSPGKVLL

SEQ ID NO: 20104 - protein, 10 aa, Homo Sapiens
LLDTMVDTFL

SEQ ID NO: 20105 - protein, 10 aa, Homo Sapiens
LLDYIDKEII

SEQ ID NO: 20106 - protein, 10 aa, Homo Sapiens
LLNPAYDVYL

SEQ ID NO: 20107 - protein, 10 aa, Homo Sapiens
LLPDDKLTLF

SEQ ID NO: 20108 - protein, 10 aa, Homo Sapiens
LLPDQPPYHL

SEQ ID NO: 20109 - protein, 10 aa, Homo Sapiens
LLPDTILEKL

SEQ ID NO: 20110 - protein, 10 aa, Homo Sapiens
LLPDYYLVTV

SEQ ID NO: 20111 - protein, 10 aa, Homo Sapiens
LLPEDTPPFL

SEQ ID NO: 20112 - protein, 10 aa, Homo Sapiens
LLPEEPVSQL

SEQ ID NO: 20113 - protein, 10 aa, Homo Sapiens
LLPEGGITAI

SEQ ID NO: 20114 - protein, 10 aa, Homo Sapiens
LLPEIMPGLI

SEQ ID NO: 20115 - protein, 10 aa, Homo Sapiens
LLPELRDWGV

SEQ ID NO: 20116 - protein, 10 aa, Homo Sapiens
LLPENLKEGL

SEQ ID NO: 20117 - protein, 10 aa, Homo Sapiens
LLPEPNILQL

SEQ ID NO: 20118 - protein, 10 aa, Homo Sapiens
LLPEYVVPYM

SEQ ID NO: 20119 - protein, 10 aa, Homo Sapiens
LLPLLLPALA

SEQ ID NO: 20120 - protein, 10 aa, Homo Sapiens
LLPPDALVGL

SEQ ID NO: 20121 - protein, 10 aa, Homo Sapiens
LLPPEPDYSL

SEQ ID NO: 20122 - protein, 10 aa, Homo Sapiens
LLPSEGIVHL

SEQ ID NO: 20123 - protein, 10 aa, Homo Sapiens
LLPVDIRQYL

SEQ ID NO: 20124 - protein, 10 aa, Homo Sapiens
LMDTLFNTKF

SEQ ID NO: 20125 - protein, 10 aa, Homo Sapiens
LMPRPLPYHL

SEQ ID NO: 20126 - protein, 10 aa, Homo Sapiens
LVDDIGDVTI

SEQ ID NO: 20127 - protein, 10 aa, Homo Sapiens
LVDEIMRAGM

SEQ ID NO: 20128 - protein, 10 aa, Homo Sapiens
LVDHAYETYF

SEQ ID NO: 20129 - protein, 10 aa, Homo Sapiens
LVDNITGQRL

SEQ ID NO: 20130 - protein, 10 aa, Homo Sapiens
LVDNNFQHSV

SEQ ID NO: 20131 - protein, 10 aa, Homo Sapiens
LVPDLSNFYA

SEQ ID NO: 20132 - protein, 10 aa, Homo Sapiens
LVPTSGIYFV

SEQ ID NO: 20133 - protein, 10 aa, Homo Sapiens
MLPDPQNISL

SEQ ID NO: 20134 - protein, 10 aa, Homo Sapiens
MLPHAPGVQM

SEQ ID NO: 20135 - protein, 10 aa, Homo Sapiens
MLPHYEPIPF

SEQ ID NO: 20136 - protein, 10 aa, Homo Sapiens
MVDEVSGKVL

SEQ ID NO: 20137 - protein, 10 aa, Homo Sapiens
MVDGTLLLLL

SEQ ID NO: 20138 - protein, 10 aa, Homo Sapiens
MVDPVTGDKL

SEQ ID NO: 20139 - protein, 10 aa, Homo Sapiens
NIDEIYKALS

SEQ ID NO: 20140 - protein, 10 aa, Homo Sapiens
NIDETYGVNV

SEQ ID NO: 20141 - protein, 10 aa, Homo Sapiens
NIDSIIQRLL

SEQ ID NO: 20142 - protein, 10 aa, Homo Sapiens
NIPAFLPNVL

SEQ ID NO: 20143 - protein, 10 aa, Homo Sapiens
NIPPHLQWEV

SEQ ID NO: 20144 - protein, 10 aa, Homo Sapiens
NLDVPHSYSV

SEQ ID NO: 20145 - protein, 10 aa, Homo Sapiens
NLDVPTFVSF

SEQ ID NO: 20146 - protein, 10 aa, Homo Sapiens
NLPEAGDSRV

SEQ ID NO: 20147 - protein, 10 aa, Homo Sapiens
NLPEYLPFVL

SEQ ID NO: 20148 - protein, 10 aa, Homo Sapiens
NMDSVFKELL

SEQ ID NO: 20149 - protein, 10 aa, Homo Sapiens
NVDKVFFDLM

SEQ ID NO: 20150 - protein, 10 aa, Homo Sapiens
NVDSLITRLL

SEQ ID NO: 20151 - protein, 10 aa, Homo Sapiens
NVIGEPFLNV

SEQ ID NO: 20152 - protein, 10 aa, Homo Sapiens
NVPEGLLATV

SEQ ID NO: 20153 - protein, 10 aa, Homo Sapiens
PGKMGEPGLP

SEQ ID NO: 20154 - protein, 10 aa, Homo Sapiens
QIDGVTEDKL

SEQ ID NO: 20155 - protein, 10 aa, Homo Sapiens
QLDDLYLIAI

SEQ ID NO: 20156 - protein, 10 aa, Homo Sapiens
QLDEARGLLL

SEQ ID NO: 20157 - protein, 10 aa, Homo Sapiens
QMPETTETVL

SEQ ID NO: 20158 - protein, 10 aa, Homo Sapiens
QVDKVNFHMF

SEQ ID NO: 20159 - protein, 10 aa, Homo Sapiens
RGPPQPLPAV

SEQ ID NO: 20160 - protein, 10 aa, Homo Sapiens
RIDPFVRTFL

SEQ ID NO: 20161 - protein, 10 aa, Homo Sapiens
RIKELPELWL

SEQ ID NO: 20162 - protein, 10 aa, Homo Sapiens
RLDDFWSLKL

SEQ ID NO: 20163 - protein, 10 aa, Homo Sapiens
RLDDLFLESF

SEQ ID NO: 20164 - protein, 10 aa, Homo Sapiens
RLDDSSFLGL

SEQ ID NO: 20165 - protein, 10 aa, Homo Sapiens
RLDEALRLYL

SEQ ID NO: 20166 - protein, 10 aa, Homo Sapiens
RLDEIFQTGL

SEQ ID NO: 20167 - protein, 10 aa, Homo Sapiens
RLDELGGVYL

SEQ ID NO: 20168 - protein, 10 aa, Homo Sapiens
RLDEPLASYI

SEQ ID NO: 20169 - protein, 10 aa, Homo Sapiens
RLDESAFVGL

SEQ ID NO: 20170 - protein, 10 aa, Homo Sapiens
RLPDPFTPNL

SEQ ID NO: 20171 - protein, 10 aa, Homo Sapiens
RLPEASVHRA

SEQ ID NO: 20172 - protein, 10 aa, Homo Sapiens
RLPPEYASTV

SEQ ID NO: 20173 - protein, 10 aa, Homo Sapiens
RLQEDPPVGV

SEQ ID NO: 20174 - protein, 10 aa, Homo Sapiens
RLYEITIEVF

SEQ ID NO: 20175 - protein, 10 aa, Homo Sapiens
RMDPLEAIQL

SEQ ID NO: 20176 - protein, 10 aa, Homo Sapiens
RMDPVNNINV

SEQ ID NO: 20177 - protein, 10 aa, Homo Sapiens
RVDESLNIKV

SEQ ID NO: 20178 - protein, 10 aa, Homo Sapiens
RVDEVFEDAF

SEQ ID NO: 20179 - protein, 10 aa, Homo Sapiens
RVPSDPFTGV

SEQ ID NO: 20180 - protein, 10 aa, Homo Sapiens
SADPFYWMRV

SEQ ID NO: 20181 - protein, 10 aa, Homo Sapiens
SIIEYLPTLR

SEQ ID NO: 20182 - protein, 10 aa, Homo Sapiens
SISTLELFTV

SEQ ID NO: 20183 - protein, 10 aa, Homo Sapiens
SIVDLPVHQL

SEQ ID NO: 20184 - protein, 10 aa, Homo Sapiens
SLAGLGAYQL

SEQ ID NO: 20185 - protein, 10 aa, Homo Sapiens
SLDDIYMIGV

SEQ ID NO: 20186 - protein, 10 aa, Homo Sapiens
SLDDLTNLVV

SEQ ID NO: 20187 - protein, 10 aa, Homo Sapiens
SLDDPNRISL

SEQ ID NO: 20188 - protein, 10 aa, Homo Sapiens
SLDDVEGMSV

SEQ ID NO: 20189 - protein, 10 aa, Homo Sapiens
SLDEAIDMRF

SEQ ID NO: 20190 - protein, 10 aa, Homo Sapiens
SLDEPLDLKL

SEQ ID NO: 20191 - protein, 10 aa, Homo Sapiens
SLDEPSVKTM

SEQ ID NO: 20192 - protein, 10 aa, Homo Sapiens
SLDEQYKHQL

SEQ ID NO: 20193 - protein, 10 aa, Homo Sapiens
SLDERIYVKM

SEQ ID NO: 20194 - protein, 10 aa, Homo Sapiens
SLDGLAVVNV

SEQ ID NO: 20195 - protein, 10 aa, Homo Sapiens
SLDPSRPVTF

SEQ ID NO: 20196 - protein, 10 aa, Homo Sapiens
SLDSLGDVFL

SEQ ID NO: 20197 - protein, 10 aa, Homo Sapiens
SLDSVFSDKL

SEQ ID NO: 20198 - protein, 10 aa, Homo Sapiens
SLEGIPLAQV

SEQ ID NO: 20199 - protein, 10 aa, Homo Sapiens
SLEKSVLLEL

SEQ ID NO: 20200 - protein, 10 aa, Homo Sapiens
SLKDMDLVEV

SEQ ID NO: 20201 - protein, 10 aa, Homo Sapiens
SLLELPHPLL

SEQ ID NO: 20202 - protein, 10 aa, Homo Sapiens
SLPDFGISYV

SEQ ID NO: 20203 - protein, 10 aa, Homo Sapiens
SLPEVLNHNL

SEQ ID NO: 20204 - protein, 10 aa, Homo Sapiens
SLPGTDLPSL

SEQ ID NO: 20205 - protein, 10 aa, Homo Sapiens
SLPSSPPPQL

SEQ ID NO: 20206 - protein, 10 aa, Homo Sapiens
SLRDLPAQLL

SEQ ID NO: 20207 - protein, 10 aa, Homo Sapiens
SLSELQISYV

SEQ ID NO: 20208 - protein, 10 aa, Homo Sapiens
SLWEDFSQSL

SEQ ID NO: 20209 - protein, 10 aa, Homo Sapiens
SLYLGEVFTQ

SEQ ID NO: 20210 - protein, 10 aa, Homo Sapiens
SVDDIHFLVL

SEQ ID NO: 20211 - protein, 10 aa, Homo Sapiens
SVDEDFCHYL

SEQ ID NO: 20212 - protein, 10 aa, Homo Sapiens
SVDEDYDLRL

SEQ ID NO: 20213 - protein, 10 aa, Homo Sapiens
SVDEVYEFIP

SEQ ID NO: 20214 - protein, 10 aa, Homo Sapiens
SVDVADLIGL

SEQ ID NO: 20215 - protein, 10 aa, Homo Sapiens
SVVGIPVFRV

SEQ ID NO: 20216 - protein, 10 aa, Homo Sapiens
TIDEGYVYGL

SEQ ID NO: 20217 - protein, 10 aa, Homo Sapiens
TIDPFWDISL

SEQ ID NO: 20218 - protein, 10 aa, Homo Sapiens
TIDPIPHQLL

SEQ ID NO: 20219 - protein, 10 aa, Homo Sapiens
TIPDFIFANV

SEQ ID NO: 20220 - protein, 10 aa, Homo Sapiens
TLDALFNIMM

SEQ ID NO: 20221 - protein, 10 aa, Homo Sapiens
TLDEIIDNHI

SEQ ID NO: 20222 - protein, 10 aa, Homo Sapiens
TLDGLPPLRL

SEQ ID NO: 20223 - protein, 10 aa, Homo Sapiens
TLDGLTKIQV

SEQ ID NO: 20224 - protein, 10 aa, Homo Sapiens
TLPEPVGTQV

SEQ ID NO: 20225 - protein, 10 aa, Homo Sapiens
TLPEVVGCEL

SEQ ID NO: 20226 - protein, 10 aa, Homo Sapiens
TLSEPRQAEI

SEQ ID NO: 20227 - protein, 10 aa, Homo Sapiens
TLWEIAKAEV

SEQ ID NO: 20228 - protein, 10 aa, Homo Sapiens
TPGNRIVYLY

SEQ ID NO: 20229 - protein, 10 aa, Homo Sapiens
TPVQTVTIVQ

SEQ ID NO: 20230 - protein, 10 aa, Homo Sapiens
TTEGIPVLIV

SEQ ID NO: 20231 - protein, 10 aa, Homo Sapiens
TVDDPYATFV

SEQ ID NO: 20232 - protein, 10 aa, Homo Sapiens
TVDPETQARL

SEQ ID NO: 20233 - protein, 10 aa, Homo Sapiens
TVDPYFHDRV

SEQ ID NO: 20234 - protein, 10 aa, Homo Sapiens
VELVDESLFD

SEQ ID NO: 20235 - protein, 10 aa, Homo Sapiens
VIDEIGKMEL

SEQ ID NO: 20236 - protein, 10 aa, Homo Sapiens
VLDDKDYFLF

SEQ ID NO: 20237 - protein, 10 aa, Homo Sapiens
VLDDPKHIQL

SEQ ID NO: 20238 - protein, 10 aa, Homo Sapiens
VLDDPKSAGV

SEQ ID NO: 20239 - protein, 10 aa, Homo Sapiens
VLDDVPVQGF

SEQ ID NO: 20240 - protein, 10 aa, Homo Sapiens
VLDENKNTAL

SEQ ID NO: 20241 - protein, 10 aa, Homo Sapiens
VLDETRTAYI

SEQ ID NO: 20242 - protein, 10 aa, Homo Sapiens
VLDFGRPIAM

SEQ ID NO: 20243 - protein, 10 aa, Homo Sapiens
VLDIPQERGL

SEQ ID NO: 20244 - protein, 10 aa, Homo Sapiens
VLDPDEGIRF

SEQ ID NO: 20245 - protein, 10 aa, Homo Sapiens
VLDPDLRMTF

SEQ ID NO: 20246 - protein, 10 aa, Homo Sapiens
VLDPPTDLKF

SEQ ID NO: 20247 - protein, 10 aa, Homo Sapiens
VLDSEYLVTL

SEQ ID NO: 20248 - protein, 10 aa, Homo Sapiens
VLDTGASIHL

SEQ ID NO: 20249 - protein, 10 aa, Homo Sapiens
VLPAEFFEVL

SEQ ID NO: 20250 - protein, 10 aa, Homo Sapiens
VLPAGALHQV

SEQ ID NO: 20251 - protein, 10 aa, Homo Sapiens
VLPDSVEIGL

SEQ ID NO: 20252 - protein, 10 aa, Homo Sapiens
VLPEIDPVLF

SEQ ID NO: 20253 - protein, 10 aa, Homo Sapiens
VLPELDDLTV

SEQ ID NO: 20254 - protein, 10 aa, Homo Sapiens
VLPLRGFLGI

SEQ ID NO: 20255 - protein, 10 aa, Homo Sapiens
VLPNFLPYNV

SEQ ID NO: 20256 - protein, 10 aa, Homo Sapiens
VLPPDVLTRV

SEQ ID NO: 20257 - protein, 10 aa, Homo Sapiens
VLPPSALQSV

SEQ ID NO: 20258 - protein, 10 aa, Homo Sapiens
VLPPVPTEGL

SEQ ID NO: 20259 - protein, 10 aa, Homo Sapiens
VMDHVSDSFL

SEQ ID NO: 20260 - protein, 10 aa, Homo Sapiens
VMDKLSSIRL

SEQ ID NO: 20261 - protein, 10 aa, Homo Sapiens
VMDSAFKVYL

SEQ ID NO: 20262 - protein, 10 aa, Homo Sapiens
VPEEQIFPVL

SEQ ID NO: 20263 - protein, 10 aa, Homo Sapiens
VQPFFDNIFV

SEQ ID NO: 20264 - protein, 10 aa, Homo Sapiens
VVDDGVEHTI

SEQ ID NO: 20265 - protein, 10 aa, Homo Sapiens
VVDDSNEHML

SEQ ID NO: 20266 - protein, 10 aa, Homo Sapiens
VVDGVHGAFI

SEQ ID NO: 20267 - protein, 10 aa, Homo Sapiens
VVDHLLDIYI

SEQ ID NO: 20268 - protein, 10 aa, Homo Sapiens
VVDPETDEQL

SEQ ID NO: 20269 - protein, 10 aa, Homo Sapiens
VVDPIVSNFL

SEQ ID NO: 20270 - protein, 10 aa, Homo Sapiens
VVPDTSRIYV

SEQ ID NO: 20271 - protein, 10 aa, Homo Sapiens
VVPPFLQPEV

SEQ ID NO: 20272 - protein, 10 aa, Homo Sapiens
VVVPPFLQPE

SEQ ID NO: 20273 - protein, 10 aa, Homo Sapiens
YDNEFGYSNR

SEQ ID NO: 20274 - protein, 10 aa, Homo Sapiens
YIAGEYTLLL

SEQ ID NO: 20275 - protein, 10 aa, Homo Sapiens
YIDAQFEAYL

SEQ ID NO: 20276 - protein, 10 aa, Homo Sapiens
YIDAQFENYL

SEQ ID NO: 20277 - protein, 10 aa, Homo Sapiens
YIDDLGHLHV

SEQ ID NO: 20278 - protein, 10 aa, Homo Sapiens
YIDEEGVRYV

SEQ ID NO: 20279 - protein, 10 aa, Homo Sapiens
YIDEQFERYL

SEQ ID NO: 20280 - protein, 10 aa, Homo Sapiens
YIDEVIIEQF

SEQ ID NO: 20281 - protein, 10 aa, Homo Sapiens
YIDSKFEDYL

SEQ ID NO: 20282 - protein, 10 aa, Homo Sapiens
YIPFYGILGA

SEQ ID NO: 20283 - protein, 10 aa, Homo Sapiens
YLDAIYDVTV

SEQ ID NO: 20284 - protein, 10 aa, Homo Sapiens
YLDEDTIYHL

SEQ ID NO: 20285 - protein, 10 aa, Homo Sapiens
YLDEEFHQSL

SEQ ID NO: 20286 - protein, 10 aa, Homo Sapiens
YLDEEFVLRV

SEQ ID NO: 20287 - protein, 10 aa, Homo Sapiens
YLDFIKEVGF

SEQ ID NO: 20288 - protein, 10 aa, Homo Sapiens
YLDHTADVQL

SEQ ID NO: 20289 - protein, 10 aa, Homo Sapiens
YLDIKGLLDV

SEQ ID NO: 20290 - protein, 10 aa, Homo Sapiens
YLDKDLKQYM

SEQ ID NO: 20291 - protein, 10 aa, Homo Sapiens
YLDPLVFREF

SEQ ID NO: 20292 - protein, 10 aa, Homo Sapiens
YLDQGTQIFL

SEQ ID NO: 20293 - protein, 10 aa, Homo Sapiens
YLDQISRYYI

SEQ ID NO: 20294 - protein, 10 aa, Homo Sapiens
YLDSIYFNRF

SEQ ID NO: 20295 - protein, 10 aa, Homo Sapiens
YLIPDIDLKL

SEQ ID NO: 20296 - protein, 10 aa, Homo Sapiens
YLLDMPLWYL

SEQ ID NO: 20297 - protein, 10 aa, Homo Sapiens
YLPAVFEEVL

SEQ ID NO: 20298 - protein, 10 aa, Homo Sapiens
YLPEDFIRVG

SEQ ID NO: 20299 - protein, 10 aa, Homo Sapiens
YLPEDFMESL

SEQ ID NO: 20300 - protein, 10 aa, Homo Sapiens
YLPPEFTAGL

SEQ ID NO: 20301 - protein, 10 aa, Homo Sapiens
YLWDLDHGFA

SEQ ID NO: 20302 - protein, 10 aa, Homo Sapiens
YLYEVSQLKD

SEQ ID NO: 20303 - protein, 10 aa, Homo Sapiens
YMDNPQNLAM

SEQ ID NO: 20304 - protein, 10 aa, Homo Sapiens
YMDPEGDWFL

SEQ ID NO: 20305 - protein, 10 aa, Homo Sapiens
YMDSPQSIGF

SEQ ID NO: 20306 - protein, 10 aa, Homo Sapiens
YVAPAYGVYL

SEQ ID NO: 20307 - protein, 10 aa, Homo Sapiens
YVDAAYKPGM

SEQ ID NO: 20308 - protein, 10 aa, Homo Sapiens
YVDAGTPMYL

SEQ ID NO: 20309 - protein, 10 aa, Homo Sapiens
YVDATYREGM

SEQ ID NO: 20310 - protein, 10 aa, Homo Sapiens
YVDDTQFLRF

SEQ ID NO: 20311 - protein, 10 aa, Homo Sapiens
YVDDTQFVRF

SEQ ID NO: 20312 - protein, 10 aa, Homo Sapiens
YVDDVFLRVL

SEQ ID NO: 20313 - protein, 10 aa, Homo Sapiens
YVDEAGTVKL

SEQ ID NO: 20314 - protein, 10 aa, Homo Sapiens
YVDEASKKEI

SEQ ID NO: 20315 - protein, 10 aa, Homo Sapiens
YVDPQFLTYM

SEQ ID NO: 20316 - protein, 10 aa, Homo Sapiens
YVDPSPDYCL

SEQ ID NO: 20317 - protein, 10 aa, Homo Sapiens
YVDPSTDERL

SEQ ID NO: 20318 - protein, 10 aa, Homo Sapiens
YVDSEGIVRM

SEQ ID NO: 20319 - protein, 10 aa, Homo Sapiens
YVPVHFDASV

SEQ ID NO: 20320 - protein, 11 aa, Homo Sapiens
AIDEALAALHV

SEQ ID NO: 20321 - protein, 11 aa, Homo Sapiens
ALADKELLPSV

SEQ ID NO: 20322 - protein, 11 aa, Homo Sapiens
ALDEADRMIDM

SEQ ID NO: 20323 - protein, 11 aa, Homo Sapiens
ALDEDFAPAKL

SEQ ID NO: 20324 - protein, 11 aa, Homo Sapiens
ALDEGDAQKTL

SEQ ID NO: 20325 - protein, 11 aa, Homo Sapiens
ALDETGKETFL

SEQ ID NO: 20326 - protein, 11 aa, Homo Sapiens
ALDKATVLLSM

SEQ ID NO: 20327 - protein, 11 aa, Homo Sapiens
ALDNVDARMYM

SEQ ID NO: 20328 - protein, 11 aa, Homo Sapiens
ALDNVLPSAQL

SEQ ID NO: 20329 - protein, 11 aa, Homo Sapiens
ALDPAAQAFLL

SEQ ID NO: 20330 - protein, 11 aa, Homo Sapiens
ALDPLADKILI

SEQ ID NO: 20331 - protein, 11 aa, Homo Sapiens
ALDPSFPRMNL

SEQ ID NO: 20332 - protein, 11 aa, Homo Sapiens
ALDPSLDNHQV

SEQ ID NO: 20333 - protein, 11 aa, Homo Sapiens
ALDRQTATQLL

SEQ ID NO: 20334 - protein, 11 aa, Homo Sapiens
ALDTIRPEHVL

SEQ ID NO: 20335 - protein, 11 aa, Homo Sapiens
ALDWVSREQSV

SEQ ID NO: 20336 - protein, 11 aa, Homo Sapiens
ALEPHINAQIM

SEQ ID NO: 20337 - protein, 11 aa, Homo Sapiens
ALFASGLIHRV

SEQ ID NO: 20338 - protein, 11 aa, Homo Sapiens
ALGNTGHEIGR

SEQ ID NO: 20339 - protein, 11 aa, Homo Sapiens
ALIEAEKVAQV

SEQ ID NO: 20340 - protein, 11 aa, Homo Sapiens
ALLEADVNIKL

SEQ ID NO: 20341 - protein, 11 aa, Homo Sapiens
ALPDLTKVIQL

SEQ ID NO: 20342 - protein, 11 aa, Homo Sapiens
ALPDTDVLYMT

SEQ ID NO: 20343 - protein, 11 aa, Homo Sapiens
ALPEIFTELEI

SEQ ID NO: 20344 - protein, 11 aa, Homo Sapiens
ALPEPQEAQKL

SEQ ID NO: 20345 - protein, 11 aa, Homo Sapiens
ALPESGSSLAL

SEQ ID NO: 20346 - protein, 11 aa, Homo Sapiens
ALPEVLAVIQV

SEQ ID NO: 20347 - protein, 11 aa, Homo Sapiens
ALPKAGKFGPA

SEQ ID NO: 20348 - protein, 11 aa, Homo Sapiens
ALPKELPLISS

SEQ ID NO: 20349 - protein, 11 aa, Homo Sapiens
ALPPAIQEEVL

SEQ ID NO: 20350 - protein, 11 aa, Homo Sapiens
ALPPDVTTQSV

SEQ ID NO: 20351 - protein, 11 aa, Homo Sapiens
ALPTEAAILTL

SEQ ID NO: 20352 - protein, 11 aa, Homo Sapiens
ALQEASEAYLV

SEQ ID NO: 20353 - protein, 11 aa, Homo Sapiens
ALWENPESGEL

SEQ ID NO: 20354 - protein, 11 aa, Homo Sapiens
ALWHDAENQTV

SEQ ID NO: 20355 - protein, 11 aa, Homo Sapiens
AMPGEDLKFNL

SEQ ID NO: 20356 - protein, 11 aa, Homo Sapiens
AMPNIAVGQNV

SEQ ID NO: 20357 - protein, 11 aa, Homo Sapiens
AQPPWLPGLEA

SEQ ID NO: 20358 - protein, 11 aa, Homo Sapiens
AVDPVADIATL

SEQ ID NO: 20359 - protein, 11 aa, Homo Sapiens
AVPDEILIEAV

SEQ ID NO: 20360 - protein, 11 aa, Homo Sapiens
AVPGPGGIWSV

SEQ ID NO: 20361 - protein, 11 aa, Homo Sapiens
AYIDDFDLGQI

SEQ ID NO: 20362 - protein, 11 aa, Homo Sapiens
FAVTEYPTLKF

SEQ ID NO: 20363 - protein, 11 aa, Homo Sapiens
FIDDLADLSCL

SEQ ID NO: 20364 - protein, 11 aa, Homo Sapiens
FIDETSDIENL

SEQ ID NO: 20365 - protein, 11 aa, Homo Sapiens
FIDMPDAAHGI

SEQ ID NO: 20366 - protein, 11 aa, Homo Sapiens
FIDPSSGLAFF

SEQ ID NO: 20367 - protein, 11 aa, Homo Sapiens
FIPLPSAVVQA

SEQ ID NO: 20368 - protein, 11 aa, Homo Sapiens
FLADPSAFVAA

SEQ ID NO: 20369 - protein, 11 aa, Homo Sapiens
FLDDFESKYSF

SEQ ID NO: 20370 - protein, 11 aa, Homo Sapiens
FLDDGFLVPTF

SEQ ID NO: 20371 - protein, 11 aa, Homo Sapiens
FLDELGQHISL

SEQ ID NO: 20372 - protein, 11 aa, Homo Sapiens
FLDENIGGVAV

SEQ ID NO: 20373 - protein, 11 aa, Homo Sapiens
FLDEPTNHLDI

SEQ ID NO: 20374 - protein, 11 aa, Homo Sapiens
FLDESRSTQYM

SEQ ID NO: 20375 - protein, 11 aa, Homo Sapiens
FLDEVSRQQEL

SEQ ID NO: 20376 - protein, 11 aa, Homo Sapiens
FLDITNPKAVL

SEQ ID NO: 20377 - protein, 11 aa, Homo Sapiens
FLDNPGILSEL

SEQ ID NO: 20378 - protein, 11 aa, Homo Sapiens
FLDPGGPMMKL

SEQ ID NO: 20379 - protein, 11 aa, Homo Sapiens
FLDTNETPYFM

SEQ ID NO: 20380 - protein, 11 aa, Homo Sapiens
FLFEPVVKAFL

SEQ ID NO: 20381 - protein, 11 aa, Homo Sapiens
FLIEPEHVNTV

SEQ ID NO: 20382 - protein, 11 aa, Homo Sapiens
FLLDPVKGERL

SEQ ID NO: 20383 - protein, 11 aa, Homo Sapiens
FLLDPYKYMTL

SEQ ID NO: 20384 - protein, 11 aa, Homo Sapiens
FLLEQEKTQAL

SEQ ID NO: 20385 - protein, 11 aa, Homo Sapiens
FLPDANSSVLL

SEQ ID NO: 20386 - protein, 11 aa, Homo Sapiens
FLPDPSALQNL

SEQ ID NO: 20387 - protein, 11 aa, Homo Sapiens
FLPDQDQRSQL

SEQ ID NO: 20388 - protein, 11 aa, Homo Sapiens
FLPEALDFVGV

SEQ ID NO: 20389 - protein, 11 aa, Homo Sapiens
FLPEGAETDLL

SEQ ID NO: 20390 - protein, 11 aa, Homo Sapiens
FLPEPMGTANI

SEQ ID NO: 20391 - protein, 11 aa, Homo Sapiens
FLPETRIMTSV

SEQ ID NO: 20392 - protein, 11 aa, Homo Sapiens
FLPPEHTIVYI

SEQ ID NO: 20393 - protein, 11 aa, Homo Sapiens
FLPPITPPEKF

SEQ ID NO: 20394 - protein, 11 aa, Homo Sapiens
FLPSADEIYDC

SEQ ID NO: 20395 - protein, 11 aa, Homo Sapiens
FLVEPQEDTRL

SEQ ID NO: 20396 - protein, 11 aa, Homo Sapiens
FLWDVPSNWTL

SEQ ID NO: 20397 - protein, 11 aa, Homo Sapiens
FMDDTSRSIIR

SEQ ID NO: 20398 - protein, 11 aa, Homo Sapiens
FMPVSSLIVGV

SEQ ID NO: 20399 - protein, 11 aa, Homo Sapiens
FVDDSGRYLAI

SEQ ID NO: 20400 - protein, 11 aa, Homo Sapiens
FVDDVSEEELL

SEQ ID NO: 20401 - protein, 11 aa, Homo Sapiens
FVDEGKATVRL

SEQ ID NO: 20402 - protein, 11 aa, Homo Sapiens
FVDGVSTVARF

SEQ ID NO: 20403 - protein, 11 aa, Homo Sapiens
FVDPAQITMKV

SEQ ID NO: 20404 - protein, 11 aa, Homo Sapiens
FVDSPSSGTHL

SEQ ID NO: 20405 - protein, 11 aa, Homo Sapiens
FVPEPSSTMGL

SEQ ID NO: 20406 - protein, 11 aa, Homo Sapiens
FVPPPLDQEEM

SEQ ID NO: 20407 - protein, 11 aa, Homo Sapiens
FVQEVVQSQQV

SEQ ID NO: 20408 - protein, 11 aa, Homo Sapiens
FVYKGGKIYKV

SEQ ID NO: 20409 - protein, 11 aa, Homo Sapiens
GLDISHISQRL

SEQ ID NO: 20410 - protein, 11 aa, Homo Sapiens
GLDPLGYEIQL

SEQ ID NO: 20411 - protein, 11 aa, Homo Sapiens
GLPDAPRNLQL

SEQ ID NO: 20412 - protein, 11 aa, Homo Sapiens
GLPDIDSKMLM

SEQ ID NO: 20413 - protein, 11 aa, Homo Sapiens
GLPEEIEELRV

SEQ ID NO: 20414 - protein, 11 aa, Homo Sapiens
GLPGPEGIVGI

SEQ ID NO: 20415 - protein, 11 aa, Homo Sapiens
GLPGVGIMPTV

SEQ ID NO: 20416 - protein, 11 aa, Homo Sapiens
GLPQEVLNENL

SEQ ID NO: 20417 - protein, 11 aa, Homo Sapiens
GLPTRLPEIML

SEQ ID NO: 20418 - protein, 11 aa, Homo Sapiens
GLWEIENNPTV

SEQ ID NO: 20419 - protein, 11 aa, Homo Sapiens
GVDAETMHTLL

SEQ ID NO: 20420 - protein, 11 aa, Homo Sapiens
HDISPQAPTHF

SEQ ID NO: 20421 - protein, 11 aa, Homo Sapiens
HIDLPNEQARL

SEQ ID NO: 20422 - protein, 11 aa, Homo Sapiens
HIPGPGGIEGV

SEQ ID NO: 20423 - protein, 11 aa, Homo Sapiens
HLDLPSNNNLV

SEQ ID NO: 20424 - protein, 11 aa, Homo Sapiens
HLMEENMIVYV

SEQ ID NO: 20425 - protein, 11 aa, Homo Sapiens
HLPLPEQIHKA

SEQ ID NO: 20426 - protein, 11 aa, Homo Sapiens
HLPPEIVPATL

SEQ ID NO: 20427 - protein, 11 aa, Homo Sapiens
HVPSTDLILNV

SEQ ID NO: 20428 - protein, 11 aa, Homo Sapiens
IAPENLPPLTP

SEQ ID NO: 20429 - protein, 11 aa, Homo Sapiens
IIDDPNLVVKI

SEQ ID NO: 20430 - protein, 11 aa, Homo Sapiens
IIDDVMKELNF

SEQ ID NO: 20431 - protein, 11 aa, Homo Sapiens
IIDPADTRLVL

SEQ ID NO: 20432 - protein, 11 aa, Homo Sapiens
IIDTPISEMGF

SEQ ID NO: 20433 - protein, 11 aa, Homo Sapiens
IILPEMVGSMV

SEQ ID NO: 20434 - protein, 11 aa, Homo Sapiens
IIPASIPGSEV

SEQ ID NO: 20435 - protein, 11 aa, Homo Sapiens
IIPDPVVAPSI

SEQ ID NO: 20436 - protein, 11 aa, Homo Sapiens
ILDDDTIITTL

SEQ ID NO: 20437 - protein, 11 aa, Homo Sapiens
ILDDTAKNLRV

SEQ ID NO: 20438 - protein, 11 aa, Homo Sapiens
ILDDVSLTHLT

SEQ ID NO: 20439 - protein, 11 aa, Homo Sapiens
ILDEMSHKLRL

SEQ ID NO: 20440 - protein, 11 aa, Homo Sapiens
ILDEPTNHLDM

SEQ ID NO: 20441 - protein, 11 aa, Homo Sapiens
ILDESGKKFAM

SEQ ID NO: 20442 - protein, 11 aa, Homo Sapiens
ILDESHYKELL

SEQ ID NO: 20443 - protein, 11 aa, Homo Sapiens
ILDPAYPDITL

SEQ ID NO: 20444 - protein, 11 aa, Homo Sapiens
ILDPVDPTNNV

SEQ ID NO: 20445 - protein, 11 aa, Homo Sapiens
ILDRVADGMVF

SEQ ID NO: 20446 - protein, 11 aa, Homo Sapiens
ILLEAGAFVNV

SEQ ID NO: 20447 - protein, 11 aa, Homo Sapiens
ILNDPSQSEVM

SEQ ID NO: 20448 - protein, 11 aa, Homo Sapiens
ILPDDPRQMTL

SEQ ID NO: 20449 - protein, 11 aa, Homo Sapiens
ILPDGEDFLAV

SEQ ID NO: 20450 - protein, 11 aa, Homo Sapiens
ILPDGSIFSRV

SEQ ID NO: 20451 - protein, 11 aa, Homo Sapiens
ILPDITKDELF

SEQ ID NO: 20452 - protein, 11 aa, Homo Sapiens
ILPEHSVLQNI

SEQ ID NO: 20453 - protein, 11 aa, Homo Sapiens
ILPENFKDSRL

SEQ ID NO: 20454 - protein, 11 aa, Homo Sapiens
ILPEVKVEGEL

SEQ ID NO: 20455 - protein, 11 aa, Homo Sapiens
ILPKIKAIPQL

SEQ ID NO: 20456 - protein, 11 aa, Homo Sapiens
ILPNEDDKFTV

SEQ ID NO: 20457 - protein, 11 aa, Homo Sapiens
ILPNIEAVSNV

SEQ ID NO: 20458 - protein, 11 aa, Homo Sapiens
ILPPQDLSHYI

SEQ ID NO: 20459 - protein, 11 aa, Homo Sapiens
ILRDPLQTDTL

SEQ ID NO: 20460 - protein, 11 aa, Homo Sapiens
ILWAASKSQLL

SEQ ID NO: 20461 - protein, 11 aa, Homo Sapiens
ILYDERSVHKV

SEQ ID NO: 20462 - protein, 11 aa, Homo Sapiens
IMDDPAGNSYL

SEQ ID NO: 20463 - protein, 11 aa, Homo Sapiens
IMPNGDHIVSA

SEQ ID NO: 20464 - protein, 11 aa, Homo Sapiens
IMPPHSITQTV

SEQ ID NO: 20465 - protein, 11 aa, Homo Sapiens
ITPENLPQILL

SEQ ID NO: 20466 - protein, 11 aa, Homo Sapiens
IVDEPTFKVLL

SEQ ID NO: 20467 - protein, 11 aa, Homo Sapiens
IVDEVNGLISM

SEQ ID NO: 20468 - protein, 11 aa, Homo Sapiens
IVDPTGEEEHL

SEQ ID NO: 20469 - protein, 11 aa, Homo Sapiens
IVDVIDQNRAL

SEQ ID NO: 20470 - protein, 11 aa, Homo Sapiens
IVLPAGALHQV

SEQ ID NO: 20471 - protein, 11 aa, Homo Sapiens
IVPKEEGVISV

SEQ ID NO: 20472 - protein, 11 aa, Homo Sapiens
KIMTEKELLAV

SEQ ID NO: 20473 - protein, 11 aa, Homo Sapiens
KIVETIEELKV

SEQ ID NO: 20474 - protein, 11 aa, Homo Sapiens
KIWDLKERTNV

SEQ ID NO: 20475 - protein, 11 aa, Homo Sapiens
KLDDTYIKAYL

SEQ ID NO: 20476 - protein, 11 aa, Homo Sapiens
KLDENSAFLQF

SEQ ID NO: 20477 - protein, 11 aa, Homo Sapiens
KLIEVDDERKL

SEQ ID NO: 20478 - protein, 11 aa, Homo Sapiens
KLPEPQSFSSA

SEQ ID NO: 20479 - protein, 11 aa, Homo Sapiens
KLPETHQLLQL

SEQ ID NO: 20480 - protein, 11 aa, Homo Sapiens
KLPMSIIIVGV

SEQ ID NO: 20481 - protein, 11 aa, Homo Sapiens
KLPQPEAVVAL

SEQ ID NO: 20482 - protein, 11 aa, Homo Sapiens
KLPSETIFVGC

SEQ ID NO: 20483 - protein, 11 aa, Homo Sapiens
KLWTGGLDNTV

SEQ ID NO: 20484 - protein, 11 aa, Homo Sapiens
KMDDPDYWRTV

SEQ ID NO: 20485 - protein, 11 aa, Homo Sapiens
KMDEVLYSIAE

SEQ ID NO: 20486 - protein, 11 aa, Homo Sapiens
KMPDVELFVNL

SEQ ID NO: 20487 - protein, 11 aa, Homo Sapiens
KMPEVIPILEV

SEQ ID NO: 20488 - protein, 11 aa, Homo Sapiens
KMPQSMPEYAL

SEQ ID NO: 20489 - protein, 11 aa, Homo Sapiens
KMPSRFPPVVF

SEQ ID NO: 20490 - protein, 11 aa, Homo Sapiens
KQPPIDNIIRA

SEQ ID NO: 20491 - protein, 11 aa, Homo Sapiens
KVDENHSEFTL

SEQ ID NO: 20492 - protein, 11 aa, Homo Sapiens
KVDSPTVNTTL

SEQ ID NO: 20493 - protein, 11 aa, Homo Sapiens
KVDTVWVNVGG

SEQ ID NO: 20494 - protein, 11 aa, Homo Sapiens
KVFDSHPVLHV

SEQ ID NO: 20495 - protein, 11 aa, Homo Sapiens
KVFPSEITDTV

SEQ ID NO: 20496 - protein, 11 aa, Homo Sapiens
KVLEPSETLVV

SEQ ID NO: 20497 - protein, 11 aa, Homo Sapiens
KVPAEEVLVAV

SEQ ID NO: 20498 - protein, 11 aa, Homo Sapiens
KVVDVVRNLVF

SEQ ID NO: 20499 - protein, 11 aa, Homo Sapiens
LAPDCEIIQEV

SEQ ID NO: 20500 - protein, 11 aa, Homo Sapiens
LIDEGETDWKL

SEQ ID NO: 20501 - protein, 11 aa, Homo Sapiens
LIDEGHAATQL

SEQ ID NO: 20502 - protein, 11 aa, Homo Sapiens
LIDSPLHNTFL

SEQ ID NO: 20503 - protein, 11 aa, Homo Sapiens
LLDDPTNAHFI

SEQ ID NO: 20504 - protein, 11 aa, Homo Sapiens
LLDELIKSGQL

SEQ ID NO: 20505 - protein, 11 aa, Homo Sapiens
LLDENNVSSYL

SEQ ID NO: 20506 - protein, 11 aa, Homo Sapiens
LLDEPTNHLDL

SEQ ID NO: 20507 - protein, 11 aa, Homo Sapiens
LLDPSIIEAKM

SEQ ID NO: 20508 - protein, 11 aa, Homo Sapiens
LLDQPVLEQRL

SEQ ID NO: 20509 - protein, 11 aa, Homo Sapiens
LLDSHLPEEAL

SEQ ID NO: 20510 - protein, 11 aa, Homo Sapiens
LLEDTNTFRGV

SEQ ID NO: 20511 - protein, 11 aa, Homo Sapiens
LLEDVTWKYTA

SEQ ID NO: 20512 - protein, 11 aa, Homo Sapiens
LLIDDKGTIKL

SEQ ID NO: 20513 - protein, 11 aa, Homo Sapiens
LLLPDYYLVTV

SEQ ID NO: 20514 - protein, 11 aa, Homo Sapiens
LLNEPDGTFLL

SEQ ID NO: 20515 - protein, 11 aa, Homo Sapiens
LLPAASELAHV

SEQ ID NO: 20516 - protein, 11 aa, Homo Sapiens
LLPDEDALPFL

SEQ ID NO: 20517 - protein, 11 aa, Homo Sapiens
LLPDPRELIEI

SEQ ID NO: 20518 - protein, 11 aa, Homo Sapiens
LLPDTAKQQEL

SEQ ID NO: 20519 - protein, 11 aa, Homo Sapiens
LLPDVGAIVTC

SEQ ID NO: 20520 - protein, 11 aa, Homo Sapiens
LLPEEEQLWAA

SEQ ID NO: 20521 - protein, 11 aa, Homo Sapiens
LLPEEIKSSFL

SEQ ID NO: 20522 - protein, 11 aa, Homo Sapiens
LLPEGPPAIAN

SEQ ID NO: 20523 - protein, 11 aa, Homo Sapiens
LLPELTNPDEL

SEQ ID NO: 20524 - protein, 11 aa, Homo Sapiens
LLPEPNILQLL

SEQ ID NO: 20525 - protein, 11 aa, Homo Sapiens
LLPESVDLECV

SEQ ID NO: 20526 - protein, 11 aa, Homo Sapiens
LLPGELAKHAV

SEQ ID NO: 20527 - protein, 11 aa, Homo Sapiens
LLPGSEAGVSV

SEQ ID NO: 20528 - protein, 11 aa, Homo Sapiens
LLPPDESLHSL

SEQ ID NO: 20529 - protein, 11 aa, Homo Sapiens
LLPPLESLATV

SEQ ID NO: 20530 - protein, 11 aa, Homo Sapiens
LLPPPMKELRV

SEQ ID NO: 20531 - protein, 11 aa, Homo Sapiens
LLPQDKKEYRL

SEQ ID NO: 20532 - protein, 11 aa, Homo Sapiens
LLPSRPEVPNI

SEQ ID NO: 20533 - protein, 11 aa, Homo Sapiens
LLPVDKAFYEA

SEQ ID NO: 20534 - protein, 11 aa, Homo Sapiens
LLVEPSRNDLL

SEQ ID NO: 20535 - protein, 11 aa, Homo Sapiens
LLVPTSGIYFV

SEQ ID NO: 20536 - protein, 11 aa, Homo Sapiens
LLWDVVTGQSV

SEQ ID NO: 20537 - protein, 11 aa, Homo Sapiens
LLYDLADQLHA

SEQ ID NO: 20538 - protein, 11 aa, Homo Sapiens
LMPDQTAMHEV

SEQ ID NO: 20539 - protein, 11 aa, Homo Sapiens
LMPQLNAIIAA

SEQ ID NO: 20540 - protein, 11 aa, Homo Sapiens
LQPDEDTIFFV

SEQ ID NO: 20541 - protein, 11 aa, Homo Sapiens
LVDDLSDRVYL

SEQ ID NO: 20542 - protein, 11 aa, Homo Sapiens
LVDHLNVGVAQ

SEQ ID NO: 20543 - protein, 11 aa, Homo Sapiens
MAPSETQFSHL

SEQ ID NO: 20544 - protein, 11 aa, Homo Sapiens
MHQPHQPLPPT

SEQ ID NO: 20545 - protein, 11 aa, Homo Sapiens
MIDPVLGTVGF

SEQ ID NO: 20546 - protein, 11 aa, Homo Sapiens
MIILPEMVGSM

SEQ ID NO: 20547 - protein, 11 aa, Homo Sapiens
MLDEMKDNLLL

SEQ ID NO: 20548 - protein, 11 aa, Homo Sapiens
MLDEPTNHLDL

SEQ ID NO: 20549 - protein, 11 aa, Homo Sapiens
MLDSGADYLHL

SEQ ID NO: 20550 - protein, 11 aa, Homo Sapiens
MLFENMGAYTV

SEQ ID NO: 20551 - protein, 11 aa, Homo Sapiens
MLPETREIYEL

SEQ ID NO: 20552 - protein, 11 aa, Homo Sapiens
MLPNQAQSPHL

SEQ ID NO: 20553 - protein, 11 aa, Homo Sapiens
MMPEEKLVEAL

SEQ ID NO: 20554 - protein, 11 aa, Homo Sapiens
MTLPVDAVISV

SEQ ID NO: 20555 - protein, 11 aa, Homo Sapiens
NIDDVVRFLDS

SEQ ID NO: 20556 - protein, 11 aa, Homo Sapiens
NIDEIYKALSR

SEQ ID NO: 20557 - protein, 11 aa, Homo Sapiens
NIIEAINELLV

SEQ ID NO: 20558 - protein, 11 aa, Homo Sapiens
NILEDLETLRL

SEQ ID NO: 20559 - protein, 11 aa, Homo Sapiens
NIPDVVPGSHL

SEQ ID NO: 20560 - protein, 11 aa, Homo Sapiens
NIVEKIDFDSV

SEQ ID NO: 20561 - protein, 11 aa, Homo Sapiens
NLDVPHSYSVL

SEQ ID NO: 20562 - protein, 11 aa, Homo Sapiens
NLPAPHIMPGV

SEQ ID NO: 20563 - protein, 11 aa, Homo Sapiens
NLPDEEIFQQL

SEQ ID NO: 20564 - protein, 11 aa, Homo Sapiens
NLPEETNEMML

SEQ ID NO: 20565 - protein, 11 aa, Homo Sapiens
NLPMSVIIVGV

SEQ ID NO: 20566 - protein, 11 aa, Homo Sapiens
NLPNTNSILGV

SEQ ID NO: 20567 - protein, 11 aa, Homo Sapiens
NLPYKVTQDEL

SEQ ID NO: 20568 - protein, 11 aa, Homo Sapiens
NQPPEDGISSV

SEQ ID NO: 20569 - protein, 11 aa, Homo Sapiens
PMFIVNTNVPR

SEQ ID NO: 20570 - protein, 11 aa, Homo Sapiens
QIDDLYSTIKV

SEQ ID NO: 20571 - protein, 11 aa, Homo Sapiens
QLDQPSWSGRL

SEQ ID NO: 20572 - protein, 11 aa, Homo Sapiens
QLPESAYMHQL

SEQ ID NO: 20573 - protein, 11 aa, Homo Sapiens
QLPPVIKNMAF

SEQ ID NO: 20574 - protein, 11 aa, Homo Sapiens
QMLEAIKALEV

SEQ ID NO: 20575 - protein, 11 aa, Homo Sapiens
QVDEVVDIMRV

SEQ ID NO: 20576 - protein, 11 aa, Homo Sapiens
RIFGESIMIGV

SEQ ID NO: 20577 - protein, 11 aa, Homo Sapiens
RIFPPETSASV

SEQ ID NO: 20578 - protein, 11 aa, Homo Sapiens
RIIDVIDKELI

SEQ ID NO: 20579 - protein, 11 aa, Homo Sapiens
RILDIDIPMSV

SEQ ID NO: 20580 - protein, 11 aa, Homo Sapiens
RLDDVSNDVRM

SEQ ID NO: 20581 - protein, 11 aa, Homo Sapiens
RLDEALQGSAL

SEQ ID NO: 20582 - protein, 11 aa, Homo Sapiens
RLDEPLASYIF

SEQ ID NO: 20583 - protein, 11 aa, Homo Sapiens
RLFDDSTVTTV

SEQ ID NO: 20584 - protein, 11 aa, Homo Sapiens
RLFPVPGSGLV

SEQ ID NO: 20585 - protein, 11 aa, Homo Sapiens
RLLEPAQVQQL

SEQ ID NO: 20586 - protein, 11 aa, Homo Sapiens
RLLPPGAVVAV

SEQ ID NO: 20587 - protein, 11 aa, Homo Sapiens
RLPAAGVGDMV

SEQ ID NO: 20588 - protein, 11 aa, Homo Sapiens
RLPDMEMVINV

SEQ ID NO: 20589 - protein, 11 aa, Homo Sapiens
RLPETIDLGAL

SEQ ID NO: 20590 - protein, 11 aa, Homo Sapiens
RLPGGNEIGMV

SEQ ID NO: 20591 - protein, 11 aa, Homo Sapiens
RLPGSGAVQAA

SEQ ID NO: 20592 - protein, 11 aa, Homo Sapiens
RLPMSIIIVGV

SEQ ID NO: 20593 - protein, 11 aa, Homo Sapiens
RLPNRALLVNV

SEQ ID NO: 20594 - protein, 11 aa, Homo Sapiens
RLPPDTLLQQV

SEQ ID NO: 20595 - protein, 11 aa, Homo Sapiens
RLPPEGILHNV

SEQ ID NO: 20596 - protein, 11 aa, Homo Sapiens
RLPPEIFGDAL

SEQ ID NO: 20597 - protein, 11 aa, Homo Sapiens
RLPPPFPGLEP

SEQ ID NO: 20598 - protein, 11 aa, Homo Sapiens
RMPPPANLPSL

SEQ ID NO: 20599 - protein, 11 aa, Homo Sapiens
RVIDDSLVVGV

SEQ ID NO: 20600 - protein, 11 aa, Homo Sapiens
RVLPPSALQSV

SEQ ID NO: 20601 - protein, 11 aa, Homo Sapiens
RVPPVVPAQTV

SEQ ID NO: 20602 - protein, 11 aa, Homo Sapiens
SAINEVVTREY

SEQ ID NO: 20603 - protein, 11 aa, Homo Sapiens
SFSDYPPLGRF

SEQ ID NO: 20604 - protein, 11 aa, Homo Sapiens
SIDKTGENFRL

SEQ ID NO: 20605 - protein, 11 aa, Homo Sapiens
SIPPVLKAELL

SEQ ID NO: 20606 - protein, 11 aa, Homo Sapiens
SLDDSAKKVLL

SEQ ID NO: 20607 - protein, 11 aa, Homo Sapiens
SLDEAYLNITK

SEQ ID NO: 20608 - protein, 11 aa, Homo Sapiens
SLDELIQSQQI

SEQ ID NO: 20609 - protein, 11 aa, Homo Sapiens
SLDESGEHMGV

SEQ ID NO: 20610 - protein, 11 aa, Homo Sapiens
SLDPDIDTLKL

SEQ ID NO: 20611 - protein, 11 aa, Homo Sapiens
SLMMPAVFHTV

SEQ ID NO: 20612 - protein, 11 aa, Homo Sapiens
SLPDDISVVKV

SEQ ID NO: 20613 - protein, 11 aa, Homo Sapiens
SLPDPNLITFL

SEQ ID NO: 20614 - protein, 11 aa, Homo Sapiens
SLPDSGVVEYL

SEQ ID NO: 20615 - protein, 11 aa, Homo Sapiens
SLPELSASAEL

SEQ ID NO: 20616 - protein, 11 aa, Homo Sapiens
SLPESDKIAEI

SEQ ID NO: 20617 - protein, 11 aa, Homo Sapiens
SLPESSLTDLL

SEQ ID NO: 20618 - protein, 11 aa, Homo Sapiens
SLPESTLLQAV

SEQ ID NO: 20619 - protein, 11 aa, Homo Sapiens
SLPGQGVIYNV

SEQ ID NO: 20620 - protein, 11 aa, Homo Sapiens
SLPNEEIVQKI

SEQ ID NO: 20621 - protein, 11 aa, Homo Sapiens
SLPNTSEAQKI

SEQ ID NO: 20622 - protein, 11 aa, Homo Sapiens
SLPPVIDKMNI

SEQ ID NO: 20623 - protein, 11 aa, Homo Sapiens
SLPSASHFSQL

SEQ ID NO: 20624 - protein, 11 aa, Homo Sapiens
SLPSSKEVAEL

SEQ ID NO: 20625 - protein, 11 aa, Homo Sapiens
SLPSVPVFLEV

SEQ ID NO: 20626 - protein, 11 aa, Homo Sapiens
SMPTSGALDRV

SEQ ID NO: 20627 - protein, 11 aa, Homo Sapiens
SNGLNITDGAF

SEQ ID NO: 20628 - protein, 11 aa, Homo Sapiens
SSVEVRSDWEV

SEQ ID NO: 20629 - protein, 11 aa, Homo Sapiens
SVDDIVKGINS

SEQ ID NO: 20630 - protein, 11 aa, Homo Sapiens
SVPDPELIDLI

SEQ ID NO: 20631 - protein, 11 aa, Homo Sapiens
SVPESTVLKKV

SEQ ID NO: 20632 - protein, 11 aa, Homo Sapiens
SVPGKDAIYSL

SEQ ID NO: 20633 - protein, 11 aa, Homo Sapiens
SVTDTNVILSM

SEQ ID NO: 20634 - protein, 11 aa, Homo Sapiens
SVVPQLTGGSV

SEQ ID NO: 20635 - protein, 11 aa, Homo Sapiens
SVVPVPEGYSV

SEQ ID NO: 20636 - protein, 11 aa, Homo Sapiens
TADPLSLLRNV

SEQ ID NO: 20637 - protein, 11 aa, Homo Sapiens
TANGGLALASI

SEQ ID NO: 20638 - protein, 11 aa, Homo Sapiens
TAQVIILNHPG

SEQ ID NO: 20639 - protein, 11 aa, Homo Sapiens
THAVVTVPAYF

SEQ ID NO: 20640 - protein, 11 aa, Homo Sapiens
TIPEAWVGQEV

SEQ ID NO: 20641 - protein, 11 aa, Homo Sapiens
TLDENHSIWQL

SEQ ID NO: 20642 - protein, 11 aa, Homo Sapiens
TLDEPIWRTEL

SEQ ID NO: 20643 - protein, 11 aa, Homo Sapiens
TLDMPDEEFRF

SEQ ID NO: 20644 - protein, 11 aa, Homo Sapiens
TLLDPNEKYLL

SEQ ID NO: 20645 - protein, 11 aa, Homo Sapiens
TLPHSSAFTPL

SEQ ID NO: 20646 - protein, 11 aa, Homo Sapiens
TLPPVLPGSHI

SEQ ID NO: 20647 - protein, 11 aa, Homo Sapiens
TLPSTVAVTSV

SEQ ID NO: 20648 - protein, 11 aa, Homo Sapiens
TLPTREVFLEA

SEQ ID NO: 20649 - protein, 11 aa, Homo Sapiens
TMPDGQQVLTV

SEQ ID NO: 20650 - protein, 11 aa, Homo Sapiens
TVFSHAQTVVL

SEQ ID NO: 20651 - protein, 11 aa, Homo Sapiens
TVPDTRELPSI

SEQ ID NO: 20652 - protein, 11 aa, Homo Sapiens
TVPKPDVVVQV

SEQ ID NO: 20653 - protein, 11 aa, Homo Sapiens
VAPDGHIFLEA

SEQ ID NO: 20654 - protein, 11 aa, Homo Sapiens
VGPPETSLHTV

SEQ ID NO: 20655 - protein, 11 aa, Homo Sapiens
VIDDLVYSIID

SEQ ID NO: 20656 - protein, 11 aa, Homo Sapiens
VIDEIGKMELF

SEQ ID NO: 20657 - protein, 11 aa, Homo Sapiens
VIIDDHPEVTV

SEQ ID NO: 20658 - protein, 11 aa, Homo Sapiens
VILESDPQQVV

SEQ ID NO: 20659 - protein, 11 aa, Homo Sapiens
VIPEPSKLPYI

SEQ ID NO: 20660 - protein, 11 aa, Homo Sapiens
VLDDPELRQGI

SEQ ID NO: 20661 - protein, 11 aa, Homo Sapiens
VLDEADRMIDM

SEQ ID NO: 20662 - protein, 11 aa, Homo Sapiens
VLDFPSSATGL

SEQ ID NO: 20663 - protein, 11 aa, Homo Sapiens
VLDGLSNILKM

SEQ ID NO: 20664 - protein, 11 aa, Homo Sapiens
VLDPPVGNTRL

SEQ ID NO: 20665 - protein, 11 aa, Homo Sapiens
VLDPSHRDISL

SEQ ID NO: 20666 - protein, 11 aa, Homo Sapiens
VLPDQEMLMKL

SEQ ID NO: 20667 - protein, 11 aa, Homo Sapiens
VLPDSGHLHPL

SEQ ID NO: 20668 - protein, 11 aa, Homo Sapiens
VLPPSYASDRL

SEQ ID NO: 20669 - protein, 11 aa, Homo Sapiens
VLWEALRKMGL

SEQ ID NO: 20670 - protein, 11 aa, Homo Sapiens
VMDETHVINQV

SEQ ID NO: 20671 - protein, 11 aa, Homo Sapiens
VMPGEGDLPQM

SEQ ID NO: 20672 - protein, 11 aa, Homo Sapiens
VQPEATQVPLV

SEQ ID NO: 20673 - protein, 11 aa, Homo Sapiens
VTSEPHEVSAL

SEQ ID NO: 20674 - protein, 11 aa, Homo Sapiens
VVDDIVSKLVF

SEQ ID NO: 20675 - protein, 11 aa, Homo Sapiens
VVDDLGQKITL

SEQ ID NO: 20676 - protein, 11 aa, Homo Sapiens
VVDNPQKFALF

SEQ ID NO: 20677 - protein, 11 aa, Homo Sapiens
VVDPVEKTMEL

SEQ ID NO: 20678 - protein, 11 aa, Homo Sapiens
VVDPVTSEHEL

SEQ ID NO: 20679 - protein, 11 aa, Homo Sapiens
VVPDTDVLPSF

SEQ ID NO: 20680 - protein, 11 aa, Homo Sapiens
VVPNAGILPLV

SEQ ID NO: 20681 - protein, 11 aa, Homo Sapiens
VVPPKFLGDSL

SEQ ID NO: 20682 - protein, 11 aa, Homo Sapiens
VVPPPFEQEAL

SEQ ID NO: 20683 - protein, 11 aa, Homo Sapiens
YGMTPDLTISL

SEQ ID NO: 20684 - protein, 11 aa, Homo Sapiens
YIDIADRSQVL

SEQ ID NO: 20685 - protein, 11 aa, Homo Sapiens
YIMEPSIFNTL

SEQ ID NO: 20686 - protein, 11 aa, Homo Sapiens
YLDCGDLSNAL

SEQ ID NO: 20687 - protein, 11 aa, Homo Sapiens
YLDDLNEGVYI

SEQ ID NO: 20688 - protein, 11 aa, Homo Sapiens
YLDEAGRGHSF

SEQ ID NO: 20689 - protein, 11 aa, Homo Sapiens
YLDEAHSIGAL

SEQ ID NO: 20690 - protein, 11 aa, Homo Sapiens
YLDEAYPGKKL

SEQ ID NO: 20691 - protein, 11 aa, Homo Sapiens
YLDPDAQKLDF

SEQ ID NO: 20692 - protein, 11 aa, Homo Sapiens
YLDPPNERLIL

SEQ ID NO: 20693 - protein, 11 aa, Homo Sapiens
YLDQTVVPILL

SEQ ID NO: 20694 - protein, 11 aa, Homo Sapiens
YLDSIPPGQYM

SEQ ID NO: 20695 - protein, 11 aa, Homo Sapiens
YLISQVEGHQV

SEQ ID NO: 20696 - protein, 11 aa, Homo Sapiens
YLNETFSELRL

SEQ ID NO: 20697 - protein, 11 aa, Homo Sapiens
YLPAHIPYQEL

SEQ ID NO: 20698 - protein, 11 aa, Homo Sapiens
YLPDIIKDQKA

SEQ ID NO: 20699 - protein, 11 aa, Homo Sapiens
YLPDTDDRHRI

SEQ ID NO: 20700 - protein, 11 aa, Homo Sapiens
YLPEADSILFL

SEQ ID NO: 20701 - protein, 11 aa, Homo Sapiens
YLPEELRGVDF

SEQ ID NO: 20702 - protein, 11 aa, Homo Sapiens
YLPERQKYEML

SEQ ID NO: 20703 - protein, 11 aa, Homo Sapiens
YLPPEMIEGRM

SEQ ID NO: 20704 - protein, 11 aa, Homo Sapiens
YLPSGESLPQT

SEQ ID NO: 20705 - protein, 11 aa, Homo Sapiens
YMPPSTVLQQI

SEQ ID NO: 20706 - protein, 11 aa, Homo Sapiens
YMPTEMELIEI

SEQ ID NO: 20707 - protein, 11 aa, Homo Sapiens
YVDDVISRIDR

SEQ ID NO: 20708 - protein, 11 aa, Homo Sapiens
YVDTAVRHVLL

SEQ ID NO: 20709 - protein, 11 aa, Homo Sapiens
YVIAYIRDLAL

SEQ ID NO: 20710 - protein, 11 aa, Homo Sapiens
YVIDPIKGLKL

SEQ ID NO: 20711 - protein, 8 aa, Homo Sapiens
AALIIHHV

SEQ ID NO: 20712 - protein, 8 aa, Homo Sapiens
AIGKVYHA

SEQ ID NO: 20713 - protein, 8 aa, Homo Sapiens
ALGKILSV

SEQ ID NO: 20714 - protein, 8 aa, Homo Sapiens
EEQLQQIR

SEQ ID NO: 20715 - protein, 8 aa, Homo Sapiens
FLGAVKNV

SEQ ID NO: 20716 - protein, 8 aa, Homo Sapiens
FLGKIYQI

SEQ ID NO: 20717 - protein, 8 aa, Homo Sapiens
FLWVPRKL

SEQ ID NO: 20718 - protein, 8 aa, Homo Sapiens
FMSQVHSV

SEQ ID NO: 20719 - protein, 8 aa, Homo Sapiens
FNEKSKEL

SEQ ID NO: 20720 - protein, 8 aa, Homo Sapiens
ILGKVYSV

SEQ ID NO: 20721 - protein, 8 aa, Homo Sapiens
ILGPTFTL

SEQ ID NO: 20722 - protein, 8 aa, Homo Sapiens
IWGKVTRA

SEQ ID NO: 20723 - protein, 8 aa, Homo Sapiens
KEHLTEQI

SEQ ID NO: 20724 - protein, 8 aa, Homo Sapiens
KLLEKERL

SEQ ID NO: 20725 - protein, 8 aa, Homo Sapiens
KTGRVYNV

SEQ ID NO: 20726 - protein, 8 aa, Homo Sapiens
LAIKVPPS

SEQ ID NO: 20727 - protein, 8 aa, Homo Sapiens
LAPPPRER

SEQ ID NO: 20728 - protein, 8 aa, Homo Sapiens
LDKKVEKV

SEQ ID NO: 20729 - protein, 8 aa, Homo Sapiens
LFDRPMHV

SEQ ID NO: 20730 - protein, 8 aa, Homo Sapiens
LISLKDWL

SEQ ID NO: 20731 - protein, 8 aa, Homo Sapiens
LLGQVFQV

SEQ ID NO: 20732 - protein, 8 aa, Homo Sapiens
LLPAIVHI

SEQ ID NO: 20733 - protein, 8 aa, Homo Sapiens
LMEHIHKL

SEQ ID NO: 20734 - protein, 8 aa, Homo Sapiens
LTDITKGV

SEQ ID NO: 20735 - protein, 8 aa, Homo Sapiens
LYDWKERL

SEQ ID NO: 20736 - protein, 8 aa, Homo Sapiens
LYGKIIHL

SEQ ID NO: 20737 - protein, 8 aa, Homo Sapiens
MAVIKEKI

SEQ ID NO: 20738 - protein, 8 aa, Homo Sapiens
SLFKIWLV

SEQ ID NO: 20739 - protein, 8 aa, Homo Sapiens
SLGKIFAL

SEQ ID NO: 20740 - protein, 8 aa, Homo Sapiens
SLGKVFGV

SEQ ID NO: 20741 - protein, 8 aa, Homo Sapiens
STGKVFSV

SEQ ID NO: 20742 - protein, 8 aa, Homo Sapiens
TEELAYLK

SEQ ID NO: 20743 - protein, 8 aa, Homo Sapiens
TLASALQV

SEQ ID NO: 20744 - protein, 8 aa, Homo Sapiens
TLGQIYYL

SEQ ID NO: 20745 - protein, 8 aa, Homo Sapiens
VLGKIWKL

SEQ ID NO: 20746 - protein, 8 aa, Homo Sapiens
VSLTACKV

SEQ ID NO: 20747 - protein, 8 aa, Homo Sapiens
YLGQIQHI

SEQ ID NO: 20748 - protein, 9 aa, Homo Sapiens
AAALIIHHV

SEQ ID NO: 20749 - protein, 9 aa, Homo Sapiens
AAPAPAAHV

SEQ ID NO: 20750 - protein, 9 aa, Homo Sapiens
AAPAYSRAL

SEQ ID NO: 20751 - protein, 9 aa, Homo Sapiens
AAPKAGPGV

SEQ ID NO: 20752 - protein, 9 aa, Homo Sapiens
AAPPPSVTV

SEQ ID NO: 20753 - protein, 9 aa, Homo Sapiens
ADASLLKKV

SEQ ID NO: 20754 - protein, 9 aa, Homo Sapiens
AIAPIIAAV

SEQ ID NO: 20755 - protein, 9 aa, Homo Sapiens
AIARICQTV

SEQ ID NO: 20756 - protein, 9 aa, Homo Sapiens
AIAYILQGV

SEQ ID NO: 20757 - protein, 9 aa, Homo Sapiens
AICPNNHEV

SEQ ID NO: 20758 - protein, 9 aa, Homo Sapiens
AILLIDHQV

SEQ ID NO: 20759 - protein, 9 aa, Homo Sapiens
AIMEHAYYA

SEQ ID NO: 20760 - protein, 9 aa, Homo Sapiens
AIQDKLFQV

SEQ ID NO: 20761 - protein, 9 aa, Homo Sapiens
AIRELNEYL

SEQ ID NO: 20762 - protein, 9 aa, Homo Sapiens
AIVDKVPSV

SEQ ID NO: 20763 - protein, 9 aa, Homo Sapiens
AIYGGLCAL

SEQ ID NO: 20764 - protein, 9 aa, Homo Sapiens
AIYHVIMSV

SEQ ID NO: 20765 - protein, 9 aa, Homo Sapiens
ALAAALAHI

SEQ ID NO: 20766 - protein, 9 aa, Homo Sapiens
ALADFLPVM

SEQ ID NO: 20767 - protein, 9 aa, Homo Sapiens
ALADGVQKV

SEQ ID NO: 20768 - protein, 9 aa, Homo Sapiens
ALAEALKEV

SEQ ID NO: 20769 - protein, 9 aa, Homo Sapiens
ALAKLVEAI

SEQ ID NO: 20770 - protein, 9 aa, Homo Sapiens
ALANIAANI

SEQ ID NO: 20771 - protein, 9 aa, Homo Sapiens
ALANQIPTV

SEQ ID NO: 20772 - protein, 9 aa, Homo Sapiens
ALAPAPPQV

SEQ ID NO: 20773 - protein, 9 aa, Homo Sapiens
ALAPAPSLP

SEQ ID NO: 20774 - protein, 9 aa, Homo Sapiens
ALAPPPPAA

SEQ ID NO: 20775 - protein, 9 aa, Homo Sapiens
ALAPTPSAV

SEQ ID NO: 20776 - protein, 9 aa, Homo Sapiens
ALASLENHV

SEQ ID NO: 20777 - protein, 9 aa, Homo Sapiens
ALASVIMGL

SEQ ID NO: 20778 - protein, 9 aa, Homo Sapiens
ALATLIHQV

SEQ ID NO: 20779 - protein, 9 aa, Homo Sapiens
ALCALVYRL

SEQ ID NO: 20780 - protein, 9 aa, Homo Sapiens
ALCDFGHAV

SEQ ID NO: 20781 - protein, 9 aa, Homo Sapiens
ALCDTLITV

SEQ ID NO: 20782 - protein, 9 aa, Homo Sapiens
ALCPRIHEV

SEQ ID NO: 20783 - protein, 9 aa, Homo Sapiens
ALCPRLWDV

SEQ ID NO: 20784 - protein, 9 aa, Homo Sapiens
ALCVIRNLI

SEQ ID NO: 20785 - protein, 9 aa, Homo Sapiens
ALDDRLYCV

SEQ ID NO: 20786 - protein, 9 aa, Homo Sapiens
ALDEICFKV

SEQ ID NO: 20787 - protein, 9 aa, Homo Sapiens
ALDEPTTNL

SEQ ID NO: 20788 - protein, 9 aa, Homo Sapiens
ALDFLKHHL

SEQ ID NO: 20789 - protein, 9 aa, Homo Sapiens
ALDHMVEYV

SEQ ID NO: 20790 - protein, 9 aa, Homo Sapiens
ALDKITASL

SEQ ID NO: 20791 - protein, 9 aa, Homo Sapiens
ALDRIVEYL

SEQ ID NO: 20792 - protein, 9 aa, Homo Sapiens
ALDSQVPKV

SEQ ID NO: 20793 - protein, 9 aa, Homo Sapiens
ALFAGFRAL

SEQ ID NO: 20794 - protein, 9 aa, Homo Sapiens
ALFLLEHQA

SEQ ID NO: 20795 - protein, 9 aa, Homo Sapiens
ALFQHITAL

SEQ ID NO: 20796 - protein, 9 aa, Homo Sapiens
ALFQIEQGI

SEQ ID NO: 20797 - protein, 9 aa, Homo Sapiens
ALFQRPPLI

SEQ ID NO: 20798 - protein, 9 aa, Homo Sapiens
ALFSFLYHL

SEQ ID NO: 20799 - protein, 9 aa, Homo Sapiens
ALFVLPCTI

SEQ ID NO: 20800 - protein, 9 aa, Homo Sapiens
ALGPTGRGV

SEQ ID NO: 20801 - protein, 9 aa, Homo Sapiens
ALGPVPTAI

SEQ ID NO: 20802 - protein, 9 aa, Homo Sapiens
ALHDQLFYL

SEQ ID NO: 20803 - protein, 9 aa, Homo Sapiens
ALHPVQFYL

SEQ ID NO: 20804 - protein, 9 aa, Homo Sapiens
ALIEKLVEL

SEQ ID NO: 20805 - protein, 9 aa, Homo Sapiens
ALITRIFGV

SEQ ID NO: 20806 - protein, 9 aa, Homo Sapiens
ALLDKLYAL

SEQ ID NO: 20807 - protein, 9 aa, Homo Sapiens
ALLDRIVSV

SEQ ID NO: 20808 - protein, 9 aa, Homo Sapiens
ALLELLHEL

SEQ ID NO: 20809 - protein, 9 aa, Homo Sapiens
ALLGILQHV

SEQ ID NO: 20810 - protein, 9 aa, Homo Sapiens
ALLGKIEKV

SEQ ID NO: 20811 - protein, 9 aa, Homo Sapiens
ALLQRLEAL

SEQ ID NO: 20812 - protein, 9 aa, Homo Sapiens
ALLSRLEQI

SEQ ID NO: 20813 - protein, 9 aa, Homo Sapiens
ALMADMVYV

SEQ ID NO: 20814 - protein, 9 aa, Homo Sapiens
ALMDQVHHM

SEQ ID NO: 20815 - protein, 9 aa, Homo Sapiens
ALMEIKQLL

SEQ ID NO: 20816 - protein, 9 aa, Homo Sapiens
ALMPVLNQV

SEQ ID NO: 20817 - protein, 9 aa, Homo Sapiens
ALMPWRYAL

SEQ ID NO: 20818 - protein, 9 aa, Homo Sapiens
ALMQIQQGL

SEQ ID NO: 20819 - protein, 9 aa, Homo Sapiens
ALMSRPAQV

SEQ ID NO: 20820 - protein, 9 aa, Homo Sapiens
ALNDCIYSV

SEQ ID NO: 20821 - protein, 9 aa, Homo Sapiens
ALNDPKMYV

SEQ ID NO: 20822 - protein, 9 aa, Homo Sapiens
ALNEKLVNL

SEQ ID NO: 20823 - protein, 9 aa, Homo Sapiens
ALNELLQHV

SEQ ID NO: 20824 - protein, 9 aa, Homo Sapiens
ALNEQIARL

SEQ ID NO: 20825 - protein, 9 aa, Homo Sapiens
ALNGHVEMV

SEQ ID NO: 20826 - protein, 9 aa, Homo Sapiens
ALPPPPPAA

SEQ ID NO: 20827 - protein, 9 aa, Homo Sapiens
ALPPVLTTV

SEQ ID NO: 20828 - protein, 9 aa, Homo Sapiens
ALQEKLWNV

SEQ ID NO: 20829 - protein, 9 aa, Homo Sapiens
ALQEKVQAV

SEQ ID NO: 20830 - protein, 9 aa, Homo Sapiens
ALSDIFQAV

SEQ ID NO: 20831 - protein, 9 aa, Homo Sapiens
ALSDSIHTV

SEQ ID NO: 20832 - protein, 9 aa, Homo Sapiens
ALSEKIVSV

SEQ ID NO: 20833 - protein, 9 aa, Homo Sapiens
ALSQLVPCV

SEQ ID NO: 20834 - protein, 9 aa, Homo Sapiens
ALSSVIKEL

SEQ ID NO: 20835 - protein, 9 aa, Homo Sapiens
ALTELLAKI

SEQ ID NO: 20836 - protein, 9 aa, Homo Sapiens
ALTRVIYNL

SEQ ID NO: 20837 - protein, 9 aa, Homo Sapiens
ALWAGLLTL

SEQ ID NO: 20838 - protein, 9 aa, Homo Sapiens
ALWDKLFNL

SEQ ID NO: 20839 - protein, 9 aa, Homo Sapiens
ALWEGPSKA

SEQ ID NO: 20840 - protein, 9 aa, Homo Sapiens
ALWGGPISL

SEQ ID NO: 20841 - protein, 9 aa, Homo Sapiens
ALWHVPEHA

SEQ ID NO: 20842 - protein, 9 aa, Homo Sapiens
ALWIPEVSI

SEQ ID NO: 20843 - protein, 9 aa, Homo Sapiens
ALWPVSKQL

SEQ ID NO: 20844 - protein, 9 aa, Homo Sapiens
ALWREVASL

SEQ ID NO: 20845 - protein, 9 aa, Homo Sapiens
ALYAVIEKA

SEQ ID NO: 20846 - protein, 9 aa, Homo Sapiens
ALYDNVEKL

SEQ ID NO: 20847 - protein, 9 aa, Homo Sapiens
ALYPNVVQV

SEQ ID NO: 20848 - protein, 9 aa, Homo Sapiens
ALYTLVNKV

SEQ ID NO: 20849 - protein, 9 aa, Homo Sapiens
ALYTVIETV

SEQ ID NO: 20850 - protein, 9 aa, Homo Sapiens
ALYTVLHRL

SEQ ID NO: 20851 - protein, 9 aa, Homo Sapiens
AMAASPHAV

SEQ ID NO: 20852 - protein, 9 aa, Homo Sapiens
AMAKIQAKI

SEQ ID NO: 20853 - protein, 9 aa, Homo Sapiens
AMAVIKEKI

SEQ ID NO: 20854 - protein, 9 aa, Homo Sapiens
AMFDFSEKL

SEQ ID NO: 20855 - protein, 9 aa, Homo Sapiens
AMFENFVSV

SEQ ID NO: 20856 - protein, 9 aa, Homo Sapiens
AMFERIVKA

SEQ ID NO: 20857 - protein, 9 aa, Homo Sapiens
AMFGKLMTI

SEQ ID NO: 20858 - protein, 9 aa, Homo Sapiens
AMFRPFVEV

SEQ ID NO: 20859 - protein, 9 aa, Homo Sapiens
AMLAVLHTV

SEQ ID NO: 20860 - protein, 9 aa, Homo Sapiens
AMLTVLHEI

SEQ ID NO: 20861 - protein, 9 aa, Homo Sapiens
AMNARPHKV

SEQ ID NO: 20862 - protein, 9 aa, Homo Sapiens
AMNGHVPAV

SEQ ID NO: 20863 - protein, 9 aa, Homo Sapiens
AMTHITEGI

SEQ ID NO: 20864 - protein, 9 aa, Homo Sapiens
AMWANEQAL

SEQ ID NO: 20865 - protein, 9 aa, Homo Sapiens
AMWDLTTAM

SEQ ID NO: 20866 - protein, 9 aa, Homo Sapiens
AMWEHPITA

SEQ ID NO: 20867 - protein, 9 aa, Homo Sapiens
AMYFIQQKV

SEQ ID NO: 20868 - protein, 9 aa, Homo Sapiens
APSFLEGLW

SEQ ID NO: 20869 - protein, 9 aa, Homo Sapiens
AQFRVTEAL

SEQ ID NO: 20870 - protein, 9 aa, Homo Sapiens
AQIEVVPSA

SEQ ID NO: 20871 - protein, 9 aa, Homo Sapiens
AQLPRIFHV

SEQ ID NO: 20872 - protein, 9 aa, Homo Sapiens
AQVSKVEAL

SEQ ID NO: 20873 - protein, 9 aa, Homo Sapiens
AQWLIQRGV

SEQ ID NO: 20874 - protein, 9 aa, Homo Sapiens
AQYENPPHI

SEQ ID NO: 20875 - protein, 9 aa, Homo Sapiens
AQYLINARL

SEQ ID NO: 20876 - protein, 9 aa, Homo Sapiens
ATADYICKV

SEQ ID NO: 20877 - protein, 9 aa, Homo Sapiens
ATDHIKVQV

SEQ ID NO: 20878 - protein, 9 aa, Homo Sapiens
ATFIVKDLL

SEQ ID NO: 20879 - protein, 9 aa, Homo Sapiens
ATFKGIVRA

SEQ ID NO: 20880 - protein, 9 aa, Homo Sapiens
ATLNIIHSV

SEQ ID NO: 20881 - protein, 9 aa, Homo Sapiens
ATMPVVPSV

SEQ ID NO: 20882 - protein, 9 aa, Homo Sapiens
ATPLPAGIS

SEQ ID NO: 20883 - protein, 9 aa, Homo Sapiens
ATYVFLHTV

SEQ ID NO: 20884 - protein, 9 aa, Homo Sapiens
AVANIVNSV

SEQ ID NO: 20885 - protein, 9 aa, Homo Sapiens
AVAWLVAHV

SEQ ID NO: 20886 - protein, 9 aa, Homo Sapiens
AVCGYLVEL

SEQ ID NO: 20887 - protein, 9 aa, Homo Sapiens
AVFGGIYCL

SEQ ID NO: 20888 - protein, 9 aa, Homo Sapiens
AVFKELVKL

SEQ ID NO: 20889 - protein, 9 aa, Homo Sapiens
AVGQISVHV

SEQ ID NO: 20890 - protein, 9 aa, Homo Sapiens
AVMDWKDVL

SEQ ID NO: 20891 - protein, 9 aa, Homo Sapiens
AVPPPLAKA

SEQ ID NO: 20892 - protein, 9 aa, Homo Sapiens
AVWAAVQAV

SEQ ID NO: 20893 - protein, 9 aa, Homo Sapiens
AVYKVSEYA

SEQ ID NO: 20894 - protein, 9 aa, Homo Sapiens
CAPRRKVAL

SEQ ID NO: 20895 - protein, 9 aa, Homo Sapiens
CLWAQIQKL

SEQ ID NO: 20896 - protein, 9 aa, Homo Sapiens
CLYGNVEKV

SEQ ID NO: 20897 - protein, 9 aa, Homo Sapiens
CMAWLVDHV

SEQ ID NO: 20898 - protein, 9 aa, Homo Sapiens
ELKPFIEEL

SEQ ID NO: 20899 - protein, 9 aa, Homo Sapiens
ELMEQVPHI

SEQ ID NO: 20900 - protein, 9 aa, Homo Sapiens
ELYERPPHL

SEQ ID NO: 20901 - protein, 9 aa, Homo Sapiens
EVFEVVERV

SEQ ID NO: 20902 - protein, 9 aa, Homo Sapiens
FAFLISERL

SEQ ID NO: 20903 - protein, 9 aa, Homo Sapiens
FAPPQPVAA

SEQ ID NO: 20904 - protein, 9 aa, Homo Sapiens
FAYTVKYVL

SEQ ID NO: 20905 - protein, 9 aa, Homo Sapiens
FEWENKVTV

SEQ ID NO: 20906 - protein, 9 aa, Homo Sapiens
FGFEITHEV

SEQ ID NO: 20907 - protein, 9 aa, Homo Sapiens
FGPPIPKGV

SEQ ID NO: 20908 - protein, 9 aa, Homo Sapiens
FIIQGLRSV

SEQ ID NO: 20909 - protein, 9 aa, Homo Sapiens
FILANEHNV

SEQ ID NO: 20910 - protein, 9 aa, Homo Sapiens
FILEKIEYL

SEQ ID NO: 20911 - protein, 9 aa, Homo Sapiens
FILQPIHNL

SEQ ID NO: 20912 - protein, 9 aa, Homo Sapiens
FIQEIEHAL

SEQ ID NO: 20913 - protein, 9 aa, Homo Sapiens
FIWENIHTL

SEQ ID NO: 20914 - protein, 9 aa, Homo Sapiens
FIWNMKTNI

SEQ ID NO: 20915 - protein, 9 aa, Homo Sapiens
FIWPMLIHI

SEQ ID NO: 20916 - protein, 9 aa, Homo Sapiens
FLADIVQKL

SEQ ID NO: 20917 - protein, 9 aa, Homo Sapiens
FLADNHHQV

SEQ ID NO: 20918 - protein, 9 aa, Homo Sapiens
FLADPSAFV

SEQ ID NO: 20919 - protein, 9 aa, Homo Sapiens
FLAFILHRL

SEQ ID NO: 20920 - protein, 9 aa, Homo Sapiens
FLAGAVTSV

SEQ ID NO: 20921 - protein, 9 aa, Homo Sapiens
FLAHIYTEL

SEQ ID NO: 20922 - protein, 9 aa, Homo Sapiens
FLAKLIAQA

SEQ ID NO: 20923 - protein, 9 aa, Homo Sapiens
FLANIGTSV

SEQ ID NO: 20924 - protein, 9 aa, Homo Sapiens
FLCPFHLSV

SEQ ID NO: 20925 - protein, 9 aa, Homo Sapiens
FLDDVVHSL

SEQ ID NO: 20926 - protein, 9 aa, Homo Sapiens
FLDEPTNHL

SEQ ID NO: 20927 - protein, 9 aa, Homo Sapiens
FLDHIIASV

SEQ ID NO: 20928 - protein, 9 aa, Homo Sapiens
FLDHVMYTI

SEQ ID NO: 20929 - protein, 9 aa, Homo Sapiens
FLDKQGFYV

SEQ ID NO: 20930 - protein, 9 aa, Homo Sapiens
FLDLLQERI

SEQ ID NO: 20931 - protein, 9 aa, Homo Sapiens
FLDNLHINL

SEQ ID NO: 20932 - protein, 9 aa, Homo Sapiens
FLDSLRDLI

SEQ ID NO: 20933 - protein, 9 aa, Homo Sapiens
FLDTIKSNL

SEQ ID NO: 20934 - protein, 9 aa, Homo Sapiens
FLDTLKDLI

SEQ ID NO: 20935 - protein, 9 aa, Homo Sapiens
FLDTLKVLV

SEQ ID NO: 20936 - protein, 9 aa, Homo Sapiens
FLEDLKSFV

SEQ ID NO: 20937 - protein, 9 aa, Homo Sapiens
FLEEEVYPL

SEQ ID NO: 20938 - protein, 9 aa, Homo Sapiens
FLFDHLLTL

SEQ ID NO: 20939 - protein, 9 aa, Homo Sapiens
FLFDKVVIV

SEQ ID NO: 20940 - protein, 9 aa, Homo Sapiens
FLFDRPMHV

SEQ ID NO: 20941 - protein, 9 aa, Homo Sapiens
FLFDTQHFI

SEQ ID NO: 20942 - protein, 9 aa, Homo Sapiens
FLFELPSRL

SEQ ID NO: 20943 - protein, 9 aa, Homo Sapiens
FLFEPVVKA

SEQ ID NO: 20944 - protein, 9 aa, Homo Sapiens
FLFGEVHKA

SEQ ID NO: 20945 - protein, 9 aa, Homo Sapiens
FLFGSIRGA

SEQ ID NO: 20946 - protein, 9 aa, Homo Sapiens
FLFGYPKRL

SEQ ID NO: 20947 - protein, 9 aa, Homo Sapiens
FLFNKVVNL

SEQ ID NO: 20948 - protein, 9 aa, Homo Sapiens
FLFNTENKL

SEQ ID NO: 20949 - protein, 9 aa, Homo Sapiens
FLFPNKESL

SEQ ID NO: 20950 - protein, 9 aa, Homo Sapiens
FLFQEPRSI

SEQ ID NO: 20951 - protein, 9 aa, Homo Sapiens
FLFQGFRLV

SEQ ID NO: 20952 - protein, 9 aa, Homo Sapiens
FLFSDVCRV

SEQ ID NO: 20953 - protein, 9 aa, Homo Sapiens
FLFSKFIEL

SEQ ID NO: 20954 - protein, 9 aa, Homo Sapiens
FLFTTPCRL

SEQ ID NO: 20955 - protein, 9 aa, Homo Sapiens
FLGSFIDHV

SEQ ID NO: 20956 - protein, 9 aa, Homo Sapiens
FLHDNMVEI

SEQ ID NO: 20957 - protein, 9 aa, Homo Sapiens
FLHPEPFSI

SEQ ID NO: 20958 - protein, 9 aa, Homo Sapiens
FLHRIRQNV

SEQ ID NO: 20959 - protein, 9 aa, Homo Sapiens
FLINFIHTL

SEQ ID NO: 20960 - protein, 9 aa, Homo Sapiens
FLIPIYHQV

SEQ ID NO: 20961 - protein, 9 aa, Homo Sapiens
FLLDKKIGV

SEQ ID NO: 20962 - protein, 9 aa, Homo Sapiens
FLLEGIRSL

SEQ ID NO: 20963 - protein, 9 aa, Homo Sapiens
FLLEKGYEV

SEQ ID NO: 20964 - protein, 9 aa, Homo Sapiens
FLLEKPFSV

SEQ ID NO: 20965 - protein, 9 aa, Homo Sapiens
FLLFINHRL

SEQ ID NO: 20966 - protein, 9 aa, Homo Sapiens
FLLHIQQQV

SEQ ID NO: 20967 - protein, 9 aa, Homo Sapiens
FLLKLIHIL

SEQ ID NO: 20968 - protein, 9 aa, Homo Sapiens
FLLPILSQI

SEQ ID NO: 20969 - protein, 9 aa, Homo Sapiens
FLLPKVQSI

SEQ ID NO: 20970 - protein, 9 aa, Homo Sapiens
FLLQIHEHI

SEQ ID NO: 20971 - protein, 9 aa, Homo Sapiens
FLMDFIHQV

SEQ ID NO: 20972 - protein, 9 aa, Homo Sapiens
FLMEEVHMI

SEQ ID NO: 20973 - protein, 9 aa, Homo Sapiens
FLMELEQPA

SEQ ID NO: 20974 - protein, 9 aa, Homo Sapiens
FLMNEVIKL

SEQ ID NO: 20975 - protein, 9 aa, Homo Sapiens
FLNDEVWNL

SEQ ID NO: 20976 - protein, 9 aa, Homo Sapiens
FLNKEITSV

SEQ ID NO: 20977 - protein, 9 aa, Homo Sapiens
FLNKLIPVL

SEQ ID NO: 20978 - protein, 9 aa, Homo Sapiens
FLNNQIKEL

SEQ ID NO: 20979 - protein, 9 aa, Homo Sapiens
FLPEAPAEL

SEQ ID NO: 20980 - protein, 9 aa, Homo Sapiens
FLPEPMGTA

SEQ ID NO: 20981 - protein, 9 aa, Homo Sapiens
FLPPAQVTV

SEQ ID NO: 20982 - protein, 9 aa, Homo Sapiens
FLPPLPTSV

SEQ ID NO: 20983 - protein, 9 aa, Homo Sapiens
FLQEHNTTL

SEQ ID NO: 20984 - protein, 9 aa, Homo Sapiens
FLQEKSPAV

SEQ ID NO: 20985 - protein, 9 aa, Homo Sapiens
FLQEYVANL

SEQ ID NO: 20986 - protein, 9 aa, Homo Sapiens
FLQKIEALV

SEQ ID NO: 20987 - protein, 9 aa, Homo Sapiens
FLQPELVKL

SEQ ID NO: 20988 - protein, 9 aa, Homo Sapiens
FLQPGGYHV

SEQ ID NO: 20989 - protein, 9 aa, Homo Sapiens
FLQPHLDAV

SEQ ID NO: 20990 - protein, 9 aa, Homo Sapiens
FLRNINEYL

SEQ ID NO: 20991 - protein, 9 aa, Homo Sapiens
FLSEKLERI

SEQ ID NO: 20992 - protein, 9 aa, Homo Sapiens
FLSELTQQL

SEQ ID NO: 20993 - protein, 9 aa, Homo Sapiens
FLSEVFHQA

SEQ ID NO: 20994 - protein, 9 aa, Homo Sapiens
FLSFPTTKT

SEQ ID NO: 20995 - protein, 9 aa, Homo Sapiens
FLSSVIQNL

SEQ ID NO: 20996 - protein, 9 aa, Homo Sapiens
FLVDGVCTV

SEQ ID NO: 20997 - protein, 9 aa, Homo Sapiens
FLVTVIHTL

SEQ ID NO: 20998 - protein, 9 aa, Homo Sapiens
FLWERPTLL

SEQ ID NO: 20999 - protein, 9 aa, Homo Sapiens
FLWKEPATM

SEQ ID NO: 21000 - protein, 9 aa, Homo Sapiens
FLWKITNVT

SEQ ID NO: 21001 - protein, 9 aa, Homo Sapiens
FLYAGHIFL

SEQ ID NO: 21002 - protein, 9 aa, Homo Sapiens
FLYDDNQRV

SEQ ID NO: 21003 - protein, 9 aa, Homo Sapiens
FLYDTHQNL

SEQ ID NO: 21004 - protein, 9 aa, Homo Sapiens
FLYPFLHTV

SEQ ID NO: 21005 - protein, 9 aa, Homo Sapiens
FLYPFPLAL

SEQ ID NO: 21006 - protein, 9 aa, Homo Sapiens
FLYQILRGL

SEQ ID NO: 21007 - protein, 9 aa, Homo Sapiens
FLYSGGHRV

SEQ ID NO: 21008 - protein, 9 aa, Homo Sapiens
FMADCPHTI

SEQ ID NO: 21009 - protein, 9 aa, Homo Sapiens
FMAPKAWTV

SEQ ID NO: 21010 - protein, 9 aa, Homo Sapiens
FMATIAEGL

SEQ ID NO: 21011 - protein, 9 aa, Homo Sapiens
FMCDKIYQV

SEQ ID NO: 21012 - protein, 9 aa, Homo Sapiens
FMLPDPQNI

SEQ ID NO: 21013 - protein, 9 aa, Homo Sapiens
FMMPRIVNV

SEQ ID NO: 21014 - protein, 9 aa, Homo Sapiens
FMNPHLISV

SEQ ID NO: 21015 - protein, 9 aa, Homo Sapiens
FMQAIKENI

SEQ ID NO: 21016 - protein, 9 aa, Homo Sapiens
FMSSHIKSV

SEQ ID NO: 21017 - protein, 9 aa, Homo Sapiens
FMTTNVPNV

SEQ ID NO: 21018 - protein, 9 aa, Homo Sapiens
FQDEINWRL

SEQ ID NO: 21019 - protein, 9 aa, Homo Sapiens
FQHTGIYSV

SEQ ID NO: 21020 - protein, 9 aa, Homo Sapiens
FQIRNLPSL

SEQ ID NO: 21021 - protein, 9 aa, Homo Sapiens
FQLPAPPHI

SEQ ID NO: 21022 - protein, 9 aa, Homo Sapiens
FQLPIRFNL

SEQ ID NO: 21023 - protein, 9 aa, Homo Sapiens
FQWDIMERI

SEQ ID NO: 21024 - protein, 9 aa, Homo Sapiens
FSDEIRHNL

SEQ ID NO: 21025 - protein, 9 aa, Homo Sapiens
FTDVIGHYI

SEQ ID NO: 21026 - protein, 9 aa, Homo Sapiens
FTFSGICRV

SEQ ID NO: 21027 - protein, 9 aa, Homo Sapiens
FTWEGLYNV

SEQ ID NO: 21028 - protein, 9 aa, Homo Sapiens
FTWNMNEKL

SEQ ID NO: 21029 - protein, 9 aa, Homo Sapiens
FTWPIKIQV

SEQ ID NO: 21030 - protein, 9 aa, Homo Sapiens
FTYATTEKV

SEQ ID NO: 21031 - protein, 9 aa, Homo Sapiens
FVAPPTAAV

SEQ ID NO: 21032 - protein, 9 aa, Homo Sapiens
FVARMIPKV

SEQ ID NO: 21033 - protein, 9 aa, Homo Sapiens
FVCDIRPEI

SEQ ID NO: 21034 - protein, 9 aa, Homo Sapiens
FVLDKVPFL

SEQ ID NO: 21035 - protein, 9 aa, Homo Sapiens
FVLPELPSV

SEQ ID NO: 21036 - protein, 9 aa, Homo Sapiens
FVNDIFERI

SEQ ID NO: 21037 - protein, 9 aa, Homo Sapiens
FVPDTPVGV

SEQ ID NO: 21038 - protein, 9 aa, Homo Sapiens
FVWEASHYL

SEQ ID NO: 21039 - protein, 9 aa, Homo Sapiens
GIFETKFQV

SEQ ID NO: 21040 - protein, 9 aa, Homo Sapiens
GIMKKAYEL

SEQ ID NO: 21041 - protein, 9 aa, Homo Sapiens
GIWSITAKV

SEQ ID NO: 21042 - protein, 9 aa, Homo Sapiens
GLADKVYFL

SEQ ID NO: 21043 - protein, 9 aa, Homo Sapiens
GLAKAVASV

SEQ ID NO: 21044 - protein, 9 aa, Homo Sapiens
GLAPKPVQV

SEQ ID NO: 21045 - protein, 9 aa, Homo Sapiens
GLCERLVSL

SEQ ID NO: 21046 - protein, 9 aa, Homo Sapiens
GLDGPPPTV

SEQ ID NO: 21047 - protein, 9 aa, Homo Sapiens
GLDIITNKV

SEQ ID NO: 21048 - protein, 9 aa, Homo Sapiens
GLFHLGEFV

SEQ ID NO: 21049 - protein, 9 aa, Homo Sapiens
GLLENIPRV

SEQ ID NO: 21050 - protein, 9 aa, Homo Sapiens
GLLGYLHFV

SEQ ID NO: 21051 - protein, 9 aa, Homo Sapiens
GLLPDVPSL

SEQ ID NO: 21052 - protein, 9 aa, Homo Sapiens
GLMRKVPRV

SEQ ID NO: 21053 - protein, 9 aa, Homo Sapiens
GLMTTVHAI

SEQ ID NO: 21054 - protein, 9 aa, Homo Sapiens
GLTEALHFV

SEQ ID NO: 21055 - protein, 9 aa, Homo Sapiens
GLWGPVHEL

SEQ ID NO: 21056 - protein, 9 aa, Homo Sapiens
GLYELVWRV

SEQ ID NO: 21057 - protein, 9 aa, Homo Sapiens
GMYIFLHTV

SEQ ID NO: 21058 - protein, 9 aa, Homo Sapiens
GMYPNLVHV

SEQ ID NO: 21059 - protein, 9 aa, Homo Sapiens
GMYVFLHAV

SEQ ID NO: 21060 - protein, 9 aa, Homo Sapiens
GQAPSVFSV

SEQ ID NO: 21061 - protein, 9 aa, Homo Sapiens
GQIEVVPEV

SEQ ID NO: 21062 - protein, 9 aa, Homo Sapiens
GVDDLDFFI

SEQ ID NO: 21063 - protein, 9 aa, Homo Sapiens
GVGPVPARA

SEQ ID NO: 21064 - protein, 9 aa, Homo Sapiens
GVYGDVQRV

SEQ ID NO: 21065 - protein, 9 aa, Homo Sapiens
HIIENIVAV

SEQ ID NO: 21066 - protein, 9 aa, Homo Sapiens
HIWDPLTNV

SEQ ID NO: 21067 - protein, 9 aa, Homo Sapiens
HIYPLSFFL

SEQ ID NO: 21068 - protein, 9 aa, Homo Sapiens
HLAEVLERV

SEQ ID NO: 21069 - protein, 9 aa, Homo Sapiens
HLAEVSAEV

SEQ ID NO: 21070 - protein, 9 aa, Homo Sapiens
HLAHYVPKI

SEQ ID NO: 21071 - protein, 9 aa, Homo Sapiens
HLANIVERL

SEQ ID NO: 21072 - protein, 9 aa, Homo Sapiens
HLANIVERV

SEQ ID NO: 21073 - protein, 9 aa, Homo Sapiens
HLCEHIWTL

SEQ ID NO: 21074 - protein, 9 aa, Homo Sapiens
HLDTLHNFV

SEQ ID NO: 21075 - protein, 9 aa, Homo Sapiens
HLFDLNCKI

SEQ ID NO: 21076 - protein, 9 aa, Homo Sapiens
HLFKITENI

SEQ ID NO: 21077 - protein, 9 aa, Homo Sapiens
HLFNVAHTL

SEQ ID NO: 21078 - protein, 9 aa, Homo Sapiens
HLLHTVPAL

SEQ ID NO: 21079 - protein, 9 aa, Homo Sapiens
HLNEHLYNM

SEQ ID NO: 21080 - protein, 9 aa, Homo Sapiens
HLSDAIVEV

SEQ ID NO: 21081 - protein, 9 aa, Homo Sapiens
HLWRGIVSI

SEQ ID NO: 21082 - protein, 9 aa, Homo Sapiens
HLWSGPRCL

SEQ ID NO: 21083 - protein, 9 aa, Homo Sapiens
HLYDIHVTV

SEQ ID NO: 21084 - protein, 9 aa, Homo Sapiens
HLYRIIQHL

SEQ ID NO: 21085 - protein, 9 aa, Homo Sapiens
HMYKLRTNL

SEQ ID NO: 21086 - protein, 9 aa, Homo Sapiens
HTYHIKNYI

SEQ ID NO: 21087 - protein, 9 aa, Homo Sapiens
HVDEIKEFL

SEQ ID NO: 21088 - protein, 9 aa, Homo Sapiens
HVLDVIHEV

SEQ ID NO: 21089 - protein, 9 aa, Homo Sapiens
IAPPGHTGV

SEQ ID NO: 21090 - protein, 9 aa, Homo Sapiens
IAPPVPLKA

SEQ ID NO: 21091 - protein, 9 aa, Homo Sapiens
IAVVQPEKQ

SEQ ID NO: 21092 - protein, 9 aa, Homo Sapiens
IIDGKIFCV

SEQ ID NO: 21093 - protein, 9 aa, Homo Sapiens
IIHNLGMYV

SEQ ID NO: 21094 - protein, 9 aa, Homo Sapiens
IIYIVHDEV

SEQ ID NO: 21095 - protein, 9 aa, Homo Sapiens
ILAAIVNHL

SEQ ID NO: 21096 - protein, 9 aa, Homo Sapiens
ILCEHPNQV

SEQ ID NO: 21097 - protein, 9 aa, Homo Sapiens
ILCELINKL

SEQ ID NO: 21098 - protein, 9 aa, Homo Sapiens
ILDDIGHGV

SEQ ID NO: 21099 - protein, 9 aa, Homo Sapiens
ILDEPTNHL

SEQ ID NO: 21100 - protein, 9 aa, Homo Sapiens
ILDESHERV

SEQ ID NO: 21101 - protein, 9 aa, Homo Sapiens
ILDEVIFKL

SEQ ID NO: 21102 - protein, 9 aa, Homo Sapiens
ILDKIVQKV

SEQ ID NO: 21103 - protein, 9 aa, Homo Sapiens
ILDKKVEKV

SEQ ID NO: 21104 - protein, 9 aa, Homo Sapiens
ILDLIKKGV

SEQ ID NO: 21105 - protein, 9 aa, Homo Sapiens
ILFDPKTSV

SEQ ID NO: 21106 - protein, 9 aa, Homo Sapiens
ILFNRVLGV

SEQ ID NO: 21107 - protein, 9 aa, Homo Sapiens
ILFPLRFTL

SEQ ID NO: 21108 - protein, 9 aa, Homo Sapiens
ILFYVEHQA

SEQ ID NO: 21109 - protein, 9 aa, Homo Sapiens
ILGPIPSHM

SEQ ID NO: 21110 - protein, 9 aa, Homo Sapiens
ILGPKPQGV

SEQ ID NO: 21111 - protein, 9 aa, Homo Sapiens
ILHEIALGV

SEQ ID NO: 21112 - protein, 9 aa, Homo Sapiens
ILHHVNIGL

SEQ ID NO: 21113 - protein, 9 aa, Homo Sapiens
ILHSVTTNL

SEQ ID NO: 21114 - protein, 9 aa, Homo Sapiens
ILLAEVPTM

SEQ ID NO: 21115 - protein, 9 aa, Homo Sapiens
ILLDNEFHV

SEQ ID NO: 21116 - protein, 9 aa, Homo Sapiens
ILLEMIHSI

SEQ ID NO: 21117 - protein, 9 aa, Homo Sapiens
ILLGCVPSL

SEQ ID NO: 21118 - protein, 9 aa, Homo Sapiens
ILLNIEHRI

SEQ ID NO: 21119 - protein, 9 aa, Homo Sapiens
ILMEHIHKL

SEQ ID NO: 21120 - protein, 9 aa, Homo Sapiens
ILMGVLKEV

SEQ ID NO: 21121 - protein, 9 aa, Homo Sapiens
ILMHHPPQV

SEQ ID NO: 21122 - protein, 9 aa, Homo Sapiens
ILNEIVNFV

SEQ ID NO: 21123 - protein, 9 aa, Homo Sapiens
ILNKQEFFV

SEQ ID NO: 21124 - protein, 9 aa, Homo Sapiens
ILSEIKEAV

SEQ ID NO: 21125 - protein, 9 aa, Homo Sapiens
ILSEVQQAV

SEQ ID NO: 21126 - protein, 9 aa, Homo Sapiens
ILSGVIRSV

SEQ ID NO: 21127 - protein, 9 aa, Homo Sapiens
ILTDITKGV

SEQ ID NO: 21128 - protein, 9 aa, Homo Sapiens
ILWEHCIRL

SEQ ID NO: 21129 - protein, 9 aa, Homo Sapiens
ILWEHLEIL

SEQ ID NO: 21130 - protein, 9 aa, Homo Sapiens
ILWETVPSM

SEQ ID NO: 21131 - protein, 9 aa, Homo Sapiens
ILWSHLELL

SEQ ID NO: 21132 - protein, 9 aa, Homo Sapiens
ILYDKLEKI

SEQ ID NO: 21133 - protein, 9 aa, Homo Sapiens
ILYDLQQNL

SEQ ID NO: 21134 - protein, 9 aa, Homo Sapiens
ILYGEVEKL

SEQ ID NO: 21135 - protein, 9 aa, Homo Sapiens
ILYGKIIHL

SEQ ID NO: 21136 - protein, 9 aa, Homo Sapiens
ILYRVGDGV

SEQ ID NO: 21137 - protein, 9 aa, Homo Sapiens
IMDKLKEYL

SEQ ID NO: 21138 - protein, 9 aa, Homo Sapiens
IMDRIYKNV

SEQ ID NO: 21139 - protein, 9 aa, Homo Sapiens
IMFQKPVEV

SEQ ID NO: 21140 - protein, 9 aa, Homo Sapiens
IMHDCVVKL

SEQ ID NO: 21141 - protein, 9 aa, Homo Sapiens
IMLEALERV

SEQ ID NO: 21142 - protein, 9 aa, Homo Sapiens
IMQLLRDNL

SEQ ID NO: 21143 - protein, 9 aa, Homo Sapiens
IMWPIIAKL

SEQ ID NO: 21144 - protein, 9 aa, Homo Sapiens
IQAERVRGV

SEQ ID NO: 21145 - protein, 9 aa, Homo Sapiens
IQDEIRSVI

SEQ ID NO: 21146 - protein, 9 aa, Homo Sapiens
IQDKCVPLV

SEQ ID NO: 21147 - protein, 9 aa, Homo Sapiens
IQDRAVPSL

SEQ ID NO: 21148 - protein, 9 aa, Homo Sapiens
IQLVHGLKL

SEQ ID NO: 21149 - protein, 9 aa, Homo Sapiens
IQVEKVFSI

SEQ ID NO: 21150 - protein, 9 aa, Homo Sapiens
IQVNCPPAV

SEQ ID NO: 21151 - protein, 9 aa, Homo Sapiens
IQVTKVTQV

SEQ ID NO: 21152 - protein, 9 aa, Homo Sapiens
ISPDVFTHV

SEQ ID NO: 21153 - protein, 9 aa, Homo Sapiens
ITDDLHFYV

SEQ ID NO: 21154 - protein, 9 aa, Homo Sapiens
ITFPVSEEL

SEQ ID NO: 21155 - protein, 9 aa, Homo Sapiens
ITMEIVNKL

SEQ ID NO: 21156 - protein, 9 aa, Homo Sapiens
ITTDVLYTI

SEQ ID NO: 21157 - protein, 9 aa, Homo Sapiens
IVNEPPPKL

SEQ ID NO: 21158 - protein, 9 aa, Homo Sapiens
IVRDIKEKL

SEQ ID NO: 21159 - protein, 9 aa, Homo Sapiens
IVWKIKETV

SEQ ID NO: 21160 - protein, 9 aa, Homo Sapiens
KAAKIRVSV

SEQ ID NO: 21161 - protein, 9 aa, Homo Sapiens
KAAQIKEHL

SEQ ID NO: 21162 - protein, 9 aa, Homo Sapiens
KAFNISTTL

SEQ ID NO: 21163 - protein, 9 aa, Homo Sapiens
KAPPAPLAA

SEQ ID NO: 21164 - protein, 9 aa, Homo Sapiens
KIADFGWSV

SEQ ID NO: 21165 - protein, 9 aa, Homo Sapiens
KIAEIKSLL

SEQ ID NO: 21166 - protein, 9 aa, Homo Sapiens
KIAWISETL

SEQ ID NO: 21167 - protein, 9 aa, Homo Sapiens
KICDYLFNV

SEQ ID NO: 21168 - protein, 9 aa, Homo Sapiens
KIFEFKETL

SEQ ID NO: 21169 - protein, 9 aa, Homo Sapiens
KIFLLKVLL

SEQ ID NO: 21170 - protein, 9 aa, Homo Sapiens
KIFNITDNA

SEQ ID NO: 21171 - protein, 9 aa, Homo Sapiens
KIFNNQEFA

SEQ ID NO: 21172 - protein, 9 aa, Homo Sapiens
KIFPALCTV

SEQ ID NO: 21173 - protein, 9 aa, Homo Sapiens
KIFQVAQEL

SEQ ID NO: 21174 - protein, 9 aa, Homo Sapiens
KIIDIQEKV

SEQ ID NO: 21175 - protein, 9 aa, Homo Sapiens
KILETLYTL

SEQ ID NO: 21176 - protein, 9 aa, Homo Sapiens
KILPTLEAV

SEQ ID NO: 21177 - protein, 9 aa, Homo Sapiens
KIMKLAANI

SEQ ID NO: 21178 - protein, 9 aa, Homo Sapiens
KINEAIVAV

SEQ ID NO: 21179 - protein, 9 aa, Homo Sapiens
KIPTPIVGV

SEQ ID NO: 21180 - protein, 9 aa, Homo Sapiens
KIQEILTQV

SEQ ID NO: 21181 - protein, 9 aa, Homo Sapiens
KISVIVETV

SEQ ID NO: 21182 - protein, 9 aa, Homo Sapiens
KITTVIQHV

SEQ ID NO: 21183 - protein, 9 aa, Homo Sapiens
KIVVVTAGV

SEQ ID NO: 21184 - protein, 9 aa, Homo Sapiens
KIWAPTAEA

SEQ ID NO: 21185 - protein, 9 aa, Homo Sapiens
KIWDLEGKI

SEQ ID NO: 21186 - protein, 9 aa, Homo Sapiens
KIWDPVHRV

SEQ ID NO: 21187 - protein, 9 aa, Homo Sapiens
KIWDVSVNS

SEQ ID NO: 21188 - protein, 9 aa, Homo Sapiens
KIWTPTAKA

SEQ ID NO: 21189 - protein, 9 aa, Homo Sapiens
KIWTSVPYL

SEQ ID NO: 21190 - protein, 9 aa, Homo Sapiens
KIYEGQVEV

SEQ ID NO: 21191 - protein, 9 aa, Homo Sapiens
KIYEHHIKV

SEQ ID NO: 21192 - protein, 9 aa, Homo Sapiens
KIYQWINEL

SEQ ID NO: 21193 - protein, 9 aa, Homo Sapiens
KLAAVVNNL

SEQ ID NO: 21194 - protein, 9 aa, Homo Sapiens
KLADICKNL

SEQ ID NO: 21195 - protein, 9 aa, Homo Sapiens
KLADKLYNL

SEQ ID NO: 21196 - protein, 9 aa, Homo Sapiens
KLAEFIDFL

SEQ ID NO: 21197 - protein, 9 aa, Homo Sapiens
KLAEIRHEV

SEQ ID NO: 21198 - protein, 9 aa, Homo Sapiens
KLAEIVKQV

SEQ ID NO: 21199 - protein, 9 aa, Homo Sapiens
KLAESVEKA

SEQ ID NO: 21200 - protein, 9 aa, Homo Sapiens
KLAEVSQNI

SEQ ID NO: 21201 - protein, 9 aa, Homo Sapiens
KLAKLQAQV

SEQ ID NO: 21202 - protein, 9 aa, Homo Sapiens
KLAKQPETV

SEQ ID NO: 21203 - protein, 9 aa, Homo Sapiens
KLAPPPKKA

SEQ ID NO: 21204 - protein, 9 aa, Homo Sapiens
KLCDIIVHI

SEQ ID NO: 21205 - protein, 9 aa, Homo Sapiens
KLCDVTLKI

SEQ ID NO: 21206 - protein, 9 aa, Homo Sapiens
KLCDVTTGL

SEQ ID NO: 21207 - protein, 9 aa, Homo Sapiens
KLCEGFNEV

SEQ ID NO: 21208 - protein, 9 aa, Homo Sapiens
KLCESLEEL

SEQ ID NO: 21209 - protein, 9 aa, Homo Sapiens
KLCYVGYNI

SEQ ID NO: 21210 - protein, 9 aa, Homo Sapiens
KLDDIVQHI

SEQ ID NO: 21211 - protein, 9 aa, Homo Sapiens
KLDHINMNL

SEQ ID NO: 21212 - protein, 9 aa, Homo Sapiens
KLDLIHESI

SEQ ID NO: 21213 - protein, 9 aa, Homo Sapiens
KLDQVIIHV

SEQ ID NO: 21214 - protein, 9 aa, Homo Sapiens
KLDSPRVTV

SEQ ID NO: 21215 - protein, 9 aa, Homo Sapiens
KLDVQPKCV

SEQ ID NO: 21216 - protein, 9 aa, Homo Sapiens
KLEEIIHQI

SEQ ID NO: 21217 - protein, 9 aa, Homo Sapiens
KLFDAPLSI

SEQ ID NO: 21218 - protein, 9 aa, Homo Sapiens
KLFDLDEKL

SEQ ID NO: 21219 - protein, 9 aa, Homo Sapiens
KLFDLLDVL

SEQ ID NO: 21220 - protein, 9 aa, Homo Sapiens
KLFDRPQEL

SEQ ID NO: 21221 - protein, 9 aa, Homo Sapiens
KLFDTQHRV

SEQ ID NO: 21222 - protein, 9 aa, Homo Sapiens
KLFDTQQFL

SEQ ID NO: 21223 - protein, 9 aa, Homo Sapiens
KLFEKVKEV

SEQ ID NO: 21224 - protein, 9 aa, Homo Sapiens
KLFGHLTSA

SEQ ID NO: 21225 - protein, 9 aa, Homo Sapiens
KLFKAPAYI

SEQ ID NO: 21226 - protein, 9 aa, Homo Sapiens
KLFLVNNKI

SEQ ID NO: 21227 - protein, 9 aa, Homo Sapiens
KLFNVTSTL

SEQ ID NO: 21228 - protein, 9 aa, Homo Sapiens
KLFPFYFHI

SEQ ID NO: 21229 - protein, 9 aa, Homo Sapiens
KLFSILSTV

SEQ ID NO: 21230 - protein, 9 aa, Homo Sapiens
KLFSLEHFL

SEQ ID NO: 21231 - protein, 9 aa, Homo Sapiens
KLFSLQDLL

SEQ ID NO: 21232 - protein, 9 aa, Homo Sapiens
KLFVIAQKI

SEQ ID NO: 21233 - protein, 9 aa, Homo Sapiens
KLGEIVTTI

SEQ ID NO: 21234 - protein, 9 aa, Homo Sapiens
KLGPAPKTL

SEQ ID NO: 21235 - protein, 9 aa, Homo Sapiens
KLGSVPVTV

SEQ ID NO: 21236 - protein, 9 aa, Homo Sapiens
KLHAVVETL

SEQ ID NO: 21237 - protein, 9 aa, Homo Sapiens
KLHDINAQL

SEQ ID NO: 21238 - protein, 9 aa, Homo Sapiens
KLHGVNINV

SEQ ID NO: 21239 - protein, 9 aa, Homo Sapiens
KLHLILDYV

SEQ ID NO: 21240 - protein, 9 aa, Homo Sapiens
KLHYVVTEV

SEQ ID NO: 21241 - protein, 9 aa, Homo Sapiens
KLIDKLDSL

SEQ ID NO: 21242 - protein, 9 aa, Homo Sapiens
KLIEELETL

SEQ ID NO: 21243 - protein, 9 aa, Homo Sapiens
KLIELKAEI

SEQ ID NO: 21244 - protein, 9 aa, Homo Sapiens
KLIGQVHEV

SEQ ID NO: 21245 - protein, 9 aa, Homo Sapiens
KLILLITQV

SEQ ID NO: 21246 - protein, 9 aa, Homo Sapiens
KLISELQKL

SEQ ID NO: 21247 - protein, 9 aa, Homo Sapiens
KLKNVNFEV

SEQ ID NO: 21248 - protein, 9 aa, Homo Sapiens
KLLAVIHEL

SEQ ID NO: 21249 - protein, 9 aa, Homo Sapiens
KLLDIRSYL

SEQ ID NO: 21250 - protein, 9 aa, Homo Sapiens
KLLDKISEL

SEQ ID NO: 21251 - protein, 9 aa, Homo Sapiens
KLLDKISSV

SEQ ID NO: 21252 - protein, 9 aa, Homo Sapiens
KLLDLQVRV

SEQ ID NO: 21253 - protein, 9 aa, Homo Sapiens
KLLDQMPSL

SEQ ID NO: 21254 - protein, 9 aa, Homo Sapiens
KLLDSMHEV

SEQ ID NO: 21255 - protein, 9 aa, Homo Sapiens
KLLDVVHPA

SEQ ID NO: 21256 - protein, 9 aa, Homo Sapiens
KLLEEICNL

SEQ ID NO: 21257 - protein, 9 aa, Homo Sapiens
KLLEIMTRI

SEQ ID NO: 21258 - protein, 9 aa, Homo Sapiens
KLLEKAFSI

SEQ ID NO: 21259 - protein, 9 aa, Homo Sapiens
KLLEKLYKV

SEQ ID NO: 21260 - protein, 9 aa, Homo Sapiens
KLLERVSAI

SEQ ID NO: 21261 - protein, 9 aa, Homo Sapiens
KLLEVYEQL

SEQ ID NO: 21262 - protein, 9 aa, Homo Sapiens
KLLFWVTEV

SEQ ID NO: 21263 - protein, 9 aa, Homo Sapiens
KLLGELHTL

SEQ ID NO: 21264 - protein, 9 aa, Homo Sapiens
KLLGNIKNV

SEQ ID NO: 21265 - protein, 9 aa, Homo Sapiens
KLLKLFQGV

SEQ ID NO: 21266 - protein, 9 aa, Homo Sapiens
KLLNLISKL

SEQ ID NO: 21267 - protein, 9 aa, Homo Sapiens
KLLPQLTYL

SEQ ID NO: 21268 - protein, 9 aa, Homo Sapiens
KLLTEVHAA

SEQ ID NO: 21269 - protein, 9 aa, Homo Sapiens
KLMDHIYAV

SEQ ID NO: 21270 - protein, 9 aa, Homo Sapiens
KLMDQLEAL

SEQ ID NO: 21271 - protein, 9 aa, Homo Sapiens
KLMEEIREL

SEQ ID NO: 21272 - protein, 9 aa, Homo Sapiens
KLMELLEEI

SEQ ID NO: 21273 - protein, 9 aa, Homo Sapiens
KLMELYERL

SEQ ID NO: 21274 - protein, 9 aa, Homo Sapiens
KLMGIVNKV

SEQ ID NO: 21275 - protein, 9 aa, Homo Sapiens
KLMSDLQKL

SEQ ID NO: 21276 - protein, 9 aa, Homo Sapiens
KLMTALVNV

SEQ ID NO: 21277 - protein, 9 aa, Homo Sapiens
KLNDIKEKV

SEQ ID NO: 21278 - protein, 9 aa, Homo Sapiens
KLNDLIQRL

SEQ ID NO: 21279 - protein, 9 aa, Homo Sapiens
KLNEIVDQI

SEQ ID NO: 21280 - protein, 9 aa, Homo Sapiens
KLNLLTEYI

SEQ ID NO: 21281 - protein, 9 aa, Homo Sapiens
KLNNLNKKL

SEQ ID NO: 21282 - protein, 9 aa, Homo Sapiens
KLNPQQFEV

SEQ ID NO: 21283 - protein, 9 aa, Homo Sapiens
KLPPPPPQA

SEQ ID NO: 21284 - protein, 9 aa, Homo Sapiens
KLQDQIFNL

SEQ ID NO: 21285 - protein, 9 aa, Homo Sapiens
KLQEFLQTL

SEQ ID NO: 21286 - protein, 9 aa, Homo Sapiens
KLQEKIQEL

SEQ ID NO: 21287 - protein, 9 aa, Homo Sapiens
KLQELEARV

SEQ ID NO: 21288 - protein, 9 aa, Homo Sapiens
KLQELNYNL

SEQ ID NO: 21289 - protein, 9 aa, Homo Sapiens
KLQEQIFHL

SEQ ID NO: 21290 - protein, 9 aa, Homo Sapiens
KLQEQIHRV

SEQ ID NO: 21291 - protein, 9 aa, Homo Sapiens
KLQEVLDYL

SEQ ID NO: 21292 - protein, 9 aa, Homo Sapiens
KLTEIRHEV

SEQ ID NO: 21293 - protein, 9 aa, Homo Sapiens
KLTENLVAL

SEQ ID NO: 21294 - protein, 9 aa, Homo Sapiens
KLVDCIIEV

SEQ ID NO: 21295 - protein, 9 aa, Homo Sapiens
KLVELPYTV

SEQ ID NO: 21296 - protein, 9 aa, Homo Sapiens
KLWDINAHI

SEQ ID NO: 21297 - protein, 9 aa, Homo Sapiens
KLWDIRDGM

SEQ ID NO: 21298 - protein, 9 aa, Homo Sapiens
KLWDLLYKL

SEQ ID NO: 21299 - protein, 9 aa, Homo Sapiens
KLWDVRDSM

SEQ ID NO: 21300 - protein, 9 aa, Homo Sapiens
KLWDVREGM

SEQ ID NO: 21301 - protein, 9 aa, Homo Sapiens
KLWEAESKL

SEQ ID NO: 21302 - protein, 9 aa, Homo Sapiens
KLWELLYKL

SEQ ID NO: 21303 - protein, 9 aa, Homo Sapiens
KLWEMDNML

SEQ ID NO: 21304 - protein, 9 aa, Homo Sapiens
KLWESPNVL

SEQ ID NO: 21305 - protein, 9 aa, Homo Sapiens
KLWIIMEYL

SEQ ID NO: 21306 - protein, 9 aa, Homo Sapiens
KLWKGARSV

SEQ ID NO: 21307 - protein, 9 aa, Homo Sapiens
KLWNKIWCI

SEQ ID NO: 21308 - protein, 9 aa, Homo Sapiens
KLWPLFVKL

SEQ ID NO: 21309 - protein, 9 aa, Homo Sapiens
KLWQTPLHV

SEQ ID NO: 21310 - protein, 9 aa, Homo Sapiens
KLWTIHELL

SEQ ID NO: 21311 - protein, 9 aa, Homo Sapiens
KLWVPDEEV

SEQ ID NO: 21312 - protein, 9 aa, Homo Sapiens
KLYDGFQYL

SEQ ID NO: 21313 - protein, 9 aa, Homo Sapiens
KLYEAVPQL

SEQ ID NO: 21314 - protein, 9 aa, Homo Sapiens
KLYEQHHVV

SEQ ID NO: 21315 - protein, 9 aa, Homo Sapiens
KLYGKPIRV

SEQ ID NO: 21316 - protein, 9 aa, Homo Sapiens
KLYSISSQV

SEQ ID NO: 21317 - protein, 9 aa, Homo Sapiens
KLYSVSCHL

SEQ ID NO: 21318 - protein, 9 aa, Homo Sapiens
KLYTGLREV

SEQ ID NO: 21319 - protein, 9 aa, Homo Sapiens
KMADIEYRL

SEQ ID NO: 21320 - protein, 9 aa, Homo Sapiens
KMAEIKVKL

SEQ ID NO: 21321 - protein, 9 aa, Homo Sapiens
KMAEMLVEL

SEQ ID NO: 21322 - protein, 9 aa, Homo Sapiens
KMAIITTHL

SEQ ID NO: 21323 - protein, 9 aa, Homo Sapiens
KMAPALRKV

SEQ ID NO: 21324 - protein, 9 aa, Homo Sapiens
KMAPPPKEV

SEQ ID NO: 21325 - protein, 9 aa, Homo Sapiens
KMDEVLYSI

SEQ ID NO: 21326 - protein, 9 aa, Homo Sapiens
KMDLLVEKV

SEQ ID NO: 21327 - protein, 9 aa, Homo Sapiens
KMDWIFHTI

SEQ ID NO: 21328 - protein, 9 aa, Homo Sapiens
KMFEVDMKI

SEQ ID NO: 21329 - protein, 9 aa, Homo Sapiens
KMFFLIDKV

SEQ ID NO: 21330 - protein, 9 aa, Homo Sapiens
KMFFLIEKI

SEQ ID NO: 21331 - protein, 9 aa, Homo Sapiens
KMFKMSEKI

SEQ ID NO: 21332 - protein, 9 aa, Homo Sapiens
KMFQVHQVL

SEQ ID NO: 21333 - protein, 9 aa, Homo Sapiens
KMLAKVKQV

SEQ ID NO: 21334 - protein, 9 aa, Homo Sapiens
KMLDKIISI

SEQ ID NO: 21335 - protein, 9 aa, Homo Sapiens
KMLEKLPEL

SEQ ID NO: 21336 - protein, 9 aa, Homo Sapiens
KMLELTNRL

SEQ ID NO: 21337 - protein, 9 aa, Homo Sapiens
KMMDKVEFV

SEQ ID NO: 21338 - protein, 9 aa, Homo Sapiens
KMMDLEHKV

SEQ ID NO: 21339 - protein, 9 aa, Homo Sapiens
KMMDVTVTI

SEQ ID NO: 21340 - protein, 9 aa, Homo Sapiens
KMMLIVNMV

SEQ ID NO: 21341 - protein, 9 aa, Homo Sapiens
KMNEKIASL

SEQ ID NO: 21342 - protein, 9 aa, Homo Sapiens
KMNEKLYTV

SEQ ID NO: 21343 - protein, 9 aa, Homo Sapiens
KMPEINAKV

SEQ ID NO: 21344 - protein, 9 aa, Homo Sapiens
KMQETLVGL

SEQ ID NO: 21345 - protein, 9 aa, Homo Sapiens
KMVYIYHSL

SEQ ID NO: 21346 - protein, 9 aa, Homo Sapiens
KMWDVSTGM

SEQ ID NO: 21347 - protein, 9 aa, Homo Sapiens
KMWEEAISL

SEQ ID NO: 21348 - protein, 9 aa, Homo Sapiens
KMWENRQNL

SEQ ID NO: 21349 - protein, 9 aa, Homo Sapiens
KMWRDLEQL

SEQ ID NO: 21350 - protein, 9 aa, Homo Sapiens
KMYAVDTRV

SEQ ID NO: 21351 - protein, 9 aa, Homo Sapiens
KQFLVKVLI

SEQ ID NO: 21352 - protein, 9 aa, Homo Sapiens
KQIDSVNHI

SEQ ID NO: 21353 - protein, 9 aa, Homo Sapiens
KQLEVVHTL

SEQ ID NO: 21354 - protein, 9 aa, Homo Sapiens
KQMEKIQPA

SEQ ID NO: 21355 - protein, 9 aa, Homo Sapiens
KQVEEIFNL

SEQ ID NO: 21356 - protein, 9 aa, Homo Sapiens
KQWDVVSYL

SEQ ID NO: 21357 - protein, 9 aa, Homo Sapiens
KSFATKANV

SEQ ID NO: 21358 - protein, 9 aa, Homo Sapiens
KSFSLRAQV

SEQ ID NO: 21359 - protein, 9 aa, Homo Sapiens
KSWRVRYMV

SEQ ID NO: 21360 - protein, 9 aa, Homo Sapiens
KTALIHDGL

SEQ ID NO: 21361 - protein, 9 aa, Homo Sapiens
KTALITEVV

SEQ ID NO: 21362 - protein, 9 aa, Homo Sapiens
KTANITFSL

SEQ ID NO: 21363 - protein, 9 aa, Homo Sapiens
KTASINQNV

SEQ ID NO: 21364 - protein, 9 aa, Homo Sapiens
KTDVVVNSV

SEQ ID NO: 21365 - protein, 9 aa, Homo Sapiens
KTFEGFCAL

SEQ ID NO: 21366 - protein, 9 aa, Homo Sapiens
KTFFTKEYL

SEQ ID NO: 21367 - protein, 9 aa, Homo Sapiens
KTFQMAEYL

SEQ ID NO: 21368 - protein, 9 aa, Homo Sapiens
KTLGKLWRL

SEQ ID NO: 21369 - protein, 9 aa, Homo Sapiens
KTLPVAFKV

SEQ ID NO: 21370 - protein, 9 aa, Homo Sapiens
KTTTIAVEV

SEQ ID NO: 21371 - protein, 9 aa, Homo Sapiens
KTWKVDVVL

SEQ ID NO: 21372 - protein, 9 aa, Homo Sapiens
KTWNPKFTL

SEQ ID NO: 21373 - protein, 9 aa, Homo Sapiens
KTYGVSFFL

SEQ ID NO: 21374 - protein, 9 aa, Homo Sapiens
KVAEAPPNL

SEQ ID NO: 21375 - protein, 9 aa, Homo Sapiens
KVAEITELI

SEQ ID NO: 21376 - protein, 9 aa, Homo Sapiens
KVAELFEKL

SEQ ID NO: 21377 - protein, 9 aa, Homo Sapiens
KVAELKQEL

SEQ ID NO: 21378 - protein, 9 aa, Homo Sapiens
KVAPAPAVV

SEQ ID NO: 21379 - protein, 9 aa, Homo Sapiens
KVASLLHQV

SEQ ID NO: 21380 - protein, 9 aa, Homo Sapiens
KVDTVWVNV

SEQ ID NO: 21381 - protein, 9 aa, Homo Sapiens
KVFELMTSL

SEQ ID NO: 21382 - protein, 9 aa, Homo Sapiens
KVFKLQTSL

SEQ ID NO: 21383 - protein, 9 aa, Homo Sapiens
KVFKLQTTL

SEQ ID NO: 21384 - protein, 9 aa, Homo Sapiens
KVFLHEATV

SEQ ID NO: 21385 - protein, 9 aa, Homo Sapiens
KVGPVPVLV

SEQ ID NO: 21386 - protein, 9 aa, Homo Sapiens
KVHFITDTL

SEQ ID NO: 21387 - protein, 9 aa, Homo Sapiens
KVIDYVPGI

SEQ ID NO: 21388 - protein, 9 aa, Homo Sapiens
KVIPVYVGV

SEQ ID NO: 21389 - protein, 9 aa, Homo Sapiens
KVLDILQHI

SEQ ID NO: 21390 - protein, 9 aa, Homo Sapiens
KVLDLKINL

SEQ ID NO: 21391 - protein, 9 aa, Homo Sapiens
KVLDLRINL

SEQ ID NO: 21392 - protein, 9 aa, Homo Sapiens
KVLDVLWEL

SEQ ID NO: 21393 - protein, 9 aa, Homo Sapiens
KVLEILHRV

SEQ ID NO: 21394 - protein, 9 aa, Homo Sapiens
KVLERVNAV

SEQ ID NO: 21395 - protein, 9 aa, Homo Sapiens
KVLGKIEKV

SEQ ID NO: 21396 - protein, 9 aa, Homo Sapiens
KVMCIEHEI

SEQ ID NO: 21397 - protein, 9 aa, Homo Sapiens
KVMDVTEKL

SEQ ID NO: 21398 - protein, 9 aa, Homo Sapiens
KVMELLVHL

SEQ ID NO: 21399 - protein, 9 aa, Homo Sapiens
KVMNILHRI

SEQ ID NO: 21400 - protein, 9 aa, Homo Sapiens
KVMNWKETL

SEQ ID NO: 21401 - protein, 9 aa, Homo Sapiens
KVPEIEVTV

SEQ ID NO: 21402 - protein, 9 aa, Homo Sapiens
KVQDIKNNL

SEQ ID NO: 21403 - protein, 9 aa, Homo Sapiens
KVSVIQDFV

SEQ ID NO: 21404 - protein, 9 aa, Homo Sapiens
KVVALVHAV

SEQ ID NO: 21405 - protein, 9 aa, Homo Sapiens
KVWAPVQGL

SEQ ID NO: 21406 - protein, 9 aa, Homo Sapiens
KVWDLAQQV

SEQ ID NO: 21407 - protein, 9 aa, Homo Sapiens
KVWKLAEVL

SEQ ID NO: 21408 - protein, 9 aa, Homo Sapiens
KVYPVQEAL

SEQ ID NO: 21409 - protein, 9 aa, Homo Sapiens
KVYQGLYCV

SEQ ID NO: 21410 - protein, 9 aa, Homo Sapiens
LAPEVEVRV

SEQ ID NO: 21411 - protein, 9 aa, Homo Sapiens
LAPPEGQTV

SEQ ID NO: 21412 - protein, 9 aa, Homo Sapiens
LAPPPPTSA

SEQ ID NO: 21413 - protein, 9 aa, Homo Sapiens
LGGQLNVSV

SEQ ID NO: 21414 - protein, 9 aa, Homo Sapiens
LGPPPPLRV

SEQ ID NO: 21415 - protein, 9 aa, Homo Sapiens
LHLKLLDYL

SEQ ID NO: 21416 - protein, 9 aa, Homo Sapiens
LILGKLHYV

SEQ ID NO: 21417 - protein, 9 aa, Homo Sapiens
LIMELINNV

SEQ ID NO: 21418 - protein, 9 aa, Homo Sapiens
LISQIVSSI

SEQ ID NO: 21419 - protein, 9 aa, Homo Sapiens
LIWNIKDEL

SEQ ID NO: 21420 - protein, 9 aa, Homo Sapiens
LIYPWVHVV

SEQ ID NO: 21421 - protein, 9 aa, Homo Sapiens
LKLDIDKSL

SEQ ID NO: 21422 - protein, 9 aa, Homo Sapiens
LLAAWTARA

SEQ ID NO: 21423 - protein, 9 aa, Homo Sapiens
LLADLKTMV

SEQ ID NO: 21424 - protein, 9 aa, Homo Sapiens
LLADLLHNV

SEQ ID NO: 21425 - protein, 9 aa, Homo Sapiens
LLAEAKYYL

SEQ ID NO: 21426 - protein, 9 aa, Homo Sapiens
LLAEKIYKI

SEQ ID NO: 21427 - protein, 9 aa, Homo Sapiens
LLAEKVEQL

SEQ ID NO: 21428 - protein, 9 aa, Homo Sapiens
LLAELLTHL

SEQ ID NO: 21429 - protein, 9 aa, Homo Sapiens
LLAELPASV

SEQ ID NO: 21430 - protein, 9 aa, Homo Sapiens
LLAELQCQL

SEQ ID NO: 21431 - protein, 9 aa, Homo Sapiens
LLAEPVPGI

SEQ ID NO: 21432 - protein, 9 aa, Homo Sapiens
LLAETHYQL

SEQ ID NO: 21433 - protein, 9 aa, Homo Sapiens
LLALMHHSN

SEQ ID NO: 21434 - protein, 9 aa, Homo Sapiens
LLANKVPAA

SEQ ID NO: 21435 - protein, 9 aa, Homo Sapiens
LLAPAPAQA

SEQ ID NO: 21436 - protein, 9 aa, Homo Sapiens
LLAPFCPHL

SEQ ID NO: 21437 - protein, 9 aa, Homo Sapiens
LLASEVPQL

SEQ ID NO: 21438 - protein, 9 aa, Homo Sapiens
LLASINSTV

SEQ ID NO: 21439 - protein, 9 aa, Homo Sapiens
LLCDIVLHV

SEQ ID NO: 21440 - protein, 9 aa, Homo Sapiens
LLDIIKSTV

SEQ ID NO: 21441 - protein, 9 aa, Homo Sapiens
LLDKVYSSV

SEQ ID NO: 21442 - protein, 9 aa, Homo Sapiens
LLDPNVKSI

SEQ ID NO: 21443 - protein, 9 aa, Homo Sapiens
LLDQIRQGI

SEQ ID NO: 21444 - protein, 9 aa, Homo Sapiens
LLDRFLATV

SEQ ID NO: 21445 - protein, 9 aa, Homo Sapiens
LLDSAPLNV

SEQ ID NO: 21446 - protein, 9 aa, Homo Sapiens
LLDTIRDEI

SEQ ID NO: 21447 - protein, 9 aa, Homo Sapiens
LLDVPTAAV

SEQ ID NO: 21448 - protein, 9 aa, Homo Sapiens
LLFDRPMHV

SEQ ID NO: 21449 - protein, 9 aa, Homo Sapiens
LLFDVHTTL

SEQ ID NO: 21450 - protein, 9 aa, Homo Sapiens
LLFEGIARI

SEQ ID NO: 21451 - protein, 9 aa, Homo Sapiens
LLFILKQLV

SEQ ID NO: 21452 - protein, 9 aa, Homo Sapiens
LLGEIPDRL

SEQ ID NO: 21453 - protein, 9 aa, Homo Sapiens
LLGPKPFPL

SEQ ID NO: 21454 - protein, 9 aa, Homo Sapiens
LLGPPPVGV

SEQ ID NO: 21455 - protein, 9 aa, Homo Sapiens
LLGPRLVLA

SEQ ID NO: 21456 - protein, 9 aa, Homo Sapiens
LLHEVIVCV

SEQ ID NO: 21457 - protein, 9 aa, Homo Sapiens
LLHGHIVEL

SEQ ID NO: 21458 - protein, 9 aa, Homo Sapiens
LLHSFVDSV

SEQ ID NO: 21459 - protein, 9 aa, Homo Sapiens
LLIGHLERV

SEQ ID NO: 21460 - protein, 9 aa, Homo Sapiens
LLKELRHGV

SEQ ID NO: 21461 - protein, 9 aa, Homo Sapiens
LLLAHIIAL

SEQ ID NO: 21462 - protein, 9 aa, Homo Sapiens
LLLDVPTAA

SEQ ID NO: 21463 - protein, 9 aa, Homo Sapiens
LLLEILHEI

SEQ ID NO: 21464 - protein, 9 aa, Homo Sapiens
LLMEHIQEI

SEQ ID NO: 21465 - protein, 9 aa, Homo Sapiens
LLNDHIYVV

SEQ ID NO: 21466 - protein, 9 aa, Homo Sapiens
LLNEILEQV

SEQ ID NO: 21467 - protein, 9 aa, Homo Sapiens
LLNHRIFQL

SEQ ID NO: 21468 - protein, 9 aa, Homo Sapiens
LLNKAPEYL

SEQ ID NO: 21469 - protein, 9 aa, Homo Sapiens
LLNKKPHVV

SEQ ID NO: 21470 - protein, 9 aa, Homo Sapiens
LLPGCVYHV

SEQ ID NO: 21471 - protein, 9 aa, Homo Sapiens
LLPHPGLQV

SEQ ID NO: 21472 - protein, 9 aa, Homo Sapiens
LLPPAPPHA

SEQ ID NO: 21473 - protein, 9 aa, Homo Sapiens
LLPPPGSCA

SEQ ID NO: 21474 - protein, 9 aa, Homo Sapiens
LLPPPMKEL

SEQ ID NO: 21475 - protein, 9 aa, Homo Sapiens
LLPPPPCPA

SEQ ID NO: 21476 - protein, 9 aa, Homo Sapiens
LLPPVTLAA

SEQ ID NO: 21477 - protein, 9 aa, Homo Sapiens
LLQDHPWLL

SEQ ID NO: 21478 - protein, 9 aa, Homo Sapiens
LLQDKQFEL

SEQ ID NO: 21479 - protein, 9 aa, Homo Sapiens
LLREKVEFL

SEQ ID NO: 21480 - protein, 9 aa, Homo Sapiens
LLSAEPVPA

SEQ ID NO: 21481 - protein, 9 aa, Homo Sapiens
LLSHVIVAL

SEQ ID NO: 21482 - protein, 9 aa, Homo Sapiens
LLSPVVPQI

SEQ ID NO: 21483 - protein, 9 aa, Homo Sapiens
LLTEIRAVV

SEQ ID NO: 21484 - protein, 9 aa, Homo Sapiens
LLVEVSNIF

SEQ ID NO: 21485 - protein, 9 aa, Homo Sapiens
LLWCPTNGL

SEQ ID NO: 21486 - protein, 9 aa, Homo Sapiens
LLWDKIHKL

SEQ ID NO: 21487 - protein, 9 aa, Homo Sapiens
LLWERVEKL

SEQ ID NO: 21488 - protein, 9 aa, Homo Sapiens
LLWPGAALL

SEQ ID NO: 21489 - protein, 9 aa, Homo Sapiens
LLWTPSVGL

SEQ ID NO: 21490 - protein, 9 aa, Homo Sapiens
LLWVPGCFA

SEQ ID NO: 21491 - protein, 9 aa, Homo Sapiens
LLYDLADQL

SEQ ID NO: 21492 - protein, 9 aa, Homo Sapiens
LLYGHTVTV

SEQ ID NO: 21493 - protein, 9 aa, Homo Sapiens
LMAITRHGV

SEQ ID NO: 21494 - protein, 9 aa, Homo Sapiens
LMAPAPSTV

SEQ ID NO: 21495 - protein, 9 aa, Homo Sapiens
LMDHTIPEV

SEQ ID NO: 21496 - protein, 9 aa, Homo Sapiens
LMDSNLPRL

SEQ ID NO: 21497 - protein, 9 aa, Homo Sapiens
LMGFFPFRV

SEQ ID NO: 21498 - protein, 9 aa, Homo Sapiens
LMGPVVHEV

SEQ ID NO: 21499 - protein, 9 aa, Homo Sapiens
LMMDPLTGL

SEQ ID NO: 21500 - protein, 9 aa, Homo Sapiens
LMNPMVPGL

SEQ ID NO: 21501 - protein, 9 aa, Homo Sapiens
LMQTEVHHV

SEQ ID NO: 21502 - protein, 9 aa, Homo Sapiens
LMTKEISSV

SEQ ID NO: 21503 - protein, 9 aa, Homo Sapiens
LMVDHVTEV

SEQ ID NO: 21504 - protein, 9 aa, Homo Sapiens
LMYAVREEV

SEQ ID NO: 21505 - protein, 9 aa, Homo Sapiens
LMYPYIFHV

SEQ ID NO: 21506 - protein, 9 aa, Homo Sapiens
LQAPELANV

SEQ ID NO: 21507 - protein, 9 aa, Homo Sapiens
LQFDGIHVV

SEQ ID NO: 21508 - protein, 9 aa, Homo Sapiens
LQIDNARLA

SEQ ID NO: 21509 - protein, 9 aa, Homo Sapiens
LQLEAIHKV

SEQ ID NO: 21510 - protein, 9 aa, Homo Sapiens
LQVEEVHQL

SEQ ID NO: 21511 - protein, 9 aa, Homo Sapiens
LRLLKTLET

SEQ ID NO: 21512 - protein, 9 aa, Homo Sapiens
LSLEIGKTL

SEQ ID NO: 21513 - protein, 9 aa, Homo Sapiens
LSLENLEKI

SEQ ID NO: 21514 - protein, 9 aa, Homo Sapiens
LTFPVRDGV

SEQ ID NO: 21515 - protein, 9 aa, Homo Sapiens
LTHLVTAAV

SEQ ID NO: 21516 - protein, 9 aa, Homo Sapiens
LTMEVIRQV

SEQ ID NO: 21517 - protein, 9 aa, Homo Sapiens
LTTCISAHV

SEQ ID NO: 21518 - protein, 9 aa, Homo Sapiens
LTWLIVNHI

SEQ ID NO: 21519 - protein, 9 aa, Homo Sapiens
LVLEIIHRI

SEQ ID NO: 21520 - protein, 9 aa, Homo Sapiens
LVPPVVACV

SEQ ID NO: 21521 - protein, 9 aa, Homo Sapiens
LYIQRSAPL

SEQ ID NO: 21522 - protein, 9 aa, Homo Sapiens
MAPKPGPYV

SEQ ID NO: 21523 - protein, 9 aa, Homo Sapiens
MAPPAHKSI

SEQ ID NO: 21524 - protein, 9 aa, Homo Sapiens
MAPPPPRSV

SEQ ID NO: 21525 - protein, 9 aa, Homo Sapiens
MLAEKLPNL

SEQ ID NO: 21526 - protein, 9 aa, Homo Sapiens
MLAWINESL

SEQ ID NO: 21527 - protein, 9 aa, Homo Sapiens
MLDMSVPAV

SEQ ID NO: 21528 - protein, 9 aa, Homo Sapiens
MLDSLRIYL

SEQ ID NO: 21529 - protein, 9 aa, Homo Sapiens
MLFDKFRSV

SEQ ID NO: 21530 - protein, 9 aa, Homo Sapiens
MLFLGLHNV

SEQ ID NO: 21531 - protein, 9 aa, Homo Sapiens
MLHTVTDMV

SEQ ID NO: 21532 - protein, 9 aa, Homo Sapiens
MLLDFIQHI

SEQ ID NO: 21533 - protein, 9 aa, Homo Sapiens
MLLDVMHTV

SEQ ID NO: 21534 - protein, 9 aa, Homo Sapiens
MLPPPPLTA

SEQ ID NO: 21535 - protein, 9 aa, Homo Sapiens
MLSPFISSV

SEQ ID NO: 21536 - protein, 9 aa, Homo Sapiens
MLVEITERA

SEQ ID NO: 21537 - protein, 9 aa, Homo Sapiens
MMPPPVGMV

SEQ ID NO: 21538 - protein, 9 aa, Homo Sapiens
MMWNNHYIL

SEQ ID NO: 21539 - protein, 9 aa, Homo Sapiens
MQGPIPERI

SEQ ID NO: 21540 - protein, 9 aa, Homo Sapiens
MQWQNVEHV

SEQ ID NO: 21541 - protein, 9 aa, Homo Sapiens
MQWTLTELL

SEQ ID NO: 21542 - protein, 9 aa, Homo Sapiens
MTSEIHNTV

SEQ ID NO: 21543 - protein, 9 aa, Homo Sapiens
MVAEILHHL

SEQ ID NO: 21544 - protein, 9 aa, Homo Sapiens
MVAPAVASV

SEQ ID NO: 21545 - protein, 9 aa, Homo Sapiens
MVDKYIPNI

SEQ ID NO: 21546 - protein, 9 aa, Homo Sapiens
MVWEGLNVV

SEQ ID NO: 21547 - protein, 9 aa, Homo Sapiens
NIFEPHVAV

SEQ ID NO: 21548 - protein, 9 aa, Homo Sapiens
NIFGPLVKL

SEQ ID NO: 21549 - protein, 9 aa, Homo Sapiens
NIFRWETTI

SEQ ID NO: 21550 - protein, 9 aa, Homo Sapiens
NIIELVHQV

SEQ ID NO: 21551 - protein, 9 aa, Homo Sapiens
NILELLHRL

SEQ ID NO: 21552 - protein, 9 aa, Homo Sapiens
NIMDIKIGL

SEQ ID NO: 21553 - protein, 9 aa, Homo Sapiens
NLAEVVERV

SEQ ID NO: 21554 - protein, 9 aa, Homo Sapiens
NLAKCIVSV

SEQ ID NO: 21555 - protein, 9 aa, Homo Sapiens
NLFDRVVTL

SEQ ID NO: 21556 - protein, 9 aa, Homo Sapiens
NLFEWHFTV

SEQ ID NO: 21557 - protein, 9 aa, Homo Sapiens
NLFHYLTEV

SEQ ID NO: 21558 - protein, 9 aa, Homo Sapiens
NLFKHLAKA

SEQ ID NO: 21559 - protein, 9 aa, Homo Sapiens
NLFKLEVRL

SEQ ID NO: 21560 - protein, 9 aa, Homo Sapiens
NLFKWVGTI

SEQ ID NO: 21561 - protein, 9 aa, Homo Sapiens
NLFSLCQKI

SEQ ID NO: 21562 - protein, 9 aa, Homo Sapiens
NLFTVIAHL

SEQ ID NO: 21563 - protein, 9 aa, Homo Sapiens
NLLKLIAEV

SEQ ID NO: 21564 - protein, 9 aa, Homo Sapiens
NLLQIQRNV

SEQ ID NO: 21565 - protein, 9 aa, Homo Sapiens
NLNEKINHL

SEQ ID NO: 21566 - protein, 9 aa, Homo Sapiens
NLNSIVPSV

SEQ ID NO: 21567 - protein, 9 aa, Homo Sapiens
NLWCPTLKV

SEQ ID NO: 21568 - protein, 9 aa, Homo Sapiens
NLWPVPHGL

SEQ ID NO: 21569 - protein, 9 aa, Homo Sapiens
NLWSLVAKV

SEQ ID NO: 21570 - protein, 9 aa, Homo Sapiens
NLYPFVKTV

SEQ ID NO: 21571 - protein, 9 aa, Homo Sapiens
NMAELFAVV

SEQ ID NO: 21572 - protein, 9 aa, Homo Sapiens
NMDELRHQV

SEQ ID NO: 21573 - protein, 9 aa, Homo Sapiens
NMFEISDRL

SEQ ID NO: 21574 - protein, 9 aa, Homo Sapiens
NMVDIIHSV

SEQ ID NO: 21575 - protein, 9 aa, Homo Sapiens
NMYGKVVTV

SEQ ID NO: 21576 - protein, 9 aa, Homo Sapiens
NQYRLIVNV

SEQ ID NO: 21577 - protein, 9 aa, Homo Sapiens
NTCPYVHNI

SEQ ID NO: 21578 - protein, 9 aa, Homo Sapiens
NTWEPEENI

SEQ ID NO: 21579 - protein, 9 aa, Homo Sapiens
NVFHLVATV

SEQ ID NO: 21580 - protein, 9 aa, Homo Sapiens
PDIIKDQKA

SEQ ID NO: 21581 - protein, 9 aa, Homo Sapiens
PDPKLLEKV

SEQ ID NO: 21582 - protein, 9 aa, Homo Sapiens
PGLPRPPGL

SEQ ID NO: 21583 - protein, 9 aa, Homo Sapiens
QAPGVITGV

SEQ ID NO: 21584 - protein, 9 aa, Homo Sapiens
QAPPPPQQV

SEQ ID NO: 21585 - protein, 9 aa, Homo Sapiens
QIAELKMQL

SEQ ID NO: 21586 - protein, 9 aa, Homo Sapiens
QLAQFVHEV

SEQ ID NO: 21587 - protein, 9 aa, Homo Sapiens
QLDDLKVEL

SEQ ID NO: 21588 - protein, 9 aa, Homo Sapiens
QLDIIIHSL

SEQ ID NO: 21589 - protein, 9 aa, Homo Sapiens
QLFEDLVYL

SEQ ID NO: 21590 - protein, 9 aa, Homo Sapiens
QLFEMHEKL

SEQ ID NO: 21591 - protein, 9 aa, Homo Sapiens
QLGPVPVTI

SEQ ID NO: 21592 - protein, 9 aa, Homo Sapiens
QLIDGLEYL

SEQ ID NO: 21593 - protein, 9 aa, Homo Sapiens
QLIDKVWQL

SEQ ID NO: 21594 - protein, 9 aa, Homo Sapiens
QLISKIPHI

SEQ ID NO: 21595 - protein, 9 aa, Homo Sapiens
QLLDLMHTL

SEQ ID NO: 21596 - protein, 9 aa, Homo Sapiens
QLLDVIHYV

SEQ ID NO: 21597 - protein, 9 aa, Homo Sapiens
QLLEKVIEL

SEQ ID NO: 21598 - protein, 9 aa, Homo Sapiens
QLLEKVPTL

SEQ ID NO: 21599 - protein, 9 aa, Homo Sapiens
QLMEQVAQL

SEQ ID NO: 21600 - protein, 9 aa, Homo Sapiens
QLNEKVAQL

SEQ ID NO: 21601 - protein, 9 aa, Homo Sapiens
QLNEQVHSL

SEQ ID NO: 21602 - protein, 9 aa, Homo Sapiens
QLQDRVYAL

SEQ ID NO: 21603 - protein, 9 aa, Homo Sapiens
QLQELVCHV

SEQ ID NO: 21604 - protein, 9 aa, Homo Sapiens
QLVDIIEKV

SEQ ID NO: 21605 - protein, 9 aa, Homo Sapiens
QLWNNYFHL

SEQ ID NO: 21606 - protein, 9 aa, Homo Sapiens
QMAEIAVNA

SEQ ID NO: 21607 - protein, 9 aa, Homo Sapiens
QMAQIVERL

SEQ ID NO: 21608 - protein, 9 aa, Homo Sapiens
QMISRIEYI

SEQ ID NO: 21609 - protein, 9 aa, Homo Sapiens
QMISRIEYV

SEQ ID NO: 21610 - protein, 9 aa, Homo Sapiens
QMLEIHSQV

SEQ ID NO: 21611 - protein, 9 aa, Homo Sapiens
QMMWLMDHI

SEQ ID NO: 21612 - protein, 9 aa, Homo Sapiens
QQINKLEEL

SEQ ID NO: 21613 - protein, 9 aa, Homo Sapiens
QVANVRFNV

SEQ ID NO: 21614 - protein, 9 aa, Homo Sapiens
QVCAIIERV

SEQ ID NO: 21615 - protein, 9 aa, Homo Sapiens
QVLELQHTL

SEQ ID NO: 21616 - protein, 9 aa, Homo Sapiens
QVMQIIEHL

SEQ ID NO: 21617 - protein, 9 aa, Homo Sapiens
RAAEIRETL

SEQ ID NO: 21618 - protein, 9 aa, Homo Sapiens
RAFLVEHNL

SEQ ID NO: 21619 - protein, 9 aa, Homo Sapiens
RIADLSYTV

SEQ ID NO: 21620 - protein, 9 aa, Homo Sapiens
RIAELLTEL

SEQ ID NO: 21621 - protein, 9 aa, Homo Sapiens
RIFDLQNKV

SEQ ID NO: 21622 - protein, 9 aa, Homo Sapiens
RIFLLIQSV

SEQ ID NO: 21623 - protein, 9 aa, Homo Sapiens
RIFVGLCQV

SEQ ID NO: 21624 - protein, 9 aa, Homo Sapiens
RIIDTVAQV

SEQ ID NO: 21625 - protein, 9 aa, Homo Sapiens
RIIDVVYNA

SEQ ID NO: 21626 - protein, 9 aa, Homo Sapiens
RILDILEYI

SEQ ID NO: 21627 - protein, 9 aa, Homo Sapiens
RIMEFTTTL

SEQ ID NO: 21628 - protein, 9 aa, Homo Sapiens
RIMEIVDAI

SEQ ID NO: 21629 - protein, 9 aa, Homo Sapiens
RISDVHFSV

SEQ ID NO: 21630 - protein, 9 aa, Homo Sapiens
RIWDPVLSV

SEQ ID NO: 21631 - protein, 9 aa, Homo Sapiens
RIWDVRTKA

SEQ ID NO: 21632 - protein, 9 aa, Homo Sapiens
RIYKYIHKV

SEQ ID NO: 21633 - protein, 9 aa, Homo Sapiens
RLAALEQNV

SEQ ID NO: 21634 - protein, 9 aa, Homo Sapiens
RLAEAHAKV

SEQ ID NO: 21635 - protein, 9 aa, Homo Sapiens
RLAELEEFI

SEQ ID NO: 21636 - protein, 9 aa, Homo Sapiens
RLAELQEQL

SEQ ID NO: 21637 - protein, 9 aa, Homo Sapiens
RLAEQIATL

SEQ ID NO: 21638 - protein, 9 aa, Homo Sapiens
RLAEVVHEL

SEQ ID NO: 21639 - protein, 9 aa, Homo Sapiens
RLAQHITYV

SEQ ID NO: 21640 - protein, 9 aa, Homo Sapiens
RLAQICSSI

SEQ ID NO: 21641 - protein, 9 aa, Homo Sapiens
RLCQEILGV

SEQ ID NO: 21642 - protein, 9 aa, Homo Sapiens
RLCRLLKPA

SEQ ID NO: 21643 - protein, 9 aa, Homo Sapiens
RLDIVHENL

SEQ ID NO: 21644 - protein, 9 aa, Homo Sapiens
RLDNLKAHL

SEQ ID NO: 21645 - protein, 9 aa, Homo Sapiens
RLDYITAEI

SEQ ID NO: 21646 - protein, 9 aa, Homo Sapiens
RLFAVLEQL

SEQ ID NO: 21647 - protein, 9 aa, Homo Sapiens
RLFDDVPQV

SEQ ID NO: 21648 - protein, 9 aa, Homo Sapiens
RLFESINNL

SEQ ID NO: 21649 - protein, 9 aa, Homo Sapiens
RLFEVPHEL

SEQ ID NO: 21650 - protein, 9 aa, Homo Sapiens
RLGPPPSHA

SEQ ID NO: 21651 - protein, 9 aa, Homo Sapiens
RLGPVPPGL

SEQ ID NO: 21652 - protein, 9 aa, Homo Sapiens
RLGPVPSGL

SEQ ID NO: 21653 - protein, 9 aa, Homo Sapiens
RLIDLHTNV

SEQ ID NO: 21654 - protein, 9 aa, Homo Sapiens
RLIESLFTI

SEQ ID NO: 21655 - protein, 9 aa, Homo Sapiens
RLLDALEFL

SEQ ID NO: 21656 - protein, 9 aa, Homo Sapiens
RLLDMGFEA

SEQ ID NO: 21657 - protein, 9 aa, Homo Sapiens
RLLDVLCEM

SEQ ID NO: 21658 - protein, 9 aa, Homo Sapiens
RLLDYVATV

SEQ ID NO: 21659 - protein, 9 aa, Homo Sapiens
RLLDYVVNI

SEQ ID NO: 21660 - protein, 9 aa, Homo Sapiens
RLLEFLVAL

SEQ ID NO: 21661 - protein, 9 aa, Homo Sapiens
RLLEIPCVI

SEQ ID NO: 21662 - protein, 9 aa, Homo Sapiens
RLLENMTEV

SEQ ID NO: 21663 - protein, 9 aa, Homo Sapiens
RLLESFETM

SEQ ID NO: 21664 - protein, 9 aa, Homo Sapiens
RLLEVQSQV

SEQ ID NO: 21665 - protein, 9 aa, Homo Sapiens
RLLEVTNTI

SEQ ID NO: 21666 - protein, 9 aa, Homo Sapiens
RLLGHIKNV

SEQ ID NO: 21667 - protein, 9 aa, Homo Sapiens
RLLHVKETM

SEQ ID NO: 21668 - protein, 9 aa, Homo Sapiens
RLMEICESL

SEQ ID NO: 21669 - protein, 9 aa, Homo Sapiens
RLMNDMTAV

SEQ ID NO: 21670 - protein, 9 aa, Homo Sapiens
RLMNETTAV

SEQ ID NO: 21671 - protein, 9 aa, Homo Sapiens
RLNEAAVTV

SEQ ID NO: 21672 - protein, 9 aa, Homo Sapiens
RLNKVIKSV

SEQ ID NO: 21673 - protein, 9 aa, Homo Sapiens
RLPEAIEEV

SEQ ID NO: 21674 - protein, 9 aa, Homo Sapiens
RLPEIYIQL

SEQ ID NO: 21675 - protein, 9 aa, Homo Sapiens
RLQDAIAKV

SEQ ID NO: 21676 - protein, 9 aa, Homo Sapiens
RLQEEINEV

SEQ ID NO: 21677 - protein, 9 aa, Homo Sapiens
RLQEVTHSV

SEQ ID NO: 21678 - protein, 9 aa, Homo Sapiens
RLQQLQHRV

SEQ ID NO: 21679 - protein, 9 aa, Homo Sapiens
RLSDAQIYV

SEQ ID NO: 21680 - protein, 9 aa, Homo Sapiens
RLSDVQIYV

SEQ ID NO: 21681 - protein, 9 aa, Homo Sapiens
RLSSVNAEV

SEQ ID NO: 21682 - protein, 9 aa, Homo Sapiens
RLTDYISKV

SEQ ID NO: 21683 - protein, 9 aa, Homo Sapiens
RLVEIQYEL

SEQ ID NO: 21684 - protein, 9 aa, Homo Sapiens
RLWDLTTGT

SEQ ID NO: 21685 - protein, 9 aa, Homo Sapiens
RLWDVHTSA

SEQ ID NO: 21686 - protein, 9 aa, Homo Sapiens
RLWDVSCDL

SEQ ID NO: 21687 - protein, 9 aa, Homo Sapiens
RLWEYLLEL

SEQ ID NO: 21688 - protein, 9 aa, Homo Sapiens
RLWGEPVNL

SEQ ID NO: 21689 - protein, 9 aa, Homo Sapiens
RLWKAIHTA

SEQ ID NO: 21690 - protein, 9 aa, Homo Sapiens
RLWQVQSRL

SEQ ID NO: 21691 - protein, 9 aa, Homo Sapiens
RLYDGLFKV

SEQ ID NO: 21692 - protein, 9 aa, Homo Sapiens
RLYDTHITV

SEQ ID NO: 21693 - protein, 9 aa, Homo Sapiens
RLYEFWWSL

SEQ ID NO: 21694 - protein, 9 aa, Homo Sapiens
RLYGKLAKV

SEQ ID NO: 21695 - protein, 9 aa, Homo Sapiens
RLYGLGTGV

SEQ ID NO: 21696 - protein, 9 aa, Homo Sapiens
RLYHITDQV

SEQ ID NO: 21697 - protein, 9 aa, Homo Sapiens
RLYPLAIQI

SEQ ID NO: 21698 - protein, 9 aa, Homo Sapiens
RLYSVSYLL

SEQ ID NO: 21699 - protein, 9 aa, Homo Sapiens
RMAVLNEQV

SEQ ID NO: 21700 - protein, 9 aa, Homo Sapiens
RMFHIRAVI

SEQ ID NO: 21701 - protein, 9 aa, Homo Sapiens
RMGPPLHTV

SEQ ID NO: 21702 - protein, 9 aa, Homo Sapiens
RMLDSVEKL

SEQ ID NO: 21703 - protein, 9 aa, Homo Sapiens
RMLHFLTAV

SEQ ID NO: 21704 - protein, 9 aa, Homo Sapiens
RMLPHAPGV

SEQ ID NO: 21705 - protein, 9 aa, Homo Sapiens
RMNFPYFYV

SEQ ID NO: 21706 - protein, 9 aa, Homo Sapiens
RMVHILTSV

SEQ ID NO: 21707 - protein, 9 aa, Homo Sapiens
RMWATQGLA

SEQ ID NO: 21708 - protein, 9 aa, Homo Sapiens
RMWEDPMGA

SEQ ID NO: 21709 - protein, 9 aa, Homo Sapiens
RMYELVHRM

SEQ ID NO: 21710 - protein, 9 aa, Homo Sapiens
RQADKVWRL

SEQ ID NO: 21711 - protein, 9 aa, Homo Sapiens
RQLAKIHAI

SEQ ID NO: 21712 - protein, 9 aa, Homo Sapiens
RQLEKLKEV

SEQ ID NO: 21713 - protein, 9 aa, Homo Sapiens
RTFHLLHTV

SEQ ID NO: 21714 - protein, 9 aa, Homo Sapiens
RTFLVGERV

SEQ ID NO: 21715 - protein, 9 aa, Homo Sapiens
RTGEVKWSV

SEQ ID NO: 21716 - protein, 9 aa, Homo Sapiens
RTLPVDFHI

SEQ ID NO: 21717 - protein, 9 aa, Homo Sapiens
RTMEWVQTI

SEQ ID NO: 21718 - protein, 9 aa, Homo Sapiens
RTTEILHHL

SEQ ID NO: 21719 - protein, 9 aa, Homo Sapiens
RVADILTQL

SEQ ID NO: 21720 - protein, 9 aa, Homo Sapiens
RVAVIKWGA

SEQ ID NO: 21721 - protein, 9 aa, Homo Sapiens
RVDKITEYL

SEQ ID NO: 21722 - protein, 9 aa, Homo Sapiens
RVFENIVAV

SEQ ID NO: 21723 - protein, 9 aa, Homo Sapiens
RVLDNIKAV

SEQ ID NO: 21724 - protein, 9 aa, Homo Sapiens
RVLELIPQI

SEQ ID NO: 21725 - protein, 9 aa, Homo Sapiens
RVLEVVNHV

SEQ ID NO: 21726 - protein, 9 aa, Homo Sapiens
RVMELFFTV

SEQ ID NO: 21727 - protein, 9 aa, Homo Sapiens
RVMEYINRL

SEQ ID NO: 21728 - protein, 9 aa, Homo Sapiens
RVPPPPQSV

SEQ ID NO: 21729 - protein, 9 aa, Homo Sapiens
RVQILKDYV

SEQ ID NO: 21730 - protein, 9 aa, Homo Sapiens
RVREITENL

SEQ ID NO: 21731 - protein, 9 aa, Homo Sapiens
RVTFVNFTV

SEQ ID NO: 21732 - protein, 9 aa, Homo Sapiens
RVWQVTIGT

SEQ ID NO: 21733 - protein, 9 aa, Homo Sapiens
RVYEFLDKL

SEQ ID NO: 21734 - protein, 9 aa, Homo Sapiens
RVYNVTQHA

SEQ ID NO: 21735 - protein, 9 aa, Homo Sapiens
SAAEPTPAV

SEQ ID NO: 21736 - protein, 9 aa, Homo Sapiens
SAPASQASL

SEQ ID NO: 21737 - protein, 9 aa, Homo Sapiens
SAPPRPPRA

SEQ ID NO: 21738 - protein, 9 aa, Homo Sapiens
SAWRVISSI

SEQ ID NO: 21739 - protein, 9 aa, Homo Sapiens
SAYLVAEKV

SEQ ID NO: 21740 - protein, 9 aa, Homo Sapiens
SIAECLTYL

SEQ ID NO: 21741 - protein, 9 aa, Homo Sapiens
SIAEMGAYV

SEQ ID NO: 21742 - protein, 9 aa, Homo Sapiens
SIAEVVHQL

SEQ ID NO: 21743 - protein, 9 aa, Homo Sapiens
SICGTLHSV

SEQ ID NO: 21744 - protein, 9 aa, Homo Sapiens
SIFEFVHAL

SEQ ID NO: 21745 - protein, 9 aa, Homo Sapiens
SIHDVTFQV

SEQ ID NO: 21746 - protein, 9 aa, Homo Sapiens
SIHVGQAGV

SEQ ID NO: 21747 - protein, 9 aa, Homo Sapiens
SIIGRLLEV

SEQ ID NO: 21748 - protein, 9 aa, Homo Sapiens
SILEDPPSI

SEQ ID NO: 21749 - protein, 9 aa, Homo Sapiens
SIMQVVNYV

SEQ ID NO: 21750 - protein, 9 aa, Homo Sapiens
SIYPSPTGV

SEQ ID NO: 21751 - protein, 9 aa, Homo Sapiens
SLADCIPLL

SEQ ID NO: 21752 - protein, 9 aa, Homo Sapiens
SLAEPRVSV

SEQ ID NO: 21753 - protein, 9 aa, Homo Sapiens
SLAKIPATL

SEQ ID NO: 21754 - protein, 9 aa, Homo Sapiens
SLAPIIVHV

SEQ ID NO: 21755 - protein, 9 aa, Homo Sapiens
SLAPLFFKL

SEQ ID NO: 21756 - protein, 9 aa, Homo Sapiens
SLAQYLINV

SEQ ID NO: 21757 - protein, 9 aa, Homo Sapiens
SLASFIPAV

SEQ ID NO: 21758 - protein, 9 aa, Homo Sapiens
SLCDLKSRL

SEQ ID NO: 21759 - protein, 9 aa, Homo Sapiens
SLDERPVAV

SEQ ID NO: 21760 - protein, 9 aa, Homo Sapiens
SLDQPTQTV

SEQ ID NO: 21761 - protein, 9 aa, Homo Sapiens
SLDTQPKKV

SEQ ID NO: 21762 - protein, 9 aa, Homo Sapiens
SLEELLHYV

SEQ ID NO: 21763 - protein, 9 aa, Homo Sapiens
SLFDWNVKL

SEQ ID NO: 21764 - protein, 9 aa, Homo Sapiens
SLFERLVKV

SEQ ID NO: 21765 - protein, 9 aa, Homo Sapiens
SLFERLVVL

SEQ ID NO: 21766 - protein, 9 aa, Homo Sapiens
SLFGDVKKL

SEQ ID NO: 21767 - protein, 9 aa, Homo Sapiens
SLFKGICAL

SEQ ID NO: 21768 - protein, 9 aa, Homo Sapiens
SLFKLIVKV

SEQ ID NO: 21769 - protein, 9 aa, Homo Sapiens
SLFNKLVEL

SEQ ID NO: 21770 - protein, 9 aa, Homo Sapiens
SLFRVITEV

SEQ ID NO: 21771 - protein, 9 aa, Homo Sapiens
SLFRWRHQA

SEQ ID NO: 21772 - protein, 9 aa, Homo Sapiens
SLFSVIVRV

SEQ ID NO: 21773 - protein, 9 aa, Homo Sapiens
SLFYLHNEL

SEQ ID NO: 21774 - protein, 9 aa, Homo Sapiens
SLIDKLYNI

SEQ ID NO: 21775 - protein, 9 aa, Homo Sapiens
SLIEKLWQT

SEQ ID NO: 21776 - protein, 9 aa, Homo Sapiens
SLIEKYFSV

SEQ ID NO: 21777 - protein, 9 aa, Homo Sapiens
SLIGHLQTL

SEQ ID NO: 21778 - protein, 9 aa, Homo Sapiens
SLIHGLWNL

SEQ ID NO: 21779 - protein, 9 aa, Homo Sapiens
SLIKQIPRI

SEQ ID NO: 21780 - protein, 9 aa, Homo Sapiens
SLISNPPAM

SEQ ID NO: 21781 - protein, 9 aa, Homo Sapiens
SLITRLLEV

SEQ ID NO: 21782 - protein, 9 aa, Homo Sapiens
SLLDCTFRL

SEQ ID NO: 21783 - protein, 9 aa, Homo Sapiens
SLLDIIEKV

SEQ ID NO: 21784 - protein, 9 aa, Homo Sapiens
SLLDLHTKV

SEQ ID NO: 21785 - protein, 9 aa, Homo Sapiens
SLLDPFAAV

SEQ ID NO: 21786 - protein, 9 aa, Homo Sapiens
SLLDPVPEV

SEQ ID NO: 21787 - protein, 9 aa, Homo Sapiens
SLLEHLSHV

SEQ ID NO: 21788 - protein, 9 aa, Homo Sapiens
SLLEKLSAL

SEQ ID NO: 21789 - protein, 9 aa, Homo Sapiens
SLLENLEKI

SEQ ID NO: 21790 - protein, 9 aa, Homo Sapiens
SLLPAIVEL

SEQ ID NO: 21791 - protein, 9 aa, Homo Sapiens
SLLQTLYKV

SEQ ID NO: 21792 - protein, 9 aa, Homo Sapiens
SLLRHLEKV

SEQ ID NO: 21793 - protein, 9 aa, Homo Sapiens
SLLRLQETL

SEQ ID NO: 21794 - protein, 9 aa, Homo Sapiens
SLLRVGWSV

SEQ ID NO: 21795 - protein, 9 aa, Homo Sapiens
SLLSHVEQL

SEQ ID NO: 21796 - protein, 9 aa, Homo Sapiens
SLLYNVPAV

SEQ ID NO: 21797 - protein, 9 aa, Homo Sapiens
SLMEKISKL

SEQ ID NO: 21798 - protein, 9 aa, Homo Sapiens
SLMHVPPSL

SEQ ID NO: 21799 - protein, 9 aa, Homo Sapiens
SLNKHVEAV

SEQ ID NO: 21800 - protein, 9 aa, Homo Sapiens
SLPAIVSIA

SEQ ID NO: 21801 - protein, 9 aa, Homo Sapiens
SLQEKLWAI

SEQ ID NO: 21802 - protein, 9 aa, Homo Sapiens
SLSKITTTV

SEQ ID NO: 21803 - protein, 9 aa, Homo Sapiens
SLSPIYPAA

SEQ ID NO: 21804 - protein, 9 aa, Homo Sapiens
SLVEIRNFL

SEQ ID NO: 21805 - protein, 9 aa, Homo Sapiens
SLWANPKYV

SEQ ID NO: 21806 - protein, 9 aa, Homo Sapiens
SLWEISKQI

SEQ ID NO: 21807 - protein, 9 aa, Homo Sapiens
SLWFKPEEL

SEQ ID NO: 21808 - protein, 9 aa, Homo Sapiens
SLWGQPAEA

SEQ ID NO: 21809 - protein, 9 aa, Homo Sapiens
SLWHNITVV

SEQ ID NO: 21810 - protein, 9 aa, Homo Sapiens
SLWKEVSEL

SEQ ID NO: 21811 - protein, 9 aa, Homo Sapiens
SLWKGLVGI

SEQ ID NO: 21812 - protein, 9 aa, Homo Sapiens
SLWQNEERA

SEQ ID NO: 21813 - protein, 9 aa, Homo Sapiens
SLWSIISKV

SEQ ID NO: 21814 - protein, 9 aa, Homo Sapiens
SLYALHVKA

SEQ ID NO: 21815 - protein, 9 aa, Homo Sapiens
SLYDWHVKL

SEQ ID NO: 21816 - protein, 9 aa, Homo Sapiens
SLYDWNVKL

SEQ ID NO: 21817 - protein, 9 aa, Homo Sapiens
SLYEMVSRV

SEQ ID NO: 21818 - protein, 9 aa, Homo Sapiens
SLYGQFRVV

SEQ ID NO: 21819 - protein, 9 aa, Homo Sapiens
SLYHVESTV

SEQ ID NO: 21820 - protein, 9 aa, Homo Sapiens
SLYPIAVLI

SEQ ID NO: 21821 - protein, 9 aa, Homo Sapiens
SLYSQVHQI

SEQ ID NO: 21822 - protein, 9 aa, Homo Sapiens
SMAAFVPAA

SEQ ID NO: 21823 - protein, 9 aa, Homo Sapiens
SMFEFSEKL

SEQ ID NO: 21824 - protein, 9 aa, Homo Sapiens
SMFLPPTTV

SEQ ID NO: 21825 - protein, 9 aa, Homo Sapiens
SMHEVVENL

SEQ ID NO: 21826 - protein, 9 aa, Homo Sapiens
SMLDDLRNV

SEQ ID NO: 21827 - protein, 9 aa, Homo Sapiens
SMLEPVPEL

SEQ ID NO: 21828 - protein, 9 aa, Homo Sapiens
SMMDRMFAL

SEQ ID NO: 21829 - protein, 9 aa, Homo Sapiens
SMMDVDHQI

SEQ ID NO: 21830 - protein, 9 aa, Homo Sapiens
SMMKNFFFV

SEQ ID NO: 21831 - protein, 9 aa, Homo Sapiens
SMSADVPLV

SEQ ID NO: 21832 - protein, 9 aa, Homo Sapiens
SMWGSAVYL

SEQ ID NO: 21833 - protein, 9 aa, Homo Sapiens
SMYYNGIGV

SEQ ID NO: 21834 - protein, 9 aa, Homo Sapiens
SPPAILVTV

SEQ ID NO: 21835 - protein, 9 aa, Homo Sapiens
SPVVILPAV

SEQ ID NO: 21836 - protein, 9 aa, Homo Sapiens
SQAERLFNL

SEQ ID NO: 21837 - protein, 9 aa, Homo Sapiens
SQVDRLVAL

SEQ ID NO: 21838 - protein, 9 aa, Homo Sapiens
STLKNVPQV

SEQ ID NO: 21839 - protein, 9 aa, Homo Sapiens
STWEPEENI

SEQ ID NO: 21840 - protein, 9 aa, Homo Sapiens
STWRIMTTL

SEQ ID NO: 21841 - protein, 9 aa, Homo Sapiens
STYPIKNEV

SEQ ID NO: 21842 - protein, 9 aa, Homo Sapiens
SVFAGVVGV

SEQ ID NO: 21843 - protein, 9 aa, Homo Sapiens
SVFEGLERL

SEQ ID NO: 21844 - protein, 9 aa, Homo Sapiens
SVHKGFAFV

SEQ ID NO: 21845 - protein, 9 aa, Homo Sapiens
SVITQVFHV

SEQ ID NO: 21846 - protein, 9 aa, Homo Sapiens
SVLGAITSV

SEQ ID NO: 21847 - protein, 9 aa, Homo Sapiens
SVLGALIGV

SEQ ID NO: 21848 - protein, 9 aa, Homo Sapiens
SVLKVSHSV

SEQ ID NO: 21849 - protein, 9 aa, Homo Sapiens
SVLLITQHL

SEQ ID NO: 21850 - protein, 9 aa, Homo Sapiens
SVLLVEHAL

SEQ ID NO: 21851 - protein, 9 aa, Homo Sapiens
SVLVSPPAV

SEQ ID NO: 21852 - protein, 9 aa, Homo Sapiens
SVMDWKDGV

SEQ ID NO: 21853 - protein, 9 aa, Homo Sapiens
SVMELLQGV

SEQ ID NO: 21854 - protein, 9 aa, Homo Sapiens
SVPDTVHHV

SEQ ID NO: 21855 - protein, 9 aa, Homo Sapiens
SVTQIYHAV

SEQ ID NO: 21856 - protein, 9 aa, Homo Sapiens
SVTSHIYQV

SEQ ID NO: 21857 - protein, 9 aa, Homo Sapiens
SVWFGPKEV

SEQ ID NO: 21858 - protein, 9 aa, Homo Sapiens
SVYGKLRKV

SEQ ID NO: 21859 - protein, 9 aa, Homo Sapiens
SVYGSLASV

SEQ ID NO: 21860 - protein, 9 aa, Homo Sapiens
SVYHKPPSA

SEQ ID NO: 21861 - protein, 9 aa, Homo Sapiens
TAPPIATGV

SEQ ID NO: 21862 - protein, 9 aa, Homo Sapiens
TIFDLSEVL

SEQ ID NO: 21863 - protein, 9 aa, Homo Sapiens
TLAAIIEHL

SEQ ID NO: 21864 - protein, 9 aa, Homo Sapiens
TLADLVHHV

SEQ ID NO: 21865 - protein, 9 aa, Homo Sapiens
TLADVLYHV

SEQ ID NO: 21866 - protein, 9 aa, Homo Sapiens
TLAHIHYGV

SEQ ID NO: 21867 - protein, 9 aa, Homo Sapiens
TLCDLYETL

SEQ ID NO: 21868 - protein, 9 aa, Homo Sapiens
TLCDVILMV

SEQ ID NO: 21869 - protein, 9 aa, Homo Sapiens
TLCDVTLRV

SEQ ID NO: 21870 - protein, 9 aa, Homo Sapiens
TLDGSLHAV

SEQ ID NO: 21871 - protein, 9 aa, Homo Sapiens
TLFNVIKSV

SEQ ID NO: 21872 - protein, 9 aa, Homo Sapiens
TLFPSKIGV

SEQ ID NO: 21873 - protein, 9 aa, Homo Sapiens
TLFRITSNA

SEQ ID NO: 21874 - protein, 9 aa, Homo Sapiens
TLGVIPESV

SEQ ID NO: 21875 - protein, 9 aa, Homo Sapiens
TLLKKVWKV

SEQ ID NO: 21876 - protein, 9 aa, Homo Sapiens
TLNEKLFLL

SEQ ID NO: 21877 - protein, 9 aa, Homo Sapiens
TLNEKLTAL

SEQ ID NO: 21878 - protein, 9 aa, Homo Sapiens
TLPPPPSGL

SEQ ID NO: 21879 - protein, 9 aa, Homo Sapiens
TLQDIVYKL

SEQ ID NO: 21880 - protein, 9 aa, Homo Sapiens
TLQEKIHRL

SEQ ID NO: 21881 - protein, 9 aa, Homo Sapiens
TLSDLRVYL

SEQ ID NO: 21882 - protein, 9 aa, Homo Sapiens
TLSERLWGL

SEQ ID NO: 21883 - protein, 9 aa, Homo Sapiens
TLSKIVPHI

SEQ ID NO: 21884 - protein, 9 aa, Homo Sapiens
TLTNIIHNL

SEQ ID NO: 21885 - protein, 9 aa, Homo Sapiens
TLTNVIHNL

SEQ ID NO: 21886 - protein, 9 aa, Homo Sapiens
TLTSKLYSL

SEQ ID NO: 21887 - protein, 9 aa, Homo Sapiens
TLWDIQKDL

SEQ ID NO: 21888 - protein, 9 aa, Homo Sapiens
TLWGGLLRL

SEQ ID NO: 21889 - protein, 9 aa, Homo Sapiens
TLWGIQKEL

SEQ ID NO: 21890 - protein, 9 aa, Homo Sapiens
TLWPEVQKL

SEQ ID NO: 21891 - protein, 9 aa, Homo Sapiens
TLWVDPYEV

SEQ ID NO: 21892 - protein, 9 aa, Homo Sapiens
TLWYVPLSL

SEQ ID NO: 21893 - protein, 9 aa, Homo Sapiens
TLYDIRAEL

SEQ ID NO: 21894 - protein, 9 aa, Homo Sapiens
TLYEAVREV

SEQ ID NO: 21895 - protein, 9 aa, Homo Sapiens
TLYEMKSQV

SEQ ID NO: 21896 - protein, 9 aa, Homo Sapiens
TLYRLANQL

SEQ ID NO: 21897 - protein, 9 aa, Homo Sapiens
TQILSVPKV

SEQ ID NO: 21898 - protein, 9 aa, Homo Sapiens
TTTHITKTV

SEQ ID NO: 21899 - protein, 9 aa, Homo Sapiens
TVADKIHSV

SEQ ID NO: 21900 - protein, 9 aa, Homo Sapiens
TVAQIKAHV

SEQ ID NO: 21901 - protein, 9 aa, Homo Sapiens
TVAQIKATV

SEQ ID NO: 21902 - protein, 9 aa, Homo Sapiens
TVFEHTFHV

SEQ ID NO: 21903 - protein, 9 aa, Homo Sapiens
TVIAKVNNV

SEQ ID NO: 21904 - protein, 9 aa, Homo Sapiens
TVIRDPPSI

SEQ ID NO: 21905 - protein, 9 aa, Homo Sapiens
TVLLIMHTL

SEQ ID NO: 21906 - protein, 9 aa, Homo Sapiens
TVMGKIFAV

SEQ ID NO: 21907 - protein, 9 aa, Homo Sapiens
TVPPPPAAA

SEQ ID NO: 21908 - protein, 9 aa, Homo Sapiens
TVWHPECFV

SEQ ID NO: 21909 - protein, 9 aa, Homo Sapiens
TVWIPEVGV

SEQ ID NO: 21910 - protein, 9 aa, Homo Sapiens
VAFSVQKEV

SEQ ID NO: 21911 - protein, 9 aa, Homo Sapiens
VAPPARVAP

SEQ ID NO: 21912 - protein, 9 aa, Homo Sapiens
VAPPKAHEV

SEQ ID NO: 21913 - protein, 9 aa, Homo Sapiens
VAPPPPTHL

SEQ ID NO: 21914 - protein, 9 aa, Homo Sapiens
VAPPRGPLP

SEQ ID NO: 21915 - protein, 9 aa, Homo Sapiens
VAWEVANKV

SEQ ID NO: 21916 - protein, 9 aa, Homo Sapiens
VCVPSYLEL

SEQ ID NO: 21917 - protein, 9 aa, Homo Sapiens
VEELKPTPE

SEQ ID NO: 21918 - protein, 9 aa, Homo Sapiens
VIAEILRGV

SEQ ID NO: 21919 - protein, 9 aa, Homo Sapiens
VIDGHIYAV

SEQ ID NO: 21920 - protein, 9 aa, Homo Sapiens
VIHNLATYV

SEQ ID NO: 21921 - protein, 9 aa, Homo Sapiens
VIMWQKHYV

SEQ ID NO: 21922 - protein, 9 aa, Homo Sapiens
VIWGKVTRA

SEQ ID NO: 21923 - protein, 9 aa, Homo Sapiens
VIYDVSHNI

SEQ ID NO: 21924 - protein, 9 aa, Homo Sapiens
VIYTLIHYI

SEQ ID NO: 21925 - protein, 9 aa, Homo Sapiens
VLADQVWTL

SEQ ID NO: 21926 - protein, 9 aa, Homo Sapiens
VLAELKEYA

SEQ ID NO: 21927 - protein, 9 aa, Homo Sapiens
VLCELINAL

SEQ ID NO: 21928 - protein, 9 aa, Homo Sapiens
VLCFTPYHV

SEQ ID NO: 21929 - protein, 9 aa, Homo Sapiens
VLDDKLVFV

SEQ ID NO: 21930 - protein, 9 aa, Homo Sapiens
VLDIIKHIV

SEQ ID NO: 21931 - protein, 9 aa, Homo Sapiens
VLDNPTPEM

SEQ ID NO: 21932 - protein, 9 aa, Homo Sapiens
VLDVIHEVL

SEQ ID NO: 21933 - protein, 9 aa, Homo Sapiens
VLFDVTGQV

SEQ ID NO: 21934 - protein, 9 aa, Homo Sapiens
VLFELSKTV

SEQ ID NO: 21935 - protein, 9 aa, Homo Sapiens
VLFGEITRL

SEQ ID NO: 21936 - protein, 9 aa, Homo Sapiens
VLFGLLREV

SEQ ID NO: 21937 - protein, 9 aa, Homo Sapiens
VLFGVETHV

SEQ ID NO: 21938 - protein, 9 aa, Homo Sapiens
VLFLVAWTV

SEQ ID NO: 21939 - protein, 9 aa, Homo Sapiens
VLFNKLTYL

SEQ ID NO: 21940 - protein, 9 aa, Homo Sapiens
VLFPWQARL

SEQ ID NO: 21941 - protein, 9 aa, Homo Sapiens
VLFSSPPQM

SEQ ID NO: 21942 - protein, 9 aa, Homo Sapiens
VLFTGVKEV

SEQ ID NO: 21943 - protein, 9 aa, Homo Sapiens
VLFTITKTV

SEQ ID NO: 21944 - protein, 9 aa, Homo Sapiens
VLHDRIVSV

SEQ ID NO: 21945 - protein, 9 aa, Homo Sapiens
VLHELTFQA

SEQ ID NO: 21946 - protein, 9 aa, Homo Sapiens
VLIPKLPQL

SEQ ID NO: 21947 - protein, 9 aa, Homo Sapiens
VLISKLPYI

SEQ ID NO: 21948 - protein, 9 aa, Homo Sapiens
VLKEIVERV

SEQ ID NO: 21949 - protein, 9 aa, Homo Sapiens
VLLFIEHSV

SEQ ID NO: 21950 - protein, 9 aa, Homo Sapiens
VLLGHIFYV

SEQ ID NO: 21951 - protein, 9 aa, Homo Sapiens
VLLGKVYVV

SEQ ID NO: 21952 - protein, 9 aa, Homo Sapiens
VLLKIVEQI

SEQ ID NO: 21953 - protein, 9 aa, Homo Sapiens
VLLQIVHFL

SEQ ID NO: 21954 - protein, 9 aa, Homo Sapiens
VLLSTIHEL

SEQ ID NO: 21955 - protein, 9 aa, Homo Sapiens
VLMDLKALL

SEQ ID NO: 21956 - protein, 9 aa, Homo Sapiens
VLMDRLPSL

SEQ ID NO: 21957 - protein, 9 aa, Homo Sapiens
VLMEMSYRL

SEQ ID NO: 21958 - protein, 9 aa, Homo Sapiens
VLMENIVYL

SEQ ID NO: 21959 - protein, 9 aa, Homo Sapiens
VLMNQPPQI

SEQ ID NO: 21960 - protein, 9 aa, Homo Sapiens
VLMPWIHEL

SEQ ID NO: 21961 - protein, 9 aa, Homo Sapiens
VLQGKLAEV

SEQ ID NO: 21962 - protein, 9 aa, Homo Sapiens
VLSELLWQV

SEQ ID NO: 21963 - protein, 9 aa, Homo Sapiens
VLSSPLALA

SEQ ID NO: 21964 - protein, 9 aa, Homo Sapiens
VLTESPPSL

SEQ ID NO: 21965 - protein, 9 aa, Homo Sapiens
VLWAGTPMV

SEQ ID NO: 21966 - protein, 9 aa, Homo Sapiens
VLWDLVDRI

SEQ ID NO: 21967 - protein, 9 aa, Homo Sapiens
VLWDRTFSL

SEQ ID NO: 21968 - protein, 9 aa, Homo Sapiens
VLWFKPVEL

SEQ ID NO: 21969 - protein, 9 aa, Homo Sapiens
VLWLPHWGL

SEQ ID NO: 21970 - protein, 9 aa, Homo Sapiens
VLWSVLQQI

SEQ ID NO: 21971 - protein, 9 aa, Homo Sapiens
VLWTLHSEG

SEQ ID NO: 21972 - protein, 9 aa, Homo Sapiens
VLYDQPRHV

SEQ ID NO: 21973 - protein, 9 aa, Homo Sapiens
VLYDWKERL

SEQ ID NO: 21974 - protein, 9 aa, Homo Sapiens
VLYELLQHI

SEQ ID NO: 21975 - protein, 9 aa, Homo Sapiens
VLYENKVAV

SEQ ID NO: 21976 - protein, 9 aa, Homo Sapiens
VLYHVETEV

SEQ ID NO: 21977 - protein, 9 aa, Homo Sapiens
VLYSIAEKV

SEQ ID NO: 21978 - protein, 9 aa, Homo Sapiens
VMADIRELI

SEQ ID NO: 21979 - protein, 9 aa, Homo Sapiens
VMAPRTLVL

SEQ ID NO: 21980 - protein, 9 aa, Homo Sapiens
VMDSKIVQV

SEQ ID NO: 21981 - protein, 9 aa, Homo Sapiens
VMFKEPVEV

SEQ ID NO: 21982 - protein, 9 aa, Homo Sapiens
VMFKITARA

SEQ ID NO: 21983 - protein, 9 aa, Homo Sapiens
VMGDIPAAV

SEQ ID NO: 21984 - protein, 9 aa, Homo Sapiens
VMPHANMNV

SEQ ID NO: 21985 - protein, 9 aa, Homo Sapiens
VMWSPTHPA

SEQ ID NO: 21986 - protein, 9 aa, Homo Sapiens
VMYDLITEL

SEQ ID NO: 21987 - protein, 9 aa, Homo Sapiens
VMYGKVYRI

SEQ ID NO: 21988 - protein, 9 aa, Homo Sapiens
VQTDYVPLL

SEQ ID NO: 21989 - protein, 9 aa, Homo Sapiens
VQWKVVETL

SEQ ID NO: 21990 - protein, 9 aa, Homo Sapiens
VSAHITEQL

SEQ ID NO: 21991 - protein, 9 aa, Homo Sapiens
VTAEVKHNI

SEQ ID NO: 21992 - protein, 9 aa, Homo Sapiens
VTFVPVSKV

SEQ ID NO: 21993 - protein, 9 aa, Homo Sapiens
VTIKKDVDG

SEQ ID NO: 21994 - protein, 9 aa, Homo Sapiens
VVAAIAISE

SEQ ID NO: 21995 - protein, 9 aa, Homo Sapiens
VVAEFVPLI

SEQ ID NO: 21996 - protein, 9 aa, Homo Sapiens
VVCGLIFRL

SEQ ID NO: 21997 - protein, 9 aa, Homo Sapiens
VVDIIRVNV

SEQ ID NO: 21998 - protein, 9 aa, Homo Sapiens
VVFRLQEFI

SEQ ID NO: 21999 - protein, 9 aa, Homo Sapiens
VVGHITEGV

SEQ ID NO: 22000 - protein, 9 aa, Homo Sapiens
VVLPAPPAV

SEQ ID NO: 22001 - protein, 9 aa, Homo Sapiens
VVMNVVHQL

SEQ ID NO: 22002 - protein, 9 aa, Homo Sapiens
VVWMVPENV

SEQ ID NO: 22003 - protein, 9 aa, Homo Sapiens
VVWPVPENI

SEQ ID NO: 22004 - protein, 9 aa, Homo Sapiens
WKPVGDLLI

SEQ ID NO: 22005 - protein, 9 aa, Homo Sapiens
WLAEKLPTL

SEQ ID NO: 22006 - protein, 9 aa, Homo Sapiens
WLVDHVYAI

SEQ ID NO: 22007 - protein, 9 aa, Homo Sapiens
WLWPFKETV

SEQ ID NO: 22008 - protein, 9 aa, Homo Sapiens
YAAELIERV

SEQ ID NO: 22009 - protein, 9 aa, Homo Sapiens
YAFNMKATV

SEQ ID NO: 22010 - protein, 9 aa, Homo Sapiens
YALYVRDTL

SEQ ID NO: 22011 - protein, 9 aa, Homo Sapiens
YAWEIKDFL

SEQ ID NO: 22012 - protein, 9 aa, Homo Sapiens
YAYDGKDYI

SEQ ID NO: 22013 - protein, 9 aa, Homo Sapiens
YAYETKDAL

SEQ ID NO: 22014 - protein, 9 aa, Homo Sapiens
YGPPVRTEY

SEQ ID NO: 22015 - protein, 9 aa, Homo Sapiens
YIAKITEGV

SEQ ID NO: 22016 - protein, 9 aa, Homo Sapiens
YIAPLKALV

SEQ ID NO: 22017 - protein, 9 aa, Homo Sapiens
YIASLPFQV

SEQ ID NO: 22018 - protein, 9 aa, Homo Sapiens
YIFDNCHEL

SEQ ID NO: 22019 - protein, 9 aa, Homo Sapiens
YIFQPQQSV

SEQ ID NO: 22020 - protein, 9 aa, Homo Sapiens
YIFSVVENL

SEQ ID NO: 22021 - protein, 9 aa, Homo Sapiens
YIIVPPLTL

SEQ ID NO: 22022 - protein, 9 aa, Homo Sapiens
YILLPRIIE

SEQ ID NO: 22023 - protein, 9 aa, Homo Sapiens
YLADIFTKL

SEQ ID NO: 22024 - protein, 9 aa, Homo Sapiens
YLADLYHFV

SEQ ID NO: 22025 - protein, 9 aa, Homo Sapiens
YLADVTNAL

SEQ ID NO: 22026 - protein, 9 aa, Homo Sapiens
YLAGLHANI

SEQ ID NO: 22027 - protein, 9 aa, Homo Sapiens
YLAHLAHHL

SEQ ID NO: 22028 - protein, 9 aa, Homo Sapiens
YLAKHIENI

SEQ ID NO: 22029 - protein, 9 aa, Homo Sapiens
YLAPFLRNV

SEQ ID NO: 22030 - protein, 9 aa, Homo Sapiens
YLATLTEKM

SEQ ID NO: 22031 - protein, 9 aa, Homo Sapiens
YLDAIRSGL

SEQ ID NO: 22032 - protein, 9 aa, Homo Sapiens
YLDEIVKEV

SEQ ID NO: 22033 - protein, 9 aa, Homo Sapiens
YLDKTFYNL

SEQ ID NO: 22034 - protein, 9 aa, Homo Sapiens
YLDPAQRGV

SEQ ID NO: 22035 - protein, 9 aa, Homo Sapiens
YLDQIRQTI

SEQ ID NO: 22036 - protein, 9 aa, Homo Sapiens
YLDTINRSV

SEQ ID NO: 22037 - protein, 9 aa, Homo Sapiens
YLDVVQSNV

SEQ ID NO: 22038 - protein, 9 aa, Homo Sapiens
YLFALQSHL

SEQ ID NO: 22039 - protein, 9 aa, Homo Sapiens
YLFDLPLKV

SEQ ID NO: 22040 - protein, 9 aa, Homo Sapiens
YLFERIKEL

SEQ ID NO: 22041 - protein, 9 aa, Homo Sapiens
YLFILKNQV

SEQ ID NO: 22042 - protein, 9 aa, Homo Sapiens
YLFIVKNEL

SEQ ID NO: 22043 - protein, 9 aa, Homo Sapiens
YLFKCPQSV

SEQ ID NO: 22044 - protein, 9 aa, Homo Sapiens
YLFNSVVNV

SEQ ID NO: 22045 - protein, 9 aa, Homo Sapiens
YLFREPATI

SEQ ID NO: 22046 - protein, 9 aa, Homo Sapiens
YLFSTKTHL

SEQ ID NO: 22047 - protein, 9 aa, Homo Sapiens
YLFTFLNHL

SEQ ID NO: 22048 - protein, 9 aa, Homo Sapiens
YLFTIINSL

SEQ ID NO: 22049 - protein, 9 aa, Homo Sapiens
YLFTSPQRV

SEQ ID NO: 22050 - protein, 9 aa, Homo Sapiens
YLGNINPQM

SEQ ID NO: 22051 - protein, 9 aa, Homo Sapiens
YLGPHIASV

SEQ ID NO: 22052 - protein, 9 aa, Homo Sapiens
YLHEFRDKL

SEQ ID NO: 22053 - protein, 9 aa, Homo Sapiens
YLHNQGIGV

SEQ ID NO: 22054 - protein, 9 aa, Homo Sapiens
YLHSQVVSV

SEQ ID NO: 22055 - protein, 9 aa, Homo Sapiens
YLIELIDRV

SEQ ID NO: 22056 - protein, 9 aa, Homo Sapiens
YLIPLLERL

SEQ ID NO: 22057 - protein, 9 aa, Homo Sapiens
YLITLLEHL

SEQ ID NO: 22058 - protein, 9 aa, Homo Sapiens
YLLDHFLSM

SEQ ID NO: 22059 - protein, 9 aa, Homo Sapiens
YLLDLHSYL

SEQ ID NO: 22060 - protein, 9 aa, Homo Sapiens
YLLDRLPEM

SEQ ID NO: 22061 - protein, 9 aa, Homo Sapiens
YLLEKFVAV

SEQ ID NO: 22062 - protein, 9 aa, Homo Sapiens
YLLESVNKL

SEQ ID NO: 22063 - protein, 9 aa, Homo Sapiens
YLLKINGKV

SEQ ID NO: 22064 - protein, 9 aa, Homo Sapiens
YLLPAIVHI

SEQ ID NO: 22065 - protein, 9 aa, Homo Sapiens
YLMEVTHDL

SEQ ID NO: 22066 - protein, 9 aa, Homo Sapiens
YLNCIVEKV

SEQ ID NO: 22067 - protein, 9 aa, Homo Sapiens
YLNDGLWHM

SEQ ID NO: 22068 - protein, 9 aa, Homo Sapiens
YLNEIKDSV

SEQ ID NO: 22069 - protein, 9 aa, Homo Sapiens
YLNHLIQGL

SEQ ID NO: 22070 - protein, 9 aa, Homo Sapiens
YLNKHIQKV

SEQ ID NO: 22071 - protein, 9 aa, Homo Sapiens
YLNQHIEHV

SEQ ID NO: 22072 - protein, 9 aa, Homo Sapiens
YLPHAPPFA

SEQ ID NO: 22073 - protein, 9 aa, Homo Sapiens
YLPYPIHQV

SEQ ID NO: 22074 - protein, 9 aa, Homo Sapiens
YLQAHTQSV

SEQ ID NO: 22075 - protein, 9 aa, Homo Sapiens
YLQDTMNHV

SEQ ID NO: 22076 - protein, 9 aa, Homo Sapiens
YLQDVIMQV

SEQ ID NO: 22077 - protein, 9 aa, Homo Sapiens
YLQEHAQEV

SEQ ID NO: 22078 - protein, 9 aa, Homo Sapiens
YLQEKLHAL

SEQ ID NO: 22079 - protein, 9 aa, Homo Sapiens
YLQNWSHVL

SEQ ID NO: 22080 - protein, 9 aa, Homo Sapiens
YLQQVNHKL

SEQ ID NO: 22081 - protein, 9 aa, Homo Sapiens
YLRSMIPHL

SEQ ID NO: 22082 - protein, 9 aa, Homo Sapiens
YLSDNVHLV

SEQ ID NO: 22083 - protein, 9 aa, Homo Sapiens
YLSDPCPGL

SEQ ID NO: 22084 - protein, 9 aa, Homo Sapiens
YLSEEVQAV

SEQ ID NO: 22085 - protein, 9 aa, Homo Sapiens
YLSELSEHV

SEQ ID NO: 22086 - protein, 9 aa, Homo Sapiens
YLSKIIPAL

SEQ ID NO: 22087 - protein, 9 aa, Homo Sapiens
YLSPKLWAL

SEQ ID NO: 22088 - protein, 9 aa, Homo Sapiens
YLTDRVMTV

SEQ ID NO: 22089 - protein, 9 aa, Homo Sapiens
YLVEDIQHI

SEQ ID NO: 22090 - protein, 9 aa, Homo Sapiens
YLWQGVRVA

SEQ ID NO: 22091 - protein, 9 aa, Homo Sapiens
YLWSRVEKL

SEQ ID NO: 22092 - protein, 9 aa, Homo Sapiens
YLYDLNHTL

SEQ ID NO: 22093 - protein, 9 aa, Homo Sapiens
YLYDRIRKA

SEQ ID NO: 22094 - protein, 9 aa, Homo Sapiens
YLYDRLLRI

SEQ ID NO: 22095 - protein, 9 aa, Homo Sapiens
YLYDVEVKC

SEQ ID NO: 22096 - protein, 9 aa, Homo Sapiens
YLYPDITRL

SEQ ID NO: 22097 - protein, 9 aa, Homo Sapiens
YLYQILQGI

SEQ ID NO: 22098 - protein, 9 aa, Homo Sapiens
YMADRLLGV

SEQ ID NO: 22099 - protein, 9 aa, Homo Sapiens
YMAELIERL

SEQ ID NO: 22100 - protein, 9 aa, Homo Sapiens
YMAPEVVEA

SEQ ID NO: 22101 - protein, 9 aa, Homo Sapiens
YMDAPKAAL

SEQ ID NO: 22102 - protein, 9 aa, Homo Sapiens
YMDVVKERI

SEQ ID NO: 22103 - protein, 9 aa, Homo Sapiens
YMEEIYHRI

SEQ ID NO: 22104 - protein, 9 aa, Homo Sapiens
YMFEAREFL

SEQ ID NO: 22105 - protein, 9 aa, Homo Sapiens
YMHFLENQV

SEQ ID NO: 22106 - protein, 9 aa, Homo Sapiens
YMIAHITGL

SEQ ID NO: 22107 - protein, 9 aa, Homo Sapiens
YMKDIENYI

SEQ ID NO: 22108 - protein, 9 aa, Homo Sapiens
YMLDLQKQL

SEQ ID NO: 22109 - protein, 9 aa, Homo Sapiens
YMLEHVITL

SEQ ID NO: 22110 - protein, 9 aa, Homo Sapiens
YMMPVNSEV

SEQ ID NO: 22111 - protein, 9 aa, Homo Sapiens
YMNHIMVSV

SEQ ID NO: 22112 - protein, 9 aa, Homo Sapiens
YMPKRGLEV

SEQ ID NO: 22113 - protein, 9 aa, Homo Sapiens
YMPPTSEAA

SEQ ID NO: 22114 - protein, 9 aa, Homo Sapiens
YMSDSFINV

SEQ ID NO: 22115 - protein, 9 aa, Homo Sapiens
YQVGQLYSV

SEQ ID NO: 22116 - protein, 9 aa, Homo Sapiens
YQYPVIIHL

SEQ ID NO: 22117 - protein, 9 aa, Homo Sapiens
YTAEIKQNL

SEQ ID NO: 22118 - protein, 9 aa, Homo Sapiens
YTFDPVTKV

SEQ ID NO: 22119 - protein, 9 aa, Homo Sapiens
YTFNVDQKL

SEQ ID NO: 22120 - protein, 9 aa, Homo Sapiens
YTFPLAEKV

SEQ ID NO: 22121 - protein, 9 aa, Homo Sapiens
YTFPLRINL

SEQ ID NO: 22122 - protein, 9 aa, Homo Sapiens
YTPPAGAKV

SEQ ID NO: 22123 - protein, 9 aa, Homo Sapiens
YTPPPPPTA

SEQ ID NO: 22124 - protein, 9 aa, Homo Sapiens
YVFPGVTRL

SEQ ID NO: 22125 - protein, 9 aa, Homo Sapiens
YVHMVTHFI

SEQ ID NO: 22126 - protein, 9 aa, Homo Sapiens
YVLDLAAKV

SEQ ID NO: 22127 - protein, 9 aa, Homo Sapiens
YVLEGLKSV

SEQ ID NO: 22128 - protein, 9 aa, Homo Sapiens
YVSEILEKV

SEQ ID NO: 22129 - protein, 9 aa, Homo Sapiens
YVTDVLYRV

SEQ ID NO: 22130 - protein, 9 aa, Homo Sapiens
YVWDIKSIM

SEQ ID NO: 22131 - protein, 9 aa, Homo Sapiens
YVYEFRDKL

SEQ ID NO: 22132 - protein, 9 aa, Homo Sapiens
YVYEMRDKL

SEQ ID NO: 22133 - protein, 9 aa, Homo Sapiens
YVYEYLLHV

SEQ ID NO: 22134 - protein, 10 aa, Homo Sapiens
AIIEARGVSV

SEQ ID NO: 22135 - protein, 10 aa, Homo Sapiens
ALAEPAWLHI

SEQ ID NO: 22136 - protein, 10 aa, Homo Sapiens
ALASLKKYGV

SEQ ID NO: 22137 - protein, 10 aa, Homo Sapiens
ALCEENMRGV

SEQ ID NO: 22138 - protein, 10 aa, Homo Sapiens
ALFPAPLAQI

SEQ ID NO: 22139 - protein, 10 aa, Homo Sapiens
ALLDVTPKAV

SEQ ID NO: 22140 - protein, 10 aa, Homo Sapiens
ALLEKGITEA

SEQ ID NO: 22141 - protein, 10 aa, Homo Sapiens
ALLKIEGVYA

SEQ ID NO: 22142 - protein, 10 aa, Homo Sapiens
ALMAHAMEEV

SEQ ID NO: 22143 - protein, 10 aa, Homo Sapiens
ALMEVKMKEM

SEQ ID NO: 22144 - protein, 10 aa, Homo Sapiens
ALPAELLEAL

SEQ ID NO: 22145 - protein, 10 aa, Homo Sapiens
ALSKEGIVAL

SEQ ID NO: 22146 - protein, 10 aa, Homo Sapiens
ALWDLRNLKL

SEQ ID NO: 22147 - protein, 10 aa, Homo Sapiens
ALWDPGPEAA

SEQ ID NO: 22148 - protein, 10 aa, Homo Sapiens
ALWHVPEHAV

SEQ ID NO: 22149 - protein, 10 aa, Homo Sapiens
ALWKNEGFFL

SEQ ID NO: 22150 - protein, 10 aa, Homo Sapiens
ALYDICFRTL

SEQ ID NO: 22151 - protein, 10 aa, Homo Sapiens
ALYPGQLVQL

SEQ ID NO: 22152 - protein, 10 aa, Homo Sapiens
AMFDHIPVGV

SEQ ID NO: 22153 - protein, 10 aa, Homo Sapiens
AMFPDTIPRV

SEQ ID NO: 22154 - protein, 10 aa, Homo Sapiens
AMIAVVPGYI

SEQ ID NO: 22155 - protein, 10 aa, Homo Sapiens
AMPPPPPQGV

SEQ ID NO: 22156 - protein, 10 aa, Homo Sapiens
AQYENPPHIY

SEQ ID NO: 22157 - protein, 10 aa, Homo Sapiens
AVGGIANATI

SEQ ID NO: 22158 - protein, 10 aa, Homo Sapiens
AVPPAPTATV

SEQ ID NO: 22159 - protein, 10 aa, Homo Sapiens
AVWAKGIRNV

SEQ ID NO: 22160 - protein, 10 aa, Homo Sapiens
CLMGKGMKRV

SEQ ID NO: 22161 - protein, 10 aa, Homo Sapiens
FICDYELHEL

SEQ ID NO: 22162 - protein, 10 aa, Homo Sapiens
FIFEKKLAQA

SEQ ID NO: 22163 - protein, 10 aa, Homo Sapiens
FIMEGTLTRV

SEQ ID NO: 22164 - protein, 10 aa, Homo Sapiens
FLADPSAFVA

SEQ ID NO: 22165 - protein, 10 aa, Homo Sapiens
FLCDVTMKSV

SEQ ID NO: 22166 - protein, 10 aa, Homo Sapiens
FLCPFHLSVA

SEQ ID NO: 22167 - protein, 10 aa, Homo Sapiens
FLDPNNIPKA

SEQ ID NO: 22168 - protein, 10 aa, Homo Sapiens
FLFDEEMEQM

SEQ ID NO: 22169 - protein, 10 aa, Homo Sapiens
FLFDGSPTYV

SEQ ID NO: 22170 - protein, 10 aa, Homo Sapiens
FLFDPKKLSV

SEQ ID NO: 22171 - protein, 10 aa, Homo Sapiens
FLHDLKETNI

SEQ ID NO: 22172 - protein, 10 aa, Homo Sapiens
FLHETGGAMV

SEQ ID NO: 22173 - protein, 10 aa, Homo Sapiens
FLLDGFPRTV

SEQ ID NO: 22174 - protein, 10 aa, Homo Sapiens
FLLEPGNLEV

SEQ ID NO: 22175 - protein, 10 aa, Homo Sapiens
FLLNLQNCHL

SEQ ID NO: 22176 - protein, 10 aa, Homo Sapiens
FLLPDGLVRL

SEQ ID NO: 22177 - protein, 10 aa, Homo Sapiens
FLLPHPGLQV

SEQ ID NO: 22178 - protein, 10 aa, Homo Sapiens
FLLPIKTVGV

SEQ ID NO: 22179 - protein, 10 aa, Homo Sapiens
FLLPSEVPAL

SEQ ID NO: 22180 - protein, 10 aa, Homo Sapiens
FLLPTGLSSL

SEQ ID NO: 22181 - protein, 10 aa, Homo Sapiens
FLNDPRRLNV

SEQ ID NO: 22182 - protein, 10 aa, Homo Sapiens
FLWERPTLLV

SEQ ID NO: 22183 - protein, 10 aa, Homo Sapiens
FLYKEKLVSV

SEQ ID NO: 22184 - protein, 10 aa, Homo Sapiens
FMDPQKMPYL

SEQ ID NO: 22185 - protein, 10 aa, Homo Sapiens
FMFDEKLVTV

SEQ ID NO: 22186 - protein, 10 aa, Homo Sapiens
FMQDPMEVFV

SEQ ID NO: 22187 - protein, 10 aa, Homo Sapiens
FQADLSNLHL

SEQ ID NO: 22188 - protein, 10 aa, Homo Sapiens
FQAGSGIYHV

SEQ ID NO: 22189 - protein, 10 aa, Homo Sapiens
FVADEGICYL

SEQ ID NO: 22190 - protein, 10 aa, Homo Sapiens
GLAGVKIAEV

SEQ ID NO: 22191 - protein, 10 aa, Homo Sapiens
GLDDIKDLKV

SEQ ID NO: 22192 - protein, 10 aa, Homo Sapiens
GLFGKELHKV

SEQ ID NO: 22193 - protein, 10 aa, Homo Sapiens
GLIGVGLINV

SEQ ID NO: 22194 - protein, 10 aa, Homo Sapiens
GLWHGMFANV

SEQ ID NO: 22195 - protein, 10 aa, Homo Sapiens
GLWSGPLPRV

SEQ ID NO: 22196 - protein, 10 aa, Homo Sapiens
HLPPVRLAEL

SEQ ID NO: 22197 - protein, 10 aa, Homo Sapiens
HLWDPENSVL

SEQ ID NO: 22198 - protein, 10 aa, Homo Sapiens
HVFDHPWETV

SEQ ID NO: 22199 - protein, 10 aa, Homo Sapiens
IIAEPGRYYV

SEQ ID NO: 22200 - protein, 10 aa, Homo Sapiens
ILAPCKLETV

SEQ ID NO: 22201 - protein, 10 aa, Homo Sapiens
ILFLIAGKIV

SEQ ID NO: 22202 - protein, 10 aa, Homo Sapiens
ILNEFPGHGL

SEQ ID NO: 22203 - protein, 10 aa, Homo Sapiens
ILPSYIPVRV

SEQ ID NO: 22204 - protein, 10 aa, Homo Sapiens
ILQDLTFVHL

SEQ ID NO: 22205 - protein, 10 aa, Homo Sapiens
ILQSKEPAYV

SEQ ID NO: 22206 - protein, 10 aa, Homo Sapiens
ILWSERPTKV

SEQ ID NO: 22207 - protein, 10 aa, Homo Sapiens
ILYDKDHYKL

SEQ ID NO: 22208 - protein, 10 aa, Homo Sapiens
ILYTLPKLGV

SEQ ID NO: 22209 - protein, 10 aa, Homo Sapiens
IMPAFIFEHI

SEQ ID NO: 22210 - protein, 10 aa, Homo Sapiens
KAEGVLLDYL

SEQ ID NO: 22211 - protein, 10 aa, Homo Sapiens
KAPEVPTEGV

SEQ ID NO: 22212 - protein, 10 aa, Homo Sapiens
KICDFGLARV

SEQ ID NO: 22213 - protein, 10 aa, Homo Sapiens
KIFSGVFVKV

SEQ ID NO: 22214 - protein, 10 aa, Homo Sapiens
KIGPITPLEF

SEQ ID NO: 22215 - protein, 10 aa, Homo Sapiens
KILDIGLAYI

SEQ ID NO: 22216 - protein, 10 aa, Homo Sapiens
KIMDLIGIQT

SEQ ID NO: 22217 - protein, 10 aa, Homo Sapiens
KIWDVSVNSV

SEQ ID NO: 22218 - protein, 10 aa, Homo Sapiens
KLFDIFSQQV

SEQ ID NO: 22219 - protein, 10 aa, Homo Sapiens
KLFEGLKFFL

SEQ ID NO: 22220 - protein, 10 aa, Homo Sapiens
KLFPDTPLAL

SEQ ID NO: 22221 - protein, 10 aa, Homo Sapiens
KLHDFGYRGV

SEQ ID NO: 22222 - protein, 10 aa, Homo Sapiens
KLIQLPVVYV

SEQ ID NO: 22223 - protein, 10 aa, Homo Sapiens
KLLDEAIQAV

SEQ ID NO: 22224 - protein, 10 aa, Homo Sapiens
KLLDISELDM

SEQ ID NO: 22225 - protein, 10 aa, Homo Sapiens
KLLDPEDISV

SEQ ID NO: 22226 - protein, 10 aa, Homo Sapiens
KLLEGTIVNV

SEQ ID NO: 22227 - protein, 10 aa, Homo Sapiens
KLLEPVPVSV

SEQ ID NO: 22228 - protein, 10 aa, Homo Sapiens
KLMALGPIRL

SEQ ID NO: 22229 - protein, 10 aa, Homo Sapiens
KLMDLDVEQL

SEQ ID NO: 22230 - protein, 10 aa, Homo Sapiens
KLMDLRNEYL

SEQ ID NO: 22231 - protein, 10 aa, Homo Sapiens
KLMDVGLIAI

SEQ ID NO: 22232 - protein, 10 aa, Homo Sapiens
KLMSLGDIRL

SEQ ID NO: 22233 - protein, 10 aa, Homo Sapiens
KLPAEPPALL

SEQ ID NO: 22234 - protein, 10 aa, Homo Sapiens
KLQDAEIARL

SEQ ID NO: 22235 - protein, 10 aa, Homo Sapiens
KLQDLTDVQI

SEQ ID NO: 22236 - protein, 10 aa, Homo Sapiens
KLQEVGQVSV

SEQ ID NO: 22237 - protein, 10 aa, Homo Sapiens
KLTEMRGIYA

SEQ ID NO: 22238 - protein, 10 aa, Homo Sapiens
KLVELDATGV

SEQ ID NO: 22239 - protein, 10 aa, Homo Sapiens
KLWALPQCQL

SEQ ID NO: 22240 - protein, 10 aa, Homo Sapiens
KLWDIINVNI

SEQ ID NO: 22241 - protein, 10 aa, Homo Sapiens
KLWDIRDGMC

SEQ ID NO: 22242 - protein, 10 aa, Homo Sapiens
KLWDISEVMV

SEQ ID NO: 22243 - protein, 10 aa, Homo Sapiens
KLWDVRDSMC

SEQ ID NO: 22244 - protein, 10 aa, Homo Sapiens
KLWEMDNMLI

SEQ ID NO: 22245 - protein, 10 aa, Homo Sapiens
KLWPLPKALL

SEQ ID NO: 22246 - protein, 10 aa, Homo Sapiens
KLYDIDVAKV

SEQ ID NO: 22247 - protein, 10 aa, Homo Sapiens
KLYDIEQQQI

SEQ ID NO: 22248 - protein, 10 aa, Homo Sapiens
KLYEGKTKEV

SEQ ID NO: 22249 - protein, 10 aa, Homo Sapiens
KLYEKKLLKL

SEQ ID NO: 22250 - protein, 10 aa, Homo Sapiens
KLYNPENIYL

SEQ ID NO: 22251 - protein, 10 aa, Homo Sapiens
KMADIGGHAI

SEQ ID NO: 22252 - protein, 10 aa, Homo Sapiens
KMWEEAISLC

SEQ ID NO: 22253 - protein, 10 aa, Homo Sapiens
KMWENRQNLL

SEQ ID NO: 22254 - protein, 10 aa, Homo Sapiens
KMYEEFLSKV

SEQ ID NO: 22255 - protein, 10 aa, Homo Sapiens
KTLELPHVFV

SEQ ID NO: 22256 - protein, 10 aa, Homo Sapiens
KVADPTPFHI

SEQ ID NO: 22257 - protein, 10 aa, Homo Sapiens
KVARLDNIFL

SEQ ID NO: 22258 - protein, 10 aa, Homo Sapiens
KVFDPVPVGV

SEQ ID NO: 22259 - protein, 10 aa, Homo Sapiens
KVGSFKFIYV

SEQ ID NO: 22260 - protein, 10 aa, Homo Sapiens
KVWDIVGTEL

SEQ ID NO: 22261 - protein, 10 aa, Homo Sapiens
KVWVDGIQRV

SEQ ID NO: 22262 - protein, 10 aa, Homo Sapiens
LANSDPKLAL

SEQ ID NO: 22263 - protein, 10 aa, Homo Sapiens
LAPPPPPAAA

SEQ ID NO: 22264 - protein, 10 aa, Homo Sapiens
LFLHAGIVLP

SEQ ID NO: 22265 - protein, 10 aa, Homo Sapiens
LLDPSTPVHI

SEQ ID NO: 22266 - protein, 10 aa, Homo Sapiens
LLIFTEGAAV

SEQ ID NO: 22267 - protein, 10 aa, Homo Sapiens
LLLDVPTAAV

SEQ ID NO: 22268 - protein, 10 aa, Homo Sapiens
LLLDVTPLSL

SEQ ID NO: 22269 - protein, 10 aa, Homo Sapiens
LLLPFTTTSL

SEQ ID NO: 22270 - protein, 10 aa, Homo Sapiens
LLLPPPPCPA

SEQ ID NO: 22271 - protein, 10 aa, Homo Sapiens
LLLSAEPVPA

SEQ ID NO: 22272 - protein, 10 aa, Homo Sapiens
LLPDQPPYHL

SEQ ID NO: 22273 - protein, 10 aa, Homo Sapiens
LLSAAEPVPA

SEQ ID NO: 22274 - protein, 10 aa, Homo Sapiens
LLWAPAAVRA

SEQ ID NO: 22275 - protein, 10 aa, Homo Sapiens
LLWELVTREV

SEQ ID NO: 22276 - protein, 10 aa, Homo Sapiens
LLWQVIKIGL

SEQ ID NO: 22277 - protein, 10 aa, Homo Sapiens
LMADLEGLHL

SEQ ID NO: 22278 - protein, 10 aa, Homo Sapiens
LMAEMGVHSV

SEQ ID NO: 22279 - protein, 10 aa, Homo Sapiens
LMDPNSPERV

SEQ ID NO: 22280 - protein, 10 aa, Homo Sapiens
LMYPYIFHVL

SEQ ID NO: 22281 - protein, 10 aa, Homo Sapiens
LTFRDPLALL

SEQ ID NO: 22282 - protein, 10 aa, Homo Sapiens
LTWDVKDTLL

SEQ ID NO: 22283 - protein, 10 aa, Homo Sapiens
MLLEIPYMAA

SEQ ID NO: 22284 - protein, 10 aa, Homo Sapiens
MQAERIFSEV

SEQ ID NO: 22285 - protein, 10 aa, Homo Sapiens
MVWEIPDGGL

SEQ ID NO: 22286 - protein, 10 aa, Homo Sapiens
NIPEPVVIGI

SEQ ID NO: 22287 - protein, 10 aa, Homo Sapiens
NLAEPVWKQL

SEQ ID NO: 22288 - protein, 10 aa, Homo Sapiens
NLFDLGGQYL

SEQ ID NO: 22289 - protein, 10 aa, Homo Sapiens
NLQDLARIYI

SEQ ID NO: 22290 - protein, 10 aa, Homo Sapiens
PKIVKWDRDM

SEQ ID NO: 22291 - protein, 10 aa, Homo Sapiens
QLNELRQLGG

SEQ ID NO: 22292 - protein, 10 aa, Homo Sapiens
QLWNKPLVGV

SEQ ID NO: 22293 - protein, 10 aa, Homo Sapiens
QMPTLPPPSV

SEQ ID NO: 22294 - protein, 10 aa, Homo Sapiens
QVFPGLLERV

SEQ ID NO: 22295 - protein, 10 aa, Homo Sapiens
RIWNLEGVQT

SEQ ID NO: 22296 - protein, 10 aa, Homo Sapiens
RLAQEGIYTL

SEQ ID NO: 22297 - protein, 10 aa, Homo Sapiens
RLDELGGVYL

SEQ ID NO: 22298 - protein, 10 aa, Homo Sapiens
RLFDMSGVRL

SEQ ID NO: 22299 - protein, 10 aa, Homo Sapiens
RLISQIVSSI

SEQ ID NO: 22300 - protein, 10 aa, Homo Sapiens
RLLDLENIQI

SEQ ID NO: 22301 - protein, 10 aa, Homo Sapiens
RLLEGYEIYV

SEQ ID NO: 22302 - protein, 10 aa, Homo Sapiens
RLMDQNLKCL

SEQ ID NO: 22303 - protein, 10 aa, Homo Sapiens
RLMNLPLHSV

SEQ ID NO: 22304 - protein, 10 aa, Homo Sapiens
RLPDDDPTAV

SEQ ID NO: 22305 - protein, 10 aa, Homo Sapiens
RLPEHCIEYV

SEQ ID NO: 22306 - protein, 10 aa, Homo Sapiens
RLQEDPPAGV

SEQ ID NO: 22307 - protein, 10 aa, Homo Sapiens
RLQEDPPVGV

SEQ ID NO: 22308 - protein, 10 aa, Homo Sapiens
RLSEFIPAVF

SEQ ID NO: 22309 - protein, 10 aa, Homo Sapiens
RLWDVPLHHL

SEQ ID NO: 22310 - protein, 10 aa, Homo Sapiens
RLYDGLFKVI

SEQ ID NO: 22311 - protein, 10 aa, Homo Sapiens
RLYPEGLAQL

SEQ ID NO: 22312 - protein, 10 aa, Homo Sapiens
RLYPWGVVEV

SEQ ID NO: 22313 - protein, 10 aa, Homo Sapiens
RMFDGKFVVA

SEQ ID NO: 22314 - protein, 10 aa, Homo Sapiens
RMFDIVGTHL

SEQ ID NO: 22315 - protein, 10 aa, Homo Sapiens
RMIKEKLCYV

SEQ ID NO: 22316 - protein, 10 aa, Homo Sapiens
RMYPFQIHSI

SEQ ID NO: 22317 - protein, 10 aa, Homo Sapiens
RQPDSGISSI

SEQ ID NO: 22318 - protein, 10 aa, Homo Sapiens
RTWIEGLTGL

SEQ ID NO: 22319 - protein, 10 aa, Homo Sapiens
RVAQLEQVYI

SEQ ID NO: 22320 - protein, 10 aa, Homo Sapiens
RVMELFFTVH

SEQ ID NO: 22321 - protein, 10 aa, Homo Sapiens
SFGSLAPAPL

SEQ ID NO: 22322 - protein, 10 aa, Homo Sapiens
SIYPLHDVFV

SEQ ID NO: 22323 - protein, 10 aa, Homo Sapiens
SLADLQNDEV

SEQ ID NO: 22324 - protein, 10 aa, Homo Sapiens
SLAELKGFEV

SEQ ID NO: 22325 - protein, 10 aa, Homo Sapiens
SLEGIPLAQV

SEQ ID NO: 22326 - protein, 10 aa, Homo Sapiens
SLFEKGLKNV

SEQ ID NO: 22327 - protein, 10 aa, Homo Sapiens
SLFPGKLEVV

SEQ ID NO: 22328 - protein, 10 aa, Homo Sapiens
SLINVGLISV

SEQ ID NO: 22329 - protein, 10 aa, Homo Sapiens
SLIPEGPPQV

SEQ ID NO: 22330 - protein, 10 aa, Homo Sapiens
SLLDRFLATV

SEQ ID NO: 22331 - protein, 10 aa, Homo Sapiens
SLLPEGPPAI

SEQ ID NO: 22332 - protein, 10 aa, Homo Sapiens
SLPDFGISYV

SEQ ID NO: 22333 - protein, 10 aa, Homo Sapiens
SLYSIRKQYV

SEQ ID NO: 22334 - protein, 10 aa, Homo Sapiens
SMIDPPRAAV

SEQ ID NO: 22335 - protein, 10 aa, Homo Sapiens
SVAEITNACF

SEQ ID NO: 22336 - protein, 10 aa, Homo Sapiens
TAWELPKTYV

SEQ ID NO: 22337 - protein, 10 aa, Homo Sapiens
TLMDMRLSQV

SEQ ID NO: 22338 - protein, 10 aa, Homo Sapiens
TLMNLGGLAV

SEQ ID NO: 22339 - protein, 10 aa, Homo Sapiens
TLQCLEGIHL

SEQ ID NO: 22340 - protein, 10 aa, Homo Sapiens
TLWEIAKAEV

SEQ ID NO: 22341 - protein, 10 aa, Homo Sapiens
TLYERGFENI

SEQ ID NO: 22342 - protein, 10 aa, Homo Sapiens
TVMDSKIVQV

SEQ ID NO: 22343 - protein, 10 aa, Homo Sapiens
TVYGGYLCSV

SEQ ID NO: 22344 - protein, 10 aa, Homo Sapiens
VAPPPPPVEV

SEQ ID NO: 22345 - protein, 10 aa, Homo Sapiens
VICDLKYILI

SEQ ID NO: 22346 - protein, 10 aa, Homo Sapiens
VIWEHDYTSV

SEQ ID NO: 22347 - protein, 10 aa, Homo Sapiens
VLLKARLVPA

SEQ ID NO: 22348 - protein, 10 aa, Homo Sapiens
VLMDLKALLL

SEQ ID NO: 22349 - protein, 10 aa, Homo Sapiens
VLPNFLPYNV

SEQ ID NO: 22350 - protein, 10 aa, Homo Sapiens
VLQNLKGQYV

SEQ ID NO: 22351 - protein, 10 aa, Homo Sapiens
VLWDRTFSLF

SEQ ID NO: 22352 - protein, 10 aa, Homo Sapiens
VLWEVSHKGV

SEQ ID NO: 22353 - protein, 10 aa, Homo Sapiens
VLYPHEPTAV

SEQ ID NO: 22354 - protein, 10 aa, Homo Sapiens
VMLESPPKGV

SEQ ID NO: 22355 - protein, 10 aa, Homo Sapiens
VMMDIGSTRL

SEQ ID NO: 22356 - protein, 10 aa, Homo Sapiens
VPGLYTLEEL

SEQ ID NO: 22357 - protein, 10 aa, Homo Sapiens
VTDIEEIIGV

SEQ ID NO: 22358 - protein, 10 aa, Homo Sapiens
VVWDLDRPLE

SEQ ID NO: 22359 - protein, 10 aa, Homo Sapiens
WAPERPLVGV

SEQ ID NO: 22360 - protein, 10 aa, Homo Sapiens
YAHELPKYGV

SEQ ID NO: 22361 - protein, 10 aa, Homo Sapiens
YAPPPRDYTY

SEQ ID NO: 22362 - protein, 10 aa, Homo Sapiens
YAYDGKDYIA

SEQ ID NO: 22363 - protein, 10 aa, Homo Sapiens
YIYDKDMEII

SEQ ID NO: 22364 - protein, 10 aa, Homo Sapiens
YLARIQGFQV

SEQ ID NO: 22365 - protein, 10 aa, Homo Sapiens
YLDGHLITTV

SEQ ID NO: 22366 - protein, 10 aa, Homo Sapiens
YLDIKGLLDV

SEQ ID NO: 22367 - protein, 10 aa, Homo Sapiens
YLDPRLAFTV

SEQ ID NO: 22368 - protein, 10 aa, Homo Sapiens
YLDPSVLSGV

SEQ ID NO: 22369 - protein, 10 aa, Homo Sapiens
YLFDVQRNNI

SEQ ID NO: 22370 - protein, 10 aa, Homo Sapiens
YLLEQDFPGM

SEQ ID NO: 22371 - protein, 10 aa, Homo Sapiens
YLLQEPPRTV

SEQ ID NO: 22372 - protein, 10 aa, Homo Sapiens
YLLTHPPPIM

SEQ ID NO: 22373 - protein, 10 aa, Homo Sapiens
YLMEGSYNKV

SEQ ID NO: 22374 - protein, 10 aa, Homo Sapiens
YLMQESPPHV

SEQ ID NO: 22375 - protein, 10 aa, Homo Sapiens
YLNDLHEVLL

SEQ ID NO: 22376 - protein, 10 aa, Homo Sapiens
YLTNEGIQYL

SEQ ID NO: 22377 - protein, 10 aa, Homo Sapiens
YLYDLNHTLY

SEQ ID NO: 22378 - protein, 10 aa, Homo Sapiens
YQILDGIHYL

SEQ ID NO: 22379 - protein, 10 aa, Homo Sapiens
YTFPGWKVGV

SEQ ID NO: 22380 - protein, 10 aa, Homo Sapiens
YVADLGAMVV

SEQ ID NO: 22381 - protein, 11 aa, Homo Sapiens
ALADKELLPSV

SEQ ID NO: 22382 - protein, 11 aa, Homo Sapiens
ALAEMLKENKV

SEQ ID NO: 22383 - protein, 11 aa, Homo Sapiens
ALDNVDARMYM

SEQ ID NO: 22384 - protein, 11 aa, Homo Sapiens
ALFARPDLLLL

SEQ ID NO: 22385 - protein, 11 aa, Homo Sapiens
ALFELSRVITL

SEQ ID NO: 22386 - protein, 11 aa, Homo Sapiens
ALFEQKGPVYV

SEQ ID NO: 22387 - protein, 11 aa, Homo Sapiens
ALIEAEKVAQV

SEQ ID NO: 22388 - protein, 11 aa, Homo Sapiens
ALIEVPDGFTA

SEQ ID NO: 22389 - protein, 11 aa, Homo Sapiens
ALKELMEIEEV

SEQ ID NO: 22390 - protein, 11 aa, Homo Sapiens
ALLENGIIHHV

SEQ ID NO: 22391 - protein, 11 aa, Homo Sapiens
ALLEPEFILKA

SEQ ID NO: 22392 - protein, 11 aa, Homo Sapiens
ALLGKLDAINV

SEQ ID NO: 22393 - protein, 11 aa, Homo Sapiens
ALMEQVAHQTI

SEQ ID NO: 22394 - protein, 11 aa, Homo Sapiens
ALQDPECFAHL

SEQ ID NO: 22395 - protein, 11 aa, Homo Sapiens
ALVEIGPRFVL

SEQ ID NO: 22396 - protein, 11 aa, Homo Sapiens
ALWDIETGQQT

SEQ ID NO: 22397 - protein, 11 aa, Homo Sapiens
ALWNMYVEEEV

SEQ ID NO: 22398 - protein, 11 aa, Homo Sapiens
ALYNVDAGHRA

SEQ ID NO: 22399 - protein, 11 aa, Homo Sapiens
AMASLGALALL

SEQ ID NO: 22400 - protein, 11 aa, Homo Sapiens
AQLDPEALGNI

SEQ ID NO: 22401 - protein, 11 aa, Homo Sapiens
AQWAIHPTFNL

SEQ ID NO: 22402 - protein, 11 aa, Homo Sapiens
AVIEAEKIAQV

SEQ ID NO: 22403 - protein, 11 aa, Homo Sapiens
AVMAPRTLVLL

SEQ ID NO: 22404 - protein, 11 aa, Homo Sapiens
CLIKEVDIYTV

SEQ ID NO: 22405 - protein, 11 aa, Homo Sapiens
EMIDPDKFCSL

SEQ ID NO: 22406 - protein, 11 aa, Homo Sapiens
FLADPDTVNHL

SEQ ID NO: 22407 - protein, 11 aa, Homo Sapiens
FLADPSAFVAA

SEQ ID NO: 22408 - protein, 11 aa, Homo Sapiens
FLAELPGSLSL

SEQ ID NO: 22409 - protein, 11 aa, Homo Sapiens
FLASESLIKQI

SEQ ID NO: 22410 - protein, 11 aa, Homo Sapiens
FLDESRSTQYM

SEQ ID NO: 22411 - protein, 11 aa, Homo Sapiens
FLFDGSPTYVL

SEQ ID NO: 22412 - protein, 11 aa, Homo Sapiens
FLIEPEHVNTV

SEQ ID NO: 22413 - protein, 11 aa, Homo Sapiens
FLLDPYKYMTL

SEQ ID NO: 22414 - protein, 11 aa, Homo Sapiens
FLLGPEGQHLL

SEQ ID NO: 22415 - protein, 11 aa, Homo Sapiens
FLNSVTDIHQL

SEQ ID NO: 22416 - protein, 11 aa, Homo Sapiens
FLPDPSALQNL

SEQ ID NO: 22417 - protein, 11 aa, Homo Sapiens
FLSEEGGHVAV

SEQ ID NO: 22418 - protein, 11 aa, Homo Sapiens
FLTDSNNIKEV

SEQ ID NO: 22419 - protein, 11 aa, Homo Sapiens
FLVNPESGYNV

SEQ ID NO: 22420 - protein, 11 aa, Homo Sapiens
FLWDPAKRTSV

SEQ ID NO: 22421 - protein, 11 aa, Homo Sapiens
FLWQHGEESMA

SEQ ID NO: 22422 - protein, 11 aa, Homo Sapiens
FLYQPQYLNAI

SEQ ID NO: 22423 - protein, 11 aa, Homo Sapiens
FVDCPDESWAL

SEQ ID NO: 22424 - protein, 11 aa, Homo Sapiens
FVFPLDKDELL

SEQ ID NO: 22425 - protein, 11 aa, Homo Sapiens
FVIDRPNGTKV

SEQ ID NO: 22426 - protein, 11 aa, Homo Sapiens
FVQEVVQSQQV

SEQ ID NO: 22427 - protein, 11 aa, Homo Sapiens
GLADASLLKKV

SEQ ID NO: 22428 - protein, 11 aa, Homo Sapiens
GLADNTVIAKV

SEQ ID NO: 22429 - protein, 11 aa, Homo Sapiens
GLFAHPSLWQL

SEQ ID NO: 22430 - protein, 11 aa, Homo Sapiens
GLIDTKELEPL

SEQ ID NO: 22431 - protein, 11 aa, Homo Sapiens
GLLAGDRLVEV

SEQ ID NO: 22432 - protein, 11 aa, Homo Sapiens
GLLDPGMLVNI

SEQ ID NO: 22433 - protein, 11 aa, Homo Sapiens
GLLYPTEDYKV

SEQ ID NO: 22434 - protein, 11 aa, Homo Sapiens
GLVDEKALAQA

SEQ ID NO: 22435 - protein, 11 aa, Homo Sapiens
GLWEIENNPTV

SEQ ID NO: 22436 - protein, 11 aa, Homo Sapiens
GMAFLDKRLQV

SEQ ID NO: 22437 - protein, 11 aa, Homo Sapiens
GMYGKIAVMEL

SEQ ID NO: 22438 - protein, 11 aa, Homo Sapiens
HILGIPQSWRL

SEQ ID NO: 22439 - protein, 11 aa, Homo Sapiens
HLFKITENIGC

SEQ ID NO: 22440 - protein, 11 aa, Homo Sapiens
HLIDPNTLQVA

SEQ ID NO: 22441 - protein, 11 aa, Homo Sapiens
HLLGEGAFAQV

SEQ ID NO: 22442 - protein, 11 aa, Homo Sapiens
HLMEENMIVYV

SEQ ID NO: 22443 - protein, 11 aa, Homo Sapiens
HLVSPEALDFL

SEQ ID NO: 22444 - protein, 11 aa, Homo Sapiens
HTDDPLTWDYV

SEQ ID NO: 22445 - protein, 11 aa, Homo Sapiens
HVYDGKFLARV

SEQ ID NO: 22446 - protein, 11 aa, Homo Sapiens
IIFPLNKSWII

SEQ ID NO: 22447 - protein, 11 aa, Homo Sapiens
IIQDIDDTHVF

SEQ ID NO: 22448 - protein, 11 aa, Homo Sapiens
IIWDVSKGQKI

SEQ ID NO: 22449 - protein, 11 aa, Homo Sapiens
ILAPAGSLPKI

SEQ ID NO: 22450 - protein, 11 aa, Homo Sapiens
ILFPPDQFECL

SEQ ID NO: 22451 - protein, 11 aa, Homo Sapiens
ILIEKEYLERV

SEQ ID NO: 22452 - protein, 11 aa, Homo Sapiens
ILLDDTGLAYI

SEQ ID NO: 22453 - protein, 11 aa, Homo Sapiens
ILMEHIHKLKA

SEQ ID NO: 22454 - protein, 11 aa, Homo Sapiens
ILNDPSQSEVM

SEQ ID NO: 22455 - protein, 11 aa, Homo Sapiens
ILPPTRPTDKP

SEQ ID NO: 22456 - protein, 11 aa, Homo Sapiens
ILQDPRLITPL

SEQ ID NO: 22457 - protein, 11 aa, Homo Sapiens
ILSDPSVFSPL

SEQ ID NO: 22458 - protein, 11 aa, Homo Sapiens
ILWAPDEESGV

SEQ ID NO: 22459 - protein, 11 aa, Homo Sapiens
IMAQLPQEQKA

SEQ ID NO: 22460 - protein, 11 aa, Homo Sapiens
IMLSEKHLISV

SEQ ID NO: 22461 - protein, 11 aa, Homo Sapiens
IPCTTLIPTKI

SEQ ID NO: 22462 - protein, 11 aa, Homo Sapiens
IQVSPEIFQFL

SEQ ID NO: 22463 - protein, 11 aa, Homo Sapiens
ISERYGPVFTI

SEQ ID NO: 22464 - protein, 11 aa, Homo Sapiens
IVLPAGALHQV

SEQ ID NO: 22465 - protein, 11 aa, Homo Sapiens
IVSMGSLFPVI

SEQ ID NO: 22466 - protein, 11 aa, Homo Sapiens
KAFSIGSNLNV

SEQ ID NO: 22467 - protein, 11 aa, Homo Sapiens
KFLLTSVFPQL

SEQ ID NO: 22468 - protein, 11 aa, Homo Sapiens
KIFDLDGDECL

SEQ ID NO: 22469 - protein, 11 aa, Homo Sapiens
KIFNITDNAAI

SEQ ID NO: 22470 - protein, 11 aa, Homo Sapiens
KIFPMGDRLYI

SEQ ID NO: 22471 - protein, 11 aa, Homo Sapiens
KIKELNKKEAV

SEQ ID NO: 22472 - protein, 11 aa, Homo Sapiens
KILDVASLEVL

SEQ ID NO: 22473 - protein, 11 aa, Homo Sapiens
KILSTGKYLNV

SEQ ID NO: 22474 - protein, 11 aa, Homo Sapiens
KIMDYSLLVGI

SEQ ID NO: 22475 - protein, 11 aa, Homo Sapiens
KIMTEKELLAV

SEQ ID NO: 22476 - protein, 11 aa, Homo Sapiens
KIWDIKTGQCL

SEQ ID NO: 22477 - protein, 11 aa, Homo Sapiens
KIWDLKERTNV

SEQ ID NO: 22478 - protein, 11 aa, Homo Sapiens
KIWDVSSGKCL

SEQ ID NO: 22479 - protein, 11 aa, Homo Sapiens
KIWDVSVNSVV

SEQ ID NO: 22480 - protein, 11 aa, Homo Sapiens
KIYEPPRYMSV

SEQ ID NO: 22481 - protein, 11 aa, Homo Sapiens
KLADDVDLEQV

SEQ ID NO: 22482 - protein, 11 aa, Homo Sapiens
KLCEYITQTTL

SEQ ID NO: 22483 - protein, 11 aa, Homo Sapiens
KLDDLTQDLTV

SEQ ID NO: 22484 - protein, 11 aa, Homo Sapiens
KLFDLDEKLML

SEQ ID NO: 22485 - protein, 11 aa, Homo Sapiens
KLFDRPQELKL

SEQ ID NO: 22486 - protein, 11 aa, Homo Sapiens
KLFPGFEIETV

SEQ ID NO: 22487 - protein, 11 aa, Homo Sapiens
KLFPLEENNCL

SEQ ID NO: 22488 - protein, 11 aa, Homo Sapiens
KLFVFDERYAL

SEQ ID NO: 22489 - protein, 11 aa, Homo Sapiens
KLGHTDILVGV

SEQ ID NO: 22490 - protein, 11 aa, Homo Sapiens
KLIDFGSGALL

SEQ ID NO: 22491 - protein, 11 aa, Homo Sapiens
KLIDLSQVMYL

SEQ ID NO: 22492 - protein, 11 aa, Homo Sapiens
KLLDFGSLSNL

SEQ ID NO: 22493 - protein, 11 aa, Homo Sapiens
KLLDISELDMV

SEQ ID NO: 22494 - protein, 11 aa, Homo Sapiens
KLLDLKKQLAV

SEQ ID NO: 22495 - protein, 11 aa, Homo Sapiens
KLLDLSDSTSV

SEQ ID NO: 22496 - protein, 11 aa, Homo Sapiens
KLLDMVGKVQI

SEQ ID NO: 22497 - protein, 11 aa, Homo Sapiens
KLLETELLQEI

SEQ ID NO: 22498 - protein, 11 aa, Homo Sapiens
KLLPDTILEKL

SEQ ID NO: 22499 - protein, 11 aa, Homo Sapiens
KLLPGSAIQAL

SEQ ID NO: 22500 - protein, 11 aa, Homo Sapiens
KLLSHSLLVTL

SEQ ID NO: 22501 - protein, 11 aa, Homo Sapiens
KLMDEVAGIVA

SEQ ID NO: 22502 - protein, 11 aa, Homo Sapiens
KLPGRENKTAV

SEQ ID NO: 22503 - protein, 11 aa, Homo Sapiens
KLPTRPASTGV

SEQ ID NO: 22504 - protein, 11 aa, Homo Sapiens
KLSEPSSLQYL

SEQ ID NO: 22505 - protein, 11 aa, Homo Sapiens
KLVEIPTKMRV

SEQ ID NO: 22506 - protein, 11 aa, Homo Sapiens
KLWALPQCQLL

SEQ ID NO: 22507 - protein, 11 aa, Homo Sapiens
KLWDPRTPCNA

SEQ ID NO: 22508 - protein, 11 aa, Homo Sapiens
KLWDPTVGKSL

SEQ ID NO: 22509 - protein, 11 aa, Homo Sapiens
KLWDTETGQCI

SEQ ID NO: 22510 - protein, 11 aa, Homo Sapiens
KLWNVGKPYCL

SEQ ID NO: 22511 - protein, 11 aa, Homo Sapiens
KLWSVPDCNLL

SEQ ID NO: 22512 - protein, 11 aa, Homo Sapiens
KLYRPGSVAYV

SEQ ID NO: 22513 - protein, 11 aa, Homo Sapiens
KMADEDALRKI

SEQ ID NO: 22514 - protein, 11 aa, Homo Sapiens
KMDASLGNLFA

SEQ ID NO: 22515 - protein, 11 aa, Homo Sapiens
KMDDPDYWRTV

SEQ ID NO: 22516 - protein, 11 aa, Homo Sapiens
KMDDPTVNWSI

SEQ ID NO: 22517 - protein, 11 aa, Homo Sapiens
KMFDLNGDGEV

SEQ ID NO: 22518 - protein, 11 aa, Homo Sapiens
KMIEDGKIHTV

SEQ ID NO: 22519 - protein, 11 aa, Homo Sapiens
KMMDPRVLHHM

SEQ ID NO: 22520 - protein, 11 aa, Homo Sapiens
KMWDLSSNQAI

SEQ ID NO: 22521 - protein, 11 aa, Homo Sapiens
KMWDPHNDPNA

SEQ ID NO: 22522 - protein, 11 aa, Homo Sapiens
KQWKFPDGSFI

SEQ ID NO: 22523 - protein, 11 aa, Homo Sapiens
KSYELPDGQVI

SEQ ID NO: 22524 - protein, 11 aa, Homo Sapiens
KTAAEDAIRNL

SEQ ID NO: 22525 - protein, 11 aa, Homo Sapiens
KTLDVDATYEI

SEQ ID NO: 22526 - protein, 11 aa, Homo Sapiens
KTMELNVGNEA

SEQ ID NO: 22527 - protein, 11 aa, Homo Sapiens
KVLEPSETLVV

SEQ ID NO: 22528 - protein, 11 aa, Homo Sapiens
KVLKPDTTYQV

SEQ ID NO: 22529 - protein, 11 aa, Homo Sapiens
KVWDVGTRTCV

SEQ ID NO: 22530 - protein, 11 aa, Homo Sapiens
KVWLIDVSQSV

SEQ ID NO: 22531 - protein, 11 aa, Homo Sapiens
LIPGAEFRCFV

SEQ ID NO: 22532 - protein, 11 aa, Homo Sapiens
LLAELPASVHA

SEQ ID NO: 22533 - protein, 11 aa, Homo Sapiens
LLAILPEAARA

SEQ ID NO: 22534 - protein, 11 aa, Homo Sapiens
LLANTSWTGTV

SEQ ID NO: 22535 - protein, 11 aa, Homo Sapiens
LLDPNVKSIFV

SEQ ID NO: 22536 - protein, 11 aa, Homo Sapiens
LLLEEDNKFCA

SEQ ID NO: 22537 - protein, 11 aa, Homo Sapiens
LLLEPGSLYIL

SEQ ID NO: 22538 - protein, 11 aa, Homo Sapiens
LLLPDYYLVTV

SEQ ID NO: 22539 - protein, 11 aa, Homo Sapiens
LLMEPGAMRFL

SEQ ID NO: 22540 - protein, 11 aa, Homo Sapiens
LLPDPRELIEI

SEQ ID NO: 22541 - protein, 11 aa, Homo Sapiens
LLQELTDIDTL

SEQ ID NO: 22542 - protein, 11 aa, Homo Sapiens
LLSEPSLLRTV

SEQ ID NO: 22543 - protein, 11 aa, Homo Sapiens
LLWDPSTGKQV

SEQ ID NO: 22544 - protein, 11 aa, Homo Sapiens
LLYDLADQLHA

SEQ ID NO: 22545 - protein, 11 aa, Homo Sapiens
LMWELEKKSAV

SEQ ID NO: 22546 - protein, 11 aa, Homo Sapiens
LTAPPEALLMV

SEQ ID NO: 22547 - protein, 11 aa, Homo Sapiens
LVWDLRNMGYV

SEQ ID NO: 22548 - protein, 11 aa, Homo Sapiens
MALDIDERHLL

SEQ ID NO: 22549 - protein, 11 aa, Homo Sapiens
MAMEPDRKAAV

SEQ ID NO: 22550 - protein, 11 aa, Homo Sapiens
MLFEFIDRCTA

SEQ ID NO: 22551 - protein, 11 aa, Homo Sapiens
MLIEEGGLQHL

SEQ ID NO: 22552 - protein, 11 aa, Homo Sapiens
MLLAGLYRTMR

SEQ ID NO: 22553 - protein, 11 aa, Homo Sapiens
MLLDPPPGSHV

SEQ ID NO: 22554 - protein, 11 aa, Homo Sapiens
MLWDLNEGKHL

SEQ ID NO: 22555 - protein, 11 aa, Homo Sapiens
MVFDAKLLSQL

SEQ ID NO: 22556 - protein, 11 aa, Homo Sapiens
MVFKPSDVMLV

SEQ ID NO: 22557 - protein, 11 aa, Homo Sapiens
MVQDPSQFDVL

SEQ ID NO: 22558 - protein, 11 aa, Homo Sapiens
NAIYYYADQIY

SEQ ID NO: 22559 - protein, 11 aa, Homo Sapiens
NGTVAGFELLL

SEQ ID NO: 22560 - protein, 11 aa, Homo Sapiens
NIWRDVGLFGV

SEQ ID NO: 22561 - protein, 11 aa, Homo Sapiens
NLANPKIFRDL

SEQ ID NO: 22562 - protein, 11 aa, Homo Sapiens
NLAPTDVLEAL

SEQ ID NO: 22563 - protein, 11 aa, Homo Sapiens
NLFDISQSAQT

SEQ ID NO: 22564 - protein, 11 aa, Homo Sapiens
NMFKMAKNWSA

SEQ ID NO: 22565 - protein, 11 aa, Homo Sapiens
NMYEGVGRMFI

SEQ ID NO: 22566 - protein, 11 aa, Homo Sapiens
PPCAMAGPPPA

SEQ ID NO: 22567 - protein, 11 aa, Homo Sapiens
QLLDPASFEYL

SEQ ID NO: 22568 - protein, 11 aa, Homo Sapiens
QMLEAIKALEV

SEQ ID NO: 22569 - protein, 11 aa, Homo Sapiens
QMMQNPQILAA

SEQ ID NO: 22570 - protein, 11 aa, Homo Sapiens
QQLDSKFLEQV

SEQ ID NO: 22571 - protein, 11 aa, Homo Sapiens
QQLDTRYLEQL

SEQ ID NO: 22572 - protein, 11 aa, Homo Sapiens
QQWDTSKGEQV

SEQ ID NO: 22573 - protein, 11 aa, Homo Sapiens
QVPEAPGGSAV

SEQ ID NO: 22574 - protein, 11 aa, Homo Sapiens
QVYQLDTGHYL

SEQ ID NO: 22575 - protein, 11 aa, Homo Sapiens
RAPPVRPQNSL

SEQ ID NO: 22576 - protein, 11 aa, Homo Sapiens
RIFILGPSHHV

SEQ ID NO: 22577 - protein, 11 aa, Homo Sapiens
RILDIDIPMSV

SEQ ID NO: 22578 - protein, 11 aa, Homo Sapiens
RLAGADVVLGV

SEQ ID NO: 22579 - protein, 11 aa, Homo Sapiens
RLFEASDPYQV

SEQ ID NO: 22580 - protein, 11 aa, Homo Sapiens
RLFEVPHELVA

SEQ ID NO: 22581 - protein, 11 aa, Homo Sapiens
RLFKIDKEYLL

SEQ ID NO: 22582 - protein, 11 aa, Homo Sapiens
RLFNHPNILRL

SEQ ID NO: 22583 - protein, 11 aa, Homo Sapiens
RLFPLSGHLLL

SEQ ID NO: 22584 - protein, 11 aa, Homo Sapiens
RLFPVPGSGLV

SEQ ID NO: 22585 - protein, 11 aa, Homo Sapiens
RLISLTDENAL

SEQ ID NO: 22586 - protein, 11 aa, Homo Sapiens
RLLEEGVLRQI

SEQ ID NO: 22587 - protein, 11 aa, Homo Sapiens
RLLEIPAVSHV

SEQ ID NO: 22588 - protein, 11 aa, Homo Sapiens
RLLEPADMVLL

SEQ ID NO: 22589 - protein, 11 aa, Homo Sapiens
RLLPPGAVVAV

SEQ ID NO: 22590 - protein, 11 aa, Homo Sapiens
RLLSIKEAFRL

SEQ ID NO: 22591 - protein, 11 aa, Homo Sapiens
RLMEPIYLVEI

SEQ ID NO: 22592 - protein, 11 aa, Homo Sapiens
RLPPEGILHNV

SEQ ID NO: 22593 - protein, 11 aa, Homo Sapiens
RLQETEGMVAV

SEQ ID NO: 22594 - protein, 11 aa, Homo Sapiens
RLVQGSILKKV

SEQ ID NO: 22595 - protein, 11 aa, Homo Sapiens
RLWDCETGKQL

SEQ ID NO: 22596 - protein, 11 aa, Homo Sapiens
RLWDHATMTEV

SEQ ID NO: 22597 - protein, 11 aa, Homo Sapiens
RLWDLENGKQI

SEQ ID NO: 22598 - protein, 11 aa, Homo Sapiens
RLWDLTTGTTT

SEQ ID NO: 22599 - protein, 11 aa, Homo Sapiens
RLWGIPDQARV

SEQ ID NO: 22600 - protein, 11 aa, Homo Sapiens
RLWNMPENNGL

SEQ ID NO: 22601 - protein, 11 aa, Homo Sapiens
RLWTPPEDYRL

SEQ ID NO: 22602 - protein, 11 aa, Homo Sapiens
RMFPTQGFTEI

SEQ ID NO: 22603 - protein, 11 aa, Homo Sapiens
RMNPNSPSITY

SEQ ID NO: 22604 - protein, 11 aa, Homo Sapiens
RQADTKAIQHL

SEQ ID NO: 22605 - protein, 11 aa, Homo Sapiens
RQLEEEGITFV

SEQ ID NO: 22606 - protein, 11 aa, Homo Sapiens
RQPPPRPFLDM

SEQ ID NO: 22607 - protein, 11 aa, Homo Sapiens
RVLDPSKFLKI

SEQ ID NO: 22608 - protein, 11 aa, Homo Sapiens
RVLPPSALQSV

SEQ ID NO: 22609 - protein, 11 aa, Homo Sapiens
RVWDIETGQCL

SEQ ID NO: 22610 - protein, 11 aa, Homo Sapiens
RVWDISTVSSV

SEQ ID NO: 22611 - protein, 11 aa, Homo Sapiens
SLADDSVLERL

SEQ ID NO: 22612 - protein, 11 aa, Homo Sapiens
SLAELDEKISA

SEQ ID NO: 22613 - protein, 11 aa, Homo Sapiens
SLFLFGEVHKA

SEQ ID NO: 22614 - protein, 11 aa, Homo Sapiens
SLFNIKDTQQL

SEQ ID NO: 22615 - protein, 11 aa, Homo Sapiens
SLIDMRGIETV

SEQ ID NO: 22616 - protein, 11 aa, Homo Sapiens
SLLGDDALVQV

SEQ ID NO: 22617 - protein, 11 aa, Homo Sapiens
SLLHLGALYGI

SEQ ID NO: 22618 - protein, 11 aa, Homo Sapiens
SLLNPPETLNL

SEQ ID NO: 22619 - protein, 11 aa, Homo Sapiens
SLLPPDALVGL

SEQ ID NO: 22620 - protein, 11 aa, Homo Sapiens
SLLSPGLLPHL

SEQ ID NO: 22621 - protein, 11 aa, Homo Sapiens
SLMDPNKFLLL

SEQ ID NO: 22622 - protein, 11 aa, Homo Sapiens
SLMEESGICKV

SEQ ID NO: 22623 - protein, 11 aa, Homo Sapiens
SLQDPPGELAV

SEQ ID NO: 22624 - protein, 11 aa, Homo Sapiens
SLVENIERLKV

SEQ ID NO: 22625 - protein, 11 aa, Homo Sapiens
SLVEVNPAYSV

SEQ ID NO: 22626 - protein, 11 aa, Homo Sapiens
SLVSPASFENV

SEQ ID NO: 22627 - protein, 11 aa, Homo Sapiens
SLWEISKQIEG

SEQ ID NO: 22628 - protein, 11 aa, Homo Sapiens
SLWSLEPGKCV

SEQ ID NO: 22629 - protein, 11 aa, Homo Sapiens
SMADIPLGFGV

SEQ ID NO: 22630 - protein, 11 aa, Homo Sapiens
SMMDPNHFLMI

SEQ ID NO: 22631 - protein, 11 aa, Homo Sapiens
SMMPPPVGMVA

SEQ ID NO: 22632 - protein, 11 aa, Homo Sapiens
SQLDISDPYKV

SEQ ID NO: 22633 - protein, 11 aa, Homo Sapiens
SVAALSKIFAV

SEQ ID NO: 22634 - protein, 11 aa, Homo Sapiens
SVAEGRALMSV

SEQ ID NO: 22635 - protein, 11 aa, Homo Sapiens
SVLDPRDLRQL

SEQ ID NO: 22636 - protein, 11 aa, Homo Sapiens
SVLEPQVLNYL

SEQ ID NO: 22637 - protein, 11 aa, Homo Sapiens
SVMQLQEEAHL

SEQ ID NO: 22638 - protein, 11 aa, Homo Sapiens
SVPDPSTRALL

SEQ ID NO: 22639 - protein, 11 aa, Homo Sapiens
SVVSPSSFENV

SEQ ID NO: 22640 - protein, 11 aa, Homo Sapiens
SVYDGKLLIGT

SEQ ID NO: 22641 - protein, 11 aa, Homo Sapiens
TIAEVGKWLQA

SEQ ID NO: 22642 - protein, 11 aa, Homo Sapiens
TIIDLPGITRV

SEQ ID NO: 22643 - protein, 11 aa, Homo Sapiens
TLAEINQKWNL

SEQ ID NO: 22644 - protein, 11 aa, Homo Sapiens
TLFHFGNCFAL

SEQ ID NO: 22645 - protein, 11 aa, Homo Sapiens
TLIDLPGITKV

SEQ ID NO: 22646 - protein, 11 aa, Homo Sapiens
TLLAAEFLKQV

SEQ ID NO: 22647 - protein, 11 aa, Homo Sapiens
TLLDPGRFSKV

SEQ ID NO: 22648 - protein, 11 aa, Homo Sapiens
TLLDPNEKYLL

SEQ ID NO: 22649 - protein, 11 aa, Homo Sapiens
TLMDAELFKKV

SEQ ID NO: 22650 - protein, 11 aa, Homo Sapiens
TLYDIAHTPGV

SEQ ID NO: 22651 - protein, 11 aa, Homo Sapiens
TLYNPERTITV

SEQ ID NO: 22652 - protein, 11 aa, Homo Sapiens
TMAKESSIIGV

SEQ ID NO: 22653 - protein, 11 aa, Homo Sapiens
TTLDVTKLTPL

SEQ ID NO: 22654 - protein, 11 aa, Homo Sapiens
TVADPSVISHL

SEQ ID NO: 22655 - protein, 11 aa, Homo Sapiens
TVFLLEKPFSV

SEQ ID NO: 22656 - protein, 11 aa, Homo Sapiens
TVIRDPPSITP

SEQ ID NO: 22657 - protein, 11 aa, Homo Sapiens
TVWEISQKTVL

SEQ ID NO: 22658 - protein, 11 aa, Homo Sapiens
VAPPEYHRKAV

SEQ ID NO: 22659 - protein, 11 aa, Homo Sapiens
VAPPGGSRKEV

SEQ ID NO: 22660 - protein, 11 aa, Homo Sapiens
VAVDPSILARL

SEQ ID NO: 22661 - protein, 11 aa, Homo Sapiens
VIFILGKEHQL

SEQ ID NO: 22662 - protein, 11 aa, Homo Sapiens
VILFLNKQDLL

SEQ ID NO: 22663 - protein, 11 aa, Homo Sapiens
VLDPKPPPLTL

SEQ ID NO: 22664 - protein, 11 aa, Homo Sapiens
VLIGEGVLTKL

SEQ ID NO: 22665 - protein, 11 aa, Homo Sapiens
VLLEDGVLNHV

SEQ ID NO: 22666 - protein, 11 aa, Homo Sapiens
VLMNQPPQIAP

SEQ ID NO: 22667 - protein, 11 aa, Homo Sapiens
VLMPMERQMSV

SEQ ID NO: 22668 - protein, 11 aa, Homo Sapiens
VLVEPKTAWRL

SEQ ID NO: 22669 - protein, 11 aa, Homo Sapiens
VLWDLVDRIGI

SEQ ID NO: 22670 - protein, 11 aa, Homo Sapiens
VLWDVRSAQAI

SEQ ID NO: 22671 - protein, 11 aa, Homo Sapiens
VLWMAPDGLYA

SEQ ID NO: 22672 - protein, 11 aa, Homo Sapiens
VMFECDKGFYL

SEQ ID NO: 22673 - protein, 11 aa, Homo Sapiens
VMQDPEFLQSV

SEQ ID NO: 22674 - protein, 11 aa, Homo Sapiens
VPAYFTSRDLF

SEQ ID NO: 22675 - protein, 11 aa, Homo Sapiens
VSWGLVKGAEI

SEQ ID NO: 22676 - protein, 11 aa, Homo Sapiens
WLIEDGKVVTV

SEQ ID NO: 22677 - protein, 11 aa, Homo Sapiens
WPLTESQLTFV

SEQ ID NO: 22678 - protein, 11 aa, Homo Sapiens
YAYDGKDYIAL

SEQ ID NO: 22679 - protein, 11 aa, Homo Sapiens
YIFPLDDKAAV

SEQ ID NO: 22680 - protein, 11 aa, Homo Sapiens
YIMEPSIFNTL

SEQ ID NO: 22681 - protein, 11 aa, Homo Sapiens
YIMETVDAQHV

SEQ ID NO: 22682 - protein, 11 aa, Homo Sapiens
YLEELPEKLKL

SEQ ID NO: 22683 - protein, 11 aa, Homo Sapiens
YLFDVQRNNIA

SEQ ID NO: 22684 - protein, 11 aa, Homo Sapiens
YLGITPSITNW

SEQ ID NO: 22685 - protein, 11 aa, Homo Sapiens
YLLDIGCGTGL

SEQ ID NO: 22686 - protein, 11 aa, Homo Sapiens
YLLDPKIADLV

SEQ ID NO: 22687 - protein, 11 aa, Homo Sapiens
YLLEIPKGEMV

SEQ ID NO: 22688 - protein, 11 aa, Homo Sapiens
YLLNDASLISV

SEQ ID NO: 22689 - protein, 11 aa, Homo Sapiens
YLMDINGKMWL

SEQ ID NO: 22690 - protein, 11 aa, Homo Sapiens
YLPDIIKDQKA

SEQ ID NO: 22691 - protein, 11 aa, Homo Sapiens
YQFDKVGILTL

SEQ ID NO: 22692 - protein, 11 aa, Homo Sapiens
YQFDSALLPAV

SEQ ID NO: 22693 - protein, 11 aa, Homo Sapiens
YQFNPAFFQTT

SEQ ID NO: 22694 - protein, 11 aa, Homo Sapiens
YQLEIPENFTT

SEQ ID NO: 22695 - protein, 11 aa, Homo Sapiens
YVIEPHSMEFA

SEQ ID NO: 22696 - protein, 11 aa, Homo Sapiens
YVWDIKSIMSM

SEQ ID NO: 22697 - protein, 8 aa, Homo Sapiens
AEWKATKL

SEQ ID NO: 22698 - protein, 8 aa, Homo Sapiens
FPGTPLKK

SEQ ID NO: 22699 - protein, 8 aa, Homo Sapiens
FSPVGSVL

SEQ ID NO: 22700 - protein, 8 aa, Homo Sapiens
IDHIFASK

SEQ ID NO: 22701 - protein, 8 aa, Homo Sapiens
LNKLGGVK

SEQ ID NO: 22702 - protein, 8 aa, Homo Sapiens
LPWPFRNK

SEQ ID NO: 22703 - protein, 8 aa, Homo Sapiens
MVYVGIPK

SEQ ID NO: 22704 - protein, 8 aa, Homo Sapiens
NAHSNILK

SEQ ID NO: 22705 - protein, 8 aa, Homo Sapiens
PAHGLFLK

SEQ ID NO: 22706 - protein, 8 aa, Homo Sapiens
RIDKPILK

SEQ ID NO: 22707 - protein, 8 aa, Homo Sapiens
RIFIGTFK

SEQ ID NO: 22708 - protein, 9 aa, Homo Sapiens
AAFVPLLLK

SEQ ID NO: 22709 - protein, 9 aa, Homo Sapiens
AAYAWPFYK

SEQ ID NO: 22710 - protein, 9 aa, Homo Sapiens
AAYNVPLPK

SEQ ID NO: 22711 - protein, 9 aa, Homo Sapiens
AIALPVTMK

SEQ ID NO: 22712 - protein, 9 aa, Homo Sapiens
AIFKPVMSK

SEQ ID NO: 22713 - protein, 9 aa, Homo Sapiens
AIFKVLNEK

SEQ ID NO: 22714 - protein, 9 aa, Homo Sapiens
AIFPSPMMY

SEQ ID NO: 22715 - protein, 9 aa, Homo Sapiens
AILDYLITK

SEQ ID NO: 22716 - protein, 9 aa, Homo Sapiens
AILLPQPPK

SEQ ID NO: 22717 - protein, 9 aa, Homo Sapiens
AILSKFLYY

SEQ ID NO: 22718 - protein, 9 aa, Homo Sapiens
AIPGFTINR

SEQ ID NO: 22719 - protein, 9 aa, Homo Sapiens
AISFVLGEK

SEQ ID NO: 22720 - protein, 9 aa, Homo Sapiens
AISWPLLQK

SEQ ID NO: 22721 - protein, 9 aa, Homo Sapiens
AIVAYGLYK

SEQ ID NO: 22722 - protein, 9 aa, Homo Sapiens
AIYGRGIAY

SEQ ID NO: 22723 - protein, 9 aa, Homo Sapiens
ALAEYVIYR

SEQ ID NO: 22724 - protein, 9 aa, Homo Sapiens
ALAGHQLIR

SEQ ID NO: 22725 - protein, 9 aa, Homo Sapiens
ALAGTFHYY

SEQ ID NO: 22726 - protein, 9 aa, Homo Sapiens
ALAIKVLNK

SEQ ID NO: 22727 - protein, 9 aa, Homo Sapiens
ALANVSIEK

SEQ ID NO: 22728 - protein, 9 aa, Homo Sapiens
ALAQARLLY

SEQ ID NO: 22729 - protein, 9 aa, Homo Sapiens
ALAQGVLEH

SEQ ID NO: 22730 - protein, 9 aa, Homo Sapiens
ALARQLLLY

SEQ ID NO: 22731 - protein, 9 aa, Homo Sapiens
ALASRFLKK

SEQ ID NO: 22732 - protein, 9 aa, Homo Sapiens
ALCSRLLEY

SEQ ID NO: 22733 - protein, 9 aa, Homo Sapiens
ALFASGLIH

SEQ ID NO: 22734 - protein, 9 aa, Homo Sapiens
ALFDGVVSK

SEQ ID NO: 22735 - protein, 9 aa, Homo Sapiens
ALFEVPSLK

SEQ ID NO: 22736 - protein, 9 aa, Homo Sapiens
ALFEYIFHH

SEQ ID NO: 22737 - protein, 9 aa, Homo Sapiens
ALFGQPPFK

SEQ ID NO: 22738 - protein, 9 aa, Homo Sapiens
ALFGVVFPH

SEQ ID NO: 22739 - protein, 9 aa, Homo Sapiens
ALFHAQLAY

SEQ ID NO: 22740 - protein, 9 aa, Homo Sapiens
ALFKHILLY

SEQ ID NO: 22741 - protein, 9 aa, Homo Sapiens
ALFKNLLLK

SEQ ID NO: 22742 - protein, 9 aa, Homo Sapiens
ALFSRIFGK

SEQ ID NO: 22743 - protein, 9 aa, Homo Sapiens
ALHLHPLLH

SEQ ID NO: 22744 - protein, 9 aa, Homo Sapiens
ALKTGIVAK

SEQ ID NO: 22745 - protein, 9 aa, Homo Sapiens
ALLDITVTK

SEQ ID NO: 22746 - protein, 9 aa, Homo Sapiens
ALLEVLSQK

SEQ ID NO: 22747 - protein, 9 aa, Homo Sapiens
ALLGTSGLK

SEQ ID NO: 22748 - protein, 9 aa, Homo Sapiens
ALLSPGSPK

SEQ ID NO: 22749 - protein, 9 aa, Homo Sapiens
ALLTGIISK

SEQ ID NO: 22750 - protein, 9 aa, Homo Sapiens
ALLTYMIAH

SEQ ID NO: 22751 - protein, 9 aa, Homo Sapiens
ALMTIFTIK

SEQ ID NO: 22752 - protein, 9 aa, Homo Sapiens
ALNALILAY

SEQ ID NO: 22753 - protein, 9 aa, Homo Sapiens
ALNFSVFYY

SEQ ID NO: 22754 - protein, 9 aa, Homo Sapiens
ALNHKVLHY

SEQ ID NO: 22755 - protein, 9 aa, Homo Sapiens
ALNSKILSV

SEQ ID NO: 22756 - protein, 9 aa, Homo Sapiens
ALNVPISVK

SEQ ID NO: 22757 - protein, 9 aa, Homo Sapiens
ALNVPLHNR

SEQ ID NO: 22758 - protein, 9 aa, Homo Sapiens
ALPALVMSK

SEQ ID NO: 22759 - protein, 9 aa, Homo Sapiens
ALSGFTIFR

SEQ ID NO: 22760 - protein, 9 aa, Homo Sapiens
ALSKTVFYY

SEQ ID NO: 22761 - protein, 9 aa, Homo Sapiens
ALSNPILNK

SEQ ID NO: 22762 - protein, 9 aa, Homo Sapiens
ALTDAYLLY

SEQ ID NO: 22763 - protein, 9 aa, Homo Sapiens
ALWGRTTLK

SEQ ID NO: 22764 - protein, 9 aa, Homo Sapiens
ALWPQIIQK

SEQ ID NO: 22765 - protein, 9 aa, Homo Sapiens
ALWSHLLHY

SEQ ID NO: 22766 - protein, 9 aa, Homo Sapiens
ALWSPGLAK

SEQ ID NO: 22767 - protein, 9 aa, Homo Sapiens
ALYDLAVLK

SEQ ID NO: 22768 - protein, 9 aa, Homo Sapiens
ALYEYARRR

SEQ ID NO: 22769 - protein, 9 aa, Homo Sapiens
ALYFPKNGD

SEQ ID NO: 22770 - protein, 9 aa, Homo Sapiens
ALYFTRGLK

SEQ ID NO: 22771 - protein, 9 aa, Homo Sapiens
ALYGRFTIK

SEQ ID NO: 22772 - protein, 9 aa, Homo Sapiens
ALYGVVNVK

SEQ ID NO: 22773 - protein, 9 aa, Homo Sapiens
ALYKKILKY

SEQ ID NO: 22774 - protein, 9 aa, Homo Sapiens
ALYNIGLTY

SEQ ID NO: 22775 - protein, 9 aa, Homo Sapiens
ALYPHFPAH

SEQ ID NO: 22776 - protein, 9 aa, Homo Sapiens
ALYQPLFDK

SEQ ID NO: 22777 - protein, 9 aa, Homo Sapiens
ALYSVPRNH

SEQ ID NO: 22778 - protein, 9 aa, Homo Sapiens
ALYSVYRQK

SEQ ID NO: 22779 - protein, 9 aa, Homo Sapiens
AMADTFLEH

SEQ ID NO: 22780 - protein, 9 aa, Homo Sapiens
AMFALPAEK

SEQ ID NO: 22781 - protein, 9 aa, Homo Sapiens
AMGDVVIFK

SEQ ID NO: 22782 - protein, 9 aa, Homo Sapiens
AMHGVFLYH

SEQ ID NO: 22783 - protein, 9 aa, Homo Sapiens
AMLDTVVFK

SEQ ID NO: 22784 - protein, 9 aa, Homo Sapiens
AMMAIAIMK

SEQ ID NO: 22785 - protein, 9 aa, Homo Sapiens
AMWTTALLH

SEQ ID NO: 22786 - protein, 9 aa, Homo Sapiens
AQATISFPK

SEQ ID NO: 22787 - protein, 9 aa, Homo Sapiens
AQWQKVLPR

SEQ ID NO: 22788 - protein, 9 aa, Homo Sapiens
AQYGNILKH

SEQ ID NO: 22789 - protein, 9 aa, Homo Sapiens
AQYQFTGIK

SEQ ID NO: 22790 - protein, 9 aa, Homo Sapiens
ASLSRPLNY

SEQ ID NO: 22791 - protein, 9 aa, Homo Sapiens
ASNPAMLLY

SEQ ID NO: 22792 - protein, 9 aa, Homo Sapiens
ASSPPAIPK

SEQ ID NO: 22793 - protein, 9 aa, Homo Sapiens
ASYGLALLH

SEQ ID NO: 22794 - protein, 9 aa, Homo Sapiens
ASYVSPVLK

SEQ ID NO: 22795 - protein, 9 aa, Homo Sapiens
ATAAVIFLH

SEQ ID NO: 22796 - protein, 9 aa, Homo Sapiens
ATADVVILY

SEQ ID NO: 22797 - protein, 9 aa, Homo Sapiens
ATATLIIEH

SEQ ID NO: 22798 - protein, 9 aa, Homo Sapiens
ATFFGEVVK

SEQ ID NO: 22799 - protein, 9 aa, Homo Sapiens
ATFIKAMFK

SEQ ID NO: 22800 - protein, 9 aa, Homo Sapiens
ATFPDPNVK

SEQ ID NO: 22801 - protein, 9 aa, Homo Sapiens
ATFPLSVQK

SEQ ID NO: 22802 - protein, 9 aa, Homo Sapiens
ATFPVAPRY

SEQ ID NO: 22803 - protein, 9 aa, Homo Sapiens
ATFTNVFGK

SEQ ID NO: 22804 - protein, 9 aa, Homo Sapiens
ATFTVMGLK

SEQ ID NO: 22805 - protein, 9 aa, Homo Sapiens
ATIYPVLPK

SEQ ID NO: 22806 - protein, 9 aa, Homo Sapiens
ATLAAVLQR

SEQ ID NO: 22807 - protein, 9 aa, Homo Sapiens
ATLLIFANK

SEQ ID NO: 22808 - protein, 9 aa, Homo Sapiens
ATLTNILEH

SEQ ID NO: 22809 - protein, 9 aa, Homo Sapiens
ATNLVQLYH

SEQ ID NO: 22810 - protein, 9 aa, Homo Sapiens
ATSKVALVY

SEQ ID NO: 22811 - protein, 9 aa, Homo Sapiens
ATSVITIVK

SEQ ID NO: 22812 - protein, 9 aa, Homo Sapiens
ATTLKNRPL

SEQ ID NO: 22813 - protein, 9 aa, Homo Sapiens
ATYPYQVVR

SEQ ID NO: 22814 - protein, 9 aa, Homo Sapiens
AVAAFVLYK

SEQ ID NO: 22815 - protein, 9 aa, Homo Sapiens
AVAEKMLQY

SEQ ID NO: 22816 - protein, 9 aa, Homo Sapiens
AVAIKAMAK

SEQ ID NO: 22817 - protein, 9 aa, Homo Sapiens
AVALPLQTK

SEQ ID NO: 22818 - protein, 9 aa, Homo Sapiens
AVASVPIMY

SEQ ID NO: 22819 - protein, 9 aa, Homo Sapiens
AVATFLIRH

SEQ ID NO: 22820 - protein, 9 aa, Homo Sapiens
AVFEWHITK

SEQ ID NO: 22821 - protein, 9 aa, Homo Sapiens
AVFGVPASK

SEQ ID NO: 22822 - protein, 9 aa, Homo Sapiens
AVFQIILRR

SEQ ID NO: 22823 - protein, 9 aa, Homo Sapiens
AVGALQLTY

SEQ ID NO: 22824 - protein, 9 aa, Homo Sapiens
AVKVPSVFK

SEQ ID NO: 22825 - protein, 9 aa, Homo Sapiens
AVLDLSWNK

SEQ ID NO: 22826 - protein, 9 aa, Homo Sapiens
AVLGFAMYK

SEQ ID NO: 22827 - protein, 9 aa, Homo Sapiens
AVLPAVIPK

SEQ ID NO: 22828 - protein, 9 aa, Homo Sapiens
AVLPSVLNK

SEQ ID NO: 22829 - protein, 9 aa, Homo Sapiens
AVLRIPILY

SEQ ID NO: 22830 - protein, 9 aa, Homo Sapiens
AVLSFSLYR

SEQ ID NO: 22831 - protein, 9 aa, Homo Sapiens
AVLSWKLAK

SEQ ID NO: 22832 - protein, 9 aa, Homo Sapiens
AVLTKQLLH

SEQ ID NO: 22833 - protein, 9 aa, Homo Sapiens
AVNFPFLVK

SEQ ID NO: 22834 - protein, 9 aa, Homo Sapiens
AVNGVQLHY

SEQ ID NO: 22835 - protein, 9 aa, Homo Sapiens
AVNSIFLSH

SEQ ID NO: 22836 - protein, 9 aa, Homo Sapiens
AVRKPIVLK

SEQ ID NO: 22837 - protein, 9 aa, Homo Sapiens
AVSLQQLTY

SEQ ID NO: 22838 - protein, 9 aa, Homo Sapiens
AVSLWAKLK

SEQ ID NO: 22839 - protein, 9 aa, Homo Sapiens
AVSTFAMVK

SEQ ID NO: 22840 - protein, 9 aa, Homo Sapiens
AVWDTCLEY

SEQ ID NO: 22841 - protein, 9 aa, Homo Sapiens
AVYLLPVPK

SEQ ID NO: 22842 - protein, 9 aa, Homo Sapiens
AVYLRALVR

SEQ ID NO: 22843 - protein, 9 aa, Homo Sapiens
AVYPVFLFY

SEQ ID NO: 22844 - protein, 9 aa, Homo Sapiens
AVYSGISLK

SEQ ID NO: 22845 - protein, 9 aa, Homo Sapiens
CLYPRFVQR

SEQ ID NO: 22846 - protein, 9 aa, Homo Sapiens
FINPKPITY

SEQ ID NO: 22847 - protein, 9 aa, Homo Sapiens
FIYLGEVFK

SEQ ID NO: 22848 - protein, 9 aa, Homo Sapiens
FLSAVFFAK

SEQ ID NO: 22849 - protein, 9 aa, Homo Sapiens
FLVPWFIPK

SEQ ID NO: 22850 - protein, 9 aa, Homo Sapiens
FLYAFIGVK

SEQ ID NO: 22851 - protein, 9 aa, Homo Sapiens
FPSLLTNPK

SEQ ID NO: 22852 - protein, 9 aa, Homo Sapiens
FQYDRFFEK

SEQ ID NO: 22853 - protein, 9 aa, Homo Sapiens
FTAPPVLGK

SEQ ID NO: 22854 - protein, 9 aa, Homo Sapiens
GIADFVLKY

SEQ ID NO: 22855 - protein, 9 aa, Homo Sapiens
GIFPGTPLK

SEQ ID NO: 22856 - protein, 9 aa, Homo Sapiens
GIFPLSFVK

SEQ ID NO: 22857 - protein, 9 aa, Homo Sapiens
GIYIGSIMK

SEQ ID NO: 22858 - protein, 9 aa, Homo Sapiens
GLAAFLLQH

SEQ ID NO: 22859 - protein, 9 aa, Homo Sapiens
GLFAHELFY

SEQ ID NO: 22860 - protein, 9 aa, Homo Sapiens
GLFALPFGR

SEQ ID NO: 22861 - protein, 9 aa, Homo Sapiens
GLFGKTVPK

SEQ ID NO: 22862 - protein, 9 aa, Homo Sapiens
GLFNRIIRK

SEQ ID NO: 22863 - protein, 9 aa, Homo Sapiens
GLFTHTIFY

SEQ ID NO: 22864 - protein, 9 aa, Homo Sapiens
GLFVPVIYK

SEQ ID NO: 22865 - protein, 9 aa, Homo Sapiens
GLGEPLALK

SEQ ID NO: 22866 - protein, 9 aa, Homo Sapiens
GLINFGIYK

SEQ ID NO: 22867 - protein, 9 aa, Homo Sapiens
GLLDIILAK

SEQ ID NO: 22868 - protein, 9 aa, Homo Sapiens
GLLSWTLSR

SEQ ID NO: 22869 - protein, 9 aa, Homo Sapiens
GLLTKPIVK

SEQ ID NO: 22870 - protein, 9 aa, Homo Sapiens
GLMGFIVYK

SEQ ID NO: 22871 - protein, 9 aa, Homo Sapiens
GLNLHTLLY

SEQ ID NO: 22872 - protein, 9 aa, Homo Sapiens
GLPFLILFH

SEQ ID NO: 22873 - protein, 9 aa, Homo Sapiens
GLRDPLIFK

SEQ ID NO: 22874 - protein, 9 aa, Homo Sapiens
GLSDIILGK

SEQ ID NO: 22875 - protein, 9 aa, Homo Sapiens
GLTDVILYH

SEQ ID NO: 22876 - protein, 9 aa, Homo Sapiens
GLTVPTSPK

SEQ ID NO: 22877 - protein, 9 aa, Homo Sapiens
GLVDVILYH

SEQ ID NO: 22878 - protein, 9 aa, Homo Sapiens
GLWHMKTYK

SEQ ID NO: 22879 - protein, 9 aa, Homo Sapiens
GLYEFFRAK

SEQ ID NO: 22880 - protein, 9 aa, Homo Sapiens
GLYEFPLNK

SEQ ID NO: 22881 - protein, 9 aa, Homo Sapiens
GLYQDGVFK

SEQ ID NO: 22882 - protein, 9 aa, Homo Sapiens
GQYGNPLNK

SEQ ID NO: 22883 - protein, 9 aa, Homo Sapiens
GSWDGTLRL

SEQ ID NO: 22884 - protein, 9 aa, Homo Sapiens
GTAQLTLLH

SEQ ID NO: 22885 - protein, 9 aa, Homo Sapiens
GTFALNLLK

SEQ ID NO: 22886 - protein, 9 aa, Homo Sapiens
GTKLPGLLK

SEQ ID NO: 22887 - protein, 9 aa, Homo Sapiens
GTLAEFIQK

SEQ ID NO: 22888 - protein, 9 aa, Homo Sapiens
GTLSSWNLK

SEQ ID NO: 22889 - protein, 9 aa, Homo Sapiens
GTMEWIMIK

SEQ ID NO: 22890 - protein, 9 aa, Homo Sapiens
GTMPVSLLK

SEQ ID NO: 22891 - protein, 9 aa, Homo Sapiens
GTMTGMLYK

SEQ ID NO: 22892 - protein, 9 aa, Homo Sapiens
GTSSLFIYK

SEQ ID NO: 22893 - protein, 9 aa, Homo Sapiens
GTYVSSVPR

SEQ ID NO: 22894 - protein, 9 aa, Homo Sapiens
GVADKILKK

SEQ ID NO: 22895 - protein, 9 aa, Homo Sapiens
GVFGFPLGR

SEQ ID NO: 22896 - protein, 9 aa, Homo Sapiens
GVFLSLIQK

SEQ ID NO: 22897 - protein, 9 aa, Homo Sapiens
GVLAWVKEK

SEQ ID NO: 22898 - protein, 9 aa, Homo Sapiens
GVLYPLSSK

SEQ ID NO: 22899 - protein, 9 aa, Homo Sapiens
GVMDYYLKY

SEQ ID NO: 22900 - protein, 9 aa, Homo Sapiens
GVMSPPLSR

SEQ ID NO: 22901 - protein, 9 aa, Homo Sapiens
GVNPYILKK

SEQ ID NO: 22902 - protein, 9 aa, Homo Sapiens
GVSAATFLK

SEQ ID NO: 22903 - protein, 9 aa, Homo Sapiens
GVSSIFIYH

SEQ ID NO: 22904 - protein, 9 aa, Homo Sapiens
HIAENILSY

SEQ ID NO: 22905 - protein, 9 aa, Homo Sapiens
HIFMKVFPK

SEQ ID NO: 22906 - protein, 9 aa, Homo Sapiens
HINGRVLYY

SEQ ID NO: 22907 - protein, 9 aa, Homo Sapiens
HIPLNLSGK

SEQ ID NO: 22908 - protein, 9 aa, Homo Sapiens
HISPNAIFK

SEQ ID NO: 22909 - protein, 9 aa, Homo Sapiens
HLADILSSK

SEQ ID NO: 22910 - protein, 9 aa, Homo Sapiens
HLEDIVRQK

SEQ ID NO: 22911 - protein, 9 aa, Homo Sapiens
HLFDHVVNR

SEQ ID NO: 22912 - protein, 9 aa, Homo Sapiens
HLISPLIQK

SEQ ID NO: 22913 - protein, 9 aa, Homo Sapiens
HLLITNSIK

SEQ ID NO: 22914 - protein, 9 aa, Homo Sapiens
HLTAVTIFY

SEQ ID NO: 22915 - protein, 9 aa, Homo Sapiens
HLYGSLLYY

SEQ ID NO: 22916 - protein, 9 aa, Homo Sapiens
HLYSTILGH

SEQ ID NO: 22917 - protein, 9 aa, Homo Sapiens
HTFGGPLLK

SEQ ID NO: 22918 - protein, 9 aa, Homo Sapiens
HTLEPLIPR

SEQ ID NO: 22919 - protein, 9 aa, Homo Sapiens
HTPQFFIYK

SEQ ID NO: 22920 - protein, 9 aa, Homo Sapiens
HVGISFVPK

SEQ ID NO: 22921 - protein, 9 aa, Homo Sapiens
HVIETLIGK

SEQ ID NO: 22922 - protein, 9 aa, Homo Sapiens
HVPSPAVPK

SEQ ID NO: 22923 - protein, 9 aa, Homo Sapiens
HVVLPVKPK

SEQ ID NO: 22924 - protein, 9 aa, Homo Sapiens
HVYVGNISK

SEQ ID NO: 22925 - protein, 9 aa, Homo Sapiens
IIAKVFLAY

SEQ ID NO: 22926 - protein, 9 aa, Homo Sapiens
IIFDRPLLY

SEQ ID NO: 22927 - protein, 9 aa, Homo Sapiens
IIFQGQSLK

SEQ ID NO: 22928 - protein, 9 aa, Homo Sapiens
IIGTIFIIK

SEQ ID NO: 22929 - protein, 9 aa, Homo Sapiens
IINPFPASK

SEQ ID NO: 22930 - protein, 9 aa, Homo Sapiens
IINSSITTK

SEQ ID NO: 22931 - protein, 9 aa, Homo Sapiens
IITSVLRIS

SEQ ID NO: 22932 - protein, 9 aa, Homo Sapiens
ILAAPGILK

SEQ ID NO: 22933 - protein, 9 aa, Homo Sapiens
ILADMLLYY

SEQ ID NO: 22934 - protein, 9 aa, Homo Sapiens
ILFGGYVAK

SEQ ID NO: 22935 - protein, 9 aa, Homo Sapiens
ILFIRIMPK

SEQ ID NO: 22936 - protein, 9 aa, Homo Sapiens
ILFSEGLIK

SEQ ID NO: 22937 - protein, 9 aa, Homo Sapiens
ILGPMFSGK

SEQ ID NO: 22938 - protein, 9 aa, Homo Sapiens
ILGPNLGDK

SEQ ID NO: 22939 - protein, 9 aa, Homo Sapiens
ILNLKVIDK

SEQ ID NO: 22940 - protein, 9 aa, Homo Sapiens
ILNNKLISK

SEQ ID NO: 22941 - protein, 9 aa, Homo Sapiens
ILNTWISLK

SEQ ID NO: 22942 - protein, 9 aa, Homo Sapiens
ILPYPVSPK

SEQ ID NO: 22943 - protein, 9 aa, Homo Sapiens
ILSGGVFNK

SEQ ID NO: 22944 - protein, 9 aa, Homo Sapiens
ILYCIPLRY

SEQ ID NO: 22945 - protein, 9 aa, Homo Sapiens
ILYIATPNK

SEQ ID NO: 22946 - protein, 9 aa, Homo Sapiens
ILYIRNLPY

SEQ ID NO: 22947 - protein, 9 aa, Homo Sapiens
ILYPVIFHK

SEQ ID NO: 22948 - protein, 9 aa, Homo Sapiens
IQATPLELK

SEQ ID NO: 22949 - protein, 9 aa, Homo Sapiens
IQFSMKLLY

SEQ ID NO: 22950 - protein, 9 aa, Homo Sapiens
IQNDRQLQY

SEQ ID NO: 22951 - protein, 9 aa, Homo Sapiens
IRSSKLIQH

SEQ ID NO: 22952 - protein, 9 aa, Homo Sapiens
ISFGAFVAK

SEQ ID NO: 22953 - protein, 9 aa, Homo Sapiens
ISQEPFVPK

SEQ ID NO: 22954 - protein, 9 aa, Homo Sapiens
ISSIPINLR

SEQ ID NO: 22955 - protein, 9 aa, Homo Sapiens
ITNPKSLLY

SEQ ID NO: 22956 - protein, 9 aa, Homo Sapiens
ITSPVVTQK

SEQ ID NO: 22957 - protein, 9 aa, Homo Sapiens
IVAGSLITK

SEQ ID NO: 22958 - protein, 9 aa, Homo Sapiens
IVALILSTK

SEQ ID NO: 22959 - protein, 9 aa, Homo Sapiens
IVFDPLGGK

SEQ ID NO: 22960 - protein, 9 aa, Homo Sapiens
IVFMPVIGK

SEQ ID NO: 22961 - protein, 9 aa, Homo Sapiens
IVFSLTFFK

SEQ ID NO: 22962 - protein, 9 aa, Homo Sapiens
IVGTVLIIK

SEQ ID NO: 22963 - protein, 9 aa, Homo Sapiens
IVLIFEAPK

SEQ ID NO: 22964 - protein, 9 aa, Homo Sapiens
IVLSAVITK

SEQ ID NO: 22965 - protein, 9 aa, Homo Sapiens
IVNGHTLLV

SEQ ID NO: 22966 - protein, 9 aa, Homo Sapiens
IVNIIVPTK

SEQ ID NO: 22967 - protein, 9 aa, Homo Sapiens
IVSAQNLLK

SEQ ID NO: 22968 - protein, 9 aa, Homo Sapiens
IVSNIRLLH

SEQ ID NO: 22969 - protein, 9 aa, Homo Sapiens
IVSSLRLAY

SEQ ID NO: 22970 - protein, 9 aa, Homo Sapiens
IVTSINFSK

SEQ ID NO: 22971 - protein, 9 aa, Homo Sapiens
IVTSVLLLY

SEQ ID NO: 22972 - protein, 9 aa, Homo Sapiens
IVVPPLPEK

SEQ ID NO: 22973 - protein, 9 aa, Homo Sapiens
IVYPPPPAK

SEQ ID NO: 22974 - protein, 9 aa, Homo Sapiens
KAGEVFIHK

SEQ ID NO: 22975 - protein, 9 aa, Homo Sapiens
KASEVFLQR

SEQ ID NO: 22976 - protein, 9 aa, Homo Sapiens
KFKFPGRQK

SEQ ID NO: 22977 - protein, 9 aa, Homo Sapiens
KIADFGLAR

SEQ ID NO: 22978 - protein, 9 aa, Homo Sapiens
KIADMGHLK

SEQ ID NO: 22979 - protein, 9 aa, Homo Sapiens
KIADRFLLY

SEQ ID NO: 22980 - protein, 9 aa, Homo Sapiens
KIGDFGLTK

SEQ ID NO: 22981 - protein, 9 aa, Homo Sapiens
KILDIGLAY

SEQ ID NO: 22982 - protein, 9 aa, Homo Sapiens
KILSNVISK

SEQ ID NO: 22983 - protein, 9 aa, Homo Sapiens
KIPDWFLNR

SEQ ID NO: 22984 - protein, 9 aa, Homo Sapiens
KISALALLK

SEQ ID NO: 22985 - protein, 9 aa, Homo Sapiens
KISLPPVLK

SEQ ID NO: 22986 - protein, 9 aa, Homo Sapiens
KITAPLINK

SEQ ID NO: 22987 - protein, 9 aa, Homo Sapiens
KIWQNLRLK

SEQ ID NO: 22988 - protein, 9 aa, Homo Sapiens
KIYHISLEY

SEQ ID NO: 22989 - protein, 9 aa, Homo Sapiens
KIYNANYLK

SEQ ID NO: 22990 - protein, 9 aa, Homo Sapiens
KLAEILYYK

SEQ ID NO: 22991 - protein, 9 aa, Homo Sapiens
KLATTILQH

SEQ ID NO: 22992 - protein, 9 aa, Homo Sapiens
KLDGRSLIK

SEQ ID NO: 22993 - protein, 9 aa, Homo Sapiens
KLDGSRLIK

SEQ ID NO: 22994 - protein, 9 aa, Homo Sapiens
KLDRPRFER

SEQ ID NO: 22995 - protein, 9 aa, Homo Sapiens
KLDSVRVLR

SEQ ID NO: 22996 - protein, 9 aa, Homo Sapiens
KLFDKLLEY

SEQ ID NO: 22997 - protein, 9 aa, Homo Sapiens
KLFGFLLEY

SEQ ID NO: 22998 - protein, 9 aa, Homo Sapiens
KLFVGFLNR

SEQ ID NO: 22999 - protein, 9 aa, Homo Sapiens
KLGDIMGVK

SEQ ID NO: 23000 - protein, 9 aa, Homo Sapiens
KLIAWERTK

SEQ ID NO: 23001 - protein, 9 aa, Homo Sapiens
KLLAHPLQR

SEQ ID NO: 23002 - protein, 9 aa, Homo Sapiens
KLLAIPVEK

SEQ ID NO: 23003 - protein, 9 aa, Homo Sapiens
KLLDAYLLY

SEQ ID NO: 23004 - protein, 9 aa, Homo Sapiens
KLLESIFHR

SEQ ID NO: 23005 - protein, 9 aa, Homo Sapiens
KLLEVWFSR

SEQ ID NO: 23006 - protein, 9 aa, Homo Sapiens
KLLGPVLVK

SEQ ID NO: 23007 - protein, 9 aa, Homo Sapiens
KLLPNGFTK

SEQ ID NO: 23008 - protein, 9 aa, Homo Sapiens
KLLPSALQK

SEQ ID NO: 23009 - protein, 9 aa, Homo Sapiens
KLNIPAILR

SEQ ID NO: 23010 - protein, 9 aa, Homo Sapiens
KLNIRPLLR

SEQ ID NO: 23011 - protein, 9 aa, Homo Sapiens
KLPHRLIEK

SEQ ID NO: 23012 - protein, 9 aa, Homo Sapiens
KLPNTVLGK

SEQ ID NO: 23013 - protein, 9 aa, Homo Sapiens
KLPVVGIGK

SEQ ID NO: 23014 - protein, 9 aa, Homo Sapiens
KLRQPFFQK

SEQ ID NO: 23015 - protein, 9 aa, Homo Sapiens
KLSFSQVFK

SEQ ID NO: 23016 - protein, 9 aa, Homo Sapiens
KLTDQTLIY

SEQ ID NO: 23017 - protein, 9 aa, Homo Sapiens
KLVENILAK

SEQ ID NO: 23018 - protein, 9 aa, Homo Sapiens
KLWDNELQY

SEQ ID NO: 23019 - protein, 9 aa, Homo Sapiens
KLYAGQVGY

SEQ ID NO: 23020 - protein, 9 aa, Homo Sapiens
KLYGKPIRV

SEQ ID NO: 23021 - protein, 9 aa, Homo Sapiens
KLYPLPSAR

SEQ ID NO: 23022 - protein, 9 aa, Homo Sapiens
KLYQSIIGY

SEQ ID NO: 23023 - protein, 9 aa, Homo Sapiens
KLYSLFLKY

SEQ ID NO: 23024 - protein, 9 aa, Homo Sapiens
KLYTLPASH

SEQ ID NO: 23025 - protein, 9 aa, Homo Sapiens
KMLRDTLYY

SEQ ID NO: 23026 - protein, 9 aa, Homo Sapiens
KMSSSVISY

SEQ ID NO: 23027 - protein, 9 aa, Homo Sapiens
KQSQILLVY

SEQ ID NO: 23028 - protein, 9 aa, Homo Sapiens
KSSAISLHY

SEQ ID NO: 23029 - protein, 9 aa, Homo Sapiens
KSTAISLFY

SEQ ID NO: 23030 - protein, 9 aa, Homo Sapiens
KTDVTMLLY

SEQ ID NO: 23031 - protein, 9 aa, Homo Sapiens
KTLDHVLTH

SEQ ID NO: 23032 - protein, 9 aa, Homo Sapiens
KTLYLIMEY

SEQ ID NO: 23033 - protein, 9 aa, Homo Sapiens
KTLYPIIGK

SEQ ID NO: 23034 - protein, 9 aa, Homo Sapiens
KTMNIYFPK

SEQ ID NO: 23035 - protein, 9 aa, Homo Sapiens
KTNFRLLKR

SEQ ID NO: 23036 - protein, 9 aa, Homo Sapiens
KTNGKFLIR

SEQ ID NO: 23037 - protein, 9 aa, Homo Sapiens
KTPDFILQV

SEQ ID NO: 23038 - protein, 9 aa, Homo Sapiens
KTSNLLLSH

SEQ ID NO: 23039 - protein, 9 aa, Homo Sapiens
KVADMALHY

SEQ ID NO: 23040 - protein, 9 aa, Homo Sapiens
KVANIILSY

SEQ ID NO: 23041 - protein, 9 aa, Homo Sapiens
KVAPVVITY

SEQ ID NO: 23042 - protein, 9 aa, Homo Sapiens
KVAVKILNR

SEQ ID NO: 23043 - protein, 9 aa, Homo Sapiens
KVAVVLIQK

SEQ ID NO: 23044 - protein, 9 aa, Homo Sapiens
KVCNPIITK

SEQ ID NO: 23045 - protein, 9 aa, Homo Sapiens
KVDAGKLHY

SEQ ID NO: 23046 - protein, 9 aa, Homo Sapiens
KVFERAVQY

SEQ ID NO: 23047 - protein, 9 aa, Homo Sapiens
KVFKQIFSK

SEQ ID NO: 23048 - protein, 9 aa, Homo Sapiens
KVGEVIVTK

SEQ ID NO: 23049 - protein, 9 aa, Homo Sapiens
KVHAYIISY

SEQ ID NO: 23050 - protein, 9 aa, Homo Sapiens
KVLFPLLTK

SEQ ID NO: 23051 - protein, 9 aa, Homo Sapiens
KVLQKFLTY

SEQ ID NO: 23052 - protein, 9 aa, Homo Sapiens
KVLSILLKH

SEQ ID NO: 23053 - protein, 9 aa, Homo Sapiens
KVSDLTIPK

SEQ ID NO: 23054 - protein, 9 aa, Homo Sapiens
KVSDWQVLY

SEQ ID NO: 23055 - protein, 9 aa, Homo Sapiens
KVYENYPTY

SEQ ID NO: 23056 - protein, 9 aa, Homo Sapiens
KVYNIQIRY

SEQ ID NO: 23057 - protein, 9 aa, Homo Sapiens
LAYRGFIFK

SEQ ID NO: 23058 - protein, 9 aa, Homo Sapiens
LIAPIFLHR

SEQ ID NO: 23059 - protein, 9 aa, Homo Sapiens
LISPIILKK

SEQ ID NO: 23060 - protein, 9 aa, Homo Sapiens
LIYKLFTLK

SEQ ID NO: 23061 - protein, 9 aa, Homo Sapiens
LLAKVFITK

SEQ ID NO: 23062 - protein, 9 aa, Homo Sapiens
LLAYTLGVK

SEQ ID NO: 23063 - protein, 9 aa, Homo Sapiens
LLCQWIQSK

SEQ ID NO: 23064 - protein, 9 aa, Homo Sapiens
LLDIIRSLK

SEQ ID NO: 23065 - protein, 9 aa, Homo Sapiens
LLFSATMPK

SEQ ID NO: 23066 - protein, 9 aa, Homo Sapiens
LLGPRVIGK

SEQ ID NO: 23067 - protein, 9 aa, Homo Sapiens
LLKEKEKKM

SEQ ID NO: 23068 - protein, 9 aa, Homo Sapiens
LLKSFFTEK

SEQ ID NO: 23069 - protein, 9 aa, Homo Sapiens
LLLAEPPLK

SEQ ID NO: 23070 - protein, 9 aa, Homo Sapiens
LLLAPAVSK

SEQ ID NO: 23071 - protein, 9 aa, Homo Sapiens
LLPNHVLQK

SEQ ID NO: 23072 - protein, 9 aa, Homo Sapiens
LLPWPFRNK

SEQ ID NO: 23073 - protein, 9 aa, Homo Sapiens
LLTAVQLLY

SEQ ID NO: 23074 - protein, 9 aa, Homo Sapiens
LLWDRILGY

SEQ ID NO: 23075 - protein, 9 aa, Homo Sapiens
LLYEKNLVK

SEQ ID NO: 23076 - protein, 9 aa, Homo Sapiens
LLYGGLLVK

SEQ ID NO: 23077 - protein, 9 aa, Homo Sapiens
LLYKHIVGK

SEQ ID NO: 23078 - protein, 9 aa, Homo Sapiens
LLYPKSLSR

SEQ ID NO: 23079 - protein, 9 aa, Homo Sapiens
LMAISATFK

SEQ ID NO: 23080 - protein, 9 aa, Homo Sapiens
LPALKQTPK

SEQ ID NO: 23081 - protein, 9 aa, Homo Sapiens
LPINGNGKQ

SEQ ID NO: 23082 - protein, 9 aa, Homo Sapiens
LRNLGSLLK

SEQ ID NO: 23083 - protein, 9 aa, Homo Sapiens
LSFDRILKK

SEQ ID NO: 23084 - protein, 9 aa, Homo Sapiens
LSGPRLLFK

SEQ ID NO: 23085 - protein, 9 aa, Homo Sapiens
LSLLPLSEK

SEQ ID NO: 23086 - protein, 9 aa, Homo Sapiens
LSSGAVLYK

SEQ ID NO: 23087 - protein, 9 aa, Homo Sapiens
LSYLKYRSP

SEQ ID NO: 23088 - protein, 9 aa, Homo Sapiens
LTAEAFGFK

SEQ ID NO: 23089 - protein, 9 aa, Homo Sapiens
LTGPVMPVR

SEQ ID NO: 23090 - protein, 9 aa, Homo Sapiens
LTLPETASL

SEQ ID NO: 23091 - protein, 9 aa, Homo Sapiens
LVANFFPKK

SEQ ID NO: 23092 - protein, 9 aa, Homo Sapiens
LVFATMITK

SEQ ID NO: 23093 - protein, 9 aa, Homo Sapiens
LVFWVILLY

SEQ ID NO: 23094 - protein, 9 aa, Homo Sapiens
LVIPFTIKK

SEQ ID NO: 23095 - protein, 9 aa, Homo Sapiens
LVMTHLILK

SEQ ID NO: 23096 - protein, 9 aa, Homo Sapiens
LVSSRILSR

SEQ ID NO: 23097 - protein, 9 aa, Homo Sapiens
MAAAAFAEK

SEQ ID NO: 23098 - protein, 9 aa, Homo Sapiens
MAPLKMLAL

SEQ ID NO: 23099 - protein, 9 aa, Homo Sapiens
MAYLGTITK

SEQ ID NO: 23100 - protein, 9 aa, Homo Sapiens
MIASHLLAY

SEQ ID NO: 23101 - protein, 9 aa, Homo Sapiens
MILPLPLRK

SEQ ID NO: 23102 - protein, 9 aa, Homo Sapiens
MILPNPLYH

SEQ ID NO: 23103 - protein, 9 aa, Homo Sapiens
MLLILMLFK

SEQ ID NO: 23104 - protein, 9 aa, Homo Sapiens
MMFSATFPK

SEQ ID NO: 23105 - protein, 9 aa, Homo Sapiens
MVFGAPVPK

SEQ ID NO: 23106 - protein, 9 aa, Homo Sapiens
NINNPFVFK

SEQ ID NO: 23107 - protein, 9 aa, Homo Sapiens
NKTQTILFY

SEQ ID NO: 23108 - protein, 9 aa, Homo Sapiens
NLATPIAIK

SEQ ID NO: 23109 - protein, 9 aa, Homo Sapiens
PISGWFALK

SEQ ID NO: 23110 - protein, 9 aa, Homo Sapiens
PLYSSPIVK

SEQ ID NO: 23111 - protein, 9 aa, Homo Sapiens
QAADILLYK

SEQ ID NO: 23112 - protein, 9 aa, Homo Sapiens
QIASFILLR

SEQ ID NO: 23113 - protein, 9 aa, Homo Sapiens
QIAVIAIFK

SEQ ID NO: 23114 - protein, 9 aa, Homo Sapiens
QIFIPMVNK

SEQ ID NO: 23115 - protein, 9 aa, Homo Sapiens
QIFKPIISK

SEQ ID NO: 23116 - protein, 9 aa, Homo Sapiens
QIFSEFLLK

SEQ ID NO: 23117 - protein, 9 aa, Homo Sapiens
QILKLLIKF

SEQ ID NO: 23118 - protein, 9 aa, Homo Sapiens
QISEVVVVK

SEQ ID NO: 23119 - protein, 9 aa, Homo Sapiens
QITLPTVQK

SEQ ID NO: 23120 - protein, 9 aa, Homo Sapiens
QIYTYFVYK

SEQ ID NO: 23121 - protein, 9 aa, Homo Sapiens
QKIYIYTLK

SEQ ID NO: 23122 - protein, 9 aa, Homo Sapiens
QLFEVKVFK

SEQ ID NO: 23123 - protein, 9 aa, Homo Sapiens
QLFSFPIKH

SEQ ID NO: 23124 - protein, 9 aa, Homo Sapiens
QLGALFILK

SEQ ID NO: 23125 - protein, 9 aa, Homo Sapiens
QLLLNPLLH

SEQ ID NO: 23126 - protein, 9 aa, Homo Sapiens
QLYEKGLYY

SEQ ID NO: 23127 - protein, 9 aa, Homo Sapiens
QLYPRNFLR

SEQ ID NO: 23128 - protein, 9 aa, Homo Sapiens
QLYSTILSH

SEQ ID NO: 23129 - protein, 9 aa, Homo Sapiens
QLYWSHPRK

SEQ ID NO: 23130 - protein, 9 aa, Homo Sapiens
QTLVRILSH

SEQ ID NO: 23131 - protein, 9 aa, Homo Sapiens
QTYVGITEK

SEQ ID NO: 23132 - protein, 9 aa, Homo Sapiens
QVHAWQLYY

SEQ ID NO: 23133 - protein, 9 aa, Homo Sapiens
QVSVRPLQH

SEQ ID NO: 23134 - protein, 9 aa, Homo Sapiens
QVYMKPPAH

SEQ ID NO: 23135 - protein, 9 aa, Homo Sapiens
RAAPFSLEY

SEQ ID NO: 23136 - protein, 9 aa, Homo Sapiens
RAYPHVFTK

SEQ ID NO: 23137 - protein, 9 aa, Homo Sapiens
RFWTSFFPK

SEQ ID NO: 23138 - protein, 9 aa, Homo Sapiens
RIAEFAFEY

SEQ ID NO: 23139 - protein, 9 aa, Homo Sapiens
RIAEIFMRH

SEQ ID NO: 23140 - protein, 9 aa, Homo Sapiens
RICEILLQY

SEQ ID NO: 23141 - protein, 9 aa, Homo Sapiens
RIFDLGRKK

SEQ ID NO: 23142 - protein, 9 aa, Homo Sapiens
RIFEPPPPK

SEQ ID NO: 23143 - protein, 9 aa, Homo Sapiens
RIFETLQDK

SEQ ID NO: 23144 - protein, 9 aa, Homo Sapiens
RIFNPHLNK

SEQ ID NO: 23145 - protein, 9 aa, Homo Sapiens
RIFTSVPKR

SEQ ID NO: 23146 - protein, 9 aa, Homo Sapiens
RIFVYFITK

SEQ ID NO: 23147 - protein, 9 aa, Homo Sapiens
RIGNFIVKK

SEQ ID NO: 23148 - protein, 9 aa, Homo Sapiens
RIGQVGKFK

SEQ ID NO: 23149 - protein, 9 aa, Homo Sapiens
RIHFHTLVY

SEQ ID NO: 23150 - protein, 9 aa, Homo Sapiens
RIHFPLATY

SEQ ID NO: 23151 - protein, 9 aa, Homo Sapiens
RIIDLVLQK

SEQ ID NO: 23152 - protein, 9 aa, Homo Sapiens
RIIQQPLIY

SEQ ID NO: 23153 - protein, 9 aa, Homo Sapiens
RIKEIFCPK

SEQ ID NO: 23154 - protein, 9 aa, Homo Sapiens
RIKPPWVVK

SEQ ID NO: 23155 - protein, 9 aa, Homo Sapiens
RILFFNTPK

SEQ ID NO: 23156 - protein, 9 aa, Homo Sapiens
RILLPIVQK

SEQ ID NO: 23157 - protein, 9 aa, Homo Sapiens
RILPWSTFR

SEQ ID NO: 23158 - protein, 9 aa, Homo Sapiens
RILSGVVTK

SEQ ID NO: 23159 - protein, 9 aa, Homo Sapiens
RIMENVFQH

SEQ ID NO: 23160 - protein, 9 aa, Homo Sapiens
RIMKKTSLY

SEQ ID NO: 23161 - protein, 9 aa, Homo Sapiens
RIQLPVVSK

SEQ ID NO: 23162 - protein, 9 aa, Homo Sapiens
RISNLIVLH

SEQ ID NO: 23163 - protein, 9 aa, Homo Sapiens
RIYAGGEHY

SEQ ID NO: 23164 - protein, 9 aa, Homo Sapiens
RIYDIFRSK

SEQ ID NO: 23165 - protein, 9 aa, Homo Sapiens
RIYSYVVSR

SEQ ID NO: 23166 - protein, 9 aa, Homo Sapiens
RLADSLIGK

SEQ ID NO: 23167 - protein, 9 aa, Homo Sapiens
RLAEVALAY

SEQ ID NO: 23168 - protein, 9 aa, Homo Sapiens
RLAEVIKNR

SEQ ID NO: 23169 - protein, 9 aa, Homo Sapiens
RLDAVTLLY

SEQ ID NO: 23170 - protein, 9 aa, Homo Sapiens
RLDPNFLLK

SEQ ID NO: 23171 - protein, 9 aa, Homo Sapiens
RLDQPFIPR

SEQ ID NO: 23172 - protein, 9 aa, Homo Sapiens
RLDSRLWPK

SEQ ID NO: 23173 - protein, 9 aa, Homo Sapiens
RLFCVGFTK

SEQ ID NO: 23174 - protein, 9 aa, Homo Sapiens
RLFEWVVNR

SEQ ID NO: 23175 - protein, 9 aa, Homo Sapiens
RLFEYILLY

SEQ ID NO: 23176 - protein, 9 aa, Homo Sapiens
RLFFHCSQY

SEQ ID NO: 23177 - protein, 9 aa, Homo Sapiens
RLFGISLSY

SEQ ID NO: 23178 - protein, 9 aa, Homo Sapiens
RLFGLTKPK

SEQ ID NO: 23179 - protein, 9 aa, Homo Sapiens
RLFGNILDK

SEQ ID NO: 23180 - protein, 9 aa, Homo Sapiens
RLFIGGIPK

SEQ ID NO: 23181 - protein, 9 aa, Homo Sapiens
RLFKDQLVY

SEQ ID NO: 23182 - protein, 9 aa, Homo Sapiens
RLFLFQIQK

SEQ ID NO: 23183 - protein, 9 aa, Homo Sapiens
RLFNAIIHR

SEQ ID NO: 23184 - protein, 9 aa, Homo Sapiens
RLFPGLAIK

SEQ ID NO: 23185 - protein, 9 aa, Homo Sapiens
RLFPPLRQR

SEQ ID NO: 23186 - protein, 9 aa, Homo Sapiens
RLFPYSQYY

SEQ ID NO: 23187 - protein, 9 aa, Homo Sapiens
RLFQCLLHR

SEQ ID NO: 23188 - protein, 9 aa, Homo Sapiens
RLFSVIFKY

SEQ ID NO: 23189 - protein, 9 aa, Homo Sapiens
RLFVGSIPK

SEQ ID NO: 23190 - protein, 9 aa, Homo Sapiens
RLFYDISEK

SEQ ID NO: 23191 - protein, 9 aa, Homo Sapiens
RLGNSLLLK

SEQ ID NO: 23192 - protein, 9 aa, Homo Sapiens
RLHIEALLH

SEQ ID NO: 23193 - protein, 9 aa, Homo Sapiens
RLIAAFEQK

SEQ ID NO: 23194 - protein, 9 aa, Homo Sapiens
RLKLSTWKV

SEQ ID NO: 23195 - protein, 9 aa, Homo Sapiens
RLLETVLGY

SEQ ID NO: 23196 - protein, 9 aa, Homo Sapiens
RLLGNLVVK

SEQ ID NO: 23197 - protein, 9 aa, Homo Sapiens
RLLLIATGK

SEQ ID NO: 23198 - protein, 9 aa, Homo Sapiens
RLLLLLLRY

SEQ ID NO: 23199 - protein, 9 aa, Homo Sapiens
RLLTSLRAK

SEQ ID NO: 23200 - protein, 9 aa, Homo Sapiens
RLMEIYQEK

SEQ ID NO: 23201 - protein, 9 aa, Homo Sapiens
RLMHIQPPK

SEQ ID NO: 23202 - protein, 9 aa, Homo Sapiens
RLMSLPIAK

SEQ ID NO: 23203 - protein, 9 aa, Homo Sapiens
RLNAPLSQM

SEQ ID NO: 23204 - protein, 9 aa, Homo Sapiens
RLNEKMITK

SEQ ID NO: 23205 - protein, 9 aa, Homo Sapiens
RLNIPVSQV

SEQ ID NO: 23206 - protein, 9 aa, Homo Sapiens
RLNLQPLAY

SEQ ID NO: 23207 - protein, 9 aa, Homo Sapiens
RLPAFTLSH

SEQ ID NO: 23208 - protein, 9 aa, Homo Sapiens
RLPEHCIEY

SEQ ID NO: 23209 - protein, 9 aa, Homo Sapiens
RLPLRVVKH

SEQ ID NO: 23210 - protein, 9 aa, Homo Sapiens
RLPPPTILK

SEQ ID NO: 23211 - protein, 9 aa, Homo Sapiens
RLPSATLCY

SEQ ID NO: 23212 - protein, 9 aa, Homo Sapiens
RLPSSTLKR

SEQ ID NO: 23213 - protein, 9 aa, Homo Sapiens
RLQDQHMFY

SEQ ID NO: 23214 - protein, 9 aa, Homo Sapiens
RLQEIFTEK

SEQ ID NO: 23215 - protein, 9 aa, Homo Sapiens
RLQHQQLYY

SEQ ID NO: 23216 - protein, 9 aa, Homo Sapiens
RLSFPNLFK

SEQ ID NO: 23217 - protein, 9 aa, Homo Sapiens
RLSNLALVK

SEQ ID NO: 23218 - protein, 9 aa, Homo Sapiens
RLSPVPVPR

SEQ ID NO: 23219 - protein, 9 aa, Homo Sapiens
RLTTEQILY

SEQ ID NO: 23220 - protein, 9 aa, Homo Sapiens
RLTTPVFGK

SEQ ID NO: 23221 - protein, 9 aa, Homo Sapiens
RLVDLPISK

SEQ ID NO: 23222 - protein, 9 aa, Homo Sapiens
RLVQGSILK

SEQ ID NO: 23223 - protein, 9 aa, Homo Sapiens
RLWFKTNTK

SEQ ID NO: 23224 - protein, 9 aa, Homo Sapiens
RLYEFIVRH

SEQ ID NO: 23225 - protein, 9 aa, Homo Sapiens
RLYERLFQH

SEQ ID NO: 23226 - protein, 9 aa, Homo Sapiens
RLYFSQQTY

SEQ ID NO: 23227 - protein, 9 aa, Homo Sapiens
RLYGGMNYR

SEQ ID NO: 23228 - protein, 9 aa, Homo Sapiens
RLYKPILWR

SEQ ID NO: 23229 - protein, 9 aa, Homo Sapiens
RLYLNVLNR

SEQ ID NO: 23230 - protein, 9 aa, Homo Sapiens
RLYPVFFLK

SEQ ID NO: 23231 - protein, 9 aa, Homo Sapiens
RLYQHAVEY

SEQ ID NO: 23232 - protein, 9 aa, Homo Sapiens
RLYTKFSAR

SEQ ID NO: 23233 - protein, 9 aa, Homo Sapiens
RMFDMGFEY

SEQ ID NO: 23234 - protein, 9 aa, Homo Sapiens
RMNCVLATY

SEQ ID NO: 23235 - protein, 9 aa, Homo Sapiens
RMVEMFLEY

SEQ ID NO: 23236 - protein, 9 aa, Homo Sapiens
RQIDFVLSY

SEQ ID NO: 23237 - protein, 9 aa, Homo Sapiens
RQIPYTMMK

SEQ ID NO: 23238 - protein, 9 aa, Homo Sapiens
RQPEFFFYY

SEQ ID NO: 23239 - protein, 9 aa, Homo Sapiens
RQTATQLLK

SEQ ID NO: 23240 - protein, 9 aa, Homo Sapiens
RQTGIVLNR

SEQ ID NO: 23241 - protein, 9 aa, Homo Sapiens
RQVIPIIGK

SEQ ID NO: 23242 - protein, 9 aa, Homo Sapiens
RQYDKFLTH

SEQ ID NO: 23243 - protein, 9 aa, Homo Sapiens
RQYMHVLQH

SEQ ID NO: 23244 - protein, 9 aa, Homo Sapiens
RSDTPLIYK

SEQ ID NO: 23245 - protein, 9 aa, Homo Sapiens
RSYSDPPLK

SEQ ID NO: 23246 - protein, 9 aa, Homo Sapiens
RTAHVILRY

SEQ ID NO: 23247 - protein, 9 aa, Homo Sapiens
RTAPLLLSY

SEQ ID NO: 23248 - protein, 9 aa, Homo Sapiens
RTAVYSLHK

SEQ ID NO: 23249 - protein, 9 aa, Homo Sapiens
RTEYNLRLK

SEQ ID NO: 23250 - protein, 9 aa, Homo Sapiens
RTFGHLLRY

SEQ ID NO: 23251 - protein, 9 aa, Homo Sapiens
RTFPFSLQY

SEQ ID NO: 23252 - protein, 9 aa, Homo Sapiens
RTFQEVLAY

SEQ ID NO: 23253 - protein, 9 aa, Homo Sapiens
RTIAPIIGR

SEQ ID NO: 23254 - protein, 9 aa, Homo Sapiens
RTIFPLFMK

SEQ ID NO: 23255 - protein, 9 aa, Homo Sapiens
RTIQMFLVY

SEQ ID NO: 23256 - protein, 9 aa, Homo Sapiens
RTLEPLAKK

SEQ ID NO: 23257 - protein, 9 aa, Homo Sapiens
RTLKEILRY

SEQ ID NO: 23258 - protein, 9 aa, Homo Sapiens
RTLPKILSH

SEQ ID NO: 23259 - protein, 9 aa, Homo Sapiens
RTLPVLLLY

SEQ ID NO: 23260 - protein, 9 aa, Homo Sapiens
RTMPIYPTY

SEQ ID NO: 23261 - protein, 9 aa, Homo Sapiens
RTMVKTLEY

SEQ ID NO: 23262 - protein, 9 aa, Homo Sapiens
RTTQILLEY

SEQ ID NO: 23263 - protein, 9 aa, Homo Sapiens
RTTSHLLRY

SEQ ID NO: 23264 - protein, 9 aa, Homo Sapiens
RTWLGYLFY

SEQ ID NO: 23265 - protein, 9 aa, Homo Sapiens
RTYDLYITY

SEQ ID NO: 23266 - protein, 9 aa, Homo Sapiens
RTYDMIQYY

SEQ ID NO: 23267 - protein, 9 aa, Homo Sapiens
RTYYSPVYR

SEQ ID NO: 23268 - protein, 9 aa, Homo Sapiens
RVASPPIKY

SEQ ID NO: 23269 - protein, 9 aa, Homo Sapiens
RVFFPLCGK

SEQ ID NO: 23270 - protein, 9 aa, Homo Sapiens
RVFNIMREK

SEQ ID NO: 23271 - protein, 9 aa, Homo Sapiens
RVFNVFCLY

SEQ ID NO: 23272 - protein, 9 aa, Homo Sapiens
RVFPWFSVK

SEQ ID NO: 23273 - protein, 9 aa, Homo Sapiens
RVFPYSVFY

SEQ ID NO: 23274 - protein, 9 aa, Homo Sapiens
RVFQECLTY

SEQ ID NO: 23275 - protein, 9 aa, Homo Sapiens
RVGDVYIPR

SEQ ID NO: 23276 - protein, 9 aa, Homo Sapiens
RVKEIVINK

SEQ ID NO: 23277 - protein, 9 aa, Homo Sapiens
RVLPEFKKK

SEQ ID NO: 23278 - protein, 9 aa, Homo Sapiens
RVLPYPFTH

SEQ ID NO: 23279 - protein, 9 aa, Homo Sapiens
RVMKALVNR

SEQ ID NO: 23280 - protein, 9 aa, Homo Sapiens
RVNKLICVK

SEQ ID NO: 23281 - protein, 9 aa, Homo Sapiens
RVNVTGIYR

SEQ ID NO: 23282 - protein, 9 aa, Homo Sapiens
RVPDVVLIK

SEQ ID NO: 23283 - protein, 9 aa, Homo Sapiens
RVRDVFEAK

SEQ ID NO: 23284 - protein, 9 aa, Homo Sapiens
RVTDLFIGK

SEQ ID NO: 23285 - protein, 9 aa, Homo Sapiens
RVTPFILKK

SEQ ID NO: 23286 - protein, 9 aa, Homo Sapiens
RVVSYQIRY

SEQ ID NO: 23287 - protein, 9 aa, Homo Sapiens
RVYEVATFY

SEQ ID NO: 23288 - protein, 9 aa, Homo Sapiens
RVYHYFQWR

SEQ ID NO: 23289 - protein, 9 aa, Homo Sapiens
RVYIGRLSY

SEQ ID NO: 23290 - protein, 9 aa, Homo Sapiens
RVYNIYIRR

SEQ ID NO: 23291 - protein, 9 aa, Homo Sapiens
RVYNWDVKR

SEQ ID NO: 23292 - protein, 9 aa, Homo Sapiens
RVYVGSIYY

SEQ ID NO: 23293 - protein, 9 aa, Homo Sapiens
SAFGQAFSK

SEQ ID NO: 23294 - protein, 9 aa, Homo Sapiens
SIAAAVAPK

SEQ ID NO: 23295 - protein, 9 aa, Homo Sapiens
SIAAKILSY

SEQ ID NO: 23296 - protein, 9 aa, Homo Sapiens
SIAPPVPLK

SEQ ID NO: 23297 - protein, 9 aa, Homo Sapiens
SIASWFGLK

SEQ ID NO: 23298 - protein, 9 aa, Homo Sapiens
SIAVPIVLK

SEQ ID NO: 23299 - protein, 9 aa, Homo Sapiens
SIAWFTVFY

SEQ ID NO: 23300 - protein, 9 aa, Homo Sapiens
SIFKQPVTK

SEQ ID NO: 23301 - protein, 9 aa, Homo Sapiens
SIFPYVTTK

SEQ ID NO: 23302 - protein, 9 aa, Homo Sapiens
SIFRTPISK

SEQ ID NO: 23303 - protein, 9 aa, Homo Sapiens
SIFSKFTSK

SEQ ID NO: 23304 - protein, 9 aa, Homo Sapiens
SIFVKILQK

SEQ ID NO: 23305 - protein, 9 aa, Homo Sapiens
SIFVPGTQK

SEQ ID NO: 23306 - protein, 9 aa, Homo Sapiens
SIGDIFLKY

SEQ ID NO: 23307 - protein, 9 aa, Homo Sapiens
SIGQVFLLK

SEQ ID NO: 23308 - protein, 9 aa, Homo Sapiens
SILNNPIVK

SEQ ID NO: 23309 - protein, 9 aa, Homo Sapiens
SILNWVKFK

SEQ ID NO: 23310 - protein, 9 aa, Homo Sapiens
SILPAIFQK

SEQ ID NO: 23311 - protein, 9 aa, Homo Sapiens
SITSVFITK

SEQ ID NO: 23312 - protein, 9 aa, Homo Sapiens
SIWDETLYK

SEQ ID NO: 23313 - protein, 9 aa, Homo Sapiens
SIWDYFIAK

SEQ ID NO: 23314 - protein, 9 aa, Homo Sapiens
SIWSHQMYY

SEQ ID NO: 23315 - protein, 9 aa, Homo Sapiens
SIYFPYVLK

SEQ ID NO: 23316 - protein, 9 aa, Homo Sapiens
SIYPLGDIK

SEQ ID NO: 23317 - protein, 9 aa, Homo Sapiens
SIYVYKVLK

SEQ ID NO: 23318 - protein, 9 aa, Homo Sapiens
SLADFQIEK

SEQ ID NO: 23319 - protein, 9 aa, Homo Sapiens
SLAEILLKK

SEQ ID NO: 23320 - protein, 9 aa, Homo Sapiens
SLAERLLSH

SEQ ID NO: 23321 - protein, 9 aa, Homo Sapiens
SLAPVNIFK

SEQ ID NO: 23322 - protein, 9 aa, Homo Sapiens
SLDIYSRLR

SEQ ID NO: 23323 - protein, 9 aa, Homo Sapiens
SLFEGSLSK

SEQ ID NO: 23324 - protein, 9 aa, Homo Sapiens
SLFGSPVAK

SEQ ID NO: 23325 - protein, 9 aa, Homo Sapiens
SLFHAQLAY

SEQ ID NO: 23326 - protein, 9 aa, Homo Sapiens
SLFNHIYFK

SEQ ID NO: 23327 - protein, 9 aa, Homo Sapiens
SLFNTGFLK

SEQ ID NO: 23328 - protein, 9 aa, Homo Sapiens
SLFSKEAPK

SEQ ID NO: 23329 - protein, 9 aa, Homo Sapiens
SLFSRLFGK

SEQ ID NO: 23330 - protein, 9 aa, Homo Sapiens
SLFTASDYK

SEQ ID NO: 23331 - protein, 9 aa, Homo Sapiens
SLFVPLTVK

SEQ ID NO: 23332 - protein, 9 aa, Homo Sapiens
SLGQVVITK

SEQ ID NO: 23333 - protein, 9 aa, Homo Sapiens
SLGVAALYK

SEQ ID NO: 23334 - protein, 9 aa, Homo Sapiens
SLLDKFLIK

SEQ ID NO: 23335 - protein, 9 aa, Homo Sapiens
SLLGKPLSY

SEQ ID NO: 23336 - protein, 9 aa, Homo Sapiens
SLLGTWIGK

SEQ ID NO: 23337 - protein, 9 aa, Homo Sapiens
SLLGYFPNK

SEQ ID NO: 23338 - protein, 9 aa, Homo Sapiens
SLLHLTLPK

SEQ ID NO: 23339 - protein, 9 aa, Homo Sapiens
SLLNVSTPK

SEQ ID NO: 23340 - protein, 9 aa, Homo Sapiens
SLLPLQPTK

SEQ ID NO: 23341 - protein, 9 aa, Homo Sapiens
SLLSPLLEK

SEQ ID NO: 23342 - protein, 9 aa, Homo Sapiens
SLLSQMLHY

SEQ ID NO: 23343 - protein, 9 aa, Homo Sapiens
SLLSVLIPK

SEQ ID NO: 23344 - protein, 9 aa, Homo Sapiens
SLLYGSIPK

SEQ ID NO: 23345 - protein, 9 aa, Homo Sapiens
SLMHSFILK

SEQ ID NO: 23346 - protein, 9 aa, Homo Sapiens
SLMNVPLFK

SEQ ID NO: 23347 - protein, 9 aa, Homo Sapiens
SLMPWFHGK

SEQ ID NO: 23348 - protein, 9 aa, Homo Sapiens
SLMSVLIPK

SEQ ID NO: 23349 - protein, 9 aa, Homo Sapiens
SLNNKILNR

SEQ ID NO: 23350 - protein, 9 aa, Homo Sapiens
SLNPPIFLK

SEQ ID NO: 23351 - protein, 9 aa, Homo Sapiens
SLNSLLLPK

SEQ ID NO: 23352 - protein, 9 aa, Homo Sapiens
SLNTPGSFR

SEQ ID NO: 23353 - protein, 9 aa, Homo Sapiens
SLSFKVLKH

SEQ ID NO: 23354 - protein, 9 aa, Homo Sapiens
SLSGISLQK

SEQ ID NO: 23355 - protein, 9 aa, Homo Sapiens
SLSPVILIK

SEQ ID NO: 23356 - protein, 9 aa, Homo Sapiens
SLSSPLNPK

SEQ ID NO: 23357 - protein, 9 aa, Homo Sapiens
SLSVPSVSK

SEQ ID NO: 23358 - protein, 9 aa, Homo Sapiens
SLWDRLIFH

SEQ ID NO: 23359 - protein, 9 aa, Homo Sapiens
SLWQFYLSK

SEQ ID NO: 23360 - protein, 9 aa, Homo Sapiens
SLYGPGTNR

SEQ ID NO: 23361 - protein, 9 aa, Homo Sapiens
SLYPKLFQK

SEQ ID NO: 23362 - protein, 9 aa, Homo Sapiens
SLYPQFMFH

SEQ ID NO: 23363 - protein, 9 aa, Homo Sapiens
SLYQYFLSY

SEQ ID NO: 23364 - protein, 9 aa, Homo Sapiens
SLYRNILMY

SEQ ID NO: 23365 - protein, 9 aa, Homo Sapiens
SMFTAILKK

SEQ ID NO: 23366 - protein, 9 aa, Homo Sapiens
SMLEYFINR

SEQ ID NO: 23367 - protein, 9 aa, Homo Sapiens
SMWDYFVAK

SEQ ID NO: 23368 - protein, 9 aa, Homo Sapiens
SSFSGLLRK

SEQ ID NO: 23369 - protein, 9 aa, Homo Sapiens
SSLYIILKK

SEQ ID NO: 23370 - protein, 9 aa, Homo Sapiens
STAAFFLLR

SEQ ID NO: 23371 - protein, 9 aa, Homo Sapiens
STFFYPKLK

SEQ ID NO: 23372 - protein, 9 aa, Homo Sapiens
STFNQVVLK

SEQ ID NO: 23373 - protein, 9 aa, Homo Sapiens
STFSAPLNK

SEQ ID NO: 23374 - protein, 9 aa, Homo Sapiens
STLLNPIPK

SEQ ID NO: 23375 - protein, 9 aa, Homo Sapiens
STLPKPVQK

SEQ ID NO: 23376 - protein, 9 aa, Homo Sapiens
STLPKSLLK

SEQ ID NO: 23377 - protein, 9 aa, Homo Sapiens
STMGYMMAK

SEQ ID NO: 23378 - protein, 9 aa, Homo Sapiens
STYEKALGY

SEQ ID NO: 23379 - protein, 9 aa, Homo Sapiens
SVAKTILKR

SEQ ID NO: 23380 - protein, 9 aa, Homo Sapiens
SVAQLLLSK

SEQ ID NO: 23381 - protein, 9 aa, Homo Sapiens
SVATKLLLY

SEQ ID NO: 23382 - protein, 9 aa, Homo Sapiens
SVAVRVLSY

SEQ ID NO: 23383 - protein, 9 aa, Homo Sapiens
SVFESLIAK

SEQ ID NO: 23384 - protein, 9 aa, Homo Sapiens
SVFGTMPLK

SEQ ID NO: 23385 - protein, 9 aa, Homo Sapiens
SVFNHAIRH

SEQ ID NO: 23386 - protein, 9 aa, Homo Sapiens
SVHWFPVQK

SEQ ID NO: 23387 - protein, 9 aa, Homo Sapiens
SVISSPLLK

SEQ ID NO: 23388 - protein, 9 aa, Homo Sapiens
SVIVQPFSK

SEQ ID NO: 23389 - protein, 9 aa, Homo Sapiens
SVLLFVTKK

SEQ ID NO: 23390 - protein, 9 aa, Homo Sapiens
SVLLPLVAK

SEQ ID NO: 23391 - protein, 9 aa, Homo Sapiens
SVLNFATNR

SEQ ID NO: 23392 - protein, 9 aa, Homo Sapiens
SVLNIPMAK

SEQ ID NO: 23393 - protein, 9 aa, Homo Sapiens
SVLNLVIVK

SEQ ID NO: 23394 - protein, 9 aa, Homo Sapiens
SVLPFQIYY

SEQ ID NO: 23395 - protein, 9 aa, Homo Sapiens
SVLSALTNK

SEQ ID NO: 23396 - protein, 9 aa, Homo Sapiens
SVMGVYVGK

SEQ ID NO: 23397 - protein, 9 aa, Homo Sapiens
SVPAFASSL

SEQ ID NO: 23398 - protein, 9 aa, Homo Sapiens
SVPLPISHK

SEQ ID NO: 23399 - protein, 9 aa, Homo Sapiens
SVPVSLQTL

SEQ ID NO: 23400 - protein, 9 aa, Homo Sapiens
SVSIPSITK

SEQ ID NO: 23401 - protein, 9 aa, Homo Sapiens
SVSNVVITK

SEQ ID NO: 23402 - protein, 9 aa, Homo Sapiens
SVSPFLLGR

SEQ ID NO: 23403 - protein, 9 aa, Homo Sapiens
SVVGLFLRH

SEQ ID NO: 23404 - protein, 9 aa, Homo Sapiens
SVYFPTLRH

SEQ ID NO: 23405 - protein, 9 aa, Homo Sapiens
SVYVYKVLK

SEQ ID NO: 23406 - protein, 9 aa, Homo Sapiens
TIFGKIIRK

SEQ ID NO: 23407 - protein, 9 aa, Homo Sapiens
TIFTARLYY

SEQ ID NO: 23408 - protein, 9 aa, Homo Sapiens
TIFVPNTGK

SEQ ID NO: 23409 - protein, 9 aa, Homo Sapiens
TIGKEIIDL

SEQ ID NO: 23410 - protein, 9 aa, Homo Sapiens
TISAARLYY

SEQ ID NO: 23411 - protein, 9 aa, Homo Sapiens
TISPPLQPK

SEQ ID NO: 23412 - protein, 9 aa, Homo Sapiens
TIYSISSLK

SEQ ID NO: 23413 - protein, 9 aa, Homo Sapiens
TLAAWLINK

SEQ ID NO: 23414 - protein, 9 aa, Homo Sapiens
TLADILLYY

SEQ ID NO: 23415 - protein, 9 aa, Homo Sapiens
TLAFKPIKK

SEQ ID NO: 23416 - protein, 9 aa, Homo Sapiens
TLALWPVSK

SEQ ID NO: 23417 - protein, 9 aa, Homo Sapiens
TLAVNIIAK

SEQ ID NO: 23418 - protein, 9 aa, Homo Sapiens
TLCKPLVPR

SEQ ID NO: 23419 - protein, 9 aa, Homo Sapiens
TLFASIILK

SEQ ID NO: 23420 - protein, 9 aa, Homo Sapiens
TLFGKAILR

SEQ ID NO: 23421 - protein, 9 aa, Homo Sapiens
TLFNLGLTK

SEQ ID NO: 23422 - protein, 9 aa, Homo Sapiens
TLGPALLQK

SEQ ID NO: 23423 - protein, 9 aa, Homo Sapiens
TLLDLMIAK

SEQ ID NO: 23424 - protein, 9 aa, Homo Sapiens
TLLEKQLEY

SEQ ID NO: 23425 - protein, 9 aa, Homo Sapiens
TLPTSTLQY

SEQ ID NO: 23426 - protein, 9 aa, Homo Sapiens
TLQGPVSFK

SEQ ID NO: 23427 - protein, 9 aa, Homo Sapiens
TLSGWILSK

SEQ ID NO: 23428 - protein, 9 aa, Homo Sapiens
TLSNQPLLK

SEQ ID NO: 23429 - protein, 9 aa, Homo Sapiens
TLYFNTQEK

SEQ ID NO: 23430 - protein, 9 aa, Homo Sapiens
TLYISECLK

SEQ ID NO: 23431 - protein, 9 aa, Homo Sapiens
TLYRIFNNK

SEQ ID NO: 23432 - protein, 9 aa, Homo Sapiens
TMCPHILRY

SEQ ID NO: 23433 - protein, 9 aa, Homo Sapiens
TSALPIIQK

SEQ ID NO: 23434 - protein, 9 aa, Homo Sapiens
TSLPPLPFK

SEQ ID NO: 23435 - protein, 9 aa, Homo Sapiens
TTVPHVFSK

SEQ ID NO: 23436 - protein, 9 aa, Homo Sapiens
TVAECVLYY

SEQ ID NO: 23437 - protein, 9 aa, Homo Sapiens
TVAKIILIH

SEQ ID NO: 23438 - protein, 9 aa, Homo Sapiens
TVAVPLVGK

SEQ ID NO: 23439 - protein, 9 aa, Homo Sapiens
TVSDAILRY

SEQ ID NO: 23440 - protein, 9 aa, Homo Sapiens
TVSRFFLYR

SEQ ID NO: 23441 - protein, 9 aa, Homo Sapiens
TVTAQILLK

SEQ ID NO: 23442 - protein, 9 aa, Homo Sapiens
TVTEVLLKY

SEQ ID NO: 23443 - protein, 9 aa, Homo Sapiens
TVTSYVFLK

SEQ ID NO: 23444 - protein, 9 aa, Homo Sapiens
TVWNKPTVK

SEQ ID NO: 23445 - protein, 9 aa, Homo Sapiens
TVYPVAIKY

SEQ ID NO: 23446 - protein, 9 aa, Homo Sapiens
VGLNVFLEK

SEQ ID NO: 23447 - protein, 9 aa, Homo Sapiens
VIFKDFVNK

SEQ ID NO: 23448 - protein, 9 aa, Homo Sapiens
VIIAKVTAK

SEQ ID NO: 23449 - protein, 9 aa, Homo Sapiens
VILFWFPLK

SEQ ID NO: 23450 - protein, 9 aa, Homo Sapiens
VILPPLSPY

SEQ ID NO: 23451 - protein, 9 aa, Homo Sapiens
VIPTNVPEL

SEQ ID NO: 23452 - protein, 9 aa, Homo Sapiens
VISPPTVPK

SEQ ID NO: 23453 - protein, 9 aa, Homo Sapiens
VIYPLAVPK

SEQ ID NO: 23454 - protein, 9 aa, Homo Sapiens
VIYVPLTDK

SEQ ID NO: 23455 - protein, 9 aa, Homo Sapiens
VLADVILLK

SEQ ID NO: 23456 - protein, 9 aa, Homo Sapiens
VLAGTQLLY

SEQ ID NO: 23457 - protein, 9 aa, Homo Sapiens
VLAPVIDLK

SEQ ID NO: 23458 - protein, 9 aa, Homo Sapiens
VLFEHAVGY

SEQ ID NO: 23459 - protein, 9 aa, Homo Sapiens
VLFFHTMRY

SEQ ID NO: 23460 - protein, 9 aa, Homo Sapiens
VLFHNTIYY

SEQ ID NO: 23461 - protein, 9 aa, Homo Sapiens
VLFSATLPK

SEQ ID NO: 23462 - protein, 9 aa, Homo Sapiens
VLFVSVLPF

SEQ ID NO: 23463 - protein, 9 aa, Homo Sapiens
VLGQFLVLK

SEQ ID NO: 23464 - protein, 9 aa, Homo Sapiens
VLGTVVHGK

SEQ ID NO: 23465 - protein, 9 aa, Homo Sapiens
VLMPKVMHY

SEQ ID NO: 23466 - protein, 9 aa, Homo Sapiens
VLNGNPLLH

SEQ ID NO: 23467 - protein, 9 aa, Homo Sapiens
VLNLVIVKK

SEQ ID NO: 23468 - protein, 9 aa, Homo Sapiens
VLNNSLLLH

SEQ ID NO: 23469 - protein, 9 aa, Homo Sapiens
VLNPTPIKR

SEQ ID NO: 23470 - protein, 9 aa, Homo Sapiens
VLPLFVLSK

SEQ ID NO: 23471 - protein, 9 aa, Homo Sapiens
VLPTFILEK

SEQ ID NO: 23472 - protein, 9 aa, Homo Sapiens
VLPTFILER

SEQ ID NO: 23473 - protein, 9 aa, Homo Sapiens
VLSAQQILH

SEQ ID NO: 23474 - protein, 9 aa, Homo Sapiens
VLTTPWKFK

SEQ ID NO: 23475 - protein, 9 aa, Homo Sapiens
VLYDRVLKY

SEQ ID NO: 23476 - protein, 9 aa, Homo Sapiens
VLYLKPLRI

SEQ ID NO: 23477 - protein, 9 aa, Homo Sapiens
VLYNGFTGR

SEQ ID NO: 23478 - protein, 9 aa, Homo Sapiens
VLYQPLFDK

SEQ ID NO: 23479 - protein, 9 aa, Homo Sapiens
VLYSLQICK

SEQ ID NO: 23480 - protein, 9 aa, Homo Sapiens
VMGAYVLLK

SEQ ID NO: 23481 - protein, 9 aa, Homo Sapiens
VMHTPPVLK

SEQ ID NO: 23482 - protein, 9 aa, Homo Sapiens
VMLGTQLLY

SEQ ID NO: 23483 - protein, 9 aa, Homo Sapiens
VSFPIGIYK

SEQ ID NO: 23484 - protein, 9 aa, Homo Sapiens
VSLGTPIMK

SEQ ID NO: 23485 - protein, 9 aa, Homo Sapiens
VTAPIALLK

SEQ ID NO: 23486 - protein, 9 aa, Homo Sapiens
VTFVPGLYK

SEQ ID NO: 23487 - protein, 9 aa, Homo Sapiens
VTISFRIYK

SEQ ID NO: 23488 - protein, 9 aa, Homo Sapiens
VTISIELKK

SEQ ID NO: 23489 - protein, 9 aa, Homo Sapiens
VVCEYIVKK

SEQ ID NO: 23490 - protein, 9 aa, Homo Sapiens
VVDPVVREK

SEQ ID NO: 23491 - protein, 9 aa, Homo Sapiens
VVFPFPVNK

SEQ ID NO: 23492 - protein, 9 aa, Homo Sapiens
VVGAVVFQK

SEQ ID NO: 23493 - protein, 9 aa, Homo Sapiens
VVGPVSLPR

SEQ ID NO: 23494 - protein, 9 aa, Homo Sapiens
VVLYPLVAK

SEQ ID NO: 23495 - protein, 9 aa, Homo Sapiens
VVNEPRIFK

SEQ ID NO: 23496 - protein, 9 aa, Homo Sapiens
VVNSYPLAH

SEQ ID NO: 23497 - protein, 9 aa, Homo Sapiens
VVPPFLQPE

SEQ ID NO: 23498 - protein, 9 aa, Homo Sapiens
VVYAPLSKK

SEQ ID NO: 23499 - protein, 9 aa, Homo Sapiens
VVYEKQMLY

SEQ ID NO: 23500 - protein, 9 aa, Homo Sapiens
VVYPKVIER

SEQ ID NO: 23501 - protein, 9 aa, Homo Sapiens
VVYQYWNTK

SEQ ID NO: 23502 - protein, 9 aa, Homo Sapiens
YCPGMGVAL

SEQ ID NO: 23503 - protein, 9 aa, Homo Sapiens
YIFKVFAEK

SEQ ID NO: 23504 - protein, 9 aa, Homo Sapiens
YILSPLSYK

SEQ ID NO: 23505 - protein, 9 aa, Homo Sapiens
YLYITKVLK

SEQ ID NO: 23506 - protein, 9 aa, Homo Sapiens
YPFPGPIPN

SEQ ID NO: 23507 - protein, 9 aa, Homo Sapiens
YQEPVLGPV

SEQ ID NO: 23508 - protein, 9 aa, Homo Sapiens
YTFDWTMLK

SEQ ID NO: 23509 - protein, 9 aa, Homo Sapiens
YVFPKPFNR

SEQ ID NO: 23510 - protein, 9 aa, Homo Sapiens
YVYFTNELK

SEQ ID NO: 23511 - protein, 10 aa, Homo Sapiens
AIAAVAVALK

SEQ ID NO: 23512 - protein, 10 aa, Homo Sapiens
AIFPATFCQK

SEQ ID NO: 23513 - protein, 10 aa, Homo Sapiens
AIFVPIHLVK

SEQ ID NO: 23514 - protein, 10 aa, Homo Sapiens
AIIDHIFASK

SEQ ID NO: 23515 - protein, 10 aa, Homo Sapiens
AILEYILHQK

SEQ ID NO: 23516 - protein, 10 aa, Homo Sapiens
AIYATIPVYK

SEQ ID NO: 23517 - protein, 10 aa, Homo Sapiens
ALALGVTLLK

SEQ ID NO: 23518 - protein, 10 aa, Homo Sapiens
ALFAKPLKGK

SEQ ID NO: 23519 - protein, 10 aa, Homo Sapiens
ALFKAWALFK

SEQ ID NO: 23520 - protein, 10 aa, Homo Sapiens
ALFKNLLLKK

SEQ ID NO: 23521 - protein, 10 aa, Homo Sapiens
ALIEELLLYK

SEQ ID NO: 23522 - protein, 10 aa, Homo Sapiens
ALIGFPSVGK

SEQ ID NO: 23523 - protein, 10 aa, Homo Sapiens
ALKNPPINTK

SEQ ID NO: 23524 - protein, 10 aa, Homo Sapiens
ALLAYTLGVK

SEQ ID NO: 23525 - protein, 10 aa, Homo Sapiens
ALLPWPFKQK

SEQ ID NO: 23526 - protein, 10 aa, Homo Sapiens
ALLPWPFRNK

SEQ ID NO: 23527 - protein, 10 aa, Homo Sapiens
ALRQEVDTLK

SEQ ID NO: 23528 - protein, 10 aa, Homo Sapiens
ALVFPPLTQR

SEQ ID NO: 23529 - protein, 10 aa, Homo Sapiens
ALWEEQVLQK

SEQ ID NO: 23530 - protein, 10 aa, Homo Sapiens
ALYETPTGWK

SEQ ID NO: 23531 - protein, 10 aa, Homo Sapiens
ALYGNLILRK

SEQ ID NO: 23532 - protein, 10 aa, Homo Sapiens
AMYNQGFIRK

SEQ ID NO: 23533 - protein, 10 aa, Homo Sapiens
AMYSRKAMYK

SEQ ID NO: 23534 - protein, 10 aa, Homo Sapiens
AQKFPFNTPK

SEQ ID NO: 23535 - protein, 10 aa, Homo Sapiens
AQYQFTGIKK

SEQ ID NO: 23536 - protein, 10 aa, Homo Sapiens
ASFDGTFLWK

SEQ ID NO: 23537 - protein, 10 aa, Homo Sapiens
ASLLNVSTPK

SEQ ID NO: 23538 - protein, 10 aa, Homo Sapiens
ATEESFFILK

SEQ ID NO: 23539 - protein, 10 aa, Homo Sapiens
ATGDMSGLLK

SEQ ID NO: 23540 - protein, 10 aa, Homo Sapiens
ATGSWDSFLK

SEQ ID NO: 23541 - protein, 10 aa, Homo Sapiens
ATIGFSLVAK

SEQ ID NO: 23542 - protein, 10 aa, Homo Sapiens
ATLKWILENK

SEQ ID NO: 23543 - protein, 10 aa, Homo Sapiens
ATLSQFYINK

SEQ ID NO: 23544 - protein, 10 aa, Homo Sapiens
ATNKITIIFK

SEQ ID NO: 23545 - protein, 10 aa, Homo Sapiens
ATPLSTLSLK

SEQ ID NO: 23546 - protein, 10 aa, Homo Sapiens
ATQVAVSVPK

SEQ ID NO: 23547 - protein, 10 aa, Homo Sapiens
ATVAVPLVGK

SEQ ID NO: 23548 - protein, 10 aa, Homo Sapiens
ATWATKELRK

SEQ ID NO: 23549 - protein, 10 aa, Homo Sapiens
ATWTYSPLLK

SEQ ID NO: 23550 - protein, 10 aa, Homo Sapiens
AVANIVNSVK

SEQ ID NO: 23551 - protein, 10 aa, Homo Sapiens
AVAVDVAVPK

SEQ ID NO: 23552 - protein, 10 aa, Homo Sapiens
AVFGAGGVGK

SEQ ID NO: 23553 - protein, 10 aa, Homo Sapiens
AVFGVIGSQK

SEQ ID NO: 23554 - protein, 10 aa, Homo Sapiens
AVFPFKPPQR

SEQ ID NO: 23555 - protein, 10 aa, Homo Sapiens
AVFPKPFVEK

SEQ ID NO: 23556 - protein, 10 aa, Homo Sapiens
AVIENPEMLK

SEQ ID NO: 23557 - protein, 10 aa, Homo Sapiens
AVISPPTVPK

SEQ ID NO: 23558 - protein, 10 aa, Homo Sapiens
AVLKHVLTPR

SEQ ID NO: 23559 - protein, 10 aa, Homo Sapiens
AVLPYELRFK

SEQ ID NO: 23560 - protein, 10 aa, Homo Sapiens
AVLRNQIHVK

SEQ ID NO: 23561 - protein, 10 aa, Homo Sapiens
AVLYQPLFDK

SEQ ID NO: 23562 - protein, 10 aa, Homo Sapiens
AVMGAYVLLK

SEQ ID NO: 23563 - protein, 10 aa, Homo Sapiens
AVNAHSNILK

SEQ ID NO: 23564 - protein, 10 aa, Homo Sapiens
AVNEVVAGIK

SEQ ID NO: 23565 - protein, 10 aa, Homo Sapiens
AVNPYFDIPK

SEQ ID NO: 23566 - protein, 10 aa, Homo Sapiens
AVPTNIIAAK

SEQ ID NO: 23567 - protein, 10 aa, Homo Sapiens
AVREEVEILK

SEQ ID NO: 23568 - protein, 10 aa, Homo Sapiens
AVWDVGSHFK

SEQ ID NO: 23569 - protein, 10 aa, Homo Sapiens
DTNADKQLSF

SEQ ID NO: 23570 - protein, 10 aa, Homo Sapiens
FPEILLIVLK

SEQ ID NO: 23571 - protein, 10 aa, Homo Sapiens
FQAPYLLHGK

SEQ ID NO: 23572 - protein, 10 aa, Homo Sapiens
FTFDNVLPGK

SEQ ID NO: 23573 - protein, 10 aa, Homo Sapiens
FVYPGNPLRH

SEQ ID NO: 23574 - protein, 10 aa, Homo Sapiens
GIFPGTPLKK

SEQ ID NO: 23575 - protein, 10 aa, Homo Sapiens
GIISSPLTGK

SEQ ID NO: 23576 - protein, 10 aa, Homo Sapiens
GIKDWVTPYK

SEQ ID NO: 23577 - protein, 10 aa, Homo Sapiens
GIKSGRMIFK

SEQ ID NO: 23578 - protein, 10 aa, Homo Sapiens
GIYPPGSPGK

SEQ ID NO: 23579 - protein, 10 aa, Homo Sapiens
GLAGLPGSPK

SEQ ID NO: 23580 - protein, 10 aa, Homo Sapiens
GLFGGAGVGK

SEQ ID NO: 23581 - protein, 10 aa, Homo Sapiens
GLLEKIATPK

SEQ ID NO: 23582 - protein, 10 aa, Homo Sapiens
GLPLSPGLPK

SEQ ID NO: 23583 - protein, 10 aa, Homo Sapiens
GLRGFPNVLK

SEQ ID NO: 23584 - protein, 10 aa, Homo Sapiens
GLYAGDPVSK

SEQ ID NO: 23585 - protein, 10 aa, Homo Sapiens
GLYGGLPPTH

SEQ ID NO: 23586 - protein, 10 aa, Homo Sapiens
GLYHGQVLCK

SEQ ID NO: 23587 - protein, 10 aa, Homo Sapiens
GNCPERIITL

SEQ ID NO: 23588 - protein, 10 aa, Homo Sapiens
GQFSGFPFEK

SEQ ID NO: 23589 - protein, 10 aa, Homo Sapiens
GSYDPQQIFK

SEQ ID NO: 23590 - protein, 10 aa, Homo Sapiens
GSYNKVFLAK

SEQ ID NO: 23591 - protein, 10 aa, Homo Sapiens
GTAIIQLPSK

SEQ ID NO: 23592 - protein, 10 aa, Homo Sapiens
GTFNRAMLRL

SEQ ID NO: 23593 - protein, 10 aa, Homo Sapiens
GTFQQMWISK

SEQ ID NO: 23594 - protein, 10 aa, Homo Sapiens
GTILIILTGR

SEQ ID NO: 23595 - protein, 10 aa, Homo Sapiens
GTIPGNPYPK

SEQ ID NO: 23596 - protein, 10 aa, Homo Sapiens
GTSHLPGLLK

SEQ ID NO: 23597 - protein, 10 aa, Homo Sapiens
GTWKTPSFPK

SEQ ID NO: 23598 - protein, 10 aa, Homo Sapiens
GVFRGPVLPK

SEQ ID NO: 23599 - protein, 10 aa, Homo Sapiens
GVIGFPNVGK

SEQ ID NO: 23600 - protein, 10 aa, Homo Sapiens
GVLDAILATK

SEQ ID NO: 23601 - protein, 10 aa, Homo Sapiens
GVLPSALNPK

SEQ ID NO: 23602 - protein, 10 aa, Homo Sapiens
HIRESLPALR

SEQ ID NO: 23603 - protein, 10 aa, Homo Sapiens
HLFEHILNGY

SEQ ID NO: 23604 - protein, 10 aa, Homo Sapiens
HLINAFHTPK

SEQ ID NO: 23605 - protein, 10 aa, Homo Sapiens
HLIRAPLAGK

SEQ ID NO: 23606 - protein, 10 aa, Homo Sapiens
HLLDIQGLPK

SEQ ID NO: 23607 - protein, 10 aa, Homo Sapiens
HLLETPLVVK

SEQ ID NO: 23608 - protein, 10 aa, Homo Sapiens
HLYNSLTRNK

SEQ ID NO: 23609 - protein, 10 aa, Homo Sapiens
HTRTPPIIHR

SEQ ID NO: 23610 - protein, 10 aa, Homo Sapiens
HVIETLIGKK

SEQ ID NO: 23611 - protein, 10 aa, Homo Sapiens
HVYDGKFLAR

SEQ ID NO: 23612 - protein, 10 aa, Homo Sapiens
HVYVGNISKK

SEQ ID NO: 23613 - protein, 10 aa, Homo Sapiens
IALWPPVREK

SEQ ID NO: 23614 - protein, 10 aa, Homo Sapiens
IIDEQPLIFK

SEQ ID NO: 23615 - protein, 10 aa, Homo Sapiens
IIFGPPGTGK

SEQ ID NO: 23616 - protein, 10 aa, Homo Sapiens
IIFVGTPVQK

SEQ ID NO: 23617 - protein, 10 aa, Homo Sapiens
IIWLPTGAGK

SEQ ID NO: 23618 - protein, 10 aa, Homo Sapiens
IIYPTAPPRF

SEQ ID NO: 23619 - protein, 10 aa, Homo Sapiens
ILAGLGFTPK

SEQ ID NO: 23620 - protein, 10 aa, Homo Sapiens
ILFPHQPLSR

SEQ ID NO: 23621 - protein, 10 aa, Homo Sapiens
ILFPLRFTLK

SEQ ID NO: 23622 - protein, 10 aa, Homo Sapiens
ILYGPPGTGK

SEQ ID NO: 23623 - protein, 10 aa, Homo Sapiens
ILYSSKLYRF

SEQ ID NO: 23624 - protein, 10 aa, Homo Sapiens
ILYVGSMPLK

SEQ ID NO: 23625 - protein, 10 aa, Homo Sapiens
IQFNPPLSEK

SEQ ID NO: 23626 - protein, 10 aa, Homo Sapiens
IQNVPLSEKI

SEQ ID NO: 23627 - protein, 10 aa, Homo Sapiens
ISAPKPGPLK

SEQ ID NO: 23628 - protein, 10 aa, Homo Sapiens
ISFPATGCQK

SEQ ID NO: 23629 - protein, 10 aa, Homo Sapiens
ITFDVAPSRL

SEQ ID NO: 23630 - protein, 10 aa, Homo Sapiens
ITFGIREDLK

SEQ ID NO: 23631 - protein, 10 aa, Homo Sapiens
ITWERIISHF

SEQ ID NO: 23632 - protein, 10 aa, Homo Sapiens
IVLGLPLWWK

SEQ ID NO: 23633 - protein, 10 aa, Homo Sapiens
IVLYFKLRSK

SEQ ID NO: 23634 - protein, 10 aa, Homo Sapiens
IVNENLVERF

SEQ ID NO: 23635 - protein, 10 aa, Homo Sapiens
IVREDLLSAK

SEQ ID NO: 23636 - protein, 10 aa, Homo Sapiens
IVYAVDFNHK

SEQ ID NO: 23637 - protein, 10 aa, Homo Sapiens
KAFNQGKIFK

SEQ ID NO: 23638 - protein, 10 aa, Homo Sapiens
KASEVFLQRL

SEQ ID NO: 23639 - protein, 10 aa, Homo Sapiens
KIADMGHLKY

SEQ ID NO: 23640 - protein, 10 aa, Homo Sapiens
KIFNVAIPRF

SEQ ID NO: 23641 - protein, 10 aa, Homo Sapiens
KIKEIAVTVK

SEQ ID NO: 23642 - protein, 10 aa, Homo Sapiens
KILNLRFLGK

SEQ ID NO: 23643 - protein, 10 aa, Homo Sapiens
KIRQDSVTKL

SEQ ID NO: 23644 - protein, 10 aa, Homo Sapiens
KITVPASQKL

SEQ ID NO: 23645 - protein, 10 aa, Homo Sapiens
KLADQIFAYY

SEQ ID NO: 23646 - protein, 10 aa, Homo Sapiens
KLAYTLLNKL

SEQ ID NO: 23647 - protein, 10 aa, Homo Sapiens
KLCNIFSTKF

SEQ ID NO: 23648 - protein, 10 aa, Homo Sapiens
KLFDFVNAKK

SEQ ID NO: 23649 - protein, 10 aa, Homo Sapiens
KLFDHAVSKF

SEQ ID NO: 23650 - protein, 10 aa, Homo Sapiens
KLFGETTLVK

SEQ ID NO: 23651 - protein, 10 aa, Homo Sapiens
KLFIPWTNQK

SEQ ID NO: 23652 - protein, 10 aa, Homo Sapiens
KLFNGTFLKA

SEQ ID NO: 23653 - protein, 10 aa, Homo Sapiens
KLFPGSPAIY

SEQ ID NO: 23654 - protein, 10 aa, Homo Sapiens
KLFSELPLAK

SEQ ID NO: 23655 - protein, 10 aa, Homo Sapiens
KLGGVIKEKL

SEQ ID NO: 23656 - protein, 10 aa, Homo Sapiens
KLGIKSLVSK

SEQ ID NO: 23657 - protein, 10 aa, Homo Sapiens
KLIDIVSSQK

SEQ ID NO: 23658 - protein, 10 aa, Homo Sapiens
KLIENPLLRY

SEQ ID NO: 23659 - protein, 10 aa, Homo Sapiens
KLKEGGLIDK

SEQ ID NO: 23660 - protein, 10 aa, Homo Sapiens
KLLNYAPLEK

SEQ ID NO: 23661 - protein, 10 aa, Homo Sapiens
KLMENTFVSK

SEQ ID NO: 23662 - protein, 10 aa, Homo Sapiens
KLNIRPLLRL

SEQ ID NO: 23663 - protein, 10 aa, Homo Sapiens
KLNPQQAPLY

SEQ ID NO: 23664 - protein, 10 aa, Homo Sapiens
KLNPYAKTMR

SEQ ID NO: 23665 - protein, 10 aa, Homo Sapiens
KLNVGGALYY

SEQ ID NO: 23666 - protein, 10 aa, Homo Sapiens
KLPEYFFENK

SEQ ID NO: 23667 - protein, 10 aa, Homo Sapiens
KLPKQPVIVK

SEQ ID NO: 23668 - protein, 10 aa, Homo Sapiens
KLPLPLPPRL

SEQ ID NO: 23669 - protein, 10 aa, Homo Sapiens
KLPTRPGLNK

SEQ ID NO: 23670 - protein, 10 aa, Homo Sapiens
KLREPNFTLK

SEQ ID NO: 23671 - protein, 10 aa, Homo Sapiens
KLVSFGRTLT

SEQ ID NO: 23672 - protein, 10 aa, Homo Sapiens
KLWDEVLSHL

SEQ ID NO: 23673 - protein, 10 aa, Homo Sapiens
KLWLDAYLHK

SEQ ID NO: 23674 - protein, 10 aa, Homo Sapiens
KLYAWELAFK

SEQ ID NO: 23675 - protein, 10 aa, Homo Sapiens
KLYEKKLLKL

SEQ ID NO: 23676 - protein, 10 aa, Homo Sapiens
KLYQEMFAWK

SEQ ID NO: 23677 - protein, 10 aa, Homo Sapiens
KLYQFNPAFF

SEQ ID NO: 23678 - protein, 10 aa, Homo Sapiens
KLYRPGSVAY

SEQ ID NO: 23679 - protein, 10 aa, Homo Sapiens
KLYSKHFTLK

SEQ ID NO: 23680 - protein, 10 aa, Homo Sapiens
KMAEVIGSKL

SEQ ID NO: 23681 - protein, 10 aa, Homo Sapiens
KMALPMPTKR

SEQ ID NO: 23682 - protein, 10 aa, Homo Sapiens
KMHIPLEVRL

SEQ ID NO: 23683 - protein, 10 aa, Homo Sapiens
KMMADYGIRK

SEQ ID NO: 23684 - protein, 10 aa, Homo Sapiens
KMMDVTVTIK

SEQ ID NO: 23685 - protein, 10 aa, Homo Sapiens
KMYEEHLKRM

SEQ ID NO: 23686 - protein, 10 aa, Homo Sapiens
KQFDAVLPGY

SEQ ID NO: 23687 - protein, 10 aa, Homo Sapiens
KSFDTSLIRK

SEQ ID NO: 23688 - protein, 10 aa, Homo Sapiens
KSFPGIPLHH

SEQ ID NO: 23689 - protein, 10 aa, Homo Sapiens
KSKVFFGLLK

SEQ ID NO: 23690 - protein, 10 aa, Homo Sapiens
KSLDQAISRF

SEQ ID NO: 23691 - protein, 10 aa, Homo Sapiens
KSNSIIVSPR

SEQ ID NO: 23692 - protein, 10 aa, Homo Sapiens
KTKELIGSMK

SEQ ID NO: 23693 - protein, 10 aa, Homo Sapiens
KTLDEILQEK

SEQ ID NO: 23694 - protein, 10 aa, Homo Sapiens
KTLERSYLLK

SEQ ID NO: 23695 - protein, 10 aa, Homo Sapiens
KTTAQVLIRF

SEQ ID NO: 23696 - protein, 10 aa, Homo Sapiens
KTYEVSLREK

SEQ ID NO: 23697 - protein, 10 aa, Homo Sapiens
KVCNPIITKL

SEQ ID NO: 23698 - protein, 10 aa, Homo Sapiens
KVFDGIPPPY

SEQ ID NO: 23699 - protein, 10 aa, Homo Sapiens
KVFEVHVRPK

SEQ ID NO: 23700 - protein, 10 aa, Homo Sapiens
KVGFFKRNLK

SEQ ID NO: 23701 - protein, 10 aa, Homo Sapiens
KVKAPPSVPR

SEQ ID NO: 23702 - protein, 10 aa, Homo Sapiens
KVLENIELNK

SEQ ID NO: 23703 - protein, 10 aa, Homo Sapiens
KVLFPLLTKL

SEQ ID NO: 23704 - protein, 10 aa, Homo Sapiens
KVNIIPIIAK

SEQ ID NO: 23705 - protein, 10 aa, Homo Sapiens
KVNIIPVIAK

SEQ ID NO: 23706 - protein, 10 aa, Homo Sapiens
KVNIVPVIAK

SEQ ID NO: 23707 - protein, 10 aa, Homo Sapiens
KVPQLEIVPN

SEQ ID NO: 23708 - protein, 10 aa, Homo Sapiens
KVWSDPFGRK

SEQ ID NO: 23709 - protein, 10 aa, Homo Sapiens
KVYHLASVRL

SEQ ID NO: 23710 - protein, 10 aa, Homo Sapiens
KVYLGDIPLK

SEQ ID NO: 23711 - protein, 10 aa, Homo Sapiens
LADLLVPTKA

SEQ ID NO: 23712 - protein, 10 aa, Homo Sapiens
LAVALAFIIK

SEQ ID NO: 23713 - protein, 10 aa, Homo Sapiens
LIISSMITGV

SEQ ID NO: 23714 - protein, 10 aa, Homo Sapiens
LINPSLIGSK

SEQ ID NO: 23715 - protein, 10 aa, Homo Sapiens
LIYKHTKLLK

SEQ ID NO: 23716 - protein, 10 aa, Homo Sapiens
LIYVAGGLTK

SEQ ID NO: 23717 - protein, 10 aa, Homo Sapiens
LLAEKVLAGK

SEQ ID NO: 23718 - protein, 10 aa, Homo Sapiens
LLFPYILPPK

SEQ ID NO: 23719 - protein, 10 aa, Homo Sapiens
LLFQPLDLLK

SEQ ID NO: 23720 - protein, 10 aa, Homo Sapiens
LLNGKVGSFK

SEQ ID NO: 23721 - protein, 10 aa, Homo Sapiens
LLREQVAQLK

SEQ ID NO: 23722 - protein, 10 aa, Homo Sapiens
LLRVTPFILK

SEQ ID NO: 23723 - protein, 10 aa, Homo Sapiens
LSLGVAALYK

SEQ ID NO: 23724 - protein, 10 aa, Homo Sapiens
LVFINPFGGK

SEQ ID NO: 23725 - protein, 10 aa, Homo Sapiens
LVFPSEIVGK

SEQ ID NO: 23726 - protein, 10 aa, Homo Sapiens
LVNQDILENK

SEQ ID NO: 23727 - protein, 10 aa, Homo Sapiens
MLFPGSIALK

SEQ ID NO: 23728 - protein, 10 aa, Homo Sapiens
MLRQIIGQAK

SEQ ID NO: 23729 - protein, 10 aa, Homo Sapiens
MLYAAEMIPK

SEQ ID NO: 23730 - protein, 10 aa, Homo Sapiens
MLYPAYYSYK

SEQ ID NO: 23731 - protein, 10 aa, Homo Sapiens
MLYQTINSLK

SEQ ID NO: 23732 - protein, 10 aa, Homo Sapiens
MRIFVDIEKL

SEQ ID NO: 23733 - protein, 10 aa, Homo Sapiens
MVYDSPLCRL

SEQ ID NO: 23734 - protein, 10 aa, Homo Sapiens
NVYPSKPLTK

SEQ ID NO: 23735 - protein, 10 aa, Homo Sapiens
QIFVKTLTGK

SEQ ID NO: 23736 - protein, 10 aa, Homo Sapiens
QIPQLPAPPK

SEQ ID NO: 23737 - protein, 10 aa, Homo Sapiens
QLFTDGITNK

SEQ ID NO: 23738 - protein, 10 aa, Homo Sapiens
QLPEAPVIGK

SEQ ID NO: 23739 - protein, 10 aa, Homo Sapiens
QLSQIPLLGK

SEQ ID NO: 23740 - protein, 10 aa, Homo Sapiens
QLYWSHPRKF

SEQ ID NO: 23741 - protein, 10 aa, Homo Sapiens
QSFDKEWVAK

SEQ ID NO: 23742 - protein, 10 aa, Homo Sapiens
QVVSLPLLKP

SEQ ID NO: 23743 - protein, 10 aa, Homo Sapiens
RAFSFSKTPK

SEQ ID NO: 23744 - protein, 10 aa, Homo Sapiens
RIAYFTLPKT

SEQ ID NO: 23745 - protein, 10 aa, Homo Sapiens
RICPILMEKL

SEQ ID NO: 23746 - protein, 10 aa, Homo Sapiens
RIFTLKPVRK

SEQ ID NO: 23747 - protein, 10 aa, Homo Sapiens
RIFVYFITKL

SEQ ID NO: 23748 - protein, 10 aa, Homo Sapiens
RIHPVSTMVK

SEQ ID NO: 23749 - protein, 10 aa, Homo Sapiens
RIIEETLALK

SEQ ID NO: 23750 - protein, 10 aa, Homo Sapiens
RIIPHLPAPK

SEQ ID NO: 23751 - protein, 10 aa, Homo Sapiens
RIKSNQISKL

SEQ ID NO: 23752 - protein, 10 aa, Homo Sapiens
RILKHILTQR

SEQ ID NO: 23753 - protein, 10 aa, Homo Sapiens
RILSGPFVQK

SEQ ID NO: 23754 - protein, 10 aa, Homo Sapiens
RINFYKKTYK

SEQ ID NO: 23755 - protein, 10 aa, Homo Sapiens
RIREPALLSK

SEQ ID NO: 23756 - protein, 10 aa, Homo Sapiens
RISDVHFSVK

SEQ ID NO: 23757 - protein, 10 aa, Homo Sapiens
RITEWVSVCK

SEQ ID NO: 23758 - protein, 10 aa, Homo Sapiens
RIWAAAPNRF

SEQ ID NO: 23759 - protein, 10 aa, Homo Sapiens
RIYDYDPLYK

SEQ ID NO: 23760 - protein, 10 aa, Homo Sapiens
RIYPYAAISY

SEQ ID NO: 23761 - protein, 10 aa, Homo Sapiens
RLAEPSQMLK

SEQ ID NO: 23762 - protein, 10 aa, Homo Sapiens
RLAEVIKNRF

SEQ ID NO: 23763 - protein, 10 aa, Homo Sapiens
RLAEWKATKL

SEQ ID NO: 23764 - protein, 10 aa, Homo Sapiens
RLATSLVEKL

SEQ ID NO: 23765 - protein, 10 aa, Homo Sapiens
RLFCVGFTKK

SEQ ID NO: 23766 - protein, 10 aa, Homo Sapiens
RLFDEGTISK

SEQ ID NO: 23767 - protein, 10 aa, Homo Sapiens
RLFDTPHTPK

SEQ ID NO: 23768 - protein, 10 aa, Homo Sapiens
RLFEGTGARL

SEQ ID NO: 23769 - protein, 10 aa, Homo Sapiens
RLFGTTVTFK

SEQ ID NO: 23770 - protein, 10 aa, Homo Sapiens
RLFIGGIPKM

SEQ ID NO: 23771 - protein, 10 aa, Homo Sapiens
RLFPNSFNDK

SEQ ID NO: 23772 - protein, 10 aa, Homo Sapiens
RLFTSEKMVK

SEQ ID NO: 23773 - protein, 10 aa, Homo Sapiens
RLFTVPWPVK

SEQ ID NO: 23774 - protein, 10 aa, Homo Sapiens
RLGITMKAKL

SEQ ID NO: 23775 - protein, 10 aa, Homo Sapiens
RLIDQKWQRK

SEQ ID NO: 23776 - protein, 10 aa, Homo Sapiens
RLKGDAWVYK

SEQ ID NO: 23777 - protein, 10 aa, Homo Sapiens
RLKPFYLVPK

SEQ ID NO: 23778 - protein, 10 aa, Homo Sapiens
RLKQQTIPLK

SEQ ID NO: 23779 - protein, 10 aa, Homo Sapiens
RLLEYTPTAR

SEQ ID NO: 23780 - protein, 10 aa, Homo Sapiens
RLLLEQILNK

SEQ ID NO: 23781 - protein, 10 aa, Homo Sapiens
RLLLPGELAK

SEQ ID NO: 23782 - protein, 10 aa, Homo Sapiens
RLLSGVPLYK

SEQ ID NO: 23783 - protein, 10 aa, Homo Sapiens
RLLSPPLRPR

SEQ ID NO: 23784 - protein, 10 aa, Homo Sapiens
RLMELFPANK

SEQ ID NO: 23785 - protein, 10 aa, Homo Sapiens
RLNDRYPKKL

SEQ ID NO: 23786 - protein, 10 aa, Homo Sapiens
RLNESTSYKF

SEQ ID NO: 23787 - protein, 10 aa, Homo Sapiens
RLPAFTLSHL

SEQ ID NO: 23788 - protein, 10 aa, Homo Sapiens
RLPKGAVLYK

SEQ ID NO: 23789 - protein, 10 aa, Homo Sapiens
RLPLISGFYK

SEQ ID NO: 23790 - protein, 10 aa, Homo Sapiens
RLQEALNLFK

SEQ ID NO: 23791 - protein, 10 aa, Homo Sapiens
RLRFSEIPMK

SEQ ID NO: 23792 - protein, 10 aa, Homo Sapiens
RLSNIFVIGK

SEQ ID NO: 23793 - protein, 10 aa, Homo Sapiens
RLSNPSLVKK

SEQ ID NO: 23794 - protein, 10 aa, Homo Sapiens
RLSQLKQLLK

SEQ ID NO: 23795 - protein, 10 aa, Homo Sapiens
RLVQGSILKK

SEQ ID NO: 23796 - protein, 10 aa, Homo Sapiens
RLYDWGLRGY

SEQ ID NO: 23797 - protein, 10 aa, Homo Sapiens
RLYFGERNVK

SEQ ID NO: 23798 - protein, 10 aa, Homo Sapiens
RLYFSQQTYY

SEQ ID NO: 23799 - protein, 10 aa, Homo Sapiens
RLYGSSLTRF

SEQ ID NO: 23800 - protein, 10 aa, Homo Sapiens
RLYQHAVEYF

SEQ ID NO: 23801 - protein, 10 aa, Homo Sapiens
RLYQRALQKL

SEQ ID NO: 23802 - protein, 10 aa, Homo Sapiens
RLYQVEYAFK

SEQ ID NO: 23803 - protein, 10 aa, Homo Sapiens
RLYSVSYLLK

SEQ ID NO: 23804 - protein, 10 aa, Homo Sapiens
RLYVPLYSSK

SEQ ID NO: 23805 - protein, 10 aa, Homo Sapiens
RMADFWLTEK

SEQ ID NO: 23806 - protein, 10 aa, Homo Sapiens
RMFAPTKTWR

SEQ ID NO: 23807 - protein, 10 aa, Homo Sapiens
RMFLSFPTTK

SEQ ID NO: 23808 - protein, 10 aa, Homo Sapiens
RMFQDIGVSK

SEQ ID NO: 23809 - protein, 10 aa, Homo Sapiens
RMKDPTFLGK

SEQ ID NO: 23810 - protein, 10 aa, Homo Sapiens
RQYDKFLTHF

SEQ ID NO: 23811 - protein, 10 aa, Homo Sapiens
RSAQPLPLKI

SEQ ID NO: 23812 - protein, 10 aa, Homo Sapiens
RSYDEAILRL

SEQ ID NO: 23813 - protein, 10 aa, Homo Sapiens
RSYSDPPLKF

SEQ ID NO: 23814 - protein, 10 aa, Homo Sapiens
RTAVPSFLTK

SEQ ID NO: 23815 - protein, 10 aa, Homo Sapiens
RTCEWTGLKF

SEQ ID NO: 23816 - protein, 10 aa, Homo Sapiens
RTDDKVIRFK

SEQ ID NO: 23817 - protein, 10 aa, Homo Sapiens
RTDNISFMLK

SEQ ID NO: 23818 - protein, 10 aa, Homo Sapiens
RTFMIKFPWK

SEQ ID NO: 23819 - protein, 10 aa, Homo Sapiens
RTGKPIAVKL

SEQ ID NO: 23820 - protein, 10 aa, Homo Sapiens
RTGPPMGSRF

SEQ ID NO: 23821 - protein, 10 aa, Homo Sapiens
RTLGAIVRQK

SEQ ID NO: 23822 - protein, 10 aa, Homo Sapiens
RTLLGFFLAK

SEQ ID NO: 23823 - protein, 10 aa, Homo Sapiens
RTLSDYNIQK

SEQ ID NO: 23824 - protein, 10 aa, Homo Sapiens
RTLYPLLIKK

SEQ ID NO: 23825 - protein, 10 aa, Homo Sapiens
RVCDIILPRL

SEQ ID NO: 23826 - protein, 10 aa, Homo Sapiens
RVFQGFFTGR

SEQ ID NO: 23827 - protein, 10 aa, Homo Sapiens
RVFTGVVTKL

SEQ ID NO: 23828 - protein, 10 aa, Homo Sapiens
RVKGPGISKF

SEQ ID NO: 23829 - protein, 10 aa, Homo Sapiens
RVKTNLPIFK

SEQ ID NO: 23830 - protein, 10 aa, Homo Sapiens
RVLDFDVKRK

SEQ ID NO: 23831 - protein, 10 aa, Homo Sapiens
RVLDVGFVGR

SEQ ID NO: 23832 - protein, 10 aa, Homo Sapiens
RVLKPGGLLK

SEQ ID NO: 23833 - protein, 10 aa, Homo Sapiens
RVLNKLGGVK

SEQ ID NO: 23834 - protein, 10 aa, Homo Sapiens
RVLPAPILQY

SEQ ID NO: 23835 - protein, 10 aa, Homo Sapiens
RVLPAPMLQY

SEQ ID NO: 23836 - protein, 10 aa, Homo Sapiens
RVLRPLKTIK

SEQ ID NO: 23837 - protein, 10 aa, Homo Sapiens
RVLSERLLHK

SEQ ID NO: 23838 - protein, 10 aa, Homo Sapiens
RVLSKAFSRL

SEQ ID NO: 23839 - protein, 10 aa, Homo Sapiens
RVLYEWFLGK

SEQ ID NO: 23840 - protein, 10 aa, Homo Sapiens
RVSDCIPLSH

SEQ ID NO: 23841 - protein, 10 aa, Homo Sapiens
RVSGLVPSRF

SEQ ID NO: 23842 - protein, 10 aa, Homo Sapiens
RVWDISGLRK

SEQ ID NO: 23843 - protein, 10 aa, Homo Sapiens
RVWDLPGVLK

SEQ ID NO: 23844 - protein, 10 aa, Homo Sapiens
RVWIQGKFQK

SEQ ID NO: 23845 - protein, 10 aa, Homo Sapiens
RVWQVTIGTR

SEQ ID NO: 23846 - protein, 10 aa, Homo Sapiens
SAPGYLPTSL

SEQ ID NO: 23847 - protein, 10 aa, Homo Sapiens
SAYYPSSFPK

SEQ ID NO: 23848 - protein, 10 aa, Homo Sapiens
SIFDGRVVAK

SEQ ID NO: 23849 - protein, 10 aa, Homo Sapiens
SIFFESMPYK

SEQ ID NO: 23850 - protein, 10 aa, Homo Sapiens
SIGSPVGTPK

SEQ ID NO: 23851 - protein, 10 aa, Homo Sapiens
SILDYISTSK

SEQ ID NO: 23852 - protein, 10 aa, Homo Sapiens
SILNTWISLK

SEQ ID NO: 23853 - protein, 10 aa, Homo Sapiens
SILRNPVTNK

SEQ ID NO: 23854 - protein, 10 aa, Homo Sapiens
SISGPISTSK

SEQ ID NO: 23855 - protein, 10 aa, Homo Sapiens
SIWPGGVLPK

SEQ ID NO: 23856 - protein, 10 aa, Homo Sapiens
SIYDVKYLMK

SEQ ID NO: 23857 - protein, 10 aa, Homo Sapiens
SLAGGIIGVK

SEQ ID NO: 23858 - protein, 10 aa, Homo Sapiens
SLFDRQGFLK

SEQ ID NO: 23859 - protein, 10 aa, Homo Sapiens
SLLAKVFITK

SEQ ID NO: 23860 - protein, 10 aa, Homo Sapiens
SLPDFPAAAK

SEQ ID NO: 23861 - protein, 10 aa, Homo Sapiens
SLPDLTTPLK

SEQ ID NO: 23862 - protein, 10 aa, Homo Sapiens
SLPTVIMRNK

SEQ ID NO: 23863 - protein, 10 aa, Homo Sapiens
SLSSPLNPKL

SEQ ID NO: 23864 - protein, 10 aa, Homo Sapiens
SLWQVPYFSK

SEQ ID NO: 23865 - protein, 10 aa, Homo Sapiens
SMFPAAPAPK

SEQ ID NO: 23866 - protein, 10 aa, Homo Sapiens
SMNIPALVGK

SEQ ID NO: 23867 - protein, 10 aa, Homo Sapiens
SQYPNQPTRF

SEQ ID NO: 23868 - protein, 10 aa, Homo Sapiens
SSLSSPLNPK

SEQ ID NO: 23869 - protein, 10 aa, Homo Sapiens
SSNKQILINK

SEQ ID NO: 23870 - protein, 10 aa, Homo Sapiens
STFQQMWISK

SEQ ID NO: 23871 - protein, 10 aa, Homo Sapiens
STYEKALGYF

SEQ ID NO: 23872 - protein, 10 aa, Homo Sapiens
STYISILNQK

SEQ ID NO: 23873 - protein, 10 aa, Homo Sapiens
STYYGSFVTR

SEQ ID NO: 23874 - protein, 10 aa, Homo Sapiens
SVAQQLLNGK

SEQ ID NO: 23875 - protein, 10 aa, Homo Sapiens
SVFAGVVGVK

SEQ ID NO: 23876 - protein, 10 aa, Homo Sapiens
SVFDAYVLPK

SEQ ID NO: 23877 - protein, 10 aa, Homo Sapiens
SVFDFQKAYK

SEQ ID NO: 23878 - protein, 10 aa, Homo Sapiens
SVFQQGMKNK

SEQ ID NO: 23879 - protein, 10 aa, Homo Sapiens
SVHWFPVQKL

SEQ ID NO: 23880 - protein, 10 aa, Homo Sapiens
SVLEPPLFLK

SEQ ID NO: 23881 - protein, 10 aa, Homo Sapiens
SVLQFLGLYK

SEQ ID NO: 23882 - protein, 10 aa, Homo Sapiens
SVYDHQGIFK

SEQ ID NO: 23883 - protein, 10 aa, Homo Sapiens
TIARPTIGNK

SEQ ID NO: 23884 - protein, 10 aa, Homo Sapiens
TLFQLKFTAK

SEQ ID NO: 23885 - protein, 10 aa, Homo Sapiens
TLLDYTYTSK

SEQ ID NO: 23886 - protein, 10 aa, Homo Sapiens
TLLGKPLLGK

SEQ ID NO: 23887 - protein, 10 aa, Homo Sapiens
TLLPMPLSGR

SEQ ID NO: 23888 - protein, 10 aa, Homo Sapiens
TLMTILKNSI

SEQ ID NO: 23889 - protein, 10 aa, Homo Sapiens
TLYISECLKK

SEQ ID NO: 23890 - protein, 10 aa, Homo Sapiens
TLYSNNITKL

SEQ ID NO: 23891 - protein, 10 aa, Homo Sapiens
TLYYQPGLLY

SEQ ID NO: 23892 - protein, 10 aa, Homo Sapiens
TTVPRRLGPK

SEQ ID NO: 23893 - protein, 10 aa, Homo Sapiens
TVAVPLVGKL

SEQ ID NO: 23894 - protein, 10 aa, Homo Sapiens
TVLCQPTGGK

SEQ ID NO: 23895 - protein, 10 aa, Homo Sapiens
TVLGGVLGQK

SEQ ID NO: 23896 - protein, 10 aa, Homo Sapiens
TVYRNPESFK

SEQ ID NO: 23897 - protein, 10 aa, Homo Sapiens
VIIPTAPLYK

SEQ ID NO: 23898 - protein, 10 aa, Homo Sapiens
VILEVQSNPK

SEQ ID NO: 23899 - protein, 10 aa, Homo Sapiens
VISQEPFVPK

SEQ ID NO: 23900 - protein, 10 aa, Homo Sapiens
VIWKYPTMAK

SEQ ID NO: 23901 - protein, 10 aa, Homo Sapiens
VIYYLAFSAK

SEQ ID NO: 23902 - protein, 10 aa, Homo Sapiens
VLFSYSFSYK

SEQ ID NO: 23903 - protein, 10 aa, Homo Sapiens
VLGPNVSIGK

SEQ ID NO: 23904 - protein, 10 aa, Homo Sapiens
VLLGPPGAGK

SEQ ID NO: 23905 - protein, 10 aa, Homo Sapiens
VLLGSLFSRK

SEQ ID NO: 23906 - protein, 10 aa, Homo Sapiens
VLSSFVLAEK

SEQ ID NO: 23907 - protein, 10 aa, Homo Sapiens
VLYDRQGIGR

SEQ ID NO: 23908 - protein, 10 aa, Homo Sapiens
VMLGTQLLYK

SEQ ID NO: 23909 - protein, 10 aa, Homo Sapiens
VSILLGTVPK

SEQ ID NO: 23910 - protein, 10 aa, Homo Sapiens
VTFEKIFSQK

SEQ ID NO: 23911 - protein, 10 aa, Homo Sapiens
VTFRPLFFKL

SEQ ID NO: 23912 - protein, 10 aa, Homo Sapiens
VTLSWKPVQK

SEQ ID NO: 23913 - protein, 10 aa, Homo Sapiens
VTYRNLINKL

SEQ ID NO: 23914 - protein, 10 aa, Homo Sapiens
VVFEKAIQRT

SEQ ID NO: 23915 - protein, 10 aa, Homo Sapiens
VVLGQFLVLK

SEQ ID NO: 23916 - protein, 10 aa, Homo Sapiens
VVNKVPLTGK

SEQ ID NO: 23917 - protein, 10 aa, Homo Sapiens
VVWPQPATTK

SEQ ID NO: 23918 - protein, 10 aa, Homo Sapiens
VVYTSEMALK

SEQ ID NO: 23919 - protein, 10 aa, Homo Sapiens
VVYTSHLQLK

SEQ ID NO: 23920 - protein, 10 aa, Homo Sapiens
YIYDGELVSK

SEQ ID NO: 23921 - protein, 10 aa, Homo Sapiens
YLGEFSITYK

SEQ ID NO: 23922 - protein, 11 aa, Homo Sapiens
AEVNADRITWL

SEQ ID NO: 23923 - protein, 11 aa, Homo Sapiens
AIAQAESLRYK

SEQ ID NO: 23924 - protein, 11 aa, Homo Sapiens
AIFEVNTDLQK

SEQ ID NO: 23925 - protein, 11 aa, Homo Sapiens
AIIPSKKLRNK

SEQ ID NO: 23926 - protein, 11 aa, Homo Sapiens
AIYGGTYMLNK

SEQ ID NO: 23927 - protein, 11 aa, Homo Sapiens
AIYKTPPGIQK

SEQ ID NO: 23928 - protein, 11 aa, Homo Sapiens
AIYLVTSLASK

SEQ ID NO: 23929 - protein, 11 aa, Homo Sapiens
AIYPFLDSPNK

SEQ ID NO: 23930 - protein, 11 aa, Homo Sapiens
ALESSIEQRLK

SEQ ID NO: 23931 - protein, 11 aa, Homo Sapiens
ALFKDSEILRK

SEQ ID NO: 23932 - protein, 11 aa, Homo Sapiens
ALFSSKDFAGK

SEQ ID NO: 23933 - protein, 11 aa, Homo Sapiens
ALFVAFLLRGK

SEQ ID NO: 23934 - protein, 11 aa, Homo Sapiens
ALLDGSNVVFK

SEQ ID NO: 23935 - protein, 11 aa, Homo Sapiens
ALLRVTPFILK

SEQ ID NO: 23936 - protein, 11 aa, Homo Sapiens
ALMPQETQALK

SEQ ID NO: 23937 - protein, 11 aa, Homo Sapiens
ALPVLERLIYK

SEQ ID NO: 23938 - protein, 11 aa, Homo Sapiens
ALRNINLIVQK

SEQ ID NO: 23939 - protein, 11 aa, Homo Sapiens
ALVNQDILENK

SEQ ID NO: 23940 - protein, 11 aa, Homo Sapiens
ALWGGTQPLLK

SEQ ID NO: 23941 - protein, 11 aa, Homo Sapiens
ALYMASQPKNK

SEQ ID NO: 23942 - protein, 11 aa, Homo Sapiens
ALYPEGQAPVK

SEQ ID NO: 23943 - protein, 11 aa, Homo Sapiens
ALYYPELYILK

SEQ ID NO: 23944 - protein, 11 aa, Homo Sapiens
AMFSPPVNSGK

SEQ ID NO: 23945 - protein, 11 aa, Homo Sapiens
AMYDKGPFRSK

SEQ ID NO: 23946 - protein, 11 aa, Homo Sapiens
AQFPSSGRFWK

SEQ ID NO: 23947 - protein, 11 aa, Homo Sapiens
AQYSPQQLAGK

SEQ ID NO: 23948 - protein, 11 aa, Homo Sapiens
ASYEFVQRLLK

SEQ ID NO: 23949 - protein, 11 aa, Homo Sapiens
ATALFGQPPFK

SEQ ID NO: 23950 - protein, 11 aa, Homo Sapiens
ATFRFPGALQH

SEQ ID NO: 23951 - protein, 11 aa, Homo Sapiens
ATLPVLYMLFK

SEQ ID NO: 23952 - protein, 11 aa, Homo Sapiens
ATLSQFYINKL

SEQ ID NO: 23953 - protein, 11 aa, Homo Sapiens
ATRILFFNTPK

SEQ ID NO: 23954 - protein, 11 aa, Homo Sapiens
ATYKGVPFEVK

SEQ ID NO: 23955 - protein, 11 aa, Homo Sapiens
AVADKVHLMYK

SEQ ID NO: 23956 - protein, 11 aa, Homo Sapiens
AVASEDSVLLY

SEQ ID NO: 23957 - protein, 11 aa, Homo Sapiens
AVFPFKPPQRI

SEQ ID NO: 23958 - protein, 11 aa, Homo Sapiens
AVFPSLLTNPK

SEQ ID NO: 23959 - protein, 11 aa, Homo Sapiens
AVFVTSEASLK

SEQ ID NO: 23960 - protein, 11 aa, Homo Sapiens
AVIPEKQLVEK

SEQ ID NO: 23961 - protein, 11 aa, Homo Sapiens
AVLDQQIHLEK

SEQ ID NO: 23962 - protein, 11 aa, Homo Sapiens
AVLGETLIPHY

SEQ ID NO: 23963 - protein, 11 aa, Homo Sapiens
AVLGPNVSIGK

SEQ ID NO: 23964 - protein, 11 aa, Homo Sapiens
AVLNLLYVFSK

SEQ ID NO: 23965 - protein, 11 aa, Homo Sapiens
AVMAESAFSFK

SEQ ID NO: 23966 - protein, 11 aa, Homo Sapiens
AVMDNKNPTIK

SEQ ID NO: 23967 - protein, 11 aa, Homo Sapiens
AVRTLNKVAMK

SEQ ID NO: 23968 - protein, 11 aa, Homo Sapiens
AVVNKVPLTGK

SEQ ID NO: 23969 - protein, 11 aa, Homo Sapiens
AVVPLASVIVK

SEQ ID NO: 23970 - protein, 11 aa, Homo Sapiens
AVYGMLNLTPK

SEQ ID NO: 23971 - protein, 11 aa, Homo Sapiens
AVYSMVEFNGK

SEQ ID NO: 23972 - protein, 11 aa, Homo Sapiens
EIYDPRNPVNK

SEQ ID NO: 23973 - protein, 11 aa, Homo Sapiens
FLYQQQGRLDK

SEQ ID NO: 23974 - protein, 11 aa, Homo Sapiens
GLFQGKTPLRK

SEQ ID NO: 23975 - protein, 11 aa, Homo Sapiens
GLLAAQKVISK

SEQ ID NO: 23976 - protein, 11 aa, Homo Sapiens
GLLNGKVGSFK

SEQ ID NO: 23977 - protein, 11 aa, Homo Sapiens
GLRPGPELIQK

SEQ ID NO: 23978 - protein, 11 aa, Homo Sapiens
GMYLISKYIRK

SEQ ID NO: 23979 - protein, 11 aa, Homo Sapiens
GSYSLPGTLAK

SEQ ID NO: 23980 - protein, 11 aa, Homo Sapiens
GTFVSPEVFLK

SEQ ID NO: 23981 - protein, 11 aa, Homo Sapiens
GTVLGGVLGQK

SEQ ID NO: 23982 - protein, 11 aa, Homo Sapiens
GVIGQDGLLFK

SEQ ID NO: 23983 - protein, 11 aa, Homo Sapiens
GVIPESVILLK

SEQ ID NO: 23984 - protein, 11 aa, Homo Sapiens
HTLDSYRILQK

SEQ ID NO: 23985 - protein, 11 aa, Homo Sapiens
HVLEAQDLIAK

SEQ ID NO: 23986 - protein, 11 aa, Homo Sapiens
IIYDPKLQTPK

SEQ ID NO: 23987 - protein, 11 aa, Homo Sapiens
IIYFARKANMK

SEQ ID NO: 23988 - protein, 11 aa, Homo Sapiens
ILFPRKPSAPK

SEQ ID NO: 23989 - protein, 11 aa, Homo Sapiens
ILFTEDPRVFK

SEQ ID NO: 23990 - protein, 11 aa, Homo Sapiens
ILFVPGEYSLK

SEQ ID NO: 23991 - protein, 11 aa, Homo Sapiens
ILLGGNALSPK

SEQ ID NO: 23992 - protein, 11 aa, Homo Sapiens
ILNSPTVTSIK

SEQ ID NO: 23993 - protein, 11 aa, Homo Sapiens
ILYAQFEIRQK

SEQ ID NO: 23994 - protein, 11 aa, Homo Sapiens
ILYENPNFTGK

SEQ ID NO: 23995 - protein, 11 aa, Homo Sapiens
ITDPHSPSRFR

SEQ ID NO: 23996 - protein, 11 aa, Homo Sapiens
IVFNGPHLLLR

SEQ ID NO: 23997 - protein, 11 aa, Homo Sapiens
IVRTGGHFICK

SEQ ID NO: 23998 - protein, 11 aa, Homo Sapiens
IVYDIAQVNLK

SEQ ID NO: 23999 - protein, 11 aa, Homo Sapiens
IVYLGDYLTVK

SEQ ID NO: 24000 - protein, 11 aa, Homo Sapiens
KILDTERMLAK

SEQ ID NO: 24001 - protein, 11 aa, Homo Sapiens
KILGPQGNTIK

SEQ ID NO: 24002 - protein, 11 aa, Homo Sapiens
KILPVGGIKEK

SEQ ID NO: 24003 - protein, 11 aa, Homo Sapiens
KIYNGLFAISK

SEQ ID NO: 24004 - protein, 11 aa, Homo Sapiens
KLAEQYESFVK

SEQ ID NO: 24005 - protein, 11 aa, Homo Sapiens
KLAPAMKTQKL

SEQ ID NO: 24006 - protein, 11 aa, Homo Sapiens
KLDVDAPRLLK

SEQ ID NO: 24007 - protein, 11 aa, Homo Sapiens
KLFDYSKPSAK

SEQ ID NO: 24008 - protein, 11 aa, Homo Sapiens
KLFEAPNFFQK

SEQ ID NO: 24009 - protein, 11 aa, Homo Sapiens
KLFGPFTRNYY

SEQ ID NO: 24010 - protein, 11 aa, Homo Sapiens
KLFKPGQEAVK

SEQ ID NO: 24011 - protein, 11 aa, Homo Sapiens
KLFLIDFGLAK

SEQ ID NO: 24012 - protein, 11 aa, Homo Sapiens
KLFPGSPAIYK

SEQ ID NO: 24013 - protein, 11 aa, Homo Sapiens
KLFSEGLFSAK

SEQ ID NO: 24014 - protein, 11 aa, Homo Sapiens
KLFSELPLAKK

SEQ ID NO: 24015 - protein, 11 aa, Homo Sapiens
KLFWSQRKITK

SEQ ID NO: 24016 - protein, 11 aa, Homo Sapiens
KLIGEYGLRNK

SEQ ID NO: 24017 - protein, 11 aa, Homo Sapiens
KLISEEDLLRK

SEQ ID NO: 24018 - protein, 11 aa, Homo Sapiens
KLLDEVFFSEK

SEQ ID NO: 24019 - protein, 11 aa, Homo Sapiens
KLLDIRSYLEK

SEQ ID NO: 24020 - protein, 11 aa, Homo Sapiens
KLLDVVHPAAK

SEQ ID NO: 24021 - protein, 11 aa, Homo Sapiens
KLLEPVLLLGK

SEQ ID NO: 24022 - protein, 11 aa, Homo Sapiens
KLLGLPEDYLY

SEQ ID NO: 24023 - protein, 11 aa, Homo Sapiens
KLLQEAEQRLK

SEQ ID NO: 24024 - protein, 11 aa, Homo Sapiens
KLQDFKSFLLK

SEQ ID NO: 24025 - protein, 11 aa, Homo Sapiens
KLRETQGIEKL

SEQ ID NO: 24026 - protein, 11 aa, Homo Sapiens
KLVSFPIGIYK

SEQ ID NO: 24027 - protein, 11 aa, Homo Sapiens
KLYASHSQFIK

SEQ ID NO: 24028 - protein, 11 aa, Homo Sapiens
KLYTKHGTLKY

SEQ ID NO: 24029 - protein, 11 aa, Homo Sapiens
KLYVGSRVVAK

SEQ ID NO: 24030 - protein, 11 aa, Homo Sapiens
KMADKILPQRI

SEQ ID NO: 24031 - protein, 11 aa, Homo Sapiens
KMADKVLPQRI

SEQ ID NO: 24032 - protein, 11 aa, Homo Sapiens
KMLEENTNILK

SEQ ID NO: 24033 - protein, 11 aa, Homo Sapiens
KMQYATGPLLK

SEQ ID NO: 24034 - protein, 11 aa, Homo Sapiens
KQYGNEVFLAK

SEQ ID NO: 24035 - protein, 11 aa, Homo Sapiens
KTAEDAKDFFK

SEQ ID NO: 24036 - protein, 11 aa, Homo Sapiens
KTFDAPPALPK

SEQ ID NO: 24037 - protein, 11 aa, Homo Sapiens
KTFTIKRFLAK

SEQ ID NO: 24038 - protein, 11 aa, Homo Sapiens
KTFTWPSILSK

SEQ ID NO: 24039 - protein, 11 aa, Homo Sapiens
KTIDMELVKRK

SEQ ID NO: 24040 - protein, 11 aa, Homo Sapiens
KTIDYIQFLHK

SEQ ID NO: 24041 - protein, 11 aa, Homo Sapiens
KTLAYRGFIFK

SEQ ID NO: 24042 - protein, 11 aa, Homo Sapiens
KTLDEILQEKK

SEQ ID NO: 24043 - protein, 11 aa, Homo Sapiens
KTLDQAKAVLK

SEQ ID NO: 24044 - protein, 11 aa, Homo Sapiens
KTRTGELINRL

SEQ ID NO: 24045 - protein, 11 aa, Homo Sapiens
KTYGVSFFLVK

SEQ ID NO: 24046 - protein, 11 aa, Homo Sapiens
KTYHALSNLPK

SEQ ID NO: 24047 - protein, 11 aa, Homo Sapiens
KTYIQLLIREK

SEQ ID NO: 24048 - protein, 11 aa, Homo Sapiens
KTYQVTPMTPR

SEQ ID NO: 24049 - protein, 11 aa, Homo Sapiens
KTYYQDRPFFR

SEQ ID NO: 24050 - protein, 11 aa, Homo Sapiens
KVCNPIITKLY

SEQ ID NO: 24051 - protein, 11 aa, Homo Sapiens
KVIDGERVIGR

SEQ ID NO: 24052 - protein, 11 aa, Homo Sapiens
KVISKDLVIER

SEQ ID NO: 24053 - protein, 11 aa, Homo Sapiens
KVLDTIMATKL

SEQ ID NO: 24054 - protein, 11 aa, Homo Sapiens
KVLSIDQRNFK

SEQ ID NO: 24055 - protein, 11 aa, Homo Sapiens
KVMAGSLLLDK

SEQ ID NO: 24056 - protein, 11 aa, Homo Sapiens
KVSSINSRFAK

SEQ ID NO: 24057 - protein, 11 aa, Homo Sapiens
LAYFPYFITYK

SEQ ID NO: 24058 - protein, 11 aa, Homo Sapiens
LILEPSLYTVK

SEQ ID NO: 24059 - protein, 11 aa, Homo Sapiens
LIYEETRGVLK

SEQ ID NO: 24060 - protein, 11 aa, Homo Sapiens
LIYVSVPGSKK

SEQ ID NO: 24061 - protein, 11 aa, Homo Sapiens
LLDIQSSGRAK

SEQ ID NO: 24062 - protein, 11 aa, Homo Sapiens
LLFPSRPGLLK

SEQ ID NO: 24063 - protein, 11 aa, Homo Sapiens
LLFSATMPKKI

SEQ ID NO: 24064 - protein, 11 aa, Homo Sapiens
LLREAESLIAK

SEQ ID NO: 24065 - protein, 11 aa, Homo Sapiens
LVYSSNFQNVK

SEQ ID NO: 24066 - protein, 11 aa, Homo Sapiens
MLMKNTIIAAK

SEQ ID NO: 24067 - protein, 11 aa, Homo Sapiens
MLYGYQVGLFK

SEQ ID NO: 24068 - protein, 11 aa, Homo Sapiens
NVYPNFRPTPK

SEQ ID NO: 24069 - protein, 11 aa, Homo Sapiens
QIREMETLILK

SEQ ID NO: 24070 - protein, 11 aa, Homo Sapiens
QIYAIRQSISK

SEQ ID NO: 24071 - protein, 11 aa, Homo Sapiens
QLFRGDTVLLK

SEQ ID NO: 24072 - protein, 11 aa, Homo Sapiens
QVLCIPSWMAK

SEQ ID NO: 24073 - protein, 11 aa, Homo Sapiens
QVLNADAIVVK

SEQ ID NO: 24074 - protein, 11 aa, Homo Sapiens
QVYISSLALLK

SEQ ID NO: 24075 - protein, 11 aa, Homo Sapiens
RIAGEASRLAH

SEQ ID NO: 24076 - protein, 11 aa, Homo Sapiens
RIFANTESYLK

SEQ ID NO: 24077 - protein, 11 aa, Homo Sapiens
RIFAPNHVVAK

SEQ ID NO: 24078 - protein, 11 aa, Homo Sapiens
RIFDSPEELPK

SEQ ID NO: 24079 - protein, 11 aa, Homo Sapiens
RIKEIAQDALK

SEQ ID NO: 24080 - protein, 11 aa, Homo Sapiens
RIKRALDLNLK

SEQ ID NO: 24081 - protein, 11 aa, Homo Sapiens
RILLDIHIFMK

SEQ ID NO: 24082 - protein, 11 aa, Homo Sapiens
RIMDPDVITGY

SEQ ID NO: 24083 - protein, 11 aa, Homo Sapiens
RIMSETYMLIK

SEQ ID NO: 24084 - protein, 11 aa, Homo Sapiens
RIRDGDFVVLK

SEQ ID NO: 24085 - protein, 11 aa, Homo Sapiens
RIRDLNDEINK

SEQ ID NO: 24086 - protein, 11 aa, Homo Sapiens
RIRNISNTVMK

SEQ ID NO: 24087 - protein, 11 aa, Homo Sapiens
RIVHGDVLTFK

SEQ ID NO: 24088 - protein, 11 aa, Homo Sapiens
RIWEPTYTIMY

SEQ ID NO: 24089 - protein, 11 aa, Homo Sapiens
RIYLDLPQNFK

SEQ ID NO: 24090 - protein, 11 aa, Homo Sapiens
RIYLDMLNVYK

SEQ ID NO: 24091 - protein, 11 aa, Homo Sapiens
RIYSQKIGIKK

SEQ ID NO: 24092 - protein, 11 aa, Homo Sapiens
RLADKSVLVCK

SEQ ID NO: 24093 - protein, 11 aa, Homo Sapiens
RLASLGLKFNK

SEQ ID NO: 24094 - protein, 11 aa, Homo Sapiens
RLDQSRTWLVK

SEQ ID NO: 24095 - protein, 11 aa, Homo Sapiens
RLFAYPDTHRH

SEQ ID NO: 24096 - protein, 11 aa, Homo Sapiens
RLFGLTKPKEK

SEQ ID NO: 24097 - protein, 11 aa, Homo Sapiens
RLFVGSIPKSK

SEQ ID NO: 24098 - protein, 11 aa, Homo Sapiens
RLIAQRYLLQY

SEQ ID NO: 24099 - protein, 11 aa, Homo Sapiens
RLIDLCQPTQK

SEQ ID NO: 24100 - protein, 11 aa, Homo Sapiens
RLIESLFTIQK

SEQ ID NO: 24101 - protein, 11 aa, Homo Sapiens
RLINTQAIFAK

SEQ ID NO: 24102 - protein, 11 aa, Homo Sapiens
RLKAYASPAKL

SEQ ID NO: 24103 - protein, 11 aa, Homo Sapiens
RLLAEPVPGIK

SEQ ID NO: 24104 - protein, 11 aa, Homo Sapiens
RLLAHRVETKM

SEQ ID NO: 24105 - protein, 11 aa, Homo Sapiens
RLLDSEIKIMK

SEQ ID NO: 24106 - protein, 11 aa, Homo Sapiens
RLLGLTGLLSK

SEQ ID NO: 24107 - protein, 11 aa, Homo Sapiens
RLLLETHLPSK

SEQ ID NO: 24108 - protein, 11 aa, Homo Sapiens
RLLPGNATISK

SEQ ID NO: 24109 - protein, 11 aa, Homo Sapiens
RLLPKFSLKEK

SEQ ID NO: 24110 - protein, 11 aa, Homo Sapiens
RLLQDPLGLAY

SEQ ID NO: 24111 - protein, 11 aa, Homo Sapiens
RLLQDVGLVSK

SEQ ID NO: 24112 - protein, 11 aa, Homo Sapiens
RLLSMAKPVYH

SEQ ID NO: 24113 - protein, 11 aa, Homo Sapiens
RLLSPPLRPRL

SEQ ID NO: 24114 - protein, 11 aa, Homo Sapiens
RLLSTPSFWLY

SEQ ID NO: 24115 - protein, 11 aa, Homo Sapiens
RLMEFNSLINK

SEQ ID NO: 24116 - protein, 11 aa, Homo Sapiens
RLMEQQGALLK

SEQ ID NO: 24117 - protein, 11 aa, Homo Sapiens
RLNITYPMLFK

SEQ ID NO: 24118 - protein, 11 aa, Homo Sapiens
RLQDQGLILYH

SEQ ID NO: 24119 - protein, 11 aa, Homo Sapiens
RLRDPDSHIVK

SEQ ID NO: 24120 - protein, 11 aa, Homo Sapiens
RLRELTSIVNR

SEQ ID NO: 24121 - protein, 11 aa, Homo Sapiens
RLRELVPGVPR

SEQ ID NO: 24122 - protein, 11 aa, Homo Sapiens
RLSGVSSNIQK

SEQ ID NO: 24123 - protein, 11 aa, Homo Sapiens
RLVPREIIVEK

SEQ ID NO: 24124 - protein, 11 aa, Homo Sapiens
RLWQTTEEIPK

SEQ ID NO: 24125 - protein, 11 aa, Homo Sapiens
RLYHELVGLAK

SEQ ID NO: 24126 - protein, 11 aa, Homo Sapiens
RLYLNGDGTGK

SEQ ID NO: 24127 - protein, 11 aa, Homo Sapiens
RLYQAVVDARK

SEQ ID NO: 24128 - protein, 11 aa, Homo Sapiens
RLYRPHLASEK

SEQ ID NO: 24129 - protein, 11 aa, Homo Sapiens
RMAPVLPSVLK

SEQ ID NO: 24130 - protein, 11 aa, Homo Sapiens
RMFAPTKTWRR

SEQ ID NO: 24131 - protein, 11 aa, Homo Sapiens
RMFHIRAVILR

SEQ ID NO: 24132 - protein, 11 aa, Homo Sapiens
RMKLPSSVGQK

SEQ ID NO: 24133 - protein, 11 aa, Homo Sapiens
RSFPWQSLEAK

SEQ ID NO: 24134 - protein, 11 aa, Homo Sapiens
RSLSEDVRFYY

SEQ ID NO: 24135 - protein, 11 aa, Homo Sapiens
RSMDPFPWQQK

SEQ ID NO: 24136 - protein, 11 aa, Homo Sapiens
RSYPVTEQRVK

SEQ ID NO: 24137 - protein, 11 aa, Homo Sapiens
RTFSWASVTSK

SEQ ID NO: 24138 - protein, 11 aa, Homo Sapiens
RTISGNVYILK

SEQ ID NO: 24139 - protein, 11 aa, Homo Sapiens
RTLDTIQLAFK

SEQ ID NO: 24140 - protein, 11 aa, Homo Sapiens
RTLGSDSVILK

SEQ ID NO: 24141 - protein, 11 aa, Homo Sapiens
RTLMPEKLSHK

SEQ ID NO: 24142 - protein, 11 aa, Homo Sapiens
RTLNPQMLQKK

SEQ ID NO: 24143 - protein, 11 aa, Homo Sapiens
RTQMPDPKTFK

SEQ ID NO: 24144 - protein, 11 aa, Homo Sapiens
RTRDYASLPPK

SEQ ID NO: 24145 - protein, 11 aa, Homo Sapiens
RTSGSVYITLK

SEQ ID NO: 24146 - protein, 11 aa, Homo Sapiens
RTSPALKTTRL

SEQ ID NO: 24147 - protein, 11 aa, Homo Sapiens
RTVLKNLSLLK

SEQ ID NO: 24148 - protein, 11 aa, Homo Sapiens
RTYGVSFFLVK

SEQ ID NO: 24149 - protein, 11 aa, Homo Sapiens
RVADLVHILTH

SEQ ID NO: 24150 - protein, 11 aa, Homo Sapiens
RVADRLYGVYK

SEQ ID NO: 24151 - protein, 11 aa, Homo Sapiens
RVAPAHGLFLK

SEQ ID NO: 24152 - protein, 11 aa, Homo Sapiens
RVFAAESIIKR

SEQ ID NO: 24153 - protein, 11 aa, Homo Sapiens
RVFEVMLPEKL

SEQ ID NO: 24154 - protein, 11 aa, Homo Sapiens
RVFPVRPGSGR

SEQ ID NO: 24155 - protein, 11 aa, Homo Sapiens
RVFTQLGSVLK

SEQ ID NO: 24156 - protein, 11 aa, Homo Sapiens
RVFTTVGSAEK

SEQ ID NO: 24157 - protein, 11 aa, Homo Sapiens
RVILAGNLLSH

SEQ ID NO: 24158 - protein, 11 aa, Homo Sapiens
RVINEEYKIWK

SEQ ID NO: 24159 - protein, 11 aa, Homo Sapiens
RVIPRITIEMK

SEQ ID NO: 24160 - protein, 11 aa, Homo Sapiens
RVITEEEKNFK

SEQ ID NO: 24161 - protein, 11 aa, Homo Sapiens
RVLDALVAREK

SEQ ID NO: 24162 - protein, 11 aa, Homo Sapiens
RVLIGEGVLTK

SEQ ID NO: 24163 - protein, 11 aa, Homo Sapiens
RVLPSSLMLPK

SEQ ID NO: 24164 - protein, 11 aa, Homo Sapiens
RVLTSGIFETK

SEQ ID NO: 24165 - protein, 11 aa, Homo Sapiens
RVMTQLTLALK

SEQ ID NO: 24166 - protein, 11 aa, Homo Sapiens
RVQEAVESMVK

SEQ ID NO: 24167 - protein, 11 aa, Homo Sapiens
RVQPGLLQWVK

SEQ ID NO: 24168 - protein, 11 aa, Homo Sapiens
RVSPQPMISRL

SEQ ID NO: 24169 - protein, 11 aa, Homo Sapiens
RVSTEVTLAVK

SEQ ID NO: 24170 - protein, 11 aa, Homo Sapiens
RVWDISGLRKK

SEQ ID NO: 24171 - protein, 11 aa, Homo Sapiens
RVWDVESGSLK

SEQ ID NO: 24172 - protein, 11 aa, Homo Sapiens
RVWDVRPFAPK

SEQ ID NO: 24173 - protein, 11 aa, Homo Sapiens
RVWSLMRFLIK

SEQ ID NO: 24174 - protein, 11 aa, Homo Sapiens
RVYDPASPQRR

SEQ ID NO: 24175 - protein, 11 aa, Homo Sapiens
RVYNTDPLKEK

SEQ ID NO: 24176 - protein, 11 aa, Homo Sapiens
RVYSHLKSVLK

SEQ ID NO: 24177 - protein, 11 aa, Homo Sapiens
RVYSPPEWIRY

SEQ ID NO: 24178 - protein, 11 aa, Homo Sapiens
RVYSPPEWISR

SEQ ID NO: 24179 - protein, 11 aa, Homo Sapiens
RVYYVSEKIMK

SEQ ID NO: 24180 - protein, 11 aa, Homo Sapiens
SIFIGGSFILK

SEQ ID NO: 24181 - protein, 11 aa, Homo Sapiens
SIRPVSEVTLK

SEQ ID NO: 24182 - protein, 11 aa, Homo Sapiens
SIYIAYGPNGK

SEQ ID NO: 24183 - protein, 11 aa, Homo Sapiens
SIYRPSKNLDK

SEQ ID NO: 24184 - protein, 11 aa, Homo Sapiens
SLAERSSLLQK

SEQ ID NO: 24185 - protein, 11 aa, Homo Sapiens
SLDIPSQFRSK

SEQ ID NO: 24186 - protein, 11 aa, Homo Sapiens
SLFPGSLKPKL

SEQ ID NO: 24187 - protein, 11 aa, Homo Sapiens
SLFSPAFYTAK

SEQ ID NO: 24188 - protein, 11 aa, Homo Sapiens
SLHPGSSALHY

SEQ ID NO: 24189 - protein, 11 aa, Homo Sapiens
SLSSPLNPKLW

SEQ ID NO: 24190 - protein, 11 aa, Homo Sapiens
SLWESSQELLK

SEQ ID NO: 24191 - protein, 11 aa, Homo Sapiens
SLYDSKIWTTK

SEQ ID NO: 24192 - protein, 11 aa, Homo Sapiens
SLYEMVSRVMK

SEQ ID NO: 24193 - protein, 11 aa, Homo Sapiens
SLYFSTGQNPK

SEQ ID NO: 24194 - protein, 11 aa, Homo Sapiens
SLYQPLQNSSK

SEQ ID NO: 24195 - protein, 11 aa, Homo Sapiens
SMLPGSGSVPK

SEQ ID NO: 24196 - protein, 11 aa, Homo Sapiens
SMMDVDHQIAK

SEQ ID NO: 24197 - protein, 11 aa, Homo Sapiens
STIPPELVKQK

SEQ ID NO: 24198 - protein, 11 aa, Homo Sapiens
STLTSKCLLLK

SEQ ID NO: 24199 - protein, 11 aa, Homo Sapiens
STMYPGLPSRL

SEQ ID NO: 24200 - protein, 11 aa, Homo Sapiens
STYPPEIVVPK

SEQ ID NO: 24201 - protein, 11 aa, Homo Sapiens
SVASAAAVLSH

SEQ ID NO: 24202 - protein, 11 aa, Homo Sapiens
SVFFPESGLAK

SEQ ID NO: 24203 - protein, 11 aa, Homo Sapiens
SVIDRKDLIIK

SEQ ID NO: 24204 - protein, 11 aa, Homo Sapiens
SVIGFRILLLK

SEQ ID NO: 24205 - protein, 11 aa, Homo Sapiens
SVLDMEAITFK

SEQ ID NO: 24206 - protein, 11 aa, Homo Sapiens
SVLDTVLLRPK

SEQ ID NO: 24207 - protein, 11 aa, Homo Sapiens
SVLPEYLKVFK

SEQ ID NO: 24208 - protein, 11 aa, Homo Sapiens
SVQNRQNFVVK

SEQ ID NO: 24209 - protein, 11 aa, Homo Sapiens
TIIGELGLDPG

SEQ ID NO: 24210 - protein, 11 aa, Homo Sapiens
TIMPKDIQLAR

SEQ ID NO: 24211 - protein, 11 aa, Homo Sapiens
TLWDRIGGSFK

SEQ ID NO: 24212 - protein, 11 aa, Homo Sapiens
TLWVIDQGLKK

SEQ ID NO: 24213 - protein, 11 aa, Homo Sapiens
TVAVPLVGKLG

SEQ ID NO: 24214 - protein, 11 aa, Homo Sapiens
TVFDAKRLIGR

SEQ ID NO: 24215 - protein, 11 aa, Homo Sapiens
TVFQYLKMLQK

SEQ ID NO: 24216 - protein, 11 aa, Homo Sapiens
TVIRDVEQQFK

SEQ ID NO: 24217 - protein, 11 aa, Homo Sapiens
TVLGGVYILGK

SEQ ID NO: 24218 - protein, 11 aa, Homo Sapiens
TVMELVKIIYK

SEQ ID NO: 24219 - protein, 11 aa, Homo Sapiens
TVYAFSIENFK

SEQ ID NO: 24220 - protein, 11 aa, Homo Sapiens
VILPPLSPYFK

SEQ ID NO: 24221 - protein, 11 aa, Homo Sapiens
VIYIQAIFRGK

SEQ ID NO: 24222 - protein, 11 aa, Homo Sapiens
VLDPKSKWRSK

SEQ ID NO: 24223 - protein, 11 aa, Homo Sapiens
VLFDTQLIIEK

SEQ ID NO: 24224 - protein, 11 aa, Homo Sapiens
VLFPEGGFLRK

SEQ ID NO: 24225 - protein, 11 aa, Homo Sapiens
VLQAADILLYK

SEQ ID NO: 24226 - protein, 11 aa, Homo Sapiens
VLSLGVAALYK

SEQ ID NO: 24227 - protein, 11 aa, Homo Sapiens
VLSPDSLFTAK

SEQ ID NO: 24228 - protein, 11 aa, Homo Sapiens
VTLSMAYRLLK

SEQ ID NO: 24229 - protein, 11 aa, Homo Sapiens
VVFAVKQYISK

SEQ ID NO: 24230 - protein, 11 aa, Homo Sapiens
VVFDTSLQVKK

SEQ ID NO: 24231 - protein, 11 aa, Homo Sapiens
VVFVIDPGFAK

SEQ ID NO: 24232 - protein, 11 aa, Homo Sapiens
VVQDGITLITK

SEQ ID NO: 24233 - protein, 11 aa, Homo Sapiens
VVYSGLENIKK

SEQ ID NO: 24234 - protein, 8 aa, Homo Sapiens
AHLVHELR

SEQ ID NO: 24235 - protein, 8 aa, Homo Sapiens
AIYGVDTR

SEQ ID NO: 24236 - protein, 8 aa, Homo Sapiens
ASFISMRK

SEQ ID NO: 24237 - protein, 8 aa, Homo Sapiens
ASFVTSNK

SEQ ID NO: 24238 - protein, 8 aa, Homo Sapiens
ASSVPNLK

SEQ ID NO: 24239 - protein, 8 aa, Homo Sapiens
ATGYPLAF

SEQ ID NO: 24240 - protein, 8 aa, Homo Sapiens
ATQEAFMK

SEQ ID NO: 24241 - protein, 8 aa, Homo Sapiens
AVVTADLR

SEQ ID NO: 24242 - protein, 8 aa, Homo Sapiens
AYVNAIEK

SEQ ID NO: 24243 - protein, 8 aa, Homo Sapiens
CGVIGIAQ

SEQ ID NO: 24244 - protein, 8 aa, Homo Sapiens
DGIVSHLK

SEQ ID NO: 24245 - protein, 8 aa, Homo Sapiens
DGRVVEPK

SEQ ID NO: 24246 - protein, 8 aa, Homo Sapiens
EFGLARFK

SEQ ID NO: 24247 - protein, 8 aa, Homo Sapiens
FAGDDAPR

SEQ ID NO: 24248 - protein, 8 aa, Homo Sapiens
FDFQKAYK

SEQ ID NO: 24249 - protein, 8 aa, Homo Sapiens
FDGRVVAK

SEQ ID NO: 24250 - protein, 8 aa, Homo Sapiens
FDKAKLKK

SEQ ID NO: 24251 - protein, 8 aa, Homo Sapiens
FDTQITKK

SEQ ID NO: 24252 - protein, 8 aa, Homo Sapiens
FPKPFVEK

SEQ ID NO: 24253 - protein, 8 aa, Homo Sapiens
FPSEIVGK

SEQ ID NO: 24254 - protein, 8 aa, Homo Sapiens
FQIGSPWR

SEQ ID NO: 24255 - protein, 8 aa, Homo Sapiens
FQQGMKNK

SEQ ID NO: 24256 - protein, 8 aa, Homo Sapiens
FSPVGSVL

SEQ ID NO: 24257 - protein, 8 aa, Homo Sapiens
GDMSGLLK

SEQ ID NO: 24258 - protein, 8 aa, Homo Sapiens
GNMGLAMK

SEQ ID NO: 24259 - protein, 8 aa, Homo Sapiens
GSWDSFLK

SEQ ID NO: 24260 - protein, 8 aa, Homo Sapiens
IDGSVNPK

SEQ ID NO: 24261 - protein, 8 aa, Homo Sapiens
IFKQPVTK

SEQ ID NO: 24262 - protein, 8 aa, Homo Sapiens
IGTIFIIK

SEQ ID NO: 24263 - protein, 8 aa, Homo Sapiens
IKEGSQLK

SEQ ID NO: 24264 - protein, 8 aa, Homo Sapiens
INIVHPKL

SEQ ID NO: 24265 - protein, 8 aa, Homo Sapiens
ISTDPLKR

SEQ ID NO: 24266 - protein, 8 aa, Homo Sapiens
IVLEDGTK

SEQ ID NO: 24267 - protein, 8 aa, Homo Sapiens
LFGGILMK

SEQ ID NO: 24268 - protein, 8 aa, Homo Sapiens
LNLVIVKK

SEQ ID NO: 24269 - protein, 8 aa, Homo Sapiens
LVSLEMGK

SEQ ID NO: 24270 - protein, 8 aa, Homo Sapiens
LYQPLFDK

SEQ ID NO: 24271 - protein, 8 aa, Homo Sapiens
LYWSHPRK

SEQ ID NO: 24272 - protein, 8 aa, Homo Sapiens
MGAYVLLK

SEQ ID NO: 24273 - protein, 8 aa, Homo Sapiens
MLDTVVFK

SEQ ID NO: 24274 - protein, 8 aa, Homo Sapiens
MRVGLVAK

SEQ ID NO: 24275 - protein, 8 aa, Homo Sapiens
NAHSNILK

SEQ ID NO: 24276 - protein, 8 aa, Homo Sapiens
PALKQTPK

SEQ ID NO: 24277 - protein, 8 aa, Homo Sapiens
PANTPLRK

SEQ ID NO: 24278 - protein, 8 aa, Homo Sapiens
PDGKPLVR

SEQ ID NO: 24279 - protein, 8 aa, Homo Sapiens
PEKQLVEK

SEQ ID NO: 24280 - protein, 8 aa, Homo Sapiens
PITIFQER

SEQ ID NO: 24281 - protein, 8 aa, Homo Sapiens
PKDIQLAR

SEQ ID NO: 24282 - protein, 8 aa, Homo Sapiens
PLAGLAPK

SEQ ID NO: 24283 - protein, 8 aa, Homo Sapiens
PLDFPSKK

SEQ ID NO: 24284 - protein, 8 aa, Homo Sapiens
PLVDTHSK

SEQ ID NO: 24285 - protein, 8 aa, Homo Sapiens
PPELVKQK

SEQ ID NO: 24286 - protein, 8 aa, Homo Sapiens
PPLSPYFK

SEQ ID NO: 24287 - protein, 8 aa, Homo Sapiens
PQKPQTNK

SEQ ID NO: 24288 - protein, 8 aa, Homo Sapiens
PSLLTNPK

SEQ ID NO: 24289 - protein, 8 aa, Homo Sapiens
PSTPIAHR

SEQ ID NO: 24290 - protein, 8 aa, Homo Sapiens
PTNIIAAK

SEQ ID NO: 24291 - protein, 8 aa, Homo Sapiens
PTSPIRVK

SEQ ID NO: 24292 - protein, 8 aa, Homo Sapiens
QAESLRYK

SEQ ID NO: 24293 - protein, 8 aa, Homo Sapiens
QILVGVNK

SEQ ID NO: 24294 - protein, 8 aa, Homo Sapiens
QLLAKIYK

SEQ ID NO: 24295 - protein, 8 aa, Homo Sapiens
QSGEQPYK

SEQ ID NO: 24296 - protein, 8 aa, Homo Sapiens
RAKFKQLL

SEQ ID NO: 24297 - protein, 8 aa, Homo Sapiens
RYRVLHKR

SEQ ID NO: 24298 - protein, 8 aa, Homo Sapiens
SDFHPVKK

SEQ ID NO: 24299 - protein, 8 aa, Homo Sapiens
SDVVTAVR

SEQ ID NO: 24300 - protein, 8 aa, Homo Sapiens
SFDKAKLK

SEQ ID NO: 24301 - protein, 8 aa, Homo Sapiens
SFPIGIYK

SEQ ID NO: 24302 - protein, 8 aa, Homo Sapiens
SLDLDVNV

SEQ ID NO: 24303 - protein, 8 aa, Homo Sapiens
SNFKSPVK

SEQ ID NO: 24304 - protein, 8 aa, Homo Sapiens
SPIIIHRL

SEQ ID NO: 24305 - protein, 8 aa, Homo Sapiens
SSDVIIHR

SEQ ID NO: 24306 - protein, 8 aa, Homo Sapiens
SSGKFMYL

SEQ ID NO: 24307 - protein, 8 aa, Homo Sapiens
SSHVPIQK

SEQ ID NO: 24308 - protein, 8 aa, Homo Sapiens
STAFKGEK

SEQ ID NO: 24309 - protein, 8 aa, Homo Sapiens
SVAELDDK

SEQ ID NO: 24310 - protein, 8 aa, Homo Sapiens
SVLGPNAR

SEQ ID NO: 24311 - protein, 8 aa, Homo Sapiens
SVYITLKK

SEQ ID NO: 24312 - protein, 8 aa, Homo Sapiens
TADVHFER

SEQ ID NO: 24313 - protein, 8 aa, Homo Sapiens
TDKSFVEK

SEQ ID NO: 24314 - protein, 8 aa, Homo Sapiens
TEAPLNPK

SEQ ID NO: 24315 - protein, 8 aa, Homo Sapiens
TFYGPVKK

SEQ ID NO: 24316 - protein, 8 aa, Homo Sapiens
TITLYGKS

SEQ ID NO: 24317 - protein, 8 aa, Homo Sapiens
TLDVAVRR

SEQ ID NO: 24318 - protein, 8 aa, Homo Sapiens
TLPKPVQK

SEQ ID NO: 24319 - protein, 8 aa, Homo Sapiens
TNPFRPQK

SEQ ID NO: 24320 - protein, 8 aa, Homo Sapiens
TTLPIRNK

SEQ ID NO: 24321 - protein, 8 aa, Homo Sapiens
TVAGVHVK

SEQ ID NO: 24322 - protein, 8 aa, Homo Sapiens
TVDIFHKK

SEQ ID NO: 24323 - protein, 8 aa, Homo Sapiens
TVLYIVKK

SEQ ID NO: 24324 - protein, 8 aa, Homo Sapiens
VCEYIVKK

SEQ ID NO: 24325 - protein, 8 aa, Homo Sapiens
VGPETLGR

SEQ ID NO: 24326 - protein, 8 aa, Homo Sapiens
VIENLPKK

SEQ ID NO: 24327 - protein, 8 aa, Homo Sapiens
VIHFNNPK

SEQ ID NO: 24328 - protein, 8 aa, Homo Sapiens
VINKVHLK

SEQ ID NO: 24329 - protein, 8 aa, Homo Sapiens
VIPFTIKK

SEQ ID NO: 24330 - protein, 8 aa, Homo Sapiens
VLDFVKQK

SEQ ID NO: 24331 - protein, 8 aa, Homo Sapiens
VMRDPASK

SEQ ID NO: 24332 - protein, 8 aa, Homo Sapiens
VMRDPQTK

SEQ ID NO: 24333 - protein, 8 aa, Homo Sapiens
VNGKVLSK

SEQ ID NO: 24334 - protein, 8 aa, Homo Sapiens
VNMVPFPR

SEQ ID NO: 24335 - protein, 8 aa, Homo Sapiens
VQEFGLAR

SEQ ID NO: 24336 - protein, 8 aa, Homo Sapiens
VQKNKIEK

SEQ ID NO: 24337 - protein, 8 aa, Homo Sapiens
VQVQETVR

SEQ ID NO: 24338 - protein, 8 aa, Homo Sapiens
VSEKQFSK

SEQ ID NO: 24339 - protein, 8 aa, Homo Sapiens
VSLTACKV

SEQ ID NO: 24340 - protein, 8 aa, Homo Sapiens
VSNLSPKL

SEQ ID NO: 24341 - protein, 8 aa, Homo Sapiens
VTLELGGK

SEQ ID NO: 24342 - protein, 8 aa, Homo Sapiens
YCFPGVTL

SEQ ID NO: 24343 - protein, 8 aa, Homo Sapiens
YDHQGIFK

SEQ ID NO: 24344 - protein, 8 aa, Homo Sapiens
YGDVQRVK

SEQ ID NO: 24345 - protein, 9 aa, Homo Sapiens
AAADICFTK

SEQ ID NO: 24346 - protein, 9 aa, Homo Sapiens
AAAKVILKK

SEQ ID NO: 24347 - protein, 9 aa, Homo Sapiens
AAAPVTPLR

SEQ ID NO: 24348 - protein, 9 aa, Homo Sapiens
AAATPAIKK

SEQ ID NO: 24349 - protein, 9 aa, Homo Sapiens
AAATSVLKT

SEQ ID NO: 24350 - protein, 9 aa, Homo Sapiens
AACSKFFYK

SEQ ID NO: 24351 - protein, 9 aa, Homo Sapiens
AAFGGTFKK

SEQ ID NO: 24352 - protein, 9 aa, Homo Sapiens
AAFVPLLLK

SEQ ID NO: 24353 - protein, 9 aa, Homo Sapiens
AAGPPGPFR

SEQ ID NO: 24354 - protein, 9 aa, Homo Sapiens
AAIATIKTK

SEQ ID NO: 24355 - protein, 9 aa, Homo Sapiens
AAISLAFSK

SEQ ID NO: 24356 - protein, 9 aa, Homo Sapiens
AAITLAFSK

SEQ ID NO: 24357 - protein, 9 aa, Homo Sapiens
AALAKAIEK

SEQ ID NO: 24358 - protein, 9 aa, Homo Sapiens
AALDKYAKK

SEQ ID NO: 24359 - protein, 9 aa, Homo Sapiens
AALDWVTKK

SEQ ID NO: 24360 - protein, 9 aa, Homo Sapiens
AALKVLPPT

SEQ ID NO: 24361 - protein, 9 aa, Homo Sapiens
AAMEPLTAR

SEQ ID NO: 24362 - protein, 9 aa, Homo Sapiens
AAMLMPHQK

SEQ ID NO: 24363 - protein, 9 aa, Homo Sapiens
AAVGYIMEK

SEQ ID NO: 24364 - protein, 9 aa, Homo Sapiens
AAYAHELPK

SEQ ID NO: 24365 - protein, 9 aa, Homo Sapiens
AAYAWPFYK

SEQ ID NO: 24366 - protein, 9 aa, Homo Sapiens
AAYNVPLPK

SEQ ID NO: 24367 - protein, 9 aa, Homo Sapiens
ADSWKSLGK

SEQ ID NO: 24368 - protein, 9 aa, Homo Sapiens
AGAAVLPVK

SEQ ID NO: 24369 - protein, 9 aa, Homo Sapiens
AGISFSVKK

SEQ ID NO: 24370 - protein, 9 aa, Homo Sapiens
AGISKRWPK

SEQ ID NO: 24371 - protein, 9 aa, Homo Sapiens
AGMALGIQK

SEQ ID NO: 24372 - protein, 9 aa, Homo Sapiens
AGNFYINDK

SEQ ID NO: 24373 - protein, 9 aa, Homo Sapiens
AGPEPLPPK

SEQ ID NO: 24374 - protein, 9 aa, Homo Sapiens
AIASTLVHK

SEQ ID NO: 24375 - protein, 9 aa, Homo Sapiens
AIDQLHLEY

SEQ ID NO: 24376 - protein, 9 aa, Homo Sapiens
AIFDKSTGK

SEQ ID NO: 24377 - protein, 9 aa, Homo Sapiens
AIFEISYFK

SEQ ID NO: 24378 - protein, 9 aa, Homo Sapiens
AIFKPVMSK

SEQ ID NO: 24379 - protein, 9 aa, Homo Sapiens
AIFPRAFPK

SEQ ID NO: 24380 - protein, 9 aa, Homo Sapiens
AIFTKAYQR

SEQ ID NO: 24381 - protein, 9 aa, Homo Sapiens
AIIDTVINY

SEQ ID NO: 24382 - protein, 9 aa, Homo Sapiens
AIIQHMIKK

SEQ ID NO: 24383 - protein, 9 aa, Homo Sapiens
AIITPPPAK

SEQ ID NO: 24384 - protein, 9 aa, Homo Sapiens
AILDKNFRK

SEQ ID NO: 24385 - protein, 9 aa, Homo Sapiens
AILDYLITK

SEQ ID NO: 24386 - protein, 9 aa, Homo Sapiens
AILLPQPLK

SEQ ID NO: 24387 - protein, 9 aa, Homo Sapiens
AILLPQPPK

SEQ ID NO: 24388 - protein, 9 aa, Homo Sapiens
AILSKFLYY

SEQ ID NO: 24389 - protein, 9 aa, Homo Sapiens
AILTSLIEK

SEQ ID NO: 24390 - protein, 9 aa, Homo Sapiens
AIMDPLPLR

SEQ ID NO: 24391 - protein, 9 aa, Homo Sapiens
AINDKSIVK

SEQ ID NO: 24392 - protein, 9 aa, Homo Sapiens
AIPGFTINR

SEQ ID NO: 24393 - protein, 9 aa, Homo Sapiens
AISEYIATK

SEQ ID NO: 24394 - protein, 9 aa, Homo Sapiens
AIVAYGLYK

SEQ ID NO: 24395 - protein, 9 aa, Homo Sapiens
AIVKLFLKK

SEQ ID NO: 24396 - protein, 9 aa, Homo Sapiens
AIVNFVNQK

SEQ ID NO: 24397 - protein, 9 aa, Homo Sapiens
AIYAKPANK

SEQ ID NO: 24398 - protein, 9 aa, Homo Sapiens
AIYEPKTFK

SEQ ID NO: 24399 - protein, 9 aa, Homo Sapiens
ALASVVIHK

SEQ ID NO: 24400 - protein, 9 aa, Homo Sapiens
ALFDGVVSK

SEQ ID NO: 24401 - protein, 9 aa, Homo Sapiens
ALFSRIFGK

SEQ ID NO: 24402 - protein, 9 aa, Homo Sapiens
ALGAGFSDK

SEQ ID NO: 24403 - protein, 9 aa, Homo Sapiens
ALLDITVTK

SEQ ID NO: 24404 - protein, 9 aa, Homo Sapiens
ALLKWCQKK

SEQ ID NO: 24405 - protein, 9 aa, Homo Sapiens
ALLVKQPPP

SEQ ID NO: 24406 - protein, 9 aa, Homo Sapiens
ALMEKFKKK

SEQ ID NO: 24407 - protein, 9 aa, Homo Sapiens
ALQEIYNQK

SEQ ID NO: 24408 - protein, 9 aa, Homo Sapiens
AMIEVNINK

SEQ ID NO: 24409 - protein, 9 aa, Homo Sapiens
AMLDTVVFK

SEQ ID NO: 24410 - protein, 9 aa, Homo Sapiens
AQADPLVRR

SEQ ID NO: 24411 - protein, 9 aa, Homo Sapiens
AQAESLRYK

SEQ ID NO: 24412 - protein, 9 aa, Homo Sapiens
AQATISFPK

SEQ ID NO: 24413 - protein, 9 aa, Homo Sapiens
AQATVLHLK

SEQ ID NO: 24414 - protein, 9 aa, Homo Sapiens
AQCGKAFPK

SEQ ID NO: 24415 - protein, 9 aa, Homo Sapiens
AQCQIFMEK

SEQ ID NO: 24416 - protein, 9 aa, Homo Sapiens
AQFIPKFFK

SEQ ID NO: 24417 - protein, 9 aa, Homo Sapiens
AQFRQPLKK

SEQ ID NO: 24418 - protein, 9 aa, Homo Sapiens
AQGKPLALK

SEQ ID NO: 24419 - protein, 9 aa, Homo Sapiens
AQIFEPLHK

SEQ ID NO: 24420 - protein, 9 aa, Homo Sapiens
AQIKEHLLK

SEQ ID NO: 24421 - protein, 9 aa, Homo Sapiens
AQINSVFNK

SEQ ID NO: 24422 - protein, 9 aa, Homo Sapiens
AQLLESQQK

SEQ ID NO: 24423 - protein, 9 aa, Homo Sapiens
AQMEGFLNR

SEQ ID NO: 24424 - protein, 9 aa, Homo Sapiens
AQNEKSFFK

SEQ ID NO: 24425 - protein, 9 aa, Homo Sapiens
AQNEPLTQK

SEQ ID NO: 24426 - protein, 9 aa, Homo Sapiens
AQNPSLFVK

SEQ ID NO: 24427 - protein, 9 aa, Homo Sapiens
AQQKVTLPK

SEQ ID NO: 24428 - protein, 9 aa, Homo Sapiens
AQWQKVLPR

SEQ ID NO: 24429 - protein, 9 aa, Homo Sapiens
ASAIPAYSK

SEQ ID NO: 24430 - protein, 9 aa, Homo Sapiens
ASAPVTVKR

SEQ ID NO: 24431 - protein, 9 aa, Homo Sapiens
ASATALVSR

SEQ ID NO: 24432 - protein, 9 aa, Homo Sapiens
ASATVAIPK

SEQ ID NO: 24433 - protein, 9 aa, Homo Sapiens
ASAYSIAQK

SEQ ID NO: 24434 - protein, 9 aa, Homo Sapiens
ASCQYSLLK

SEQ ID NO: 24435 - protein, 9 aa, Homo Sapiens
ASCWIPLLK

SEQ ID NO: 24436 - protein, 9 aa, Homo Sapiens
ASCYLKQGK

SEQ ID NO: 24437 - protein, 9 aa, Homo Sapiens
ASDPHIIIK

SEQ ID NO: 24438 - protein, 9 aa, Homo Sapiens
ASDPTVFHK

SEQ ID NO: 24439 - protein, 9 aa, Homo Sapiens
ASEVLKHLK

SEQ ID NO: 24440 - protein, 9 aa, Homo Sapiens
ASFAFEFPK

SEQ ID NO: 24441 - protein, 9 aa, Homo Sapiens
ASFCGAVFR

SEQ ID NO: 24442 - protein, 9 aa, Homo Sapiens
ASFDKAKLK

SEQ ID NO: 24443 - protein, 9 aa, Homo Sapiens
ASFEPFSNK

SEQ ID NO: 24444 - protein, 9 aa, Homo Sapiens
ASFFGVHPK

SEQ ID NO: 24445 - protein, 9 aa, Homo Sapiens
ASFNDTFVH

SEQ ID NO: 24446 - protein, 9 aa, Homo Sapiens
ASFPKVFIK

SEQ ID NO: 24447 - protein, 9 aa, Homo Sapiens
ASFQSTSVK

SEQ ID NO: 24448 - protein, 9 aa, Homo Sapiens
ASGSTTFTK

SEQ ID NO: 24449 - protein, 9 aa, Homo Sapiens
ASHYIHIVK

SEQ ID NO: 24450 - protein, 9 aa, Homo Sapiens
ASIDATYAK

SEQ ID NO: 24451 - protein, 9 aa, Homo Sapiens
ASIDFRFGK

SEQ ID NO: 24452 - protein, 9 aa, Homo Sapiens
ASIDWLAQR

SEQ ID NO: 24453 - protein, 9 aa, Homo Sapiens
ASIPHVIAR

SEQ ID NO: 24454 - protein, 9 aa, Homo Sapiens
ASIPTILTH

SEQ ID NO: 24455 - protein, 9 aa, Homo Sapiens
ASLADIMAK

SEQ ID NO: 24456 - protein, 9 aa, Homo Sapiens
ASLATTLTK

SEQ ID NO: 24457 - protein, 9 aa, Homo Sapiens
ASLFSVLVR

SEQ ID NO: 24458 - protein, 9 aa, Homo Sapiens
ASLGASVHK

SEQ ID NO: 24459 - protein, 9 aa, Homo Sapiens
ASLGFLVAK

SEQ ID NO: 24460 - protein, 9 aa, Homo Sapiens
ASLGLKFNK

SEQ ID NO: 24461 - protein, 9 aa, Homo Sapiens
ASLGNLFAR

SEQ ID NO: 24462 - protein, 9 aa, Homo Sapiens
ASLIRLVPK

SEQ ID NO: 24463 - protein, 9 aa, Homo Sapiens
ASLPLAVTK

SEQ ID NO: 24464 - protein, 9 aa, Homo Sapiens
ASLPSILQY

SEQ ID NO: 24465 - protein, 9 aa, Homo Sapiens
ASLPVRNAK

SEQ ID NO: 24466 - protein, 9 aa, Homo Sapiens
ASLQSIIHK

SEQ ID NO: 24467 - protein, 9 aa, Homo Sapiens
ASLQSVVHK

SEQ ID NO: 24468 - protein, 9 aa, Homo Sapiens
ASLTDTVNK

SEQ ID NO: 24469 - protein, 9 aa, Homo Sapiens
ASLTNPFGK

SEQ ID NO: 24470 - protein, 9 aa, Homo Sapiens
ASMAIKNPK

SEQ ID NO: 24471 - protein, 9 aa, Homo Sapiens
ASMPVDIAK

SEQ ID NO: 24472 - protein, 9 aa, Homo Sapiens
ASNFKSPVK

SEQ ID NO: 24473 - protein, 9 aa, Homo Sapiens
ASNPAMLLY

SEQ ID NO: 24474 - protein, 9 aa, Homo Sapiens
ASNPATFQR

SEQ ID NO: 24475 - protein, 9 aa, Homo Sapiens
ASQELWLNH

SEQ ID NO: 24476 - protein, 9 aa, Homo Sapiens
ASQGFDFNK

SEQ ID NO: 24477 - protein, 9 aa, Homo Sapiens
ASQGFRFLR

SEQ ID NO: 24478 - protein, 9 aa, Homo Sapiens
ASQPEFPSR

SEQ ID NO: 24479 - protein, 9 aa, Homo Sapiens
ASSASMPYK

SEQ ID NO: 24480 - protein, 9 aa, Homo Sapiens
ASSEDTLLK

SEQ ID NO: 24481 - protein, 9 aa, Homo Sapiens
ASSGTCFPR

SEQ ID NO: 24482 - protein, 9 aa, Homo Sapiens
ASSHVPIQK

SEQ ID NO: 24483 - protein, 9 aa, Homo Sapiens
ASSIFVAPR

SEQ ID NO: 24484 - protein, 9 aa, Homo Sapiens
ASSPPAIPK

SEQ ID NO: 24485 - protein, 9 aa, Homo Sapiens
ASSTPTPIR

SEQ ID NO: 24486 - protein, 9 aa, Homo Sapiens
ASSYIAHLR

SEQ ID NO: 24487 - protein, 9 aa, Homo Sapiens
ASTFVDQCK

SEQ ID NO: 24488 - protein, 9 aa, Homo Sapiens
ASTPPLPRR

SEQ ID NO: 24489 - protein, 9 aa, Homo Sapiens
ASTRTIFKK

SEQ ID NO: 24490 - protein, 9 aa, Homo Sapiens
ASTTVLALK

SEQ ID NO: 24491 - protein, 9 aa, Homo Sapiens
ASVGYAVTK

SEQ ID NO: 24492 - protein, 9 aa, Homo Sapiens
ASVILPILK

SEQ ID NO: 24493 - protein, 9 aa, Homo Sapiens
ASVKAIFSK

SEQ ID NO: 24494 - protein, 9 aa, Homo Sapiens
ASVLNPYVK

SEQ ID NO: 24495 - protein, 9 aa, Homo Sapiens
ASVPAQAPK

SEQ ID NO: 24496 - protein, 9 aa, Homo Sapiens
ASVQPPPRP

SEQ ID NO: 24497 - protein, 9 aa, Homo Sapiens
ASVYQPLKK

SEQ ID NO: 24498 - protein, 9 aa, Homo Sapiens
ASWGGTIEK

SEQ ID NO: 24499 - protein, 9 aa, Homo Sapiens
ASYPEALAK

SEQ ID NO: 24500 - protein, 9 aa, Homo Sapiens
ASYTKIVVK

SEQ ID NO: 24501 - protein, 9 aa, Homo Sapiens
ASYVSPVLK

SEQ ID NO: 24502 - protein, 9 aa, Homo Sapiens
ATAAGDVIK

SEQ ID NO: 24503 - protein, 9 aa, Homo Sapiens
ATADVVILY

SEQ ID NO: 24504 - protein, 9 aa, Homo Sapiens
ATAEECLKH

SEQ ID NO: 24505 - protein, 9 aa, Homo Sapiens
ATAELIMSR

SEQ ID NO: 24506 - protein, 9 aa, Homo Sapiens
ATAGFTIGR

SEQ ID NO: 24507 - protein, 9 aa, Homo Sapiens
ATALEYVYK

SEQ ID NO: 24508 - protein, 9 aa, Homo Sapiens
ATANQIILK

SEQ ID NO: 24509 - protein, 9 aa, Homo Sapiens
ATAPPAPAY

SEQ ID NO: 24510 - protein, 9 aa, Homo Sapiens
ATAQFKINK

SEQ ID NO: 24511 - protein, 9 aa, Homo Sapiens
ATASPIVAR

SEQ ID NO: 24512 - protein, 9 aa, Homo Sapiens
ATATELTTK

SEQ ID NO: 24513 - protein, 9 aa, Homo Sapiens
ATATLIIEH

SEQ ID NO: 24514 - protein, 9 aa, Homo Sapiens
ATATMSLGK

SEQ ID NO: 24515 - protein, 9 aa, Homo Sapiens
ATATQLLQH

SEQ ID NO: 24516 - protein, 9 aa, Homo Sapiens
ATATVYFKR

SEQ ID NO: 24517 - protein, 9 aa, Homo Sapiens
ATCYPDFSK

SEQ ID NO: 24518 - protein, 9 aa, Homo Sapiens
ATDIPSSQK

SEQ ID NO: 24519 - protein, 9 aa, Homo Sapiens
ATDPNILGR

SEQ ID NO: 24520 - protein, 9 aa, Homo Sapiens
ATDPNILSL

SEQ ID NO: 24521 - protein, 9 aa, Homo Sapiens
ATEQPLTAK

SEQ ID NO: 24522 - protein, 9 aa, Homo Sapiens
ATESGMLYH

SEQ ID NO: 24523 - protein, 9 aa, Homo Sapiens
ATESMCFTK

SEQ ID NO: 24524 - protein, 9 aa, Homo Sapiens
ATEVAPLYK

SEQ ID NO: 24525 - protein, 9 aa, Homo Sapiens
ATFFGEVVK

SEQ ID NO: 24526 - protein, 9 aa, Homo Sapiens
ATFHTPFSH

SEQ ID NO: 24527 - protein, 9 aa, Homo Sapiens
ATFLDPRYK

SEQ ID NO: 24528 - protein, 9 aa, Homo Sapiens
ATFLIQLER

SEQ ID NO: 24529 - protein, 9 aa, Homo Sapiens
ATFPDPNVK

SEQ ID NO: 24530 - protein, 9 aa, Homo Sapiens
ATFPGMWER

SEQ ID NO: 24531 - protein, 9 aa, Homo Sapiens
ATFPLSVQK

SEQ ID NO: 24532 - protein, 9 aa, Homo Sapiens
ATFPVAPRY

SEQ ID NO: 24533 - protein, 9 aa, Homo Sapiens
ATFQFTVER

SEQ ID NO: 24534 - protein, 9 aa, Homo Sapiens
ATFSSSHRY

SEQ ID NO: 24535 - protein, 9 aa, Homo Sapiens
ATFSTGERK

SEQ ID NO: 24536 - protein, 9 aa, Homo Sapiens
ATFTGILGK

SEQ ID NO: 24537 - protein, 9 aa, Homo Sapiens
ATFTNVFGK

SEQ ID NO: 24538 - protein, 9 aa, Homo Sapiens
ATFTVMGLK

SEQ ID NO: 24539 - protein, 9 aa, Homo Sapiens
ATFTYFYKK

SEQ ID NO: 24540 - protein, 9 aa, Homo Sapiens
ATFYGPVKK

SEQ ID NO: 24541 - protein, 9 aa, Homo Sapiens
ATGDVALLR

SEQ ID NO: 24542 - protein, 9 aa, Homo Sapiens
ATGESIAVK

SEQ ID NO: 24543 - protein, 9 aa, Homo Sapiens
ATGFLEQLK

SEQ ID NO: 24544 - protein, 9 aa, Homo Sapiens
ATGNWGDQK

SEQ ID NO: 24545 - protein, 9 aa, Homo Sapiens
ATGPPNTSY

SEQ ID NO: 24546 - protein, 9 aa, Homo Sapiens
ATGQWTRFK

SEQ ID NO: 24547 - protein, 9 aa, Homo Sapiens
ATGSVFTGK

SEQ ID NO: 24548 - protein, 9 aa, Homo Sapiens
ATHTAFVAK

SEQ ID NO: 24549 - protein, 9 aa, Homo Sapiens
ATIALMIQR

SEQ ID NO: 24550 - protein, 9 aa, Homo Sapiens
ATIEELTEK

SEQ ID NO: 24551 - protein, 9 aa, Homo Sapiens
ATIGAALGR

SEQ ID NO: 24552 - protein, 9 aa, Homo Sapiens
ATIIDILEY

SEQ ID NO: 24553 - protein, 9 aa, Homo Sapiens
ATIIGEWVK

SEQ ID NO: 24554 - protein, 9 aa, Homo Sapiens
ATIIGQCVR

SEQ ID NO: 24555 - protein, 9 aa, Homo Sapiens
ATIKMTVER

SEQ ID NO: 24556 - protein, 9 aa, Homo Sapiens
ATIMGVRFK

SEQ ID NO: 24557 - protein, 9 aa, Homo Sapiens
ATINYPFEK

SEQ ID NO: 24558 - protein, 9 aa, Homo Sapiens
ATINYSLLR

SEQ ID NO: 24559 - protein, 9 aa, Homo Sapiens
ATIQGAYAR

SEQ ID NO: 24560 - protein, 9 aa, Homo Sapiens
ATIQNETPK

SEQ ID NO: 24561 - protein, 9 aa, Homo Sapiens
ATIRKWLTK

SEQ ID NO: 24562 - protein, 9 aa, Homo Sapiens
ATISFPKRK

SEQ ID NO: 24563 - protein, 9 aa, Homo Sapiens
ATITKVLQK

SEQ ID NO: 24564 - protein, 9 aa, Homo Sapiens
ATIVDLVER

SEQ ID NO: 24565 - protein, 9 aa, Homo Sapiens
ATIVYHLAR

SEQ ID NO: 24566 - protein, 9 aa, Homo Sapiens
ATKAVCVLK

SEQ ID NO: 24567 - protein, 9 aa, Homo Sapiens
ATKIKNYYK

SEQ ID NO: 24568 - protein, 9 aa, Homo Sapiens
ATLAAVLQR

SEQ ID NO: 24569 - protein, 9 aa, Homo Sapiens
ATLDLNAVK

SEQ ID NO: 24570 - protein, 9 aa, Homo Sapiens
ATLDRQLNH

SEQ ID NO: 24571 - protein, 9 aa, Homo Sapiens
ATLDVAVRR

SEQ ID NO: 24572 - protein, 9 aa, Homo Sapiens
ATLEETLVK

SEQ ID NO: 24573 - protein, 9 aa, Homo Sapiens
ATLEIVTDK

SEQ ID NO: 24574 - protein, 9 aa, Homo Sapiens
ATLETILRH

SEQ ID NO: 24575 - protein, 9 aa, Homo Sapiens
ATLFFILRK

SEQ ID NO: 24576 - protein, 9 aa, Homo Sapiens
ATLGAILNR

SEQ ID NO: 24577 - protein, 9 aa, Homo Sapiens
ATLHHVIDK

SEQ ID NO: 24578 - protein, 9 aa, Homo Sapiens
ATLHSFDVK

SEQ ID NO: 24579 - protein, 9 aa, Homo Sapiens
ATLKGLVQK

SEQ ID NO: 24580 - protein, 9 aa, Homo Sapiens
ATLLIFANK

SEQ ID NO: 24581 - protein, 9 aa, Homo Sapiens
ATLNSFIHV

SEQ ID NO: 24582 - protein, 9 aa, Homo Sapiens
ATLNSIVAK

SEQ ID NO: 24583 - protein, 9 aa, Homo Sapiens
ATLNVSTTR

SEQ ID NO: 24584 - protein, 9 aa, Homo Sapiens
ATLQDIIRR

SEQ ID NO: 24585 - protein, 9 aa, Homo Sapiens
ATLQEALAH

SEQ ID NO: 24586 - protein, 9 aa, Homo Sapiens
ATLQNVLRK

SEQ ID NO: 24587 - protein, 9 aa, Homo Sapiens
ATLQYIVGR

SEQ ID NO: 24588 - protein, 9 aa, Homo Sapiens
ATLRLIIRH

SEQ ID NO: 24589 - protein, 9 aa, Homo Sapiens
ATLSICSPK

SEQ ID NO: 24590 - protein, 9 aa, Homo Sapiens
ATLTKDVPK

SEQ ID NO: 24591 - protein, 9 aa, Homo Sapiens
ATLTNILEH

SEQ ID NO: 24592 - protein, 9 aa, Homo Sapiens
ATLWGGLLR

SEQ ID NO: 24593 - protein, 9 aa, Homo Sapiens
ATLYLGWNR

SEQ ID NO: 24594 - protein, 9 aa, Homo Sapiens
ATMEDTVEY

SEQ ID NO: 24595 - protein, 9 aa, Homo Sapiens
ATMPPAVER

SEQ ID NO: 24596 - protein, 9 aa, Homo Sapiens
ATMYNLLAY

SEQ ID NO: 24597 - protein, 9 aa, Homo Sapiens
ATNGAKFLK

SEQ ID NO: 24598 - protein, 9 aa, Homo Sapiens
ATNIDEIYK

SEQ ID NO: 24599 - protein, 9 aa, Homo Sapiens
ATNRSVYFK

SEQ ID NO: 24600 - protein, 9 aa, Homo Sapiens
ATNSSMFLK

SEQ ID NO: 24601 - protein, 9 aa, Homo Sapiens
ATNYITRNK

SEQ ID NO: 24602 - protein, 9 aa, Homo Sapiens
ATPNEIFLK

SEQ ID NO: 24603 - protein, 9 aa, Homo Sapiens
ATPPFTHSK

SEQ ID NO: 24604 - protein, 9 aa, Homo Sapiens
ATPSSSLPK

SEQ ID NO: 24605 - protein, 9 aa, Homo Sapiens
ATQAHSLSY

SEQ ID NO: 24606 - protein, 9 aa, Homo Sapiens
ATQAVFQKR

SEQ ID NO: 24607 - protein, 9 aa, Homo Sapiens
ATQDPAALR

SEQ ID NO: 24608 - protein, 9 aa, Homo Sapiens
ATQERTDLY

SEQ ID NO: 24609 - protein, 9 aa, Homo Sapiens
ATQFENWYK

SEQ ID NO: 24610 - protein, 9 aa, Homo Sapiens
ATQILSVPK

SEQ ID NO: 24611 - protein, 9 aa, Homo Sapiens
ATQLLKLAH

SEQ ID NO: 24612 - protein, 9 aa, Homo Sapiens
ATQQDVFQH

SEQ ID NO: 24613 - protein, 9 aa, Homo Sapiens
ATQSFSTFR

SEQ ID NO: 24614 - protein, 9 aa, Homo Sapiens
ATQTQFFHV

SEQ ID NO: 24615 - protein, 9 aa, Homo Sapiens
ATQTSVVVK

SEQ ID NO: 24616 - protein, 9 aa, Homo Sapiens
ATSAFQTQK

SEQ ID NO: 24617 - protein, 9 aa, Homo Sapiens
ATSAPLVSR

SEQ ID NO: 24618 - protein, 9 aa, Homo Sapiens
ATSAVTVTR

SEQ ID NO: 24619 - protein, 9 aa, Homo Sapiens
ATSDMDIGK

SEQ ID NO: 24620 - protein, 9 aa, Homo Sapiens
ATSEIFASK

SEQ ID NO: 24621 - protein, 9 aa, Homo Sapiens
ATSGVVAVR

SEQ ID NO: 24622 - protein, 9 aa, Homo Sapiens
ATSIPAILK

SEQ ID NO: 24623 - protein, 9 aa, Homo Sapiens
ATSKVALVY

SEQ ID NO: 24624 - protein, 9 aa, Homo Sapiens
ATSLGHFTK

SEQ ID NO: 24625 - protein, 9 aa, Homo Sapiens
ATSLVFKQK

SEQ ID NO: 24626 - protein, 9 aa, Homo Sapiens
ATSPALFNR

SEQ ID NO: 24627 - protein, 9 aa, Homo Sapiens
ATSPGRLFR

SEQ ID NO: 24628 - protein, 9 aa, Homo Sapiens
ATSPIIIHR

SEQ ID NO: 24629 - protein, 9 aa, Homo Sapiens
ATSPLQENR

SEQ ID NO: 24630 - protein, 9 aa, Homo Sapiens
ATSPVVYTR

SEQ ID NO: 24631 - protein, 9 aa, Homo Sapiens
ATSQTLLAK

SEQ ID NO: 24632 - protein, 9 aa, Homo Sapiens
ATSRTYLYR

SEQ ID NO: 24633 - protein, 9 aa, Homo Sapiens
ATSSVSALK

SEQ ID NO: 24634 - protein, 9 aa, Homo Sapiens
ATSVITIVK

SEQ ID NO: 24635 - protein, 9 aa, Homo Sapiens
ATSYLWFKK

SEQ ID NO: 24636 - protein, 9 aa, Homo Sapiens
ATTALAIYH

SEQ ID NO: 24637 - protein, 9 aa, Homo Sapiens
ATTGKILEK

SEQ ID NO: 24638 - protein, 9 aa, Homo Sapiens
ATTLPIRNK

SEQ ID NO: 24639 - protein, 9 aa, Homo Sapiens
ATTPMAVHR

SEQ ID NO: 24640 - protein, 9 aa, Homo Sapiens
ATTQTIMQK

SEQ ID NO: 24641 - protein, 9 aa, Homo Sapiens
ATTSLSLRR

SEQ ID NO: 24642 - protein, 9 aa, Homo Sapiens
ATTTVMNPK

SEQ ID NO: 24643 - protein, 9 aa, Homo Sapiens
ATVAALQEK

SEQ ID NO: 24644 - protein, 9 aa, Homo Sapiens
ATVAGVHVK

SEQ ID NO: 24645 - protein, 9 aa, Homo Sapiens
ATVDIVQKK

SEQ ID NO: 24646 - protein, 9 aa, Homo Sapiens
ATVITTEKR

SEQ ID NO: 24647 - protein, 9 aa, Homo Sapiens
ATVKEQIVK

SEQ ID NO: 24648 - protein, 9 aa, Homo Sapiens
ATVKVPFLK

SEQ ID NO: 24649 - protein, 9 aa, Homo Sapiens
ATVLTSVKK

SEQ ID NO: 24650 - protein, 9 aa, Homo Sapiens
ATVLYIVKK

SEQ ID NO: 24651 - protein, 9 aa, Homo Sapiens
ATVNEIVLK

SEQ ID NO: 24652 - protein, 9 aa, Homo Sapiens
ATVYLIYLK

SEQ ID NO: 24653 - protein, 9 aa, Homo Sapiens
ATYGLNVER

SEQ ID NO: 24654 - protein, 9 aa, Homo Sapiens
ATYILEAGK

SEQ ID NO: 24655 - protein, 9 aa, Homo Sapiens
ATYPMPTAK

SEQ ID NO: 24656 - protein, 9 aa, Homo Sapiens
ATYPYQVVR

SEQ ID NO: 24657 - protein, 9 aa, Homo Sapiens
ATYRDWISK

SEQ ID NO: 24658 - protein, 9 aa, Homo Sapiens
ATYREFVHR

SEQ ID NO: 24659 - protein, 9 aa, Homo Sapiens
ATYSVGMQK

SEQ ID NO: 24660 - protein, 9 aa, Homo Sapiens
ATYTPQAPK

SEQ ID NO: 24661 - protein, 9 aa, Homo Sapiens
ATYYGSLFK

SEQ ID NO: 24662 - protein, 9 aa, Homo Sapiens
AVAAAAYYR

SEQ ID NO: 24663 - protein, 9 aa, Homo Sapiens
AVAAFQVEK

SEQ ID NO: 24664 - protein, 9 aa, Homo Sapiens
AVAAFVLYK

SEQ ID NO: 24665 - protein, 9 aa, Homo Sapiens
AVADAVIEK

SEQ ID NO: 24666 - protein, 9 aa, Homo Sapiens
AVADSVLTK

SEQ ID NO: 24667 - protein, 9 aa, Homo Sapiens
AVAELWLQH

SEQ ID NO: 24668 - protein, 9 aa, Homo Sapiens
AVAHALTEK

SEQ ID NO: 24669 - protein, 9 aa, Homo Sapiens
AVAIKAMAK

SEQ ID NO: 24670 - protein, 9 aa, Homo Sapiens
AVAIPSWGK

SEQ ID NO: 24671 - protein, 9 aa, Homo Sapiens
AVALPLQTK

SEQ ID NO: 24672 - protein, 9 aa, Homo Sapiens
AVAPPAGPR

SEQ ID NO: 24673 - protein, 9 aa, Homo Sapiens
AVASAAKLG

SEQ ID NO: 24674 - protein, 9 aa, Homo Sapiens
AVAVTMGPK

SEQ ID NO: 24675 - protein, 9 aa, Homo Sapiens
AVCEKTFKH

SEQ ID NO: 24676 - protein, 9 aa, Homo Sapiens
AVCEVALDY

SEQ ID NO: 24677 - protein, 9 aa, Homo Sapiens
AVCMPMKRK

SEQ ID NO: 24678 - protein, 9 aa, Homo Sapiens
AVCSDFFNK

SEQ ID NO: 24679 - protein, 9 aa, Homo Sapiens
AVCTLIHRK

SEQ ID NO: 24680 - protein, 9 aa, Homo Sapiens
AVDGEPLGR

SEQ ID NO: 24681 - protein, 9 aa, Homo Sapiens
AVDQIAFQK

SEQ ID NO: 24682 - protein, 9 aa, Homo Sapiens
AVDTAYVAK

SEQ ID NO: 24683 - protein, 9 aa, Homo Sapiens
AVDVSPLRR

SEQ ID NO: 24684 - protein, 9 aa, Homo Sapiens
AVEGTPLPK

SEQ ID NO: 24685 - protein, 9 aa, Homo Sapiens
AVELSRVAK

SEQ ID NO: 24686 - protein, 9 aa, Homo Sapiens
AVFASEVKK

SEQ ID NO: 24687 - protein, 9 aa, Homo Sapiens
AVFEDLSLK

SEQ ID NO: 24688 - protein, 9 aa, Homo Sapiens
AVFEETLEK

SEQ ID NO: 24689 - protein, 9 aa, Homo Sapiens
AVFEWHITK

SEQ ID NO: 24690 - protein, 9 aa, Homo Sapiens
AVFGVPASK

SEQ ID NO: 24691 - protein, 9 aa, Homo Sapiens
AVFLGLARK

SEQ ID NO: 24692 - protein, 9 aa, Homo Sapiens
AVFQIILRR

SEQ ID NO: 24693 - protein, 9 aa, Homo Sapiens
AVGNIKVTK

SEQ ID NO: 24694 - protein, 9 aa, Homo Sapiens
AVGPHLTAK

SEQ ID NO: 24695 - protein, 9 aa, Homo Sapiens
AVGPKVALK

SEQ ID NO: 24696 - protein, 9 aa, Homo Sapiens
AVIDVGINR

SEQ ID NO: 24697 - protein, 9 aa, Homo Sapiens
AVIEDTWHY

SEQ ID NO: 24698 - protein, 9 aa, Homo Sapiens
AVIEFLLDK

SEQ ID NO: 24699 - protein, 9 aa, Homo Sapiens
AVIEHLKQK

SEQ ID NO: 24700 - protein, 9 aa, Homo Sapiens
AVIENLPKK

SEQ ID NO: 24701 - protein, 9 aa, Homo Sapiens
AVIESFVNH

SEQ ID NO: 24702 - protein, 9 aa, Homo Sapiens
AVIGNVQEK

SEQ ID NO: 24703 - protein, 9 aa, Homo Sapiens
AVISQCIYR

SEQ ID NO: 24704 - protein, 9 aa, Homo Sapiens
AVISTILKY

SEQ ID NO: 24705 - protein, 9 aa, Homo Sapiens
AVLDFVKQK

SEQ ID NO: 24706 - protein, 9 aa, Homo Sapiens
AVLDLSWNK

SEQ ID NO: 24707 - protein, 9 aa, Homo Sapiens
AVLDYVMTR

SEQ ID NO: 24708 - protein, 9 aa, Homo Sapiens
AVLEADFAK

SEQ ID NO: 24709 - protein, 9 aa, Homo Sapiens
AVLHTVLLH

SEQ ID NO: 24710 - protein, 9 aa, Homo Sapiens
AVLKHIENK

SEQ ID NO: 24711 - protein, 9 aa, Homo Sapiens
AVLLPQPPK

SEQ ID NO: 24712 - protein, 9 aa, Homo Sapiens
AVLLQWHEK

SEQ ID NO: 24713 - protein, 9 aa, Homo Sapiens
AVLLVFANK

SEQ ID NO: 24714 - protein, 9 aa, Homo Sapiens
AVLNVSNNR

SEQ ID NO: 24715 - protein, 9 aa, Homo Sapiens
AVLPAVIPK

SEQ ID NO: 24716 - protein, 9 aa, Homo Sapiens
AVLPPQPLK

SEQ ID NO: 24717 - protein, 9 aa, Homo Sapiens
AVLPSVLNK

SEQ ID NO: 24718 - protein, 9 aa, Homo Sapiens
AVLPYLLDK

SEQ ID NO: 24719 - protein, 9 aa, Homo Sapiens
AVLSFSLYR

SEQ ID NO: 24720 - protein, 9 aa, Homo Sapiens
AVLSWKLAK

SEQ ID NO: 24721 - protein, 9 aa, Homo Sapiens
AVLTKQLLH

SEQ ID NO: 24722 - protein, 9 aa, Homo Sapiens
AVLYDIILK

SEQ ID NO: 24723 - protein, 9 aa, Homo Sapiens
AVMEMMSQK

SEQ ID NO: 24724 - protein, 9 aa, Homo Sapiens
AVMETLLQR

SEQ ID NO: 24725 - protein, 9 aa, Homo Sapiens
AVMGNPVTR

SEQ ID NO: 24726 - protein, 9 aa, Homo Sapiens
AVMIPGLLR

SEQ ID NO: 24727 - protein, 9 aa, Homo Sapiens
AVMKNQVAR

SEQ ID NO: 24728 - protein, 9 aa, Homo Sapiens
AVMNFVVRY

SEQ ID NO: 24729 - protein, 9 aa, Homo Sapiens
AVMPDGQFK

SEQ ID NO: 24730 - protein, 9 aa, Homo Sapiens
AVMRCLLAY

SEQ ID NO: 24731 - protein, 9 aa, Homo Sapiens
AVMVHQLSK

SEQ ID NO: 24732 - protein, 9 aa, Homo Sapiens
AVNIVCHSK

SEQ ID NO: 24733 - protein, 9 aa, Homo Sapiens
AVNLADPYR

SEQ ID NO: 24734 - protein, 9 aa, Homo Sapiens
AVNLHPIRK

SEQ ID NO: 24735 - protein, 9 aa, Homo Sapiens
AVNMVPFPR

SEQ ID NO: 24736 - protein, 9 aa, Homo Sapiens
AVNNIRLIK

SEQ ID NO: 24737 - protein, 9 aa, Homo Sapiens
AVNNMFVSK

SEQ ID NO: 24738 - protein, 9 aa, Homo Sapiens
AVNSDFYRR

SEQ ID NO: 24739 - protein, 9 aa, Homo Sapiens
AVPRFVQQK

SEQ ID NO: 24740 - protein, 9 aa, Homo Sapiens
AVPRPIPEK

SEQ ID NO: 24741 - protein, 9 aa, Homo Sapiens
AVQHFSLLY

SEQ ID NO: 24742 - protein, 9 aa, Homo Sapiens
AVQRTLLEK

SEQ ID NO: 24743 - protein, 9 aa, Homo Sapiens
AVQVPVKGR

SEQ ID NO: 24744 - protein, 9 aa, Homo Sapiens
AVSAVVHEY

SEQ ID NO: 24745 - protein, 9 aa, Homo Sapiens
AVSSFVFLR

SEQ ID NO: 24746 - protein, 9 aa, Homo Sapiens
AVSSLIRNK

SEQ ID NO: 24747 - protein, 9 aa, Homo Sapiens
AVSTFAMVK

SEQ ID NO: 24748 - protein, 9 aa, Homo Sapiens
AVSTLGISK

SEQ ID NO: 24749 - protein, 9 aa, Homo Sapiens
AVTAFVTFR

SEQ ID NO: 24750 - protein, 9 aa, Homo Sapiens
AVTFPLKSK

SEQ ID NO: 24751 - protein, 9 aa, Homo Sapiens
AVTRFIEEK

SEQ ID NO: 24752 - protein, 9 aa, Homo Sapiens
AVVAATALK

SEQ ID NO: 24753 - protein, 9 aa, Homo Sapiens
AVVDIYHSR

SEQ ID NO: 24754 - protein, 9 aa, Homo Sapiens
AVVEKIHAK

SEQ ID NO: 24755 - protein, 9 aa, Homo Sapiens
AVVEVVRRK

SEQ ID NO: 24756 - protein, 9 aa, Homo Sapiens
AVWDTCLEY

SEQ ID NO: 24757 - protein, 9 aa, Homo Sapiens
AVYDFFIGR

SEQ ID NO: 24758 - protein, 9 aa, Homo Sapiens
AVYDVVRNR

SEQ ID NO: 24759 - protein, 9 aa, Homo Sapiens
AVYEDQVGK

SEQ ID NO: 24760 - protein, 9 aa, Homo Sapiens
AVYEINVLR

SEQ ID NO: 24761 - protein, 9 aa, Homo Sapiens
AVYERHFLR

SEQ ID NO: 24762 - protein, 9 aa, Homo Sapiens
AVYKPPGLK

SEQ ID NO: 24763 - protein, 9 aa, Homo Sapiens
AVYLLPVPK

SEQ ID NO: 24764 - protein, 9 aa, Homo Sapiens
AVYSGISLK

SEQ ID NO: 24765 - protein, 9 aa, Homo Sapiens
AVYTKMMTK

SEQ ID NO: 24766 - protein, 9 aa, Homo Sapiens
CLDAFPNLK

SEQ ID NO: 24767 - protein, 9 aa, Homo Sapiens
CTGSLLKIY

SEQ ID NO: 24768 - protein, 9 aa, Homo Sapiens
DIGLAAWGR

SEQ ID NO: 24769 - protein, 9 aa, Homo Sapiens
DPNVSKKLK

SEQ ID NO: 24770 - protein, 9 aa, Homo Sapiens
EEEVNNLVK

SEQ ID NO: 24771 - protein, 9 aa, Homo Sapiens
EFAEEQLRA

SEQ ID NO: 24772 - protein, 9 aa, Homo Sapiens
EGGPILPKK

SEQ ID NO: 24773 - protein, 9 aa, Homo Sapiens
EIFDGIQPK

SEQ ID NO: 24774 - protein, 9 aa, Homo Sapiens
EIMPPPPKP

SEQ ID NO: 24775 - protein, 9 aa, Homo Sapiens
EIMVEIPAK

SEQ ID NO: 24776 - protein, 9 aa, Homo Sapiens
EKQSCLKFK

SEQ ID NO: 24777 - protein, 9 aa, Homo Sapiens
ELMPPPPPK

SEQ ID NO: 24778 - protein, 9 aa, Homo Sapiens
EQGYDVIAY

SEQ ID NO: 24779 - protein, 9 aa, Homo Sapiens
ETFSGVYKK

SEQ ID NO: 24780 - protein, 9 aa, Homo Sapiens
ETMNIFLEK

SEQ ID NO: 24781 - protein, 9 aa, Homo Sapiens
ETQPPVALK

SEQ ID NO: 24782 - protein, 9 aa, Homo Sapiens
EVNSGFFYK

SEQ ID NO: 24783 - protein, 9 aa, Homo Sapiens
FDDFSHYEK

SEQ ID NO: 24784 - protein, 9 aa, Homo Sapiens
FEPAKGGEK

SEQ ID NO: 24785 - protein, 9 aa, Homo Sapiens
FGAYGGLLK

SEQ ID NO: 24786 - protein, 9 aa, Homo Sapiens
FLSAVFFAK

SEQ ID NO: 24787 - protein, 9 aa, Homo Sapiens
FLTLTKTIA

SEQ ID NO: 24788 - protein, 9 aa, Homo Sapiens
FLYAFIGVK

SEQ ID NO: 24789 - protein, 9 aa, Homo Sapiens
FLYDEVHPK

SEQ ID NO: 24790 - protein, 9 aa, Homo Sapiens
FPSIVGRPR

SEQ ID NO: 24791 - protein, 9 aa, Homo Sapiens
FPSLLTNPK

SEQ ID NO: 24792 - protein, 9 aa, Homo Sapiens
FSPFHASVL

SEQ ID NO: 24793 - protein, 9 aa, Homo Sapiens
FTAPDPGLK

SEQ ID NO: 24794 - protein, 9 aa, Homo Sapiens
FTAPPVLGK

SEQ ID NO: 24795 - protein, 9 aa, Homo Sapiens
FTAPSTVGK

SEQ ID NO: 24796 - protein, 9 aa, Homo Sapiens
FTFFIHNPK

SEQ ID NO: 24797 - protein, 9 aa, Homo Sapiens
FTGPPTFPK

SEQ ID NO: 24798 - protein, 9 aa, Homo Sapiens
FTNERFPLR

SEQ ID NO: 24799 - protein, 9 aa, Homo Sapiens
FTQKPGFPK

SEQ ID NO: 24800 - protein, 9 aa, Homo Sapiens
FTSPPSLFK

SEQ ID NO: 24801 - protein, 9 aa, Homo Sapiens
FVQGIFVEK

SEQ ID NO: 24802 - protein, 9 aa, Homo Sapiens
FVYEPKEQK

SEQ ID NO: 24803 - protein, 9 aa, Homo Sapiens
GAFYKGFIK

SEQ ID NO: 24804 - protein, 9 aa, Homo Sapiens
GAFYKGFVK

SEQ ID NO: 24805 - protein, 9 aa, Homo Sapiens
GAIEKTFTK

SEQ ID NO: 24806 - protein, 9 aa, Homo Sapiens
GAIKVFVNK

SEQ ID NO: 24807 - protein, 9 aa, Homo Sapiens
GALPWFLQK

SEQ ID NO: 24808 - protein, 9 aa, Homo Sapiens
GAMEHFHMK

SEQ ID NO: 24809 - protein, 9 aa, Homo Sapiens
GANIPVTEK

SEQ ID NO: 24810 - protein, 9 aa, Homo Sapiens
GAQPPSILK

SEQ ID NO: 24811 - protein, 9 aa, Homo Sapiens
GAYDGKFEK

SEQ ID NO: 24812 - protein, 9 aa, Homo Sapiens
GCDFTNVVK

SEQ ID NO: 24813 - protein, 9 aa, Homo Sapiens
GDGLIELRK

SEQ ID NO: 24814 - protein, 9 aa, Homo Sapiens
GIADFVLKY

SEQ ID NO: 24815 - protein, 9 aa, Homo Sapiens
GIAPYSYAG

SEQ ID NO: 24816 - protein, 9 aa, Homo Sapiens
GIATTFINK

SEQ ID NO: 24817 - protein, 9 aa, Homo Sapiens
GIFPGTPLK

SEQ ID NO: 24818 - protein, 9 aa, Homo Sapiens
GIFPLSFVK

SEQ ID NO: 24819 - protein, 9 aa, Homo Sapiens
GIFSAEFLK

SEQ ID NO: 24820 - protein, 9 aa, Homo Sapiens
GILKPLPKK

SEQ ID NO: 24821 - protein, 9 aa, Homo Sapiens
GILTVRHLK

SEQ ID NO: 24822 - protein, 9 aa, Homo Sapiens
GIMSPLAKK

SEQ ID NO: 24823 - protein, 9 aa, Homo Sapiens
GINKPGFYK

SEQ ID NO: 24824 - protein, 9 aa, Homo Sapiens
GISETRIEK

SEQ ID NO: 24825 - protein, 9 aa, Homo Sapiens
GIVECLGPK

SEQ ID NO: 24826 - protein, 9 aa, Homo Sapiens
GIYSVIQKK

SEQ ID NO: 24827 - protein, 9 aa, Homo Sapiens
GLGEPLALK

SEQ ID NO: 24828 - protein, 9 aa, Homo Sapiens
GLGPLVPGK

SEQ ID NO: 24829 - protein, 9 aa, Homo Sapiens
GLMGFIVYK

SEQ ID NO: 24830 - protein, 9 aa, Homo Sapiens
GLVPAAPPK

SEQ ID NO: 24831 - protein, 9 aa, Homo Sapiens
GQHTVLLVK

SEQ ID NO: 24832 - protein, 9 aa, Homo Sapiens
GQNIAVVGK

SEQ ID NO: 24833 - protein, 9 aa, Homo Sapiens
GQSPFQQRK

SEQ ID NO: 24834 - protein, 9 aa, Homo Sapiens
GQYGNPLNK

SEQ ID NO: 24835 - protein, 9 aa, Homo Sapiens
GSACIKVTK

SEQ ID NO: 24836 - protein, 9 aa, Homo Sapiens
GSCGPIKVK

SEQ ID NO: 24837 - protein, 9 aa, Homo Sapiens
GSCKVFFKR

SEQ ID NO: 24838 - protein, 9 aa, Homo Sapiens
GSFDVVHVK

SEQ ID NO: 24839 - protein, 9 aa, Homo Sapiens
GSFGKVFLV

SEQ ID NO: 24840 - protein, 9 aa, Homo Sapiens
GSGKVTFPK

SEQ ID NO: 24841 - protein, 9 aa, Homo Sapiens
GSIDIQHLK

SEQ ID NO: 24842 - protein, 9 aa, Homo Sapiens
GSIGGTFAK

SEQ ID NO: 24843 - protein, 9 aa, Homo Sapiens
GSIGSSFPR

SEQ ID NO: 24844 - protein, 9 aa, Homo Sapiens
GSLASVYHK

SEQ ID NO: 24845 - protein, 9 aa, Homo Sapiens
GSLDQVLKK

SEQ ID NO: 24846 - protein, 9 aa, Homo Sapiens
GSLFLQTPK

SEQ ID NO: 24847 - protein, 9 aa, Homo Sapiens
GSLFLRTPK

SEQ ID NO: 24848 - protein, 9 aa, Homo Sapiens
GSLGGQINK

SEQ ID NO: 24849 - protein, 9 aa, Homo Sapiens
GSLKQFLKK

SEQ ID NO: 24850 - protein, 9 aa, Homo Sapiens
GSLLWGLVK

SEQ ID NO: 24851 - protein, 9 aa, Homo Sapiens
GSLQLPPPR

SEQ ID NO: 24852 - protein, 9 aa, Homo Sapiens
GSLRPFVQK

SEQ ID NO: 24853 - protein, 9 aa, Homo Sapiens
GSMEPAFHR

SEQ ID NO: 24854 - protein, 9 aa, Homo Sapiens
GSMEPGFAK

SEQ ID NO: 24855 - protein, 9 aa, Homo Sapiens
GSMGSFSEK

SEQ ID NO: 24856 - protein, 9 aa, Homo Sapiens
GSNGDTFLK

SEQ ID NO: 24857 - protein, 9 aa, Homo Sapiens
GSNGYILNK

SEQ ID NO: 24858 - protein, 9 aa, Homo Sapiens
GSQFFITTK

SEQ ID NO: 24859 - protein, 9 aa, Homo Sapiens
GSSAINILK

SEQ ID NO: 24860 - protein, 9 aa, Homo Sapiens
GSSDVIIHR

SEQ ID NO: 24861 - protein, 9 aa, Homo Sapiens
GSSKIAIQK

SEQ ID NO: 24862 - protein, 9 aa, Homo Sapiens
GSSTIRNLK

SEQ ID NO: 24863 - protein, 9 aa, Homo Sapiens
GSSTPLIPK

SEQ ID NO: 24864 - protein, 9 aa, Homo Sapiens
GSTHVLTPK

SEQ ID NO: 24865 - protein, 9 aa, Homo Sapiens
GSVIIFVDK

SEQ ID NO: 24866 - protein, 9 aa, Homo Sapiens
GSVLLFVTK

SEQ ID NO: 24867 - protein, 9 aa, Homo Sapiens
GSVYITLKK

SEQ ID NO: 24868 - protein, 9 aa, Homo Sapiens
GSWASLVQK

SEQ ID NO: 24869 - protein, 9 aa, Homo Sapiens
GSYFVKDPK

SEQ ID NO: 24870 - protein, 9 aa, Homo Sapiens
GSYSKAFAR

SEQ ID NO: 24871 - protein, 9 aa, Homo Sapiens
GTAACIPQK

SEQ ID NO: 24872 - protein, 9 aa, Homo Sapiens
GTADVHFER

SEQ ID NO: 24873 - protein, 9 aa, Homo Sapiens
GTAEVELKK

SEQ ID NO: 24874 - protein, 9 aa, Homo Sapiens
GTAKSQFLK

SEQ ID NO: 24875 - protein, 9 aa, Homo Sapiens
GTAQLTLLH

SEQ ID NO: 24876 - protein, 9 aa, Homo Sapiens
GTCFGKFTK

SEQ ID NO: 24877 - protein, 9 aa, Homo Sapiens
GTCGVLLRK

SEQ ID NO: 24878 - protein, 9 aa, Homo Sapiens
GTCLLIANK

SEQ ID NO: 24879 - protein, 9 aa, Homo Sapiens
GTCSSVPPR

SEQ ID NO: 24880 - protein, 9 aa, Homo Sapiens
GTDELRLLY

SEQ ID NO: 24881 - protein, 9 aa, Homo Sapiens
GTDEPIFGK

SEQ ID NO: 24882 - protein, 9 aa, Homo Sapiens
GTDPRTILK

SEQ ID NO: 24883 - protein, 9 aa, Homo Sapiens
GTFALNLLK

SEQ ID NO: 24884 - protein, 9 aa, Homo Sapiens
GTFASGPPK

SEQ ID NO: 24885 - protein, 9 aa, Homo Sapiens
GTFEYIRHK

SEQ ID NO: 24886 - protein, 9 aa, Homo Sapiens
GTFGGLGSK

SEQ ID NO: 24887 - protein, 9 aa, Homo Sapiens
GTFGKALRR

SEQ ID NO: 24888 - protein, 9 aa, Homo Sapiens
GTFLEGVAK

SEQ ID NO: 24889 - protein, 9 aa, Homo Sapiens
GTFPRAFKK

SEQ ID NO: 24890 - protein, 9 aa, Homo Sapiens
GTFSRLFQK

SEQ ID NO: 24891 - protein, 9 aa, Homo Sapiens
GTGFCFNTK

SEQ ID NO: 24892 - protein, 9 aa, Homo Sapiens
GTGFTPMVK

SEQ ID NO: 24893 - protein, 9 aa, Homo Sapiens
GTGKTLIGK

SEQ ID NO: 24894 - protein, 9 aa, Homo Sapiens
GTGKTTFVK

SEQ ID NO: 24895 - protein, 9 aa, Homo Sapiens
GTGNLGFPK

SEQ ID NO: 24896 - protein, 9 aa, Homo Sapiens
GTGPLCSGK

SEQ ID NO: 24897 - protein, 9 aa, Homo Sapiens
GTGPNVPPR

SEQ ID NO: 24898 - protein, 9 aa, Homo Sapiens
GTIDVKELK

SEQ ID NO: 24899 - protein, 9 aa, Homo Sapiens
GTIEKVFVK

SEQ ID NO: 24900 - protein, 9 aa, Homo Sapiens
GTIKDIVTR

SEQ ID NO: 24901 - protein, 9 aa, Homo Sapiens
GTINIVHPK

SEQ ID NO: 24902 - protein, 9 aa, Homo Sapiens
GTIPQIFGK

SEQ ID NO: 24903 - protein, 9 aa, Homo Sapiens
GTIPVPKGK

SEQ ID NO: 24904 - protein, 9 aa, Homo Sapiens
GTKLPGLLK

SEQ ID NO: 24905 - protein, 9 aa, Homo Sapiens
GTLAEFIQK

SEQ ID NO: 24906 - protein, 9 aa, Homo Sapiens
GTLASVYHK

SEQ ID NO: 24907 - protein, 9 aa, Homo Sapiens
GTLDSVLRY

SEQ ID NO: 24908 - protein, 9 aa, Homo Sapiens
GTLDYILQR

SEQ ID NO: 24909 - protein, 9 aa, Homo Sapiens
GTLERGILK

SEQ ID NO: 24910 - protein, 9 aa, Homo Sapiens
GTLNQPLTK

SEQ ID NO: 24911 - protein, 9 aa, Homo Sapiens
GTLPAKLLK

SEQ ID NO: 24912 - protein, 9 aa, Homo Sapiens
GTLPKALTK

SEQ ID NO: 24913 - protein, 9 aa, Homo Sapiens
GTLPVSQPK

SEQ ID NO: 24914 - protein, 9 aa, Homo Sapiens
GTLSSWNLK

SEQ ID NO: 24915 - protein, 9 aa, Homo Sapiens
GTMDMSITR

SEQ ID NO: 24916 - protein, 9 aa, Homo Sapiens
GTMEWIMIK

SEQ ID NO: 24917 - protein, 9 aa, Homo Sapiens
GTMPVSLLK

SEQ ID NO: 24918 - protein, 9 aa, Homo Sapiens
GTMRGIIAK

SEQ ID NO: 24919 - protein, 9 aa, Homo Sapiens
GTMTGMLYK

SEQ ID NO: 24920 - protein, 9 aa, Homo Sapiens
GTNDVGALK

SEQ ID NO: 24921 - protein, 9 aa, Homo Sapiens
GTNFTKLEK

SEQ ID NO: 24922 - protein, 9 aa, Homo Sapiens
GTNPGIITK

SEQ ID NO: 24923 - protein, 9 aa, Homo Sapiens
GTNSVICSK

SEQ ID NO: 24924 - protein, 9 aa, Homo Sapiens
GTPEKPLYH

SEQ ID NO: 24925 - protein, 9 aa, Homo Sapiens
GTPETSFNK

SEQ ID NO: 24926 - protein, 9 aa, Homo Sapiens
GTPLETIQK

SEQ ID NO: 24927 - protein, 9 aa, Homo Sapiens
GTQFFEIRK

SEQ ID NO: 24928 - protein, 9 aa, Homo Sapiens
GTQNRPLLR

SEQ ID NO: 24929 - protein, 9 aa, Homo Sapiens
GTQPYFFNK

SEQ ID NO: 24930 - protein, 9 aa, Homo Sapiens
GTQSFVFQR

SEQ ID NO: 24931 - protein, 9 aa, Homo Sapiens
GTQSKAFYK

SEQ ID NO: 24932 - protein, 9 aa, Homo Sapiens
GTQSVTLTH

SEQ ID NO: 24933 - protein, 9 aa, Homo Sapiens
GTRALARCP

SEQ ID NO: 24934 - protein, 9 aa, Homo Sapiens
GTSDEFIEK

SEQ ID NO: 24935 - protein, 9 aa, Homo Sapiens
GTSGLILKR

SEQ ID NO: 24936 - protein, 9 aa, Homo Sapiens
GTSITVPQK

SEQ ID NO: 24937 - protein, 9 aa, Homo Sapiens
GTSPPLTPR

SEQ ID NO: 24938 - protein, 9 aa, Homo Sapiens
GTSQLYVYR

SEQ ID NO: 24939 - protein, 9 aa, Homo Sapiens
GTSSAVSLK

SEQ ID NO: 24940 - protein, 9 aa, Homo Sapiens
GTSSLFIYK

SEQ ID NO: 24941 - protein, 9 aa, Homo Sapiens
GTSSMIVPK

SEQ ID NO: 24942 - protein, 9 aa, Homo Sapiens
GTSSVIVSR

SEQ ID NO: 24943 - protein, 9 aa, Homo Sapiens
GTTAYISLK

SEQ ID NO: 24944 - protein, 9 aa, Homo Sapiens
GTTEWFHLK

SEQ ID NO: 24945 - protein, 9 aa, Homo Sapiens
GTTHNFLYK

SEQ ID NO: 24946 - protein, 9 aa, Homo Sapiens
GTTKVDALK

SEQ ID NO: 24947 - protein, 9 aa, Homo Sapiens
GTTRFAHLK

SEQ ID NO: 24948 - protein, 9 aa, Homo Sapiens
GTTSDQFLR

SEQ ID NO: 24949 - protein, 9 aa, Homo Sapiens
GTTYEGIFK

SEQ ID NO: 24950 - protein, 9 aa, Homo Sapiens
GTVLFEIKK

SEQ ID NO: 24951 - protein, 9 aa, Homo Sapiens
GTVSPLFQK

SEQ ID NO: 24952 - protein, 9 aa, Homo Sapiens
GTVTKVIPK

SEQ ID NO: 24953 - protein, 9 aa, Homo Sapiens
GTYGFWYPK

SEQ ID NO: 24954 - protein, 9 aa, Homo Sapiens
GTYHGMTLK

SEQ ID NO: 24955 - protein, 9 aa, Homo Sapiens
GTYQDRLTK

SEQ ID NO: 24956 - protein, 9 aa, Homo Sapiens
GTYRDANIK

SEQ ID NO: 24957 - protein, 9 aa, Homo Sapiens
GTYSCFWTK

SEQ ID NO: 24958 - protein, 9 aa, Homo Sapiens
GTYSKIMNH

SEQ ID NO: 24959 - protein, 9 aa, Homo Sapiens
GTYTDVTPR

SEQ ID NO: 24960 - protein, 9 aa, Homo Sapiens
GTYVSSVPR

SEQ ID NO: 24961 - protein, 9 aa, Homo Sapiens
GVADALLYR

SEQ ID NO: 24962 - protein, 9 aa, Homo Sapiens
GVADKILKK

SEQ ID NO: 24963 - protein, 9 aa, Homo Sapiens
GVAFIFNQK

SEQ ID NO: 24964 - protein, 9 aa, Homo Sapiens
GVAGGSILK

SEQ ID NO: 24965 - protein, 9 aa, Homo Sapiens
GVANALAHR

SEQ ID NO: 24966 - protein, 9 aa, Homo Sapiens
GVAPALAPK

SEQ ID NO: 24967 - protein, 9 aa, Homo Sapiens
GVAPQPPLK

SEQ ID NO: 24968 - protein, 9 aa, Homo Sapiens
GVDDKFYSK

SEQ ID NO: 24969 - protein, 9 aa, Homo Sapiens
GVDPNQYTK

SEQ ID NO: 24970 - protein, 9 aa, Homo Sapiens
GVFEGHTSK

SEQ ID NO: 24971 - protein, 9 aa, Homo Sapiens
GVFEPTIVK

SEQ ID NO: 24972 - protein, 9 aa, Homo Sapiens
GVFEYFNAK

SEQ ID NO: 24973 - protein, 9 aa, Homo Sapiens
GVFGFPLGR

SEQ ID NO: 24974 - protein, 9 aa, Homo Sapiens
GVGEVLHVK

SEQ ID NO: 24975 - protein, 9 aa, Homo Sapiens
GVIVHIIEK

SEQ ID NO: 24976 - protein, 9 aa, Homo Sapiens
GVLAWVKEK

SEQ ID NO: 24977 - protein, 9 aa, Homo Sapiens
GVLDFFFQK

SEQ ID NO: 24978 - protein, 9 aa, Homo Sapiens
GVLEKPLEK

SEQ ID NO: 24979 - protein, 9 aa, Homo Sapiens
GVLGPIINK

SEQ ID NO: 24980 - protein, 9 aa, Homo Sapiens
GVLTSIFKH

SEQ ID NO: 24981 - protein, 9 aa, Homo Sapiens
GVMPSHFSR

SEQ ID NO: 24982 - protein, 9 aa, Homo Sapiens
GVMSPPLSR

SEQ ID NO: 24983 - protein, 9 aa, Homo Sapiens
GVMTVLIKR

SEQ ID NO: 24984 - protein, 9 aa, Homo Sapiens
GVMVYGIKK

SEQ ID NO: 24985 - protein, 9 aa, Homo Sapiens
GVNPYILKK

SEQ ID NO: 24986 - protein, 9 aa, Homo Sapiens
GVSAAFAVK

SEQ ID NO: 24987 - protein, 9 aa, Homo Sapiens
GVSAATFLK

SEQ ID NO: 24988 - protein, 9 aa, Homo Sapiens
GVSSIFIYH

SEQ ID NO: 24989 - protein, 9 aa, Homo Sapiens
GVSSVIHPK

SEQ ID NO: 24990 - protein, 9 aa, Homo Sapiens
GVTRVTIRK

SEQ ID NO: 24991 - protein, 9 aa, Homo Sapiens
GVTSQFVSK

SEQ ID NO: 24992 - protein, 9 aa, Homo Sapiens
GVVPFSQRK

SEQ ID NO: 24993 - protein, 9 aa, Homo Sapiens
GVVRIYHRK

SEQ ID NO: 24994 - protein, 9 aa, Homo Sapiens
GVYDVVELK

SEQ ID NO: 24995 - protein, 9 aa, Homo Sapiens
HAVPPLVPK

SEQ ID NO: 24996 - protein, 9 aa, Homo Sapiens
HIAEPNYGK

SEQ ID NO: 24997 - protein, 9 aa, Homo Sapiens
HIFMKVFPK

SEQ ID NO: 24998 - protein, 9 aa, Homo Sapiens
HLKMQIEVF

SEQ ID NO: 24999 - protein, 9 aa, Homo Sapiens
HQDFQSYPK

SEQ ID NO: 25000 - protein, 9 aa, Homo Sapiens
HSMDFVAYR

SEQ ID NO: 25001 - protein, 9 aa, Homo Sapiens
HSQPFAWKK

SEQ ID NO: 25002 - protein, 9 aa, Homo Sapiens
HTFGGPLLK

SEQ ID NO: 25003 - protein, 9 aa, Homo Sapiens
HTIDWVREK

SEQ ID NO: 25004 - protein, 9 aa, Homo Sapiens
HTLEPLIPR

SEQ ID NO: 25005 - protein, 9 aa, Homo Sapiens
HTMGFWLTK

SEQ ID NO: 25006 - protein, 9 aa, Homo Sapiens
HTYYKFDYK

SEQ ID NO: 25007 - protein, 9 aa, Homo Sapiens
HVFELVLPK

SEQ ID NO: 25008 - protein, 9 aa, Homo Sapiens
HVIETLIGK

SEQ ID NO: 25009 - protein, 9 aa, Homo Sapiens
HVYKERFPK

SEQ ID NO: 25010 - protein, 9 aa, Homo Sapiens
HVYRERFPK

SEQ ID NO: 25011 - protein, 9 aa, Homo Sapiens
IAQPQLPPK

SEQ ID NO: 25012 - protein, 9 aa, Homo Sapiens
IATQVVVEK

SEQ ID NO: 25013 - protein, 9 aa, Homo Sapiens
IFDGRVVAK

SEQ ID NO: 25014 - protein, 9 aa, Homo Sapiens
IGADSVTLK

SEQ ID NO: 25015 - protein, 9 aa, Homo Sapiens
IIGTIFIIK

SEQ ID NO: 25016 - protein, 9 aa, Homo Sapiens
IIIKPLPGY

SEQ ID NO: 25017 - protein, 9 aa, Homo Sapiens
IINNKNFHK

SEQ ID NO: 25018 - protein, 9 aa, Homo Sapiens
IINSSITTK

SEQ ID NO: 25019 - protein, 9 aa, Homo Sapiens
IISTVEVLK

SEQ ID NO: 25020 - protein, 9 aa, Homo Sapiens
IIYDRDFSY

SEQ ID NO: 25021 - protein, 9 aa, Homo Sapiens
ILAGDVKVK

SEQ ID NO: 25022 - protein, 9 aa, Homo Sapiens
ILGATGTGK

SEQ ID NO: 25023 - protein, 9 aa, Homo Sapiens
ILGPNLGDK

SEQ ID NO: 25024 - protein, 9 aa, Homo Sapiens
ILYDHAHVK

SEQ ID NO: 25025 - protein, 9 aa, Homo Sapiens
INSSIITKK

SEQ ID NO: 25026 - protein, 9 aa, Homo Sapiens
IPEKQLVEK

SEQ ID NO: 25027 - protein, 9 aa, Homo Sapiens
IPPELVKQK

SEQ ID NO: 25028 - protein, 9 aa, Homo Sapiens
IQEEFQHLK

SEQ ID NO: 25029 - protein, 9 aa, Homo Sapiens
IQIISTILK

SEQ ID NO: 25030 - protein, 9 aa, Homo Sapiens
IQNDRQLQY

SEQ ID NO: 25031 - protein, 9 aa, Homo Sapiens
ISAPVVRPK

SEQ ID NO: 25032 - protein, 9 aa, Homo Sapiens
ISASPLTSK

SEQ ID NO: 25033 - protein, 9 aa, Homo Sapiens
ISGPISTSK

SEQ ID NO: 25034 - protein, 9 aa, Homo Sapiens
ISQEPFVPK

SEQ ID NO: 25035 - protein, 9 aa, Homo Sapiens
ISTEPLPGR

SEQ ID NO: 25036 - protein, 9 aa, Homo Sapiens
ISYPLHHPK

SEQ ID NO: 25037 - protein, 9 aa, Homo Sapiens
ITAADILDR

SEQ ID NO: 25038 - protein, 9 aa, Homo Sapiens
ITGPNMGGK

SEQ ID NO: 25039 - protein, 9 aa, Homo Sapiens
ITGPTGVGK

SEQ ID NO: 25040 - protein, 9 aa, Homo Sapiens
ITLPAGTEK

SEQ ID NO: 25041 - protein, 9 aa, Homo Sapiens
ITQGNMQLK

SEQ ID NO: 25042 - protein, 9 aa, Homo Sapiens
ITSPVVTQK

SEQ ID NO: 25043 - protein, 9 aa, Homo Sapiens
ITVAYTIPK

SEQ ID NO: 25044 - protein, 9 aa, Homo Sapiens
ITVGDIGPK

SEQ ID NO: 25045 - protein, 9 aa, Homo Sapiens
IVAGSLITK

SEQ ID NO: 25046 - protein, 9 aa, Homo Sapiens
IVAGTLTNK

SEQ ID NO: 25047 - protein, 9 aa, Homo Sapiens
IVALILSTK

SEQ ID NO: 25048 - protein, 9 aa, Homo Sapiens
IVFDGVPSK

SEQ ID NO: 25049 - protein, 9 aa, Homo Sapiens
IVFMPVIGK

SEQ ID NO: 25050 - protein, 9 aa, Homo Sapiens
IVFNIYHSK

SEQ ID NO: 25051 - protein, 9 aa, Homo Sapiens
IVFSLTFFK

SEQ ID NO: 25052 - protein, 9 aa, Homo Sapiens
IVGTVLIIK

SEQ ID NO: 25053 - protein, 9 aa, Homo Sapiens
IVIETGPLK

SEQ ID NO: 25054 - protein, 9 aa, Homo Sapiens
IVIPPATEK

SEQ ID NO: 25055 - protein, 9 aa, Homo Sapiens
IVNDFAYMK

SEQ ID NO: 25056 - protein, 9 aa, Homo Sapiens
IVSAPVPKK

SEQ ID NO: 25057 - protein, 9 aa, Homo Sapiens
IVSDFTIGR

SEQ ID NO: 25058 - protein, 9 aa, Homo Sapiens
IVSQVKVPK

SEQ ID NO: 25059 - protein, 9 aa, Homo Sapiens
IVSSVRRPM

SEQ ID NO: 25060 - protein, 9 aa, Homo Sapiens
IVTPATILK

SEQ ID NO: 25061 - protein, 9 aa, Homo Sapiens
IVVPPLPEK

SEQ ID NO: 25062 - protein, 9 aa, Homo Sapiens
IVYPPPPAK

SEQ ID NO: 25063 - protein, 9 aa, Homo Sapiens
IWKIKKLIK

SEQ ID NO: 25064 - protein, 9 aa, Homo Sapiens
KAFNVVFEK

SEQ ID NO: 25065 - protein, 9 aa, Homo Sapiens
KAFVGAFKK

SEQ ID NO: 25066 - protein, 9 aa, Homo Sapiens
KAGEVFIHK

SEQ ID NO: 25067 - protein, 9 aa, Homo Sapiens
KALEALVAK

SEQ ID NO: 25068 - protein, 9 aa, Homo Sapiens
KAVDITTPK

SEQ ID NO: 25069 - protein, 9 aa, Homo Sapiens
KIADFGLAR

SEQ ID NO: 25070 - protein, 9 aa, Homo Sapiens
KIADMGHLK

SEQ ID NO: 25071 - protein, 9 aa, Homo Sapiens
KIADRFLLY

SEQ ID NO: 25072 - protein, 9 aa, Homo Sapiens
KIFESRFEK

SEQ ID NO: 25073 - protein, 9 aa, Homo Sapiens
KIIEPIQSR

SEQ ID NO: 25074 - protein, 9 aa, Homo Sapiens
KIIGPFSKK

SEQ ID NO: 25075 - protein, 9 aa, Homo Sapiens
KILGPFHKR

SEQ ID NO: 25076 - protein, 9 aa, Homo Sapiens
KIMEYYEKK

SEQ ID NO: 25077 - protein, 9 aa, Homo Sapiens
KIQPALQEK

SEQ ID NO: 25078 - protein, 9 aa, Homo Sapiens
KITDFLQTK

SEQ ID NO: 25079 - protein, 9 aa, Homo Sapiens
KIYKKFLKK

SEQ ID NO: 25080 - protein, 9 aa, Homo Sapiens
KIYNANYLK

SEQ ID NO: 25081 - protein, 9 aa, Homo Sapiens
KKKPQLPPK

SEQ ID NO: 25082 - protein, 9 aa, Homo Sapiens
KLCGYVIFR

SEQ ID NO: 25083 - protein, 9 aa, Homo Sapiens
KLFDFVNAK

SEQ ID NO: 25084 - protein, 9 aa, Homo Sapiens
KLFNGTFLK

SEQ ID NO: 25085 - protein, 9 aa, Homo Sapiens
KLFNKFIGK

SEQ ID NO: 25086 - protein, 9 aa, Homo Sapiens
KLLDAYLLY

SEQ ID NO: 25087 - protein, 9 aa, Homo Sapiens
KLNEVIVNK

SEQ ID NO: 25088 - protein, 9 aa, Homo Sapiens
KMADIYLKH

SEQ ID NO: 25089 - protein, 9 aa, Homo Sapiens
KQDSNPLYK

SEQ ID NO: 25090 - protein, 9 aa, Homo Sapiens
KQFENPIIK

SEQ ID NO: 25091 - protein, 9 aa, Homo Sapiens
KQFSKRYLK

SEQ ID NO: 25092 - protein, 9 aa, Homo Sapiens
KQQTIPLKK

SEQ ID NO: 25093 - protein, 9 aa, Homo Sapiens
KSFGELVHK

SEQ ID NO: 25094 - protein, 9 aa, Homo Sapiens
KSIDFPLTK

SEQ ID NO: 25095 - protein, 9 aa, Homo Sapiens
KSIGDIFLK

SEQ ID NO: 25096 - protein, 9 aa, Homo Sapiens
KSINEFWNK

SEQ ID NO: 25097 - protein, 9 aa, Homo Sapiens
KSLDLVTMK

SEQ ID NO: 25098 - protein, 9 aa, Homo Sapiens
KSLEAFFLY

SEQ ID NO: 25099 - protein, 9 aa, Homo Sapiens
KSSDFAVLK

SEQ ID NO: 25100 - protein, 9 aa, Homo Sapiens
KTAEISLLK

SEQ ID NO: 25101 - protein, 9 aa, Homo Sapiens
KTCEEILNY

SEQ ID NO: 25102 - protein, 9 aa, Homo Sapiens
KTDLFYERK

SEQ ID NO: 25103 - protein, 9 aa, Homo Sapiens
KTETNVYFK

SEQ ID NO: 25104 - protein, 9 aa, Homo Sapiens
KTETPIVSK

SEQ ID NO: 25105 - protein, 9 aa, Homo Sapiens
KTFNSPNLK

SEQ ID NO: 25106 - protein, 9 aa, Homo Sapiens
KTFPNTIEH

SEQ ID NO: 25107 - protein, 9 aa, Homo Sapiens
KTFPYQHRY

SEQ ID NO: 25108 - protein, 9 aa, Homo Sapiens
KTFWQSVSK

SEQ ID NO: 25109 - protein, 9 aa, Homo Sapiens
KTGEVLDTK

SEQ ID NO: 25110 - protein, 9 aa, Homo Sapiens
KTIDASVSK

SEQ ID NO: 25111 - protein, 9 aa, Homo Sapiens
KTIIFVETK

SEQ ID NO: 25112 - protein, 9 aa, Homo Sapiens
KTIQVPQQK

SEQ ID NO: 25113 - protein, 9 aa, Homo Sapiens
KTISEAWIK

SEQ ID NO: 25114 - protein, 9 aa, Homo Sapiens
KTIVFVETK

SEQ ID NO: 25115 - protein, 9 aa, Homo Sapiens
KTLDHVLTH

SEQ ID NO: 25116 - protein, 9 aa, Homo Sapiens
KTLGPILKK

SEQ ID NO: 25117 - protein, 9 aa, Homo Sapiens
KTLKWLEKK

SEQ ID NO: 25118 - protein, 9 aa, Homo Sapiens
KTLNIFLTK

SEQ ID NO: 25119 - protein, 9 aa, Homo Sapiens
KTLPYPLKK

SEQ ID NO: 25120 - protein, 9 aa, Homo Sapiens
KTLQDIVYK

SEQ ID NO: 25121 - protein, 9 aa, Homo Sapiens
KTLYPIIGK

SEQ ID NO: 25122 - protein, 9 aa, Homo Sapiens
KTMNIYFPK

SEQ ID NO: 25123 - protein, 9 aa, Homo Sapiens
KTMPTTFNR

SEQ ID NO: 25124 - protein, 9 aa, Homo Sapiens
KTNLTSVTK

SEQ ID NO: 25125 - protein, 9 aa, Homo Sapiens
KTQEPFSVR

SEQ ID NO: 25126 - protein, 9 aa, Homo Sapiens
KTSNCVVLK

SEQ ID NO: 25127 - protein, 9 aa, Homo Sapiens
KTSNLLLSH

SEQ ID NO: 25128 - protein, 9 aa, Homo Sapiens
KTSPPVFSK

SEQ ID NO: 25129 - protein, 9 aa, Homo Sapiens
KTTTTIIPK

SEQ ID NO: 25130 - protein, 9 aa, Homo Sapiens
KTVEPLEYY

SEQ ID NO: 25131 - protein, 9 aa, Homo Sapiens
KTVIEPLKK

SEQ ID NO: 25132 - protein, 9 aa, Homo Sapiens
KTYKENFLK

SEQ ID NO: 25133 - protein, 9 aa, Homo Sapiens
KVADMALHY

SEQ ID NO: 25134 - protein, 9 aa, Homo Sapiens
KVAVVLIQK

SEQ ID NO: 25135 - protein, 9 aa, Homo Sapiens
KVCDIYINY

SEQ ID NO: 25136 - protein, 9 aa, Homo Sapiens
KVCMYFTYK

SEQ ID NO: 25137 - protein, 9 aa, Homo Sapiens
KVCNPIITK

SEQ ID NO: 25138 - protein, 9 aa, Homo Sapiens
KVFAGYYTK

SEQ ID NO: 25139 - protein, 9 aa, Homo Sapiens
KVFGGTVHK

SEQ ID NO: 25140 - protein, 9 aa, Homo Sapiens
KVFKQIFSK

SEQ ID NO: 25141 - protein, 9 aa, Homo Sapiens
KVFNQPKAK

SEQ ID NO: 25142 - protein, 9 aa, Homo Sapiens
KVGEVIVTK

SEQ ID NO: 25143 - protein, 9 aa, Homo Sapiens
KVIDLSVNK

SEQ ID NO: 25144 - protein, 9 aa, Homo Sapiens
KVIDPVTGK

SEQ ID NO: 25145 - protein, 9 aa, Homo Sapiens
KVIDRILYK

SEQ ID NO: 25146 - protein, 9 aa, Homo Sapiens
KVIGIAIMK

SEQ ID NO: 25147 - protein, 9 aa, Homo Sapiens
KVLDHFRRK

SEQ ID NO: 25148 - protein, 9 aa, Homo Sapiens
KVLDKLLLY

SEQ ID NO: 25149 - protein, 9 aa, Homo Sapiens
KVLFPLLTK

SEQ ID NO: 25150 - protein, 9 aa, Homo Sapiens
KVLHFFNVK

SEQ ID NO: 25151 - protein, 9 aa, Homo Sapiens
KVMGILINR

SEQ ID NO: 25152 - protein, 9 aa, Homo Sapiens
KVQDIKEVK

SEQ ID NO: 25153 - protein, 9 aa, Homo Sapiens
KVQEYPTLK

SEQ ID NO: 25154 - protein, 9 aa, Homo Sapiens
KVQPPGPVK

SEQ ID NO: 25155 - protein, 9 aa, Homo Sapiens
KVQTAVTMK

SEQ ID NO: 25156 - protein, 9 aa, Homo Sapiens
KVSDLTIPK

SEQ ID NO: 25157 - protein, 9 aa, Homo Sapiens
KVSGDIFSR

SEQ ID NO: 25158 - protein, 9 aa, Homo Sapiens
KVSQVIMEK

SEQ ID NO: 25159 - protein, 9 aa, Homo Sapiens
KVTTSITSK

SEQ ID NO: 25160 - protein, 9 aa, Homo Sapiens
KVVDSLYNK

SEQ ID NO: 25161 - protein, 9 aa, Homo Sapiens
KVVKVTIMK

SEQ ID NO: 25162 - protein, 9 aa, Homo Sapiens
KVVNLPFEK

SEQ ID NO: 25163 - protein, 9 aa, Homo Sapiens
KVYDKAINR

SEQ ID NO: 25164 - protein, 9 aa, Homo Sapiens
KVYGPGVAK

SEQ ID NO: 25165 - protein, 9 aa, Homo Sapiens
KVYNGILEK

SEQ ID NO: 25166 - protein, 9 aa, Homo Sapiens
KVYTPSISK

SEQ ID NO: 25167 - protein, 9 aa, Homo Sapiens
LAAPPALEK

SEQ ID NO: 25168 - protein, 9 aa, Homo Sapiens
LAGQGELNR

SEQ ID NO: 25169 - protein, 9 aa, Homo Sapiens
LDQVLKEAK

SEQ ID NO: 25170 - protein, 9 aa, Homo Sapiens
LEETLVKKK

SEQ ID NO: 25171 - protein, 9 aa, Homo Sapiens
LGCQLISLR

SEQ ID NO: 25172 - protein, 9 aa, Homo Sapiens
LGFTDYPKL

SEQ ID NO: 25173 - protein, 9 aa, Homo Sapiens
LGIPLPEIK

SEQ ID NO: 25174 - protein, 9 aa, Homo Sapiens
LGLTEAQTR

SEQ ID NO: 25175 - protein, 9 aa, Homo Sapiens
LGSSKVLAK

SEQ ID NO: 25176 - protein, 9 aa, Homo Sapiens
LIIYDDLSK

SEQ ID NO: 25177 - protein, 9 aa, Homo Sapiens
LINAFHTPK

SEQ ID NO: 25178 - protein, 9 aa, Homo Sapiens
LIQQATTVK

SEQ ID NO: 25179 - protein, 9 aa, Homo Sapiens
LLIYTEFGK

SEQ ID NO: 25180 - protein, 9 aa, Homo Sapiens
LLLAPAVSK

SEQ ID NO: 25181 - protein, 9 aa, Homo Sapiens
LLPELSVLA

SEQ ID NO: 25182 - protein, 9 aa, Homo Sapiens
LNLQEYQSK

SEQ ID NO: 25183 - protein, 9 aa, Homo Sapiens
LPALKQTPK

SEQ ID NO: 25184 - protein, 9 aa, Homo Sapiens
LPPLSPYFK

SEQ ID NO: 25185 - protein, 9 aa, Homo Sapiens
LQIPIHFPK

SEQ ID NO: 25186 - protein, 9 aa, Homo Sapiens
LQNEPIPER

SEQ ID NO: 25187 - protein, 9 aa, Homo Sapiens
LTEAPLNPK

SEQ ID NO: 25188 - protein, 9 aa, Homo Sapiens
LTGPPGVGK

SEQ ID NO: 25189 - protein, 9 aa, Homo Sapiens
LTGPVMPVR

SEQ ID NO: 25190 - protein, 9 aa, Homo Sapiens
LTIPEIPPK

SEQ ID NO: 25191 - protein, 9 aa, Homo Sapiens
LTMDKLWRK

SEQ ID NO: 25192 - protein, 9 aa, Homo Sapiens
LTMPGGVAK

SEQ ID NO: 25193 - protein, 9 aa, Homo Sapiens
LTNHFSFEK

SEQ ID NO: 25194 - protein, 9 aa, Homo Sapiens
LTTAVITNK

SEQ ID NO: 25195 - protein, 9 aa, Homo Sapiens
LTYEFVKQK

SEQ ID NO: 25196 - protein, 9 aa, Homo Sapiens
LTYNDFINK

SEQ ID NO: 25197 - protein, 9 aa, Homo Sapiens
LVAIPVYVK

SEQ ID NO: 25198 - protein, 9 aa, Homo Sapiens
LVFDVELLK

SEQ ID NO: 25199 - protein, 9 aa, Homo Sapiens
LVFDWNTPK

SEQ ID NO: 25200 - protein, 9 aa, Homo Sapiens
LVFEWTIVK

SEQ ID NO: 25201 - protein, 9 aa, Homo Sapiens
LVGPVPAGR

SEQ ID NO: 25202 - protein, 9 aa, Homo Sapiens
LVIPFAVRK

SEQ ID NO: 25203 - protein, 9 aa, Homo Sapiens
LVIPFTIKK

SEQ ID NO: 25204 - protein, 9 aa, Homo Sapiens
LVLEGAGLR

SEQ ID NO: 25205 - protein, 9 aa, Homo Sapiens
LVLSRTKLT

SEQ ID NO: 25206 - protein, 9 aa, Homo Sapiens
LVMEGHLFK

SEQ ID NO: 25207 - protein, 9 aa, Homo Sapiens
LVMTHLILK

SEQ ID NO: 25208 - protein, 9 aa, Homo Sapiens
LVSPITGEK

SEQ ID NO: 25209 - protein, 9 aa, Homo Sapiens
LVSTPVRTK

SEQ ID NO: 25210 - protein, 9 aa, Homo Sapiens
LVVYPWTQR

SEQ ID NO: 25211 - protein, 9 aa, Homo Sapiens
LVYDVSNPK

SEQ ID NO: 25212 - protein, 9 aa, Homo Sapiens
LVYNGVYQY

SEQ ID NO: 25213 - protein, 9 aa, Homo Sapiens
LYDASFETK

SEQ ID NO: 25214 - protein, 9 aa, Homo Sapiens
LYETPTGWK

SEQ ID NO: 25215 - protein, 9 aa, Homo Sapiens
MAAAAFAEK

SEQ ID NO: 25216 - protein, 9 aa, Homo Sapiens
MAADRSLKK

SEQ ID NO: 25217 - protein, 9 aa, Homo Sapiens
MGDAPDYDR

SEQ ID NO: 25218 - protein, 9 aa, Homo Sapiens
MIFRNQVPK

SEQ ID NO: 25219 - protein, 9 aa, Homo Sapiens
MMFSATFPK

SEQ ID NO: 25220 - protein, 9 aa, Homo Sapiens
MPKDIQLAR

SEQ ID NO: 25221 - protein, 9 aa, Homo Sapiens
MSQDFGWNK

SEQ ID NO: 25222 - protein, 9 aa, Homo Sapiens
MTYAQKIFK

SEQ ID NO: 25223 - protein, 9 aa, Homo Sapiens
MVANLLYEK

SEQ ID NO: 25224 - protein, 9 aa, Homo Sapiens
MVFGAPVPK

SEQ ID NO: 25225 - protein, 9 aa, Homo Sapiens
MVGVNLPQK

SEQ ID NO: 25226 - protein, 9 aa, Homo Sapiens
MVMDKKHFK

SEQ ID NO: 25227 - protein, 9 aa, Homo Sapiens
NAIKWNFTK

SEQ ID NO: 25228 - protein, 9 aa, Homo Sapiens
NFFASPMLK

SEQ ID NO: 25229 - protein, 9 aa, Homo Sapiens
NICSIYNLK

SEQ ID NO: 25230 - protein, 9 aa, Homo Sapiens
NSLIFLKPN

SEQ ID NO: 25231 - protein, 9 aa, Homo Sapiens
NSMGLFLQK

SEQ ID NO: 25232 - protein, 9 aa, Homo Sapiens
NTITPVVGK

SEQ ID NO: 25233 - protein, 9 aa, Homo Sapiens
NTMNITISK

SEQ ID NO: 25234 - protein, 9 aa, Homo Sapiens
NTMNQFVNK

SEQ ID NO: 25235 - protein, 9 aa, Homo Sapiens
NTMQQFLQK

SEQ ID NO: 25236 - protein, 9 aa, Homo Sapiens
NTNTAIELK

SEQ ID NO: 25237 - protein, 9 aa, Homo Sapiens
NVGPLIIKK

SEQ ID NO: 25238 - protein, 9 aa, Homo Sapiens
NVYEVVNPK

SEQ ID NO: 25239 - protein, 9 aa, Homo Sapiens
PEFPLSPPK

SEQ ID NO: 25240 - protein, 9 aa, Homo Sapiens
PISDIIAIK

SEQ ID NO: 25241 - protein, 9 aa, Homo Sapiens
PLDTVTFYK

SEQ ID NO: 25242 - protein, 9 aa, Homo Sapiens
PLSDALLNK

SEQ ID NO: 25243 - protein, 9 aa, Homo Sapiens
PSSETVICR

SEQ ID NO: 25244 - protein, 9 aa, Homo Sapiens
PSSHLPPPK

SEQ ID NO: 25245 - protein, 9 aa, Homo Sapiens
QAADILLYK

SEQ ID NO: 25246 - protein, 9 aa, Homo Sapiens
QAFAQVFNK

SEQ ID NO: 25247 - protein, 9 aa, Homo Sapiens
QAQEVFFLK

SEQ ID NO: 25248 - protein, 9 aa, Homo Sapiens
QASEPAVSL

SEQ ID NO: 25249 - protein, 9 aa, Homo Sapiens
QDGITLITK

SEQ ID NO: 25250 - protein, 9 aa, Homo Sapiens
QEDPDYGIR

SEQ ID NO: 25251 - protein, 9 aa, Homo Sapiens
QEFGLARFK

SEQ ID NO: 25252 - protein, 9 aa, Homo Sapiens
QGEYIAPEK

SEQ ID NO: 25253 - protein, 9 aa, Homo Sapiens
QICDTYNQK

SEQ ID NO: 25254 - protein, 9 aa, Homo Sapiens
QIFKPIISK

SEQ ID NO: 25255 - protein, 9 aa, Homo Sapiens
QIFSEFLLK

SEQ ID NO: 25256 - protein, 9 aa, Homo Sapiens
QIGPAPPLK

SEQ ID NO: 25257 - protein, 9 aa, Homo Sapiens
QINGEIICK

SEQ ID NO: 25258 - protein, 9 aa, Homo Sapiens
QIQDSIVTK

SEQ ID NO: 25259 - protein, 9 aa, Homo Sapiens
QISEVVVVK

SEQ ID NO: 25260 - protein, 9 aa, Homo Sapiens
QITLPTVQK

SEQ ID NO: 25261 - protein, 9 aa, Homo Sapiens
QIYGVFDEK

SEQ ID NO: 25262 - protein, 9 aa, Homo Sapiens
QIYSVVLKK

SEQ ID NO: 25263 - protein, 9 aa, Homo Sapiens
QIYTYFVYK

SEQ ID NO: 25264 - protein, 9 aa, Homo Sapiens
QLYWSHPRK

SEQ ID NO: 25265 - protein, 9 aa, Homo Sapiens
QPNLPPDLR

SEQ ID NO: 25266 - protein, 9 aa, Homo Sapiens
QQLYWSHPR

SEQ ID NO: 25267 - protein, 9 aa, Homo Sapiens
QSCYIIISK

SEQ ID NO: 25268 - protein, 9 aa, Homo Sapiens
QSIFPTIPK

SEQ ID NO: 25269 - protein, 9 aa, Homo Sapiens
QSLEHSWIK

SEQ ID NO: 25270 - protein, 9 aa, Homo Sapiens
QTAADAFYK

SEQ ID NO: 25271 - protein, 9 aa, Homo Sapiens
QTAGNVFLK

SEQ ID NO: 25272 - protein, 9 aa, Homo Sapiens
QTAQIFFTK

SEQ ID NO: 25273 - protein, 9 aa, Homo Sapiens
QTASFALKK

SEQ ID NO: 25274 - protein, 9 aa, Homo Sapiens
QTCRLLLSY

SEQ ID NO: 25275 - protein, 9 aa, Homo Sapiens
QTLSPQMWK

SEQ ID NO: 25276 - protein, 9 aa, Homo Sapiens
QTMSDTTFK

SEQ ID NO: 25277 - protein, 9 aa, Homo Sapiens
QTNPTYLAK

SEQ ID NO: 25278 - protein, 9 aa, Homo Sapiens
QTQPIYLAK

SEQ ID NO: 25279 - protein, 9 aa, Homo Sapiens
QTQSIYIPR

SEQ ID NO: 25280 - protein, 9 aa, Homo Sapiens
QTYGQQLQK

SEQ ID NO: 25281 - protein, 9 aa, Homo Sapiens
QTYVGITEK

SEQ ID NO: 25282 - protein, 9 aa, Homo Sapiens
QVADAFLSK

SEQ ID NO: 25283 - protein, 9 aa, Homo Sapiens
QVADVVVSR

SEQ ID NO: 25284 - protein, 9 aa, Homo Sapiens
QVDPNFYSK

SEQ ID NO: 25285 - protein, 9 aa, Homo Sapiens
QVFEFTEPK

SEQ ID NO: 25286 - protein, 9 aa, Homo Sapiens
QVFEKSPLR

SEQ ID NO: 25287 - protein, 9 aa, Homo Sapiens
QVFQKSLPK

SEQ ID NO: 25288 - protein, 9 aa, Homo Sapiens
QVIDGFFVK

SEQ ID NO: 25289 - protein, 9 aa, Homo Sapiens
QVIPASEPK

SEQ ID NO: 25290 - protein, 9 aa, Homo Sapiens
QVMFPVNSK

SEQ ID NO: 25291 - protein, 9 aa, Homo Sapiens
QVQAAQFAK

SEQ ID NO: 25292 - protein, 9 aa, Homo Sapiens
QVQDCHVLK

SEQ ID NO: 25293 - protein, 9 aa, Homo Sapiens
QVSACAFNK

SEQ ID NO: 25294 - protein, 9 aa, Homo Sapiens
QVVSPGVYK

SEQ ID NO: 25295 - protein, 9 aa, Homo Sapiens
RAAIPIAKR

SEQ ID NO: 25296 - protein, 9 aa, Homo Sapiens
RAAPFSLEY

SEQ ID NO: 25297 - protein, 9 aa, Homo Sapiens
RAISWTMKK

SEQ ID NO: 25298 - protein, 9 aa, Homo Sapiens
RAMEWITAK

SEQ ID NO: 25299 - protein, 9 aa, Homo Sapiens
RAPEPLPPK

SEQ ID NO: 25300 - protein, 9 aa, Homo Sapiens
RAQDLPLKK

SEQ ID NO: 25301 - protein, 9 aa, Homo Sapiens
RAVPFNAPK

SEQ ID NO: 25302 - protein, 9 aa, Homo Sapiens
RAYPHVFTK

SEQ ID NO: 25303 - protein, 9 aa, Homo Sapiens
RDVLPFTLK

SEQ ID NO: 25304 - protein, 9 aa, Homo Sapiens
RFYDRRFLK

SEQ ID NO: 25305 - protein, 9 aa, Homo Sapiens
RGYYRYYNK

SEQ ID NO: 25306 - protein, 9 aa, Homo Sapiens
RIAEFAFEY

SEQ ID NO: 25307 - protein, 9 aa, Homo Sapiens
RICDFGFAK

SEQ ID NO: 25308 - protein, 9 aa, Homo Sapiens
RICEILLQY

SEQ ID NO: 25309 - protein, 9 aa, Homo Sapiens
RIFDLGRKK

SEQ ID NO: 25310 - protein, 9 aa, Homo Sapiens
RIFEPPPPK

SEQ ID NO: 25311 - protein, 9 aa, Homo Sapiens
RIGNFIVKK

SEQ ID NO: 25312 - protein, 9 aa, Homo Sapiens
RIIDEVVNK

SEQ ID NO: 25313 - protein, 9 aa, Homo Sapiens
RIIDLVLQK

SEQ ID NO: 25314 - protein, 9 aa, Homo Sapiens
RIIEPLTSR

SEQ ID NO: 25315 - protein, 9 aa, Homo Sapiens
RIIGVDINK

SEQ ID NO: 25316 - protein, 9 aa, Homo Sapiens
RIIPRHLQL

SEQ ID NO: 25317 - protein, 9 aa, Homo Sapiens
RIKEIFCPK

SEQ ID NO: 25318 - protein, 9 aa, Homo Sapiens
RILACGVAK

SEQ ID NO: 25319 - protein, 9 aa, Homo Sapiens
RILFFNTPK

SEQ ID NO: 25320 - protein, 9 aa, Homo Sapiens
RILGPGLNK

SEQ ID NO: 25321 - protein, 9 aa, Homo Sapiens
RILLPIVQK

SEQ ID NO: 25322 - protein, 9 aa, Homo Sapiens
RIQDLSLLY

SEQ ID NO: 25323 - protein, 9 aa, Homo Sapiens
RIQDVLFLY

SEQ ID NO: 25324 - protein, 9 aa, Homo Sapiens
RIQLPVVSK

SEQ ID NO: 25325 - protein, 9 aa, Homo Sapiens
RIQQIIEGK

SEQ ID NO: 25326 - protein, 9 aa, Homo Sapiens
RITDPTIDK

SEQ ID NO: 25327 - protein, 9 aa, Homo Sapiens
RITTHFELK

SEQ ID NO: 25328 - protein, 9 aa, Homo Sapiens
RIYDIFRSK

SEQ ID NO: 25329 - protein, 9 aa, Homo Sapiens
RIYSYVVSR

SEQ ID NO: 25330 - protein, 9 aa, Homo Sapiens
RLADSLIGK

SEQ ID NO: 25331 - protein, 9 aa, Homo Sapiens
RLFCVGFTK

SEQ ID NO: 25332 - protein, 9 aa, Homo Sapiens
RLFHLHSQK

SEQ ID NO: 25333 - protein, 9 aa, Homo Sapiens
RLFIGGIPK

SEQ ID NO: 25334 - protein, 9 aa, Homo Sapiens
RLFLFQIQK

SEQ ID NO: 25335 - protein, 9 aa, Homo Sapiens
RLFPGLAIK

SEQ ID NO: 25336 - protein, 9 aa, Homo Sapiens
RLFVGSIPK

SEQ ID NO: 25337 - protein, 9 aa, Homo Sapiens
RLMEIYQEK

SEQ ID NO: 25338 - protein, 9 aa, Homo Sapiens
RLQEIFTEK

SEQ ID NO: 25339 - protein, 9 aa, Homo Sapiens
RLVQGSILK

SEQ ID NO: 25340 - protein, 9 aa, Homo Sapiens
RLVRWLLKK

SEQ ID NO: 25341 - protein, 9 aa, Homo Sapiens
RQFWTRTKK

SEQ ID NO: 25342 - protein, 9 aa, Homo Sapiens
RQIPYTMMK

SEQ ID NO: 25343 - protein, 9 aa, Homo Sapiens
RQVIPIIGK

SEQ ID NO: 25344 - protein, 9 aa, Homo Sapiens
RSDTPLIYK

SEQ ID NO: 25345 - protein, 9 aa, Homo Sapiens
RSFEEAFQK

SEQ ID NO: 25346 - protein, 9 aa, Homo Sapiens
RSFSLGVPR

SEQ ID NO: 25347 - protein, 9 aa, Homo Sapiens
RSLDNFFAK

SEQ ID NO: 25348 - protein, 9 aa, Homo Sapiens
RSLDTHVTK

SEQ ID NO: 25349 - protein, 9 aa, Homo Sapiens
RSMHEFSAK

SEQ ID NO: 25350 - protein, 9 aa, Homo Sapiens
RSNPYYIVK

SEQ ID NO: 25351 - protein, 9 aa, Homo Sapiens
RSSFVFVRK

SEQ ID NO: 25352 - protein, 9 aa, Homo Sapiens
RSVSIPAPA

SEQ ID NO: 25353 - protein, 9 aa, Homo Sapiens
RSYSDPPLK

SEQ ID NO: 25354 - protein, 9 aa, Homo Sapiens
RTAHVILRY

SEQ ID NO: 25355 - protein, 9 aa, Homo Sapiens
RTASFAVRK

SEQ ID NO: 25356 - protein, 9 aa, Homo Sapiens
RTAVYSLHK

SEQ ID NO: 25357 - protein, 9 aa, Homo Sapiens
RTDFTPHWK

SEQ ID NO: 25358 - protein, 9 aa, Homo Sapiens
RTFGHLLRY

SEQ ID NO: 25359 - protein, 9 aa, Homo Sapiens
RTFQEVLAY

SEQ ID NO: 25360 - protein, 9 aa, Homo Sapiens
RTFSYIKNK

SEQ ID NO: 25361 - protein, 9 aa, Homo Sapiens
RTFTWLVGK

SEQ ID NO: 25362 - protein, 9 aa, Homo Sapiens
RTGGHFICK

SEQ ID NO: 25363 - protein, 9 aa, Homo Sapiens
RTIAPIIGR

SEQ ID NO: 25364 - protein, 9 aa, Homo Sapiens
RTIDRSVFK

SEQ ID NO: 25365 - protein, 9 aa, Homo Sapiens
RTIFPLFMK

SEQ ID NO: 25366 - protein, 9 aa, Homo Sapiens
RTISETIER

SEQ ID NO: 25367 - protein, 9 aa, Homo Sapiens
RTLEPLAKK

SEQ ID NO: 25368 - protein, 9 aa, Homo Sapiens
RTLKEILRY

SEQ ID NO: 25369 - protein, 9 aa, Homo Sapiens
RTLPVLLLY

SEQ ID NO: 25370 - protein, 9 aa, Homo Sapiens
RTLQEQLEK

SEQ ID NO: 25371 - protein, 9 aa, Homo Sapiens
RTNWPNTGK

SEQ ID NO: 25372 - protein, 9 aa, Homo Sapiens
RTQGLMIMK

SEQ ID NO: 25373 - protein, 9 aa, Homo Sapiens
RTQNVLGEK

SEQ ID NO: 25374 - protein, 9 aa, Homo Sapiens
RTSEIYVHR

SEQ ID NO: 25375 - protein, 9 aa, Homo Sapiens
RTSIPVHSK

SEQ ID NO: 25376 - protein, 9 aa, Homo Sapiens
RTVEDVFLR

SEQ ID NO: 25377 - protein, 9 aa, Homo Sapiens
RTYDMIQYY

SEQ ID NO: 25378 - protein, 9 aa, Homo Sapiens
RTYYSPVYR

SEQ ID NO: 25379 - protein, 9 aa, Homo Sapiens
RVADFTEQY

SEQ ID NO: 25380 - protein, 9 aa, Homo Sapiens
RVAELILHH

SEQ ID NO: 25381 - protein, 9 aa, Homo Sapiens
RVDQIIMAK

SEQ ID NO: 25382 - protein, 9 aa, Homo Sapiens
RVFFPLCGK

SEQ ID NO: 25383 - protein, 9 aa, Homo Sapiens
RVFHPAFTK

SEQ ID NO: 25384 - protein, 9 aa, Homo Sapiens
RVFLRAINK

SEQ ID NO: 25385 - protein, 9 aa, Homo Sapiens
RVFNIMREK

SEQ ID NO: 25386 - protein, 9 aa, Homo Sapiens
RVFNVFCLY

SEQ ID NO: 25387 - protein, 9 aa, Homo Sapiens
RVFPWFSVK

SEQ ID NO: 25388 - protein, 9 aa, Homo Sapiens
RVFQECLTY

SEQ ID NO: 25389 - protein, 9 aa, Homo Sapiens
RVGDVYIPR

SEQ ID NO: 25390 - protein, 9 aa, Homo Sapiens
RVGEFCHNR

SEQ ID NO: 25391 - protein, 9 aa, Homo Sapiens
RVHSIFVLR

SEQ ID NO: 25392 - protein, 9 aa, Homo Sapiens
RVIAKALEK

SEQ ID NO: 25393 - protein, 9 aa, Homo Sapiens
RVIAPPLIK

SEQ ID NO: 25394 - protein, 9 aa, Homo Sapiens
RVISSIEQK

SEQ ID NO: 25395 - protein, 9 aa, Homo Sapiens
RVITALVER

SEQ ID NO: 25396 - protein, 9 aa, Homo Sapiens
RVKLPSGSK

SEQ ID NO: 25397 - protein, 9 aa, Homo Sapiens
RVLEAIQKK

SEQ ID NO: 25398 - protein, 9 aa, Homo Sapiens
RVLEDRALK

SEQ ID NO: 25399 - protein, 9 aa, Homo Sapiens
RVLPEFKKK

SEQ ID NO: 25400 - protein, 9 aa, Homo Sapiens
RVLPYPFTH

SEQ ID NO: 25401 - protein, 9 aa, Homo Sapiens
RVLSKAFSR

SEQ ID NO: 25402 - protein, 9 aa, Homo Sapiens
RVMDVQYNK

SEQ ID NO: 25403 - protein, 9 aa, Homo Sapiens
RVMGIRVLR

SEQ ID NO: 25404 - protein, 9 aa, Homo Sapiens
RVMKALVNR

SEQ ID NO: 25405 - protein, 9 aa, Homo Sapiens
RVMQDIVYK

SEQ ID NO: 25406 - protein, 9 aa, Homo Sapiens
RVNKLICVK

SEQ ID NO: 25407 - protein, 9 aa, Homo Sapiens
RVNKPPYPK

SEQ ID NO: 25408 - protein, 9 aa, Homo Sapiens
RVNVTGIYR

SEQ ID NO: 25409 - protein, 9 aa, Homo Sapiens
RVPDVVLIK

SEQ ID NO: 25410 - protein, 9 aa, Homo Sapiens
RVQGFQVEY

SEQ ID NO: 25411 - protein, 9 aa, Homo Sapiens
RVQVVGTYR

SEQ ID NO: 25412 - protein, 9 aa, Homo Sapiens
RVSYQKLLK

SEQ ID NO: 25413 - protein, 9 aa, Homo Sapiens
RVTDLFIGK

SEQ ID NO: 25414 - protein, 9 aa, Homo Sapiens
RVTPFILKK

SEQ ID NO: 25415 - protein, 9 aa, Homo Sapiens
RVTYPAKAK

SEQ ID NO: 25416 - protein, 9 aa, Homo Sapiens
RVYGGLTTK

SEQ ID NO: 25417 - protein, 9 aa, Homo Sapiens
RVYHYFQWR

SEQ ID NO: 25418 - protein, 9 aa, Homo Sapiens
RVYNIYIRR

SEQ ID NO: 25419 - protein, 9 aa, Homo Sapiens
RVYNWDVKR

SEQ ID NO: 25420 - protein, 9 aa, Homo Sapiens
RVYPESIPR

SEQ ID NO: 25421 - protein, 9 aa, Homo Sapiens
SAAAALVLK

SEQ ID NO: 25422 - protein, 9 aa, Homo Sapiens
SAAPAITCR

SEQ ID NO: 25423 - protein, 9 aa, Homo Sapiens
SAAPSKPAL

SEQ ID NO: 25424 - protein, 9 aa, Homo Sapiens
SAFGQAFSK

SEQ ID NO: 25425 - protein, 9 aa, Homo Sapiens
SAFGVIIEK

SEQ ID NO: 25426 - protein, 9 aa, Homo Sapiens
SAFQHFWNR

SEQ ID NO: 25427 - protein, 9 aa, Homo Sapiens
SAFSTSISK

SEQ ID NO: 25428 - protein, 9 aa, Homo Sapiens
SAFVERVRK

SEQ ID NO: 25429 - protein, 9 aa, Homo Sapiens
SAFYVPFAK

SEQ ID NO: 25430 - protein, 9 aa, Homo Sapiens
SAGPHLPLK

SEQ ID NO: 25431 - protein, 9 aa, Homo Sapiens
SAGPPSLRK

SEQ ID NO: 25432 - protein, 9 aa, Homo Sapiens
SAIRERFPK

SEQ ID NO: 25433 - protein, 9 aa, Homo Sapiens
SALDFLHNK

SEQ ID NO: 25434 - protein, 9 aa, Homo Sapiens
SALDYNEAK

SEQ ID NO: 25435 - protein, 9 aa, Homo Sapiens
SALHIAIEK

SEQ ID NO: 25436 - protein, 9 aa, Homo Sapiens
SALNFPFAR

SEQ ID NO: 25437 - protein, 9 aa, Homo Sapiens
SALSVAPSK

SEQ ID NO: 25438 - protein, 9 aa, Homo Sapiens
SAMERICEK

SEQ ID NO: 25439 - protein, 9 aa, Homo Sapiens
SAMESFIEK

SEQ ID NO: 25440 - protein, 9 aa, Homo Sapiens
SANECISVK

SEQ ID NO: 25441 - protein, 9 aa, Homo Sapiens
SAPASQASL

SEQ ID NO: 25442 - protein, 9 aa, Homo Sapiens
SAQGNVYVK

SEQ ID NO: 25443 - protein, 9 aa, Homo Sapiens
SAQNTKFFK

SEQ ID NO: 25444 - protein, 9 aa, Homo Sapiens
SAQSFFENK

SEQ ID NO: 25445 - protein, 9 aa, Homo Sapiens
SASASLPTK

SEQ ID NO: 25446 - protein, 9 aa, Homo Sapiens
SATQAVFQK

SEQ ID NO: 25447 - protein, 9 aa, Homo Sapiens
SATTSPFFK

SEQ ID NO: 25448 - protein, 9 aa, Homo Sapiens
SAVDPVQMK

SEQ ID NO: 25449 - protein, 9 aa, Homo Sapiens
SAVGTIVKK

SEQ ID NO: 25450 - protein, 9 aa, Homo Sapiens
SAVLFTITK

SEQ ID NO: 25451 - protein, 9 aa, Homo Sapiens
SAVRPVIEK

SEQ ID NO: 25452 - protein, 9 aa, Homo Sapiens
SDQFPLPLK

SEQ ID NO: 25453 - protein, 9 aa, Homo Sapiens
SGATIRIFK

SEQ ID NO: 25454 - protein, 9 aa, Homo Sapiens
SGIQVRYLK

SEQ ID NO: 25455 - protein, 9 aa, Homo Sapiens
SGMDYWIVK

SEQ ID NO: 25456 - protein, 9 aa, Homo Sapiens
SGSNVKIVK

SEQ ID NO: 25457 - protein, 9 aa, Homo Sapiens
SGSPATPLK

SEQ ID NO: 25458 - protein, 9 aa, Homo Sapiens
SGYFKQFQK

SEQ ID NO: 25459 - protein, 9 aa, Homo Sapiens
SIAAAVAPK

SEQ ID NO: 25460 - protein, 9 aa, Homo Sapiens
SIAPPVPLK

SEQ ID NO: 25461 - protein, 9 aa, Homo Sapiens
SICGKMFKK

SEQ ID NO: 25462 - protein, 9 aa, Homo Sapiens
SICGKSFTK

SEQ ID NO: 25463 - protein, 9 aa, Homo Sapiens
SICGKTFNK

SEQ ID NO: 25464 - protein, 9 aa, Homo Sapiens
SIDEHFQPK

SEQ ID NO: 25465 - protein, 9 aa, Homo Sapiens
SIFACPILR

SEQ ID NO: 25466 - protein, 9 aa, Homo Sapiens
SIFHLTEKK

SEQ ID NO: 25467 - protein, 9 aa, Homo Sapiens
SIFKQPVTK

SEQ ID NO: 25468 - protein, 9 aa, Homo Sapiens
SIFPYVTTK

SEQ ID NO: 25469 - protein, 9 aa, Homo Sapiens
SIFRTPISK

SEQ ID NO: 25470 - protein, 9 aa, Homo Sapiens
SIFSKFTSK

SEQ ID NO: 25471 - protein, 9 aa, Homo Sapiens
SIGDIFLKY

SEQ ID NO: 25472 - protein, 9 aa, Homo Sapiens
SIGPSIVCK

SEQ ID NO: 25473 - protein, 9 aa, Homo Sapiens
SIGTPLDPK

SEQ ID NO: 25474 - protein, 9 aa, Homo Sapiens
SIHRPLAYK

SEQ ID NO: 25475 - protein, 9 aa, Homo Sapiens
SIIETLRQK

SEQ ID NO: 25476 - protein, 9 aa, Homo Sapiens
SIIGVTEPR

SEQ ID NO: 25477 - protein, 9 aa, Homo Sapiens
SIINPPIAK

SEQ ID NO: 25478 - protein, 9 aa, Homo Sapiens
SIISVLPWK

SEQ ID NO: 25479 - protein, 9 aa, Homo Sapiens
SILDEVIFK

SEQ ID NO: 25480 - protein, 9 aa, Homo Sapiens
SILKESKYK

SEQ ID NO: 25481 - protein, 9 aa, Homo Sapiens
SILNNPIVK

SEQ ID NO: 25482 - protein, 9 aa, Homo Sapiens
SILNWVKFK

SEQ ID NO: 25483 - protein, 9 aa, Homo Sapiens
SILPAIFQK

SEQ ID NO: 25484 - protein, 9 aa, Homo Sapiens
SILSGGTPK

SEQ ID NO: 25485 - protein, 9 aa, Homo Sapiens
SILSHIHKR

SEQ ID NO: 25486 - protein, 9 aa, Homo Sapiens
SIMDFNSEK

SEQ ID NO: 25487 - protein, 9 aa, Homo Sapiens
SIMKWNRER

SEQ ID NO: 25488 - protein, 9 aa, Homo Sapiens
SIMSSHVMK

SEQ ID NO: 25489 - protein, 9 aa, Homo Sapiens
SIPTFYFPR

SEQ ID NO: 25490 - protein, 9 aa, Homo Sapiens
SIQHPLIKK

SEQ ID NO: 25491 - protein, 9 aa, Homo Sapiens
SISAVVMEK

SEQ ID NO: 25492 - protein, 9 aa, Homo Sapiens
SISEFLLTH

SEQ ID NO: 25493 - protein, 9 aa, Homo Sapiens
SISSPQPGK

SEQ ID NO: 25494 - protein, 9 aa, Homo Sapiens
SITGFFQRK

SEQ ID NO: 25495 - protein, 9 aa, Homo Sapiens
SITSEVFNK

SEQ ID NO: 25496 - protein, 9 aa, Homo Sapiens
SITSVFITK

SEQ ID NO: 25497 - protein, 9 aa, Homo Sapiens
SIWDETLYK

SEQ ID NO: 25498 - protein, 9 aa, Homo Sapiens
SIWDYFIAK

SEQ ID NO: 25499 - protein, 9 aa, Homo Sapiens
SIYFPYVLK

SEQ ID NO: 25500 - protein, 9 aa, Homo Sapiens
SIYVYKVLK

SEQ ID NO: 25501 - protein, 9 aa, Homo Sapiens
SIYYVDVQK

SEQ ID NO: 25502 - protein, 9 aa, Homo Sapiens
SLADFQIEK

SEQ ID NO: 25503 - protein, 9 aa, Homo Sapiens
SLAEILLKK

SEQ ID NO: 25504 - protein, 9 aa, Homo Sapiens
SLAPVNIFK

SEQ ID NO: 25505 - protein, 9 aa, Homo Sapiens
SLFGSPVAK

SEQ ID NO: 25506 - protein, 9 aa, Homo Sapiens
SLFNTGFLK

SEQ ID NO: 25507 - protein, 9 aa, Homo Sapiens
SLFNTIQAL

SEQ ID NO: 25508 - protein, 9 aa, Homo Sapiens
SLFSRLFGK

SEQ ID NO: 25509 - protein, 9 aa, Homo Sapiens
SLGQVVITK

SEQ ID NO: 25510 - protein, 9 aa, Homo Sapiens
SLLGYFPNK

SEQ ID NO: 25511 - protein, 9 aa, Homo Sapiens
SLLNVSTPK

SEQ ID NO: 25512 - protein, 9 aa, Homo Sapiens
SLLRDLTPK

SEQ ID NO: 25513 - protein, 9 aa, Homo Sapiens
SLLSVLIPK

SEQ ID NO: 25514 - protein, 9 aa, Homo Sapiens
SLMHSFILK

SEQ ID NO: 25515 - protein, 9 aa, Homo Sapiens
SLMPWFHGK

SEQ ID NO: 25516 - protein, 9 aa, Homo Sapiens
SLMSVLIPK

SEQ ID NO: 25517 - protein, 9 aa, Homo Sapiens
SLNQAVVSK

SEQ ID NO: 25518 - protein, 9 aa, Homo Sapiens
SLPYPPKTL

SEQ ID NO: 25519 - protein, 9 aa, Homo Sapiens
SLQELFLAH

SEQ ID NO: 25520 - protein, 9 aa, Homo Sapiens
SLQPSISQK

SEQ ID NO: 25521 - protein, 9 aa, Homo Sapiens
SLQRWEHLK

SEQ ID NO: 25522 - protein, 9 aa, Homo Sapiens
SLSPVILIK

SEQ ID NO: 25523 - protein, 9 aa, Homo Sapiens
SLSSPLNPK

SEQ ID NO: 25524 - protein, 9 aa, Homo Sapiens
SLSVPSVSK

SEQ ID NO: 25525 - protein, 9 aa, Homo Sapiens
SLTPVTPQK

SEQ ID NO: 25526 - protein, 9 aa, Homo Sapiens
SLYAHGYLK

SEQ ID NO: 25527 - protein, 9 aa, Homo Sapiens
SLYRCKQLK

SEQ ID NO: 25528 - protein, 9 aa, Homo Sapiens
SLYWLSTQK

SEQ ID NO: 25529 - protein, 9 aa, Homo Sapiens
SNDGATILK

SEQ ID NO: 25530 - protein, 9 aa, Homo Sapiens
SQCEFSMGK

SEQ ID NO: 25531 - protein, 9 aa, Homo Sapiens
SQCGSLIGK

SEQ ID NO: 25532 - protein, 9 aa, Homo Sapiens
SQFSLPVQK

SEQ ID NO: 25533 - protein, 9 aa, Homo Sapiens
SQGPISKPK

SEQ ID NO: 25534 - protein, 9 aa, Homo Sapiens
SQGTPISLK

SEQ ID NO: 25535 - protein, 9 aa, Homo Sapiens
SQGTTKQLP

SEQ ID NO: 25536 - protein, 9 aa, Homo Sapiens
SQISLLIGK

SEQ ID NO: 25537 - protein, 9 aa, Homo Sapiens
SQISTSIQK

SEQ ID NO: 25538 - protein, 9 aa, Homo Sapiens
SQLGIFISK

SEQ ID NO: 25539 - protein, 9 aa, Homo Sapiens
SQMLFYICK

SEQ ID NO: 25540 - protein, 9 aa, Homo Sapiens
SQNPRFYHK

SEQ ID NO: 25541 - protein, 9 aa, Homo Sapiens
SQPGLVHPK

SEQ ID NO: 25542 - protein, 9 aa, Homo Sapiens
SQQKAFFAK

SEQ ID NO: 25543 - protein, 9 aa, Homo Sapiens
SQSDPTFGK

SEQ ID NO: 25544 - protein, 9 aa, Homo Sapiens
SSAGPGLLK

SEQ ID NO: 25545 - protein, 9 aa, Homo Sapiens
SSAHWPIFK

SEQ ID NO: 25546 - protein, 9 aa, Homo Sapiens
SSAPPLTGK

SEQ ID NO: 25547 - protein, 9 aa, Homo Sapiens
SSAPQNIPK

SEQ ID NO: 25548 - protein, 9 aa, Homo Sapiens
SSCPQQWIK

SEQ ID NO: 25549 - protein, 9 aa, Homo Sapiens
SSCQTIIPK

SEQ ID NO: 25550 - protein, 9 aa, Homo Sapiens
SSCSFVVEK

SEQ ID NO: 25551 - protein, 9 aa, Homo Sapiens
SSEAPLVQK

SEQ ID NO: 25552 - protein, 9 aa, Homo Sapiens
SSFEHEFKK

SEQ ID NO: 25553 - protein, 9 aa, Homo Sapiens
SSFGNMIYK

SEQ ID NO: 25554 - protein, 9 aa, Homo Sapiens
SSFGTILRK

SEQ ID NO: 25555 - protein, 9 aa, Homo Sapiens
SSFLIKRNK

SEQ ID NO: 25556 - protein, 9 aa, Homo Sapiens
SSFQFSIQK

SEQ ID NO: 25557 - protein, 9 aa, Homo Sapiens
SSFSGLLRK

SEQ ID NO: 25558 - protein, 9 aa, Homo Sapiens
SSFSSPHMK

SEQ ID NO: 25559 - protein, 9 aa, Homo Sapiens
SSGDIFLEK

SEQ ID NO: 25560 - protein, 9 aa, Homo Sapiens
SSGPASPPR

SEQ ID NO: 25561 - protein, 9 aa, Homo Sapiens
SSGPSTPLK

SEQ ID NO: 25562 - protein, 9 aa, Homo Sapiens
SSGVPNPPK

SEQ ID NO: 25563 - protein, 9 aa, Homo Sapiens
SSHLPPPPK

SEQ ID NO: 25564 - protein, 9 aa, Homo Sapiens
SSIFVAPRK

SEQ ID NO: 25565 - protein, 9 aa, Homo Sapiens
SSIQGQWPK

SEQ ID NO: 25566 - protein, 9 aa, Homo Sapiens
SSIRHMIRK

SEQ ID NO: 25567 - protein, 9 aa, Homo Sapiens
SSITDPLIK

SEQ ID NO: 25568 - protein, 9 aa, Homo Sapiens
SSLDVNVLK

SEQ ID NO: 25569 - protein, 9 aa, Homo Sapiens
SSLDVSLQK

SEQ ID NO: 25570 - protein, 9 aa, Homo Sapiens
SSLFSGILK

SEQ ID NO: 25571 - protein, 9 aa, Homo Sapiens
SSLFSLLSK

SEQ ID NO: 25572 - protein, 9 aa, Homo Sapiens
SSLKGGLLK

SEQ ID NO: 25573 - protein, 9 aa, Homo Sapiens
SSLNHIVEK

SEQ ID NO: 25574 - protein, 9 aa, Homo Sapiens
SSLPGVFKK

SEQ ID NO: 25575 - protein, 9 aa, Homo Sapiens
SSLPKSFKR

SEQ ID NO: 25576 - protein, 9 aa, Homo Sapiens
SSLPRAFQK

SEQ ID NO: 25577 - protein, 9 aa, Homo Sapiens
SSLPTQLFK

SEQ ID NO: 25578 - protein, 9 aa, Homo Sapiens
SSLQEVYHK

SEQ ID NO: 25579 - protein, 9 aa, Homo Sapiens
SSLQPLPPR

SEQ ID NO: 25580 - protein, 9 aa, Homo Sapiens
SSLRSVCFK

SEQ ID NO: 25581 - protein, 9 aa, Homo Sapiens
SSLSLFFRK

SEQ ID NO: 25582 - protein, 9 aa, Homo Sapiens
SSLYIILKK

SEQ ID NO: 25583 - protein, 9 aa, Homo Sapiens
SSMFGTLPR

SEQ ID NO: 25584 - protein, 9 aa, Homo Sapiens
SSMSVSELK

SEQ ID NO: 25585 - protein, 9 aa, Homo Sapiens
SSNFYITEK

SEQ ID NO: 25586 - protein, 9 aa, Homo Sapiens
SSNIFTVAK

SEQ ID NO: 25587 - protein, 9 aa, Homo Sapiens
SSNLPVNNK

SEQ ID NO: 25588 - protein, 9 aa, Homo Sapiens
SSNSYAIKK

SEQ ID NO: 25589 - protein, 9 aa, Homo Sapiens
SSNVAPVKT

SEQ ID NO: 25590 - protein, 9 aa, Homo Sapiens
SSPKSHIIK

SEQ ID NO: 25591 - protein, 9 aa, Homo Sapiens
SSPQAGSSL

SEQ ID NO: 25592 - protein, 9 aa, Homo Sapiens
SSQSLSFPK

SEQ ID NO: 25593 - protein, 9 aa, Homo Sapiens
SSRGPLPVK

SEQ ID NO: 25594 - protein, 9 aa, Homo Sapiens
SSSAEFLEK

SEQ ID NO: 25595 - protein, 9 aa, Homo Sapiens
SSSGISISK

SEQ ID NO: 25596 - protein, 9 aa, Homo Sapiens
SSSNVRVIK

SEQ ID NO: 25597 - protein, 9 aa, Homo Sapiens
SSSPVNVKK

SEQ ID NO: 25598 - protein, 9 aa, Homo Sapiens
SSSSPTFPK

SEQ ID NO: 25599 - protein, 9 aa, Homo Sapiens
SSSSVLINK

SEQ ID NO: 25600 - protein, 9 aa, Homo Sapiens
SSVGSVITK

SEQ ID NO: 25601 - protein, 9 aa, Homo Sapiens
SSVPLLNSK

SEQ ID NO: 25602 - protein, 9 aa, Homo Sapiens
SSVPYSTAK

SEQ ID NO: 25603 - protein, 9 aa, Homo Sapiens
SSVSLPLAK

SEQ ID NO: 25604 - protein, 9 aa, Homo Sapiens
SSVVPSVYK

SEQ ID NO: 25605 - protein, 9 aa, Homo Sapiens
SSYDTAWKK

SEQ ID NO: 25606 - protein, 9 aa, Homo Sapiens
SSYGNQEFK

SEQ ID NO: 25607 - protein, 9 aa, Homo Sapiens
SSYPKQILR

SEQ ID NO: 25608 - protein, 9 aa, Homo Sapiens
SSYPNPVAH

SEQ ID NO: 25609 - protein, 9 aa, Homo Sapiens
SSYPVCVSK

SEQ ID NO: 25610 - protein, 9 aa, Homo Sapiens
SSYQDFYCK

SEQ ID NO: 25611 - protein, 9 aa, Homo Sapiens
SSYREAVFK

SEQ ID NO: 25612 - protein, 9 aa, Homo Sapiens
STAAATVLK

SEQ ID NO: 25613 - protein, 9 aa, Homo Sapiens
STAAFFLLR

SEQ ID NO: 25614 - protein, 9 aa, Homo Sapiens
STAAVGVLK

SEQ ID NO: 25615 - protein, 9 aa, Homo Sapiens
STAAYQPIK

SEQ ID NO: 25616 - protein, 9 aa, Homo Sapiens
STADLIRCK

SEQ ID NO: 25617 - protein, 9 aa, Homo Sapiens
STAKSQFLK

SEQ ID NO: 25618 - protein, 9 aa, Homo Sapiens
STANIDDLK

SEQ ID NO: 25619 - protein, 9 aa, Homo Sapiens
STAPAQLGK

SEQ ID NO: 25620 - protein, 9 aa, Homo Sapiens
STARHLYLR

SEQ ID NO: 25621 - protein, 9 aa, Homo Sapiens
STASELSPK

SEQ ID NO: 25622 - protein, 9 aa, Homo Sapiens
STCLTSGLK

SEQ ID NO: 25623 - protein, 9 aa, Homo Sapiens
STCSPIISK

SEQ ID NO: 25624 - protein, 9 aa, Homo Sapiens
STDNVSITK

SEQ ID NO: 25625 - protein, 9 aa, Homo Sapiens
STDPSVLGK

SEQ ID NO: 25626 - protein, 9 aa, Homo Sapiens
STDSDSFVK

SEQ ID NO: 25627 - protein, 9 aa, Homo Sapiens
STEKIYIRK

SEQ ID NO: 25628 - protein, 9 aa, Homo Sapiens
STEPPYSQK

SEQ ID NO: 25629 - protein, 9 aa, Homo Sapiens
STFDTPYCR

SEQ ID NO: 25630 - protein, 9 aa, Homo Sapiens
STFDTQITK

SEQ ID NO: 25631 - protein, 9 aa, Homo Sapiens
STFFYPKLK

SEQ ID NO: 25632 - protein, 9 aa, Homo Sapiens
STFNQVVLK

SEQ ID NO: 25633 - protein, 9 aa, Homo Sapiens
STFRESFKK

SEQ ID NO: 25634 - protein, 9 aa, Homo Sapiens
STFSAPLNK

SEQ ID NO: 25635 - protein, 9 aa, Homo Sapiens
STFSATWNR

SEQ ID NO: 25636 - protein, 9 aa, Homo Sapiens
STFSEIFKK

SEQ ID NO: 25637 - protein, 9 aa, Homo Sapiens
STGPITKPK

SEQ ID NO: 25638 - protein, 9 aa, Homo Sapiens
STHGTFLNK

SEQ ID NO: 25639 - protein, 9 aa, Homo Sapiens
STICKYYQK

SEQ ID NO: 25640 - protein, 9 aa, Homo Sapiens
STIDCGLVR

SEQ ID NO: 25641 - protein, 9 aa, Homo Sapiens
STIDDTISK

SEQ ID NO: 25642 - protein, 9 aa, Homo Sapiens
STIEYVIQR

SEQ ID NO: 25643 - protein, 9 aa, Homo Sapiens
STIHGKLQE

SEQ ID NO: 25644 - protein, 9 aa, Homo Sapiens
STIPKVLQY

SEQ ID NO: 25645 - protein, 9 aa, Homo Sapiens
STIPPELVK

SEQ ID NO: 25646 - protein, 9 aa, Homo Sapiens
STIRLPHVK

SEQ ID NO: 25647 - protein, 9 aa, Homo Sapiens
STISCVVER

SEQ ID NO: 25648 - protein, 9 aa, Homo Sapiens
STISEVLGR

SEQ ID NO: 25649 - protein, 9 aa, Homo Sapiens
STITKAWKK

SEQ ID NO: 25650 - protein, 9 aa, Homo Sapiens
STITVDQMK

SEQ ID NO: 25651 - protein, 9 aa, Homo Sapiens
STLAVTSQK

SEQ ID NO: 25652 - protein, 9 aa, Homo Sapiens
STLESIYQR

SEQ ID NO: 25653 - protein, 9 aa, Homo Sapiens
STLGHCVLK

SEQ ID NO: 25654 - protein, 9 aa, Homo Sapiens
STLHHVLQR

SEQ ID NO: 25655 - protein, 9 aa, Homo Sapiens
STLLNPIPK

SEQ ID NO: 25656 - protein, 9 aa, Homo Sapiens
STLMSLPTK

SEQ ID NO: 25657 - protein, 9 aa, Homo Sapiens
STLNVGVNK

SEQ ID NO: 25658 - protein, 9 aa, Homo Sapiens
STLPKPVQK

SEQ ID NO: 25659 - protein, 9 aa, Homo Sapiens
STLPKSLLK

SEQ ID NO: 25660 - protein, 9 aa, Homo Sapiens
STLPPVKSK

SEQ ID NO: 25661 - protein, 9 aa, Homo Sapiens
STLPVTVKK

SEQ ID NO: 25662 - protein, 9 aa, Homo Sapiens
STLRDLIFK

SEQ ID NO: 25663 - protein, 9 aa, Homo Sapiens
STLSPIAPR

SEQ ID NO: 25664 - protein, 9 aa, Homo Sapiens
STLSTVISK

SEQ ID NO: 25665 - protein, 9 aa, Homo Sapiens
STLTGVWKK

SEQ ID NO: 25666 - protein, 9 aa, Homo Sapiens
STLTPKIQK

SEQ ID NO: 25667 - protein, 9 aa, Homo Sapiens
STMAIIVNK

SEQ ID NO: 25668 - protein, 9 aa, Homo Sapiens
STMDLVKSK

SEQ ID NO: 25669 - protein, 9 aa, Homo Sapiens
STMEKFFEH

SEQ ID NO: 25670 - protein, 9 aa, Homo Sapiens
STMGYMAAK

SEQ ID NO: 25671 - protein, 9 aa, Homo Sapiens
STMGYMMAK

SEQ ID NO: 25672 - protein, 9 aa, Homo Sapiens
STMPGLPTR

SEQ ID NO: 25673 - protein, 9 aa, Homo Sapiens
STNNWVLIK

SEQ ID NO: 25674 - protein, 9 aa, Homo Sapiens
STNPFRPQK

SEQ ID NO: 25675 - protein, 9 aa, Homo Sapiens
STNSFALNK

SEQ ID NO: 25676 - protein, 9 aa, Homo Sapiens
STNWSDVGK

SEQ ID NO: 25677 - protein, 9 aa, Homo Sapiens
STPETPLTK

SEQ ID NO: 25678 - protein, 9 aa, Homo Sapiens
STPSFSSPK

SEQ ID NO: 25679 - protein, 9 aa, Homo Sapiens
STQPENFLK

SEQ ID NO: 25680 - protein, 9 aa, Homo Sapiens
STQQLQEVK

SEQ ID NO: 25681 - protein, 9 aa, Homo Sapiens
STSCPVVQK

SEQ ID NO: 25682 - protein, 9 aa, Homo Sapiens
STSDSVRLK

SEQ ID NO: 25683 - protein, 9 aa, Homo Sapiens
STSENITQK

SEQ ID NO: 25684 - protein, 9 aa, Homo Sapiens
STSEPLSSK

SEQ ID NO: 25685 - protein, 9 aa, Homo Sapiens
STSLVVPEK

SEQ ID NO: 25686 - protein, 9 aa, Homo Sapiens
STSNSFNLK

SEQ ID NO: 25687 - protein, 9 aa, Homo Sapiens
STSPEIFRK

SEQ ID NO: 25688 - protein, 9 aa, Homo Sapiens
STSPYFLEH

SEQ ID NO: 25689 - protein, 9 aa, Homo Sapiens
STSRVRLFY

SEQ ID NO: 25690 - protein, 9 aa, Homo Sapiens
STSSHCLLY

SEQ ID NO: 25691 - protein, 9 aa, Homo Sapiens
STTRLYLRK

SEQ ID NO: 25692 - protein, 9 aa, Homo Sapiens
STTTTQITK

SEQ ID NO: 25693 - protein, 9 aa, Homo Sapiens
STVEAFFKK

SEQ ID NO: 25694 - protein, 9 aa, Homo Sapiens
STVEKIAMK

SEQ ID NO: 25695 - protein, 9 aa, Homo Sapiens
STVGWASQK

SEQ ID NO: 25696 - protein, 9 aa, Homo Sapiens
STVHEILCK

SEQ ID NO: 25697 - protein, 9 aa, Homo Sapiens
STVLPLYAK

SEQ ID NO: 25698 - protein, 9 aa, Homo Sapiens
STVPPSLRK

SEQ ID NO: 25699 - protein, 9 aa, Homo Sapiens
STVSRFFLY

SEQ ID NO: 25700 - protein, 9 aa, Homo Sapiens
STYFERCLK

SEQ ID NO: 25701 - protein, 9 aa, Homo Sapiens
STYFKKLFK

SEQ ID NO: 25702 - protein, 9 aa, Homo Sapiens
STYKEAFRK

SEQ ID NO: 25703 - protein, 9 aa, Homo Sapiens
SVAALPVCK

SEQ ID NO: 25704 - protein, 9 aa, Homo Sapiens
SVAAPITVR

SEQ ID NO: 25705 - protein, 9 aa, Homo Sapiens
SVAECQLMK

SEQ ID NO: 25706 - protein, 9 aa, Homo Sapiens
SVAGIFNYY

SEQ ID NO: 25707 - protein, 9 aa, Homo Sapiens
SVAKIAQYK

SEQ ID NO: 25708 - protein, 9 aa, Homo Sapiens
SVAKNFFTK

SEQ ID NO: 25709 - protein, 9 aa, Homo Sapiens
SVAKTILKR

SEQ ID NO: 25710 - protein, 9 aa, Homo Sapiens
SVAQCQLMK

SEQ ID NO: 25711 - protein, 9 aa, Homo Sapiens
SVAQLLLSK

SEQ ID NO: 25712 - protein, 9 aa, Homo Sapiens
SVASPFTSK

SEQ ID NO: 25713 - protein, 9 aa, Homo Sapiens
SVATVVYLR

SEQ ID NO: 25714 - protein, 9 aa, Homo Sapiens
SVCFPTSNK

SEQ ID NO: 25715 - protein, 9 aa, Homo Sapiens
SVCGKSFHR

SEQ ID NO: 25716 - protein, 9 aa, Homo Sapiens
SVCGKVFLR

SEQ ID NO: 25717 - protein, 9 aa, Homo Sapiens
SVCVLDLRK

SEQ ID NO: 25718 - protein, 9 aa, Homo Sapiens
SVDKIVIQK

SEQ ID NO: 25719 - protein, 9 aa, Homo Sapiens
SVDLPKHAK

SEQ ID NO: 25720 - protein, 9 aa, Homo Sapiens
SVDPKNYPK

SEQ ID NO: 25721 - protein, 9 aa, Homo Sapiens
SVDPNQYYK

SEQ ID NO: 25722 - protein, 9 aa, Homo Sapiens
SVDRPIIDR

SEQ ID NO: 25723 - protein, 9 aa, Homo Sapiens
SVEEFQVFK

SEQ ID NO: 25724 - protein, 9 aa, Homo Sapiens
SVEIVPICK

SEQ ID NO: 25725 - protein, 9 aa, Homo Sapiens
SVELPIVGK

SEQ ID NO: 25726 - protein, 9 aa, Homo Sapiens
SVEMPLTGK

SEQ ID NO: 25727 - protein, 9 aa, Homo Sapiens
SVESIISPK

SEQ ID NO: 25728 - protein, 9 aa, Homo Sapiens
SVFACPILR

SEQ ID NO: 25729 - protein, 9 aa, Homo Sapiens
SVFAFGENK

SEQ ID NO: 25730 - protein, 9 aa, Homo Sapiens
SVFDFFLEK

SEQ ID NO: 25731 - protein, 9 aa, Homo Sapiens
SVFEKYFQF

SEQ ID NO: 25732 - protein, 9 aa, Homo Sapiens
SVFELTFKR

SEQ ID NO: 25733 - protein, 9 aa, Homo Sapiens
SVFESLIAK

SEQ ID NO: 25734 - protein, 9 aa, Homo Sapiens
SVFGTMPLK

SEQ ID NO: 25735 - protein, 9 aa, Homo Sapiens
SVFKELLGK

SEQ ID NO: 25736 - protein, 9 aa, Homo Sapiens
SVFLALPCK

SEQ ID NO: 25737 - protein, 9 aa, Homo Sapiens
SVFNHAIRH

SEQ ID NO: 25738 - protein, 9 aa, Homo Sapiens
SVFQTTDTK

SEQ ID NO: 25739 - protein, 9 aa, Homo Sapiens
SVFTSVRQK

SEQ ID NO: 25740 - protein, 9 aa, Homo Sapiens
SVFVATFLR

SEQ ID NO: 25741 - protein, 9 aa, Homo Sapiens
SVGMYLISK

SEQ ID NO: 25742 - protein, 9 aa, Homo Sapiens
SVGQTVITK

SEQ ID NO: 25743 - protein, 9 aa, Homo Sapiens
SVGSVITKK

SEQ ID NO: 25744 - protein, 9 aa, Homo Sapiens
SVHWFPVQK

SEQ ID NO: 25745 - protein, 9 aa, Homo Sapiens
SVIAKYPHK

SEQ ID NO: 25746 - protein, 9 aa, Homo Sapiens
SVIDSVTKK

SEQ ID NO: 25747 - protein, 9 aa, Homo Sapiens
SVIELTCTK

SEQ ID NO: 25748 - protein, 9 aa, Homo Sapiens
SVIEQILHY

SEQ ID NO: 25749 - protein, 9 aa, Homo Sapiens
SVIKNVSTK

SEQ ID NO: 25750 - protein, 9 aa, Homo Sapiens
SVIKPFEEK

SEQ ID NO: 25751 - protein, 9 aa, Homo Sapiens
SVILPILKK

SEQ ID NO: 25752 - protein, 9 aa, Homo Sapiens
SVINKVTEK

SEQ ID NO: 25753 - protein, 9 aa, Homo Sapiens
SVINVFVGR

SEQ ID NO: 25754 - protein, 9 aa, Homo Sapiens
SVIPEHPKK

SEQ ID NO: 25755 - protein, 9 aa, Homo Sapiens
SVIPNCQFR

SEQ ID NO: 25756 - protein, 9 aa, Homo Sapiens
SVIRPILKR

SEQ ID NO: 25757 - protein, 9 aa, Homo Sapiens
SVISSPLLK

SEQ ID NO: 25758 - protein, 9 aa, Homo Sapiens
SVITIVKSK

SEQ ID NO: 25759 - protein, 9 aa, Homo Sapiens
SVITQVLNK

SEQ ID NO: 25760 - protein, 9 aa, Homo Sapiens
SVIVQPFSK

SEQ ID NO: 25761 - protein, 9 aa, Homo Sapiens
SVKDYCFAR

SEQ ID NO: 25762 - protein, 9 aa, Homo Sapiens
SVLAETIKK

SEQ ID NO: 25763 - protein, 9 aa, Homo Sapiens
SVLDIETRK

SEQ ID NO: 25764 - protein, 9 aa, Homo Sapiens
SVLDKSLTK

SEQ ID NO: 25765 - protein, 9 aa, Homo Sapiens
SVLDLSVHK

SEQ ID NO: 25766 - protein, 9 aa, Homo Sapiens
SVLDSFLKY

SEQ ID NO: 25767 - protein, 9 aa, Homo Sapiens
SVLDVRSLK

SEQ ID NO: 25768 - protein, 9 aa, Homo Sapiens
SVLDYFSER

SEQ ID NO: 25769 - protein, 9 aa, Homo Sapiens
SVLENFVGR

SEQ ID NO: 25770 - protein, 9 aa, Homo Sapiens
SVLEPGTAK

SEQ ID NO: 25771 - protein, 9 aa, Homo Sapiens
SVLEQSFLR

SEQ ID NO: 25772 - protein, 9 aa, Homo Sapiens
SVLESVKEK

SEQ ID NO: 25773 - protein, 9 aa, Homo Sapiens
SVLEVVSEK

SEQ ID NO: 25774 - protein, 9 aa, Homo Sapiens
SVLGQAMEK

SEQ ID NO: 25775 - protein, 9 aa, Homo Sapiens
SVLHGMVFK

SEQ ID NO: 25776 - protein, 9 aa, Homo Sapiens
SVLIIAWKF

SEQ ID NO: 25777 - protein, 9 aa, Homo Sapiens
SVLLFVTKK

SEQ ID NO: 25778 - protein, 9 aa, Homo Sapiens
SVLNFATNR

SEQ ID NO: 25779 - protein, 9 aa, Homo Sapiens
SVLNIPMAK

SEQ ID NO: 25780 - protein, 9 aa, Homo Sapiens
SVLNLVIVK

SEQ ID NO: 25781 - protein, 9 aa, Homo Sapiens
SVLPFQIYY

SEQ ID NO: 25782 - protein, 9 aa, Homo Sapiens
SVLPWIILH

SEQ ID NO: 25783 - protein, 9 aa, Homo Sapiens
SVLRELFKK

SEQ ID NO: 25784 - protein, 9 aa, Homo Sapiens
SVLSPLLNK

SEQ ID NO: 25785 - protein, 9 aa, Homo Sapiens
SVLSYTSVR

SEQ ID NO: 25786 - protein, 9 aa, Homo Sapiens
SVLTPLLLR

SEQ ID NO: 25787 - protein, 9 aa, Homo Sapiens
SVLWPWINR

SEQ ID NO: 25788 - protein, 9 aa, Homo Sapiens
SVMAQVRQK

SEQ ID NO: 25789 - protein, 9 aa, Homo Sapiens
SVMDHHFRK

SEQ ID NO: 25790 - protein, 9 aa, Homo Sapiens
SVMELARLK

SEQ ID NO: 25791 - protein, 9 aa, Homo Sapiens
SVMGPQEKK

SEQ ID NO: 25792 - protein, 9 aa, Homo Sapiens
SVMGVTVSR

SEQ ID NO: 25793 - protein, 9 aa, Homo Sapiens
SVMRLTISY

SEQ ID NO: 25794 - protein, 9 aa, Homo Sapiens
SVNGIIFVH

SEQ ID NO: 25795 - protein, 9 aa, Homo Sapiens
SVNGKVLSK

SEQ ID NO: 25796 - protein, 9 aa, Homo Sapiens
SVNLKVSPK

SEQ ID NO: 25797 - protein, 9 aa, Homo Sapiens
SVNNPILRK

SEQ ID NO: 25798 - protein, 9 aa, Homo Sapiens
SVNNSIFYR

SEQ ID NO: 25799 - protein, 9 aa, Homo Sapiens
SVNPNCYAK

SEQ ID NO: 25800 - protein, 9 aa, Homo Sapiens
SVNSHIYQR

SEQ ID NO: 25801 - protein, 9 aa, Homo Sapiens
SVPLPISHK

SEQ ID NO: 25802 - protein, 9 aa, Homo Sapiens
SVPSTPIAH

SEQ ID NO: 25803 - protein, 9 aa, Homo Sapiens
SVPTHCLLH

SEQ ID NO: 25804 - protein, 9 aa, Homo Sapiens
SVQAALKLK

SEQ ID NO: 25805 - protein, 9 aa, Homo Sapiens
SVQAPEVAK

SEQ ID NO: 25806 - protein, 9 aa, Homo Sapiens
SVQCMPVAK

SEQ ID NO: 25807 - protein, 9 aa, Homo Sapiens
SVQDGSVLK

SEQ ID NO: 25808 - protein, 9 aa, Homo Sapiens
SVQEGIKFK

SEQ ID NO: 25809 - protein, 9 aa, Homo Sapiens
SVQENIQQK

SEQ ID NO: 25810 - protein, 9 aa, Homo Sapiens
SVQEYFVRK

SEQ ID NO: 25811 - protein, 9 aa, Homo Sapiens
SVQGFFLNH

SEQ ID NO: 25812 - protein, 9 aa, Homo Sapiens
SVQGIIIYR

SEQ ID NO: 25813 - protein, 9 aa, Homo Sapiens
SVQKPKFPK

SEQ ID NO: 25814 - protein, 9 aa, Homo Sapiens
SVQKPLDYY

SEQ ID NO: 25815 - protein, 9 aa, Homo Sapiens
SVQRPGLAR

SEQ ID NO: 25816 - protein, 9 aa, Homo Sapiens
SVQVFGRKK

SEQ ID NO: 25817 - protein, 9 aa, Homo Sapiens
SVQVMALKK

SEQ ID NO: 25818 - protein, 9 aa, Homo Sapiens
SVSAVNLPK

SEQ ID NO: 25819 - protein, 9 aa, Homo Sapiens
SVSDIIRLR

SEQ ID NO: 25820 - protein, 9 aa, Homo Sapiens
SVSDLAPPR

SEQ ID NO: 25821 - protein, 9 aa, Homo Sapiens
SVSDLFNTK

SEQ ID NO: 25822 - protein, 9 aa, Homo Sapiens
SVSDQFYRY

SEQ ID NO: 25823 - protein, 9 aa, Homo Sapiens
SVSEVIEGY

SEQ ID NO: 25824 - protein, 9 aa, Homo Sapiens
SVSEVVVNR

SEQ ID NO: 25825 - protein, 9 aa, Homo Sapiens
SVSGYIYHK

SEQ ID NO: 25826 - protein, 9 aa, Homo Sapiens
SVSISSAVK

SEQ ID NO: 25827 - protein, 9 aa, Homo Sapiens
SVSKLSTPK

SEQ ID NO: 25828 - protein, 9 aa, Homo Sapiens
SVSLPSVKK

SEQ ID NO: 25829 - protein, 9 aa, Homo Sapiens
SVSLPVRKK

SEQ ID NO: 25830 - protein, 9 aa, Homo Sapiens
SVSNVVITK

SEQ ID NO: 25831 - protein, 9 aa, Homo Sapiens
SVSPVVHVR

SEQ ID NO: 25832 - protein, 9 aa, Homo Sapiens
SVSSVSTLK

SEQ ID NO: 25833 - protein, 9 aa, Homo Sapiens
SVSTHLITK

SEQ ID NO: 25834 - protein, 9 aa, Homo Sapiens
SVSTPLIIK

SEQ ID NO: 25835 - protein, 9 aa, Homo Sapiens
SVTEFSEEK

SEQ ID NO: 25836 - protein, 9 aa, Homo Sapiens
SVTNVSVAK

SEQ ID NO: 25837 - protein, 9 aa, Homo Sapiens
SVVEYLLQH

SEQ ID NO: 25838 - protein, 9 aa, Homo Sapiens
SVVGELMYK

SEQ ID NO: 25839 - protein, 9 aa, Homo Sapiens
SVVGLFLRH

SEQ ID NO: 25840 - protein, 9 aa, Homo Sapiens
SVVNSFIEK

SEQ ID NO: 25841 - protein, 9 aa, Homo Sapiens
SVVPSVILK

SEQ ID NO: 25842 - protein, 9 aa, Homo Sapiens
SVVSDILFK

SEQ ID NO: 25843 - protein, 9 aa, Homo Sapiens
SVVSSVTTK

SEQ ID NO: 25844 - protein, 9 aa, Homo Sapiens
SVWHGTLSK

SEQ ID NO: 25845 - protein, 9 aa, Homo Sapiens
SVYGDFSCK

SEQ ID NO: 25846 - protein, 9 aa, Homo Sapiens
SVYGYGVQK

SEQ ID NO: 25847 - protein, 9 aa, Homo Sapiens
SVYVLVRQK

SEQ ID NO: 25848 - protein, 9 aa, Homo Sapiens
SVYVYKVLK

SEQ ID NO: 25849 - protein, 9 aa, Homo Sapiens
TAAGTLIAK

SEQ ID NO: 25850 - protein, 9 aa, Homo Sapiens
TAFENAYLK

SEQ ID NO: 25851 - protein, 9 aa, Homo Sapiens
TAFLLDALK

SEQ ID NO: 25852 - protein, 9 aa, Homo Sapiens
TAGAQVLLR

SEQ ID NO: 25853 - protein, 9 aa, Homo Sapiens
TALDPSVLD

SEQ ID NO: 25854 - protein, 9 aa, Homo Sapiens
TAMPPGTAR

SEQ ID NO: 25855 - protein, 9 aa, Homo Sapiens
TIAASLAFK

SEQ ID NO: 25856 - protein, 9 aa, Homo Sapiens
TIDGSVNPK

SEQ ID NO: 25857 - protein, 9 aa, Homo Sapiens
TIFEERHLK

SEQ ID NO: 25858 - protein, 9 aa, Homo Sapiens
TIFGKIIRK

SEQ ID NO: 25859 - protein, 9 aa, Homo Sapiens
TIFLMGPVK

SEQ ID NO: 25860 - protein, 9 aa, Homo Sapiens
TIKEGSQLK

SEQ ID NO: 25861 - protein, 9 aa, Homo Sapiens
TILEKFKEK

SEQ ID NO: 25862 - protein, 9 aa, Homo Sapiens
TISPPLQPK

SEQ ID NO: 25863 - protein, 9 aa, Homo Sapiens
TITPVVGKK

SEQ ID NO: 25864 - protein, 9 aa, Homo Sapiens
TLAFITKTI

SEQ ID NO: 25865 - protein, 9 aa, Homo Sapiens
TLCKPLVPR

SEQ ID NO: 25866 - protein, 9 aa, Homo Sapiens
TLFYLGKRK

SEQ ID NO: 25867 - protein, 9 aa, Homo Sapiens
TLFYSEIPK

SEQ ID NO: 25868 - protein, 9 aa, Homo Sapiens
TLLDKYWTK

SEQ ID NO: 25869 - protein, 9 aa, Homo Sapiens
TQATIYVHK

SEQ ID NO: 25870 - protein, 9 aa, Homo Sapiens
TQMGPVAAK

SEQ ID NO: 25871 - protein, 9 aa, Homo Sapiens
TSALPIIQK

SEQ ID NO: 25872 - protein, 9 aa, Homo Sapiens
TSETPQPPR

SEQ ID NO: 25873 - protein, 9 aa, Homo Sapiens
TSGAAVIKQ

SEQ ID NO: 25874 - protein, 9 aa, Homo Sapiens
TSIQPGAPK

SEQ ID NO: 25875 - protein, 9 aa, Homo Sapiens
TSLDKFYRK

SEQ ID NO: 25876 - protein, 9 aa, Homo Sapiens
TSLPDFCHK

SEQ ID NO: 25877 - protein, 9 aa, Homo Sapiens
TSLPPLPFK

SEQ ID NO: 25878 - protein, 9 aa, Homo Sapiens
TSLPSAICK

SEQ ID NO: 25879 - protein, 9 aa, Homo Sapiens
TSLSVSTPK

SEQ ID NO: 25880 - protein, 9 aa, Homo Sapiens
TSPIIIHRL

SEQ ID NO: 25881 - protein, 9 aa, Homo Sapiens
TSQPFQVLK

SEQ ID NO: 25882 - protein, 9 aa, Homo Sapiens
TSSQPVIAK

SEQ ID NO: 25883 - protein, 9 aa, Homo Sapiens
TTDCPVPPK

SEQ ID NO: 25884 - protein, 9 aa, Homo Sapiens
TTFPESHLR

SEQ ID NO: 25885 - protein, 9 aa, Homo Sapiens
TTFSPSISK

SEQ ID NO: 25886 - protein, 9 aa, Homo Sapiens
TTFTKIVNK

SEQ ID NO: 25887 - protein, 9 aa, Homo Sapiens
TTGEPATPK

SEQ ID NO: 25888 - protein, 9 aa, Homo Sapiens
TTHQVYVLK

SEQ ID NO: 25889 - protein, 9 aa, Homo Sapiens
TTITSHFAK

SEQ ID NO: 25890 - protein, 9 aa, Homo Sapiens
TTLGHAVLK

SEQ ID NO: 25891 - protein, 9 aa, Homo Sapiens
TTMQALAEK

SEQ ID NO: 25892 - protein, 9 aa, Homo Sapiens
TTNDIVISK

SEQ ID NO: 25893 - protein, 9 aa, Homo Sapiens
TTQDPLSNK

SEQ ID NO: 25894 - protein, 9 aa, Homo Sapiens
TTQQQLPQK

SEQ ID NO: 25895 - protein, 9 aa, Homo Sapiens
TTSNFTFSK

SEQ ID NO: 25896 - protein, 9 aa, Homo Sapiens
TTSVITIVK

SEQ ID NO: 25897 - protein, 9 aa, Homo Sapiens
TTTEPLPEK

SEQ ID NO: 25898 - protein, 9 aa, Homo Sapiens
TTTGHLIYK

SEQ ID NO: 25899 - protein, 9 aa, Homo Sapiens
TTVDIFHKK

SEQ ID NO: 25900 - protein, 9 aa, Homo Sapiens
TTVPHVFSK

SEQ ID NO: 25901 - protein, 9 aa, Homo Sapiens
TVAKSIDLK

SEQ ID NO: 25902 - protein, 9 aa, Homo Sapiens
TVAVPLVGK

SEQ ID NO: 25903 - protein, 9 aa, Homo Sapiens
TVCDFRLSY

SEQ ID NO: 25904 - protein, 9 aa, Homo Sapiens
TVCDLIQSK

SEQ ID NO: 25905 - protein, 9 aa, Homo Sapiens
TVCLTLTAK

SEQ ID NO: 25906 - protein, 9 aa, Homo Sapiens
TVFEHTFHV

SEQ ID NO: 25907 - protein, 9 aa, Homo Sapiens
TVFENLINK

SEQ ID NO: 25908 - protein, 9 aa, Homo Sapiens
TVFGTALNY

SEQ ID NO: 25909 - protein, 9 aa, Homo Sapiens
TVFLSTWNK

SEQ ID NO: 25910 - protein, 9 aa, Homo Sapiens
TVGDVLEAK

SEQ ID NO: 25911 - protein, 9 aa, Homo Sapiens
TVHPKFHYK

SEQ ID NO: 25912 - protein, 9 aa, Homo Sapiens
TVIADICRR

SEQ ID NO: 25913 - protein, 9 aa, Homo Sapiens
TVIHFNNPK

SEQ ID NO: 25914 - protein, 9 aa, Homo Sapiens
TVILPIKKK

SEQ ID NO: 25915 - protein, 9 aa, Homo Sapiens
TVIQDGIKK

SEQ ID NO: 25916 - protein, 9 aa, Homo Sapiens
TVISLLVYK

SEQ ID NO: 25917 - protein, 9 aa, Homo Sapiens
TVLGYFIGR

SEQ ID NO: 25918 - protein, 9 aa, Homo Sapiens
TVLQYVVGR

SEQ ID NO: 25919 - protein, 9 aa, Homo Sapiens
TVLRPSLGK

SEQ ID NO: 25920 - protein, 9 aa, Homo Sapiens
TVLSKLTRK

SEQ ID NO: 25921 - protein, 9 aa, Homo Sapiens
TVMVPSLLR

SEQ ID NO: 25922 - protein, 9 aa, Homo Sapiens
TVNSPAIYK

SEQ ID NO: 25923 - protein, 9 aa, Homo Sapiens
TVNTMNLPK

SEQ ID NO: 25924 - protein, 9 aa, Homo Sapiens
TVPRRLGPK

SEQ ID NO: 25925 - protein, 9 aa, Homo Sapiens
TVQEHLIEK

SEQ ID NO: 25926 - protein, 9 aa, Homo Sapiens
TVQEKTFNK

SEQ ID NO: 25927 - protein, 9 aa, Homo Sapiens
TVQVYIITK

SEQ ID NO: 25928 - protein, 9 aa, Homo Sapiens
TVSADPVVK

SEQ ID NO: 25929 - protein, 9 aa, Homo Sapiens
TVSDAILRY

SEQ ID NO: 25930 - protein, 9 aa, Homo Sapiens
TVSEPAVIK

SEQ ID NO: 25931 - protein, 9 aa, Homo Sapiens
TVSPFAVQK

SEQ ID NO: 25932 - protein, 9 aa, Homo Sapiens
TVTAQILLK

SEQ ID NO: 25933 - protein, 9 aa, Homo Sapiens
TVTEVLLKY

SEQ ID NO: 25934 - protein, 9 aa, Homo Sapiens
TVTSYVFLK

SEQ ID NO: 25935 - protein, 9 aa, Homo Sapiens
TVVDCPVCK

SEQ ID NO: 25936 - protein, 9 aa, Homo Sapiens
TVVDFQIGK

SEQ ID NO: 25937 - protein, 9 aa, Homo Sapiens
TVYECVVEK

SEQ ID NO: 25938 - protein, 9 aa, Homo Sapiens
TVYEEMMAK

SEQ ID NO: 25939 - protein, 9 aa, Homo Sapiens
TVYRGLVQK

SEQ ID NO: 25940 - protein, 9 aa, Homo Sapiens
VAAEKSFNK

SEQ ID NO: 25941 - protein, 9 aa, Homo Sapiens
VAGTPAPPK

SEQ ID NO: 25942 - protein, 9 aa, Homo Sapiens
VAIGDVYFK

SEQ ID NO: 25943 - protein, 9 aa, Homo Sapiens
VAPLPRSAL

SEQ ID NO: 25944 - protein, 9 aa, Homo Sapiens
VASTLPSRQ

SEQ ID NO: 25945 - protein, 9 aa, Homo Sapiens
VASTPISQR

SEQ ID NO: 25946 - protein, 9 aa, Homo Sapiens
VAVDVAVPK

SEQ ID NO: 25947 - protein, 9 aa, Homo Sapiens
VAVETTTPK

SEQ ID NO: 25948 - protein, 9 aa, Homo Sapiens
VAVPLPLHR

SEQ ID NO: 25949 - protein, 9 aa, Homo Sapiens
VAYHQPTLK

SEQ ID NO: 25950 - protein, 9 aa, Homo Sapiens
VFRDPYRFK

SEQ ID NO: 25951 - protein, 9 aa, Homo Sapiens
VGGLDIHKK

SEQ ID NO: 25952 - protein, 9 aa, Homo Sapiens
VGIDIFTGK

SEQ ID NO: 25953 - protein, 9 aa, Homo Sapiens
VGLNVFLEK

SEQ ID NO: 25954 - protein, 9 aa, Homo Sapiens
VGVYRPPPK

SEQ ID NO: 25955 - protein, 9 aa, Homo Sapiens
VICVWKEKK

SEQ ID NO: 25956 - protein, 9 aa, Homo Sapiens
VIFCNTKRK

SEQ ID NO: 25957 - protein, 9 aa, Homo Sapiens
VIFEGFFAH

SEQ ID NO: 25958 - protein, 9 aa, Homo Sapiens
VIFIIICLR

SEQ ID NO: 25959 - protein, 9 aa, Homo Sapiens
VIFINTRRK

SEQ ID NO: 25960 - protein, 9 aa, Homo Sapiens
VIFKDFVNK

SEQ ID NO: 25961 - protein, 9 aa, Homo Sapiens
VIIAKVTAK

SEQ ID NO: 25962 - protein, 9 aa, Homo Sapiens
VILESIFLK

SEQ ID NO: 25963 - protein, 9 aa, Homo Sapiens
VILIDPFHK

SEQ ID NO: 25964 - protein, 9 aa, Homo Sapiens
VILLPQPPK

SEQ ID NO: 25965 - protein, 9 aa, Homo Sapiens
VIMNSLITK

SEQ ID NO: 25966 - protein, 9 aa, Homo Sapiens
VIQDPMGQK

SEQ ID NO: 25967 - protein, 9 aa, Homo Sapiens
VISPPTVPK

SEQ ID NO: 25968 - protein, 9 aa, Homo Sapiens
VISQVFEIK

SEQ ID NO: 25969 - protein, 9 aa, Homo Sapiens
VIYEKTIRK

SEQ ID NO: 25970 - protein, 9 aa, Homo Sapiens
VIYFPPLQK

SEQ ID NO: 25971 - protein, 9 aa, Homo Sapiens
VLAPVIDLK

SEQ ID NO: 25972 - protein, 9 aa, Homo Sapiens
VLGPTPVQK

SEQ ID NO: 25973 - protein, 9 aa, Homo Sapiens
VLKPRCLQK

SEQ ID NO: 25974 - protein, 9 aa, Homo Sapiens
VLKVLSSLK

SEQ ID NO: 25975 - protein, 9 aa, Homo Sapiens
VLQLPLCEK

SEQ ID NO: 25976 - protein, 9 aa, Homo Sapiens
VNKVPLTGK

SEQ ID NO: 25977 - protein, 9 aa, Homo Sapiens
VRMMFNLLR

SEQ ID NO: 25978 - protein, 9 aa, Homo Sapiens
VSAPNIAMK

SEQ ID NO: 25979 - protein, 9 aa, Homo Sapiens
VSFPIGIYK

SEQ ID NO: 25980 - protein, 9 aa, Homo Sapiens
VSFSDVFFK

SEQ ID NO: 25981 - protein, 9 aa, Homo Sapiens
VSGSIQVLK

SEQ ID NO: 25982 - protein, 9 aa, Homo Sapiens
VSLDYAISK

SEQ ID NO: 25983 - protein, 9 aa, Homo Sapiens
VSLGIAVSK

SEQ ID NO: 25984 - protein, 9 aa, Homo Sapiens
VSLGLVVSK

SEQ ID NO: 25985 - protein, 9 aa, Homo Sapiens
VSLGTPIMK

SEQ ID NO: 25986 - protein, 9 aa, Homo Sapiens
VSLWLPVSK

SEQ ID NO: 25987 - protein, 9 aa, Homo Sapiens
VSMDYAISK

SEQ ID NO: 25988 - protein, 9 aa, Homo Sapiens
VSMLNVYLK

SEQ ID NO: 25989 - protein, 9 aa, Homo Sapiens
VSPLATSAL

SEQ ID NO: 25990 - protein, 9 aa, Homo Sapiens
VSQEPFPNK

SEQ ID NO: 25991 - protein, 9 aa, Homo Sapiens
VSQLPLTER

SEQ ID NO: 25992 - protein, 9 aa, Homo Sapiens
VSSPKLAPK

SEQ ID NO: 25993 - protein, 9 aa, Homo Sapiens
VSSWLPLAK

SEQ ID NO: 25994 - protein, 9 aa, Homo Sapiens
VSYVGYFTK

SEQ ID NO: 25995 - protein, 9 aa, Homo Sapiens
VTAPPARNR

SEQ ID NO: 25996 - protein, 9 aa, Homo Sapiens
VTCNFIILR

SEQ ID NO: 25997 - protein, 9 aa, Homo Sapiens
VTDSPRILK

SEQ ID NO: 25998 - protein, 9 aa, Homo Sapiens
VTFEKQWFY

SEQ ID NO: 25999 - protein, 9 aa, Homo Sapiens
VTFGHSLSK

SEQ ID NO: 26000 - protein, 9 aa, Homo Sapiens
VTFVPGLYK

SEQ ID NO: 26001 - protein, 9 aa, Homo Sapiens
VTGPNMGGK

SEQ ID NO: 26002 - protein, 9 aa, Homo Sapiens
VTIIFIYEK

SEQ ID NO: 26003 - protein, 9 aa, Homo Sapiens
VTISFRIYK

SEQ ID NO: 26004 - protein, 9 aa, Homo Sapiens
VTISSIEKK

SEQ ID NO: 26005 - protein, 9 aa, Homo Sapiens
VTISSVEKK

SEQ ID NO: 26006 - protein, 9 aa, Homo Sapiens
VTLDQVLLR

SEQ ID NO: 26007 - protein, 9 aa, Homo Sapiens
VTLELAVYK

SEQ ID NO: 26008 - protein, 9 aa, Homo Sapiens
VTLTTQHVK

SEQ ID NO: 26009 - protein, 9 aa, Homo Sapiens
VTMKQICKK

SEQ ID NO: 26010 - protein, 9 aa, Homo Sapiens
VTMPATETK

SEQ ID NO: 26011 - protein, 9 aa, Homo Sapiens
VTNDFVMLK

SEQ ID NO: 26012 - protein, 9 aa, Homo Sapiens
VTNNVIRLK

SEQ ID NO: 26013 - protein, 9 aa, Homo Sapiens
VTNQPVTPK

SEQ ID NO: 26014 - protein, 9 aa, Homo Sapiens
VTQAPISAR

SEQ ID NO: 26015 - protein, 9 aa, Homo Sapiens
VTSEVPFSK

SEQ ID NO: 26016 - protein, 9 aa, Homo Sapiens
VTSTFIIEK

SEQ ID NO: 26017 - protein, 9 aa, Homo Sapiens
VTSTSLTIK

SEQ ID NO: 26018 - protein, 9 aa, Homo Sapiens
VTTEKRFLK

SEQ ID NO: 26019 - protein, 9 aa, Homo Sapiens
VTTEPSSLK

SEQ ID NO: 26020 - protein, 9 aa, Homo Sapiens
VTVSGGTPK

SEQ ID NO: 26021 - protein, 9 aa, Homo Sapiens
VTWGFPNLK

SEQ ID NO: 26022 - protein, 9 aa, Homo Sapiens
VTYEHLITK

SEQ ID NO: 26023 - protein, 9 aa, Homo Sapiens
VVAAVIWRK

SEQ ID NO: 26024 - protein, 9 aa, Homo Sapiens
VVAAVMWRK

SEQ ID NO: 26025 - protein, 9 aa, Homo Sapiens
VVADISVAK

SEQ ID NO: 26026 - protein, 9 aa, Homo Sapiens
VVAPPGAPK

SEQ ID NO: 26027 - protein, 9 aa, Homo Sapiens
VVAPRLNSR

SEQ ID NO: 26028 - protein, 9 aa, Homo Sapiens
VVAQEPLHR

SEQ ID NO: 26029 - protein, 9 aa, Homo Sapiens
VVAVPLPLH

SEQ ID NO: 26030 - protein, 9 aa, Homo Sapiens
VVCEEPQVK

SEQ ID NO: 26031 - protein, 9 aa, Homo Sapiens
VVCEYIVKK

SEQ ID NO: 26032 - protein, 9 aa, Homo Sapiens
VVCGTPLFK

SEQ ID NO: 26033 - protein, 9 aa, Homo Sapiens
VVDIPIVEK

SEQ ID NO: 26034 - protein, 9 aa, Homo Sapiens
VVDPHSFPR

SEQ ID NO: 26035 - protein, 9 aa, Homo Sapiens
VVDPVVREK

SEQ ID NO: 26036 - protein, 9 aa, Homo Sapiens
VVDQPLPVR

SEQ ID NO: 26037 - protein, 9 aa, Homo Sapiens
VVDYPNSAK

SEQ ID NO: 26038 - protein, 9 aa, Homo Sapiens
VVFEKAIQR

SEQ ID NO: 26039 - protein, 9 aa, Homo Sapiens
VVFVTKFLY

SEQ ID NO: 26040 - protein, 9 aa, Homo Sapiens
VVGAVVFQK

SEQ ID NO: 26041 - protein, 9 aa, Homo Sapiens
VVGLPNVGK

SEQ ID NO: 26042 - protein, 9 aa, Homo Sapiens
VVGPAAEAK

SEQ ID NO: 26043 - protein, 9 aa, Homo Sapiens
VVGPVGAGK

SEQ ID NO: 26044 - protein, 9 aa, Homo Sapiens
VVGPVSLPR

SEQ ID NO: 26045 - protein, 9 aa, Homo Sapiens
VVIGTPTLK

SEQ ID NO: 26046 - protein, 9 aa, Homo Sapiens
VVINFDFPK

SEQ ID NO: 26047 - protein, 9 aa, Homo Sapiens
VVINYSIVK

SEQ ID NO: 26048 - protein, 9 aa, Homo Sapiens
VVLTYIYFK

SEQ ID NO: 26049 - protein, 9 aa, Homo Sapiens
VVLYPLVAK

SEQ ID NO: 26050 - protein, 9 aa, Homo Sapiens
VVMLESPPK

SEQ ID NO: 26051 - protein, 9 aa, Homo Sapiens
VVMRDPASK

SEQ ID NO: 26052 - protein, 9 aa, Homo Sapiens
VVMRDPNTK

SEQ ID NO: 26053 - protein, 9 aa, Homo Sapiens
VVMRDPQTK

SEQ ID NO: 26054 - protein, 9 aa, Homo Sapiens
VVNSYPLAH

SEQ ID NO: 26055 - protein, 9 aa, Homo Sapiens
VVQEVLSIK

SEQ ID NO: 26056 - protein, 9 aa, Homo Sapiens
VVSEKQFSK

SEQ ID NO: 26057 - protein, 9 aa, Homo Sapiens
VVSEVDIAK

SEQ ID NO: 26058 - protein, 9 aa, Homo Sapiens
VVTEHLINK

SEQ ID NO: 26059 - protein, 9 aa, Homo Sapiens
VVVVNPQTK

SEQ ID NO: 26060 - protein, 9 aa, Homo Sapiens
VVYEFSTTK

SEQ ID NO: 26061 - protein, 9 aa, Homo Sapiens
VVYQYWNTK

SEQ ID NO: 26062 - protein, 9 aa, Homo Sapiens
YDHQGIFKR

SEQ ID NO: 26063 - protein, 9 aa, Homo Sapiens
YDRPGASPK

SEQ ID NO: 26064 - protein, 9 aa, Homo Sapiens
YEGHVSCVK

SEQ ID NO: 26065 - protein, 9 aa, Homo Sapiens
YFGIYDTAK

SEQ ID NO: 26066 - protein, 9 aa, Homo Sapiens
YIIKEHFEK

SEQ ID NO: 26067 - protein, 9 aa, Homo Sapiens
YILSPLSYK

SEQ ID NO: 26068 - protein, 9 aa, Homo Sapiens
YIVPPAPEK

SEQ ID NO: 26069 - protein, 9 aa, Homo Sapiens
YLSTCKDSK

SEQ ID NO: 26070 - protein, 9 aa, Homo Sapiens
YLYITKVLK

SEQ ID NO: 26071 - protein, 9 aa, Homo Sapiens
YRPSKNLDK

SEQ ID NO: 26072 - protein, 9 aa, Homo Sapiens
YSFSYKHLK

SEQ ID NO: 26073 - protein, 10 aa, Homo Sapiens
AAAAAATAKR

SEQ ID NO: 26074 - protein, 10 aa, Homo Sapiens
AAFDGGFTVK

SEQ ID NO: 26075 - protein, 10 aa, Homo Sapiens
AAIVAYGLYK

SEQ ID NO: 26076 - protein, 10 aa, Homo Sapiens
AAMKPANLKK

SEQ ID NO: 26077 - protein, 10 aa, Homo Sapiens
AAMLDTVVFK

SEQ ID NO: 26078 - protein, 10 aa, Homo Sapiens
AAQGIGRAFA

SEQ ID NO: 26079 - protein, 10 aa, Homo Sapiens
AAQRGLAVLK

SEQ ID NO: 26080 - protein, 10 aa, Homo Sapiens
AATTPLDVCK

SEQ ID NO: 26081 - protein, 10 aa, Homo Sapiens
AAYAARWVAK

SEQ ID NO: 26082 - protein, 10 aa, Homo Sapiens
ACTMLVSSLR

SEQ ID NO: 26083 - protein, 10 aa, Homo Sapiens
AGDGLIELRK

SEQ ID NO: 26084 - protein, 10 aa, Homo Sapiens
AGFPSIPVGK

SEQ ID NO: 26085 - protein, 10 aa, Homo Sapiens
AGMTGYGMPR

SEQ ID NO: 26086 - protein, 10 aa, Homo Sapiens
AIETMPCVKK

SEQ ID NO: 26087 - protein, 10 aa, Homo Sapiens
AIFKGVFVHR

SEQ ID NO: 26088 - protein, 10 aa, Homo Sapiens
AIFPATFCQK

SEQ ID NO: 26089 - protein, 10 aa, Homo Sapiens
AIFPRAFPKK

SEQ ID NO: 26090 - protein, 10 aa, Homo Sapiens
AIFQEGIQQK

SEQ ID NO: 26091 - protein, 10 aa, Homo Sapiens
AIIDHIFASK

SEQ ID NO: 26092 - protein, 10 aa, Homo Sapiens
AIITPPPAKK

SEQ ID NO: 26093 - protein, 10 aa, Homo Sapiens
AIIVGSIITK

SEQ ID NO: 26094 - protein, 10 aa, Homo Sapiens
AINVNDSVTK

SEQ ID NO: 26095 - protein, 10 aa, Homo Sapiens
AIQDAVGPPK

SEQ ID NO: 26096 - protein, 10 aa, Homo Sapiens
AIQNPTMINK

SEQ ID NO: 26097 - protein, 10 aa, Homo Sapiens
AIYATIPVYK

SEQ ID NO: 26098 - protein, 10 aa, Homo Sapiens
AIYDHINEGK

SEQ ID NO: 26099 - protein, 10 aa, Homo Sapiens
ALADFLPVMK

SEQ ID NO: 26100 - protein, 10 aa, Homo Sapiens
ALFKGDNLPK

SEQ ID NO: 26101 - protein, 10 aa, Homo Sapiens
ALFSWDTVFK

SEQ ID NO: 26102 - protein, 10 aa, Homo Sapiens
ALPDAAPVTK

SEQ ID NO: 26103 - protein, 10 aa, Homo Sapiens
ALPRQAFHSK

SEQ ID NO: 26104 - protein, 10 aa, Homo Sapiens
AQAKFPAVKK

SEQ ID NO: 26105 - protein, 10 aa, Homo Sapiens
AQAQEVFFLK

SEQ ID NO: 26106 - protein, 10 aa, Homo Sapiens
AQARPPGIYK

SEQ ID NO: 26107 - protein, 10 aa, Homo Sapiens
AQCPFLGPPR

SEQ ID NO: 26108 - protein, 10 aa, Homo Sapiens
AQIDIVISNK

SEQ ID NO: 26109 - protein, 10 aa, Homo Sapiens
AQKFPFNTPK

SEQ ID NO: 26110 - protein, 10 aa, Homo Sapiens
AQMRAAINQK

SEQ ID NO: 26111 - protein, 10 aa, Homo Sapiens
AQNNPLPKGK

SEQ ID NO: 26112 - protein, 10 aa, Homo Sapiens
AQNSVIIVDK

SEQ ID NO: 26113 - protein, 10 aa, Homo Sapiens
AQYQFTGIKK

SEQ ID NO: 26114 - protein, 10 aa, Homo Sapiens
ASAAAALVLK

SEQ ID NO: 26115 - protein, 10 aa, Homo Sapiens
ASAAGLLYLH

SEQ ID NO: 26116 - protein, 10 aa, Homo Sapiens
ASADISLERL

SEQ ID NO: 26117 - protein, 10 aa, Homo Sapiens
ASAHFSPVLR

SEQ ID NO: 26118 - protein, 10 aa, Homo Sapiens
ASALPTGSPK

SEQ ID NO: 26119 - protein, 10 aa, Homo Sapiens
ASASASLPTK

SEQ ID NO: 26120 - protein, 10 aa, Homo Sapiens
ASCVPVNNPK

SEQ ID NO: 26121 - protein, 10 aa, Homo Sapiens
ASFDGRISVY

SEQ ID NO: 26122 - protein, 10 aa, Homo Sapiens
ASFDGTFLWK

SEQ ID NO: 26123 - protein, 10 aa, Homo Sapiens
ASFDKAKLKK

SEQ ID NO: 26124 - protein, 10 aa, Homo Sapiens
ASFGSAAPPR

SEQ ID NO: 26125 - protein, 10 aa, Homo Sapiens
ASFPKVFIKK

SEQ ID NO: 26126 - protein, 10 aa, Homo Sapiens
ASFYSVSQPK

SEQ ID NO: 26127 - protein, 10 aa, Homo Sapiens
ASIAAAVAPK

SEQ ID NO: 26128 - protein, 10 aa, Homo Sapiens
ASILPSSWIG

SEQ ID NO: 26129 - protein, 10 aa, Homo Sapiens
ASIQHPLIKK

SEQ ID NO: 26130 - protein, 10 aa, Homo Sapiens
ASIQPSKVGK

SEQ ID NO: 26131 - protein, 10 aa, Homo Sapiens
ASLELPAAKK

SEQ ID NO: 26132 - protein, 10 aa, Homo Sapiens
ASLIDLLVSK

SEQ ID NO: 26133 - protein, 10 aa, Homo Sapiens
ASLMHSFILK

SEQ ID NO: 26134 - protein, 10 aa, Homo Sapiens
ASLVGQTSPK

SEQ ID NO: 26135 - protein, 10 aa, Homo Sapiens
ASMRYTPVGR

SEQ ID NO: 26136 - protein, 10 aa, Homo Sapiens
ASNPCGNIQR

SEQ ID NO: 26137 - protein, 10 aa, Homo Sapiens
ASQCGSLIGK

SEQ ID NO: 26138 - protein, 10 aa, Homo Sapiens
ASQDIIPQLK

SEQ ID NO: 26139 - protein, 10 aa, Homo Sapiens
ASSAPPLTGK

SEQ ID NO: 26140 - protein, 10 aa, Homo Sapiens
ASSARTQNLK

SEQ ID NO: 26141 - protein, 10 aa, Homo Sapiens
ASSGVPNPPK

SEQ ID NO: 26142 - protein, 10 aa, Homo Sapiens
ASSIFVAPRK

SEQ ID NO: 26143 - protein, 10 aa, Homo Sapiens
ASSLQQASLK

SEQ ID NO: 26144 - protein, 10 aa, Homo Sapiens
ASSTIVPSLK

SEQ ID NO: 26145 - protein, 10 aa, Homo Sapiens
ASVAVPKKPE

SEQ ID NO: 26146 - protein, 10 aa, Homo Sapiens
ASVFGTMPLK

SEQ ID NO: 26147 - protein, 10 aa, Homo Sapiens
ASVPYPPLLR

SEQ ID NO: 26148 - protein, 10 aa, Homo Sapiens
ASYAAVPLYR

SEQ ID NO: 26149 - protein, 10 aa, Homo Sapiens
ASYATIILSK

SEQ ID NO: 26150 - protein, 10 aa, Homo Sapiens
ASYMGKENLK

SEQ ID NO: 26151 - protein, 10 aa, Homo Sapiens
ATAAVTAAVK

SEQ ID NO: 26152 - protein, 10 aa, Homo Sapiens
ATAEVLNIGK

SEQ ID NO: 26153 - protein, 10 aa, Homo Sapiens
ATAGIIGVNR

SEQ ID NO: 26154 - protein, 10 aa, Homo Sapiens
ATAIGMPVEK

SEQ ID NO: 26155 - protein, 10 aa, Homo Sapiens
ATALGEQPVK

SEQ ID NO: 26156 - protein, 10 aa, Homo Sapiens
ATALPTGTSK

SEQ ID NO: 26157 - protein, 10 aa, Homo Sapiens
ATAMLQSLLK

SEQ ID NO: 26158 - protein, 10 aa, Homo Sapiens
ATANMLGIRK

SEQ ID NO: 26159 - protein, 10 aa, Homo Sapiens
ATAPLTELLH

SEQ ID NO: 26160 - protein, 10 aa, Homo Sapiens
ATAPPAPAYK

SEQ ID NO: 26161 - protein, 10 aa, Homo Sapiens
ATAQFKINKK

SEQ ID NO: 26162 - protein, 10 aa, Homo Sapiens
ATAQVNPLYK

SEQ ID NO: 26163 - protein, 10 aa, Homo Sapiens
ATASLGVIHK

SEQ ID NO: 26164 - protein, 10 aa, Homo Sapiens
ATATGTEILK

SEQ ID NO: 26165 - protein, 10 aa, Homo Sapiens
ATAYLPMLEK

SEQ ID NO: 26166 - protein, 10 aa, Homo Sapiens
ATCDFPLLNR

SEQ ID NO: 26167 - protein, 10 aa, Homo Sapiens
ATCDHPYIVK

SEQ ID NO: 26168 - protein, 10 aa, Homo Sapiens
ATCLPLSVRR

SEQ ID NO: 26169 - protein, 10 aa, Homo Sapiens
ATDAVGIVLK

SEQ ID NO: 26170 - protein, 10 aa, Homo Sapiens
ATDFAPGFQK

SEQ ID NO: 26171 - protein, 10 aa, Homo Sapiens
ATEGPNIVCK

SEQ ID NO: 26172 - protein, 10 aa, Homo Sapiens
ATFDIWKFRK

SEQ ID NO: 26173 - protein, 10 aa, Homo Sapiens
ATFEKIPFER

SEQ ID NO: 26174 - protein, 10 aa, Homo Sapiens
ATFFEIYSGK

SEQ ID NO: 26175 - protein, 10 aa, Homo Sapiens
ATFPLSVQKF

SEQ ID NO: 26176 - protein, 10 aa, Homo Sapiens
ATFPSSAFLR

SEQ ID NO: 26177 - protein, 10 aa, Homo Sapiens
ATFQFTVERF

SEQ ID NO: 26178 - protein, 10 aa, Homo Sapiens
ATFTNVFGKK

SEQ ID NO: 26179 - protein, 10 aa, Homo Sapiens
ATFTYFYKKF

SEQ ID NO: 26180 - protein, 10 aa, Homo Sapiens
ATGDMSGLLK

SEQ ID NO: 26181 - protein, 10 aa, Homo Sapiens
ATGESIAVKK

SEQ ID NO: 26182 - protein, 10 aa, Homo Sapiens
ATGKWKQISK

SEQ ID NO: 26183 - protein, 10 aa, Homo Sapiens
ATGQWTRFKK

SEQ ID NO: 26184 - protein, 10 aa, Homo Sapiens
ATGSWDSFLK

SEQ ID NO: 26185 - protein, 10 aa, Homo Sapiens
ATIDGSVNPK

SEQ ID NO: 26186 - protein, 10 aa, Homo Sapiens
ATIRNVLREK

SEQ ID NO: 26187 - protein, 10 aa, Homo Sapiens
ATITDKELLK

SEQ ID NO: 26188 - protein, 10 aa, Homo Sapiens
ATKMNELMEK

SEQ ID NO: 26189 - protein, 10 aa, Homo Sapiens
ATLDIDGVRK

SEQ ID NO: 26190 - protein, 10 aa, Homo Sapiens
ATLEETLVKK

SEQ ID NO: 26191 - protein, 10 aa, Homo Sapiens
ATLGAILNRL

SEQ ID NO: 26192 - protein, 10 aa, Homo Sapiens
ATLGLVDIVK

SEQ ID NO: 26193 - protein, 10 aa, Homo Sapiens
ATLGSGNLRQ

SEQ ID NO: 26194 - protein, 10 aa, Homo Sapiens
ATLKWILENK

SEQ ID NO: 26195 - protein, 10 aa, Homo Sapiens
ATLLPDLIQK

SEQ ID NO: 26196 - protein, 10 aa, Homo Sapiens
ATLPKNPPPK

SEQ ID NO: 26197 - protein, 10 aa, Homo Sapiens
ATLPNQPVEK

SEQ ID NO: 26198 - protein, 10 aa, Homo Sapiens
ATLQDIIRRF

SEQ ID NO: 26199 - protein, 10 aa, Homo Sapiens
ATLQESTFSK

SEQ ID NO: 26200 - protein, 10 aa, Homo Sapiens
ATLSLEKLLK

SEQ ID NO: 26201 - protein, 10 aa, Homo Sapiens
ATMEKLALAK

SEQ ID NO: 26202 - protein, 10 aa, Homo Sapiens
ATMELRDQAK

SEQ ID NO: 26203 - protein, 10 aa, Homo Sapiens
ATNAAVTVLR

SEQ ID NO: 26204 - protein, 10 aa, Homo Sapiens
ATNGPPVLVK

SEQ ID NO: 26205 - protein, 10 aa, Homo Sapiens
ATNKITIIFK

SEQ ID NO: 26206 - protein, 10 aa, Homo Sapiens
ATNPESKVFY

SEQ ID NO: 26207 - protein, 10 aa, Homo Sapiens
ATNTVYVFAK

SEQ ID NO: 26208 - protein, 10 aa, Homo Sapiens
ATPELGSSLK

SEQ ID NO: 26209 - protein, 10 aa, Homo Sapiens
ATPEQVGKMK

SEQ ID NO: 26210 - protein, 10 aa, Homo Sapiens
ATPLDFPSKK

SEQ ID NO: 26211 - protein, 10 aa, Homo Sapiens
ATPLSTLSLK

SEQ ID NO: 26212 - protein, 10 aa, Homo Sapiens
ATPNEIFLKK

SEQ ID NO: 26213 - protein, 10 aa, Homo Sapiens
ATPTSPIRVK

SEQ ID NO: 26214 - protein, 10 aa, Homo Sapiens
ATQCGSLIGK

SEQ ID NO: 26215 - protein, 10 aa, Homo Sapiens
ATQDPPLPTR

SEQ ID NO: 26216 - protein, 10 aa, Homo Sapiens
ATQLAADLLK

SEQ ID NO: 26217 - protein, 10 aa, Homo Sapiens
ATQLLKLAHK

SEQ ID NO: 26218 - protein, 10 aa, Homo Sapiens
ATQMVRMILK

SEQ ID NO: 26219 - protein, 10 aa, Homo Sapiens
ATQNSSQFMK

SEQ ID NO: 26220 - protein, 10 aa, Homo Sapiens
ATQSLKEILK

SEQ ID NO: 26221 - protein, 10 aa, Homo Sapiens
ATQTQFFHVK

SEQ ID NO: 26222 - protein, 10 aa, Homo Sapiens
ATQVAVSVPK

SEQ ID NO: 26223 - protein, 10 aa, Homo Sapiens
ATSPIIIHRL

SEQ ID NO: 26224 - protein, 10 aa, Homo Sapiens
ATSPPFQLTK

SEQ ID NO: 26225 - protein, 10 aa, Homo Sapiens
ATSPPGAIPK

SEQ ID NO: 26226 - protein, 10 aa, Homo Sapiens
ATSSDVIEMK

SEQ ID NO: 26227 - protein, 10 aa, Homo Sapiens
ATSSGAGVFK

SEQ ID NO: 26228 - protein, 10 aa, Homo Sapiens
ATSSLDQTVK

SEQ ID NO: 26229 - protein, 10 aa, Homo Sapiens
ATSTASTFVK

SEQ ID NO: 26230 - protein, 10 aa, Homo Sapiens
ATTSNFTFSK

SEQ ID NO: 26231 - protein, 10 aa, Homo Sapiens
ATTSVITIVK

SEQ ID NO: 26232 - protein, 10 aa, Homo Sapiens
ATVAVPLVGK

SEQ ID NO: 26233 - protein, 10 aa, Homo Sapiens
ATVFPSPCQK

SEQ ID NO: 26234 - protein, 10 aa, Homo Sapiens
ATVIFVASQK

SEQ ID NO: 26235 - protein, 10 aa, Homo Sapiens
ATWATKELRK

SEQ ID NO: 26236 - protein, 10 aa, Homo Sapiens
ATYDTTLVEK

SEQ ID NO: 26237 - protein, 10 aa, Homo Sapiens
ATYEDIVTLR

SEQ ID NO: 26238 - protein, 10 aa, Homo Sapiens
ATYGSGFHFH

SEQ ID NO: 26239 - protein, 10 aa, Homo Sapiens
ATYSEDGLLK

SEQ ID NO: 26240 - protein, 10 aa, Homo Sapiens
ATYYGAFIKK

SEQ ID NO: 26241 - protein, 10 aa, Homo Sapiens
AVAALQDLRY

SEQ ID NO: 26242 - protein, 10 aa, Homo Sapiens
AVAEPANAVK

SEQ ID NO: 26243 - protein, 10 aa, Homo Sapiens
AVAEPAVYFK

SEQ ID NO: 26244 - protein, 10 aa, Homo Sapiens
AVALNYGIYK

SEQ ID NO: 26245 - protein, 10 aa, Homo Sapiens
AVANIVNSVK

SEQ ID NO: 26246 - protein, 10 aa, Homo Sapiens
AVAQPTDVVK

SEQ ID NO: 26247 - protein, 10 aa, Homo Sapiens
AVASVTEILK

SEQ ID NO: 26248 - protein, 10 aa, Homo Sapiens
AVATLALLGK

SEQ ID NO: 26249 - protein, 10 aa, Homo Sapiens
AVAVDVAVPK

SEQ ID NO: 26250 - protein, 10 aa, Homo Sapiens
AVCEVALDYK

SEQ ID NO: 26251 - protein, 10 aa, Homo Sapiens
AVDGNTVELK

SEQ ID NO: 26252 - protein, 10 aa, Homo Sapiens
AVDNADPILK

SEQ ID NO: 26253 - protein, 10 aa, Homo Sapiens
AVFDRDINCR

SEQ ID NO: 26254 - protein, 10 aa, Homo Sapiens
AVFGEATNLK

SEQ ID NO: 26255 - protein, 10 aa, Homo Sapiens
AVFGVIGSQK

SEQ ID NO: 26256 - protein, 10 aa, Homo Sapiens
AVFKGIAADK

SEQ ID NO: 26257 - protein, 10 aa, Homo Sapiens
AVFPFKPPQR

SEQ ID NO: 26258 - protein, 10 aa, Homo Sapiens
AVFPKPFVEK

SEQ ID NO: 26259 - protein, 10 aa, Homo Sapiens
AVFTIVFTQK

SEQ ID NO: 26260 - protein, 10 aa, Homo Sapiens
AVIEKFAPIK

SEQ ID NO: 26261 - protein, 10 aa, Homo Sapiens
AVIKEKIEEK

SEQ ID NO: 26262 - protein, 10 aa, Homo Sapiens
AVILESIFLK

SEQ ID NO: 26263 - protein, 10 aa, Homo Sapiens
AVIPCFPYAR

SEQ ID NO: 26264 - protein, 10 aa, Homo Sapiens
AVISDSYFPR

SEQ ID NO: 26265 - protein, 10 aa, Homo Sapiens
AVISPPTVPK

SEQ ID NO: 26266 - protein, 10 aa, Homo Sapiens
AVITNKDVRK

SEQ ID NO: 26267 - protein, 10 aa, Homo Sapiens
AVLDLSWNKL

SEQ ID NO: 26268 - protein, 10 aa, Homo Sapiens
AVLKHVLTPR

SEQ ID NO: 26269 - protein, 10 aa, Homo Sapiens
AVLKQGLPPK

SEQ ID NO: 26270 - protein, 10 aa, Homo Sapiens
AVLNDYSLTK

SEQ ID NO: 26271 - protein, 10 aa, Homo Sapiens
AVLNFKLKKK

SEQ ID NO: 26272 - protein, 10 aa, Homo Sapiens
AVLYQPLFDK

SEQ ID NO: 26273 - protein, 10 aa, Homo Sapiens
AVMDITDIIK

SEQ ID NO: 26274 - protein, 10 aa, Homo Sapiens
AVMDVVKKQK

SEQ ID NO: 26275 - protein, 10 aa, Homo Sapiens
AVMGAYVLLK

SEQ ID NO: 26276 - protein, 10 aa, Homo Sapiens
AVMKIFDAAK

SEQ ID NO: 26277 - protein, 10 aa, Homo Sapiens
AVMSATFAKF

SEQ ID NO: 26278 - protein, 10 aa, Homo Sapiens
AVNAHSNILK

SEQ ID NO: 26279 - protein, 10 aa, Homo Sapiens
AVNMVPFPRL

SEQ ID NO: 26280 - protein, 10 aa, Homo Sapiens
AVNPKEIASK

SEQ ID NO: 26281 - protein, 10 aa, Homo Sapiens
AVNPYFDIPK

SEQ ID NO: 26282 - protein, 10 aa, Homo Sapiens
AVPEAIPTPR

SEQ ID NO: 26283 - protein, 10 aa, Homo Sapiens
AVPNGPQSPK

SEQ ID NO: 26284 - protein, 10 aa, Homo Sapiens
AVPTNIIAAK

SEQ ID NO: 26285 - protein, 10 aa, Homo Sapiens
AVQAITGNFK

SEQ ID NO: 26286 - protein, 10 aa, Homo Sapiens
AVQELLPQYK

SEQ ID NO: 26287 - protein, 10 aa, Homo Sapiens
AVQGAHPVLR

SEQ ID NO: 26288 - protein, 10 aa, Homo Sapiens
AVQKAIPMYK

SEQ ID NO: 26289 - protein, 10 aa, Homo Sapiens
AVREEVEILK

SEQ ID NO: 26290 - protein, 10 aa, Homo Sapiens
AVSDFHPVKK

SEQ ID NO: 26291 - protein, 10 aa, Homo Sapiens
AVSPSLDLSK

SEQ ID NO: 26292 - protein, 10 aa, Homo Sapiens
AVVETVTTAK

SEQ ID NO: 26293 - protein, 10 aa, Homo Sapiens
AVVGAVVFQK

SEQ ID NO: 26294 - protein, 10 aa, Homo Sapiens
AVYADSGNFK

SEQ ID NO: 26295 - protein, 10 aa, Homo Sapiens
AVYGQKEIHR

SEQ ID NO: 26296 - protein, 10 aa, Homo Sapiens
DMALALESAR

SEQ ID NO: 26297 - protein, 10 aa, Homo Sapiens
DSLVFVQTDK

SEQ ID NO: 26298 - protein, 10 aa, Homo Sapiens
DTIGYPVMIR

SEQ ID NO: 26299 - protein, 10 aa, Homo Sapiens
DTNADKQLSF

SEQ ID NO: 26300 - protein, 10 aa, Homo Sapiens
EENLLDFVRF

SEQ ID NO: 26301 - protein, 10 aa, Homo Sapiens
EEQLQQIRAE

SEQ ID NO: 26302 - protein, 10 aa, Homo Sapiens
EVAPPEYHRK

SEQ ID NO: 26303 - protein, 10 aa, Homo Sapiens
FGGETDEATR

SEQ ID NO: 26304 - protein, 10 aa, Homo Sapiens
FTFDNVLPGK

SEQ ID NO: 26305 - protein, 10 aa, Homo Sapiens
FVYKGGKIYK

SEQ ID NO: 26306 - protein, 10 aa, Homo Sapiens
FVYPGNPLRH

SEQ ID NO: 26307 - protein, 10 aa, Homo Sapiens
GAYDQQIWEK

SEQ ID NO: 26308 - protein, 10 aa, Homo Sapiens
GGHYADSYLK

SEQ ID NO: 26309 - protein, 10 aa, Homo Sapiens
GIFPGTPLKK

SEQ ID NO: 26310 - protein, 10 aa, Homo Sapiens
GIISSPLTGK

SEQ ID NO: 26311 - protein, 10 aa, Homo Sapiens
GLAAGTVPEK

SEQ ID NO: 26312 - protein, 10 aa, Homo Sapiens
GLAGLPGSPK

SEQ ID NO: 26313 - protein, 10 aa, Homo Sapiens
GLCASIHLLK

SEQ ID NO: 26314 - protein, 10 aa, Homo Sapiens
GLPPYSPVFK

SEQ ID NO: 26315 - protein, 10 aa, Homo Sapiens
GQCGDILTNK

SEQ ID NO: 26316 - protein, 10 aa, Homo Sapiens
GQFIGPHRIK

SEQ ID NO: 26317 - protein, 10 aa, Homo Sapiens
GQFSGFPFEK

SEQ ID NO: 26318 - protein, 10 aa, Homo Sapiens
GQGTFTKIFK

SEQ ID NO: 26319 - protein, 10 aa, Homo Sapiens
GQIGPAPPLK

SEQ ID NO: 26320 - protein, 10 aa, Homo Sapiens
GQLGVGNYKK

SEQ ID NO: 26321 - protein, 10 aa, Homo Sapiens
GQNVFGSFLK

SEQ ID NO: 26322 - protein, 10 aa, Homo Sapiens
GQPLVVIPPK

SEQ ID NO: 26323 - protein, 10 aa, Homo Sapiens
GSFASIFWLK

SEQ ID NO: 26324 - protein, 10 aa, Homo Sapiens
GSFSENGFIK

SEQ ID NO: 26325 - protein, 10 aa, Homo Sapiens
GSFVGELMYK

SEQ ID NO: 26326 - protein, 10 aa, Homo Sapiens
GSLSGWSSPK

SEQ ID NO: 26327 - protein, 10 aa, Homo Sapiens
GSMCITQFMK

SEQ ID NO: 26328 - protein, 10 aa, Homo Sapiens
GSMSTVVSTK

SEQ ID NO: 26329 - protein, 10 aa, Homo Sapiens
GSSANIPPLK

SEQ ID NO: 26330 - protein, 10 aa, Homo Sapiens
GSTYFERCLK

SEQ ID NO: 26331 - protein, 10 aa, Homo Sapiens
GSVELPIVGK

SEQ ID NO: 26332 - protein, 10 aa, Homo Sapiens
GSYDPQQIFK

SEQ ID NO: 26333 - protein, 10 aa, Homo Sapiens
GSYNKVFLAK

SEQ ID NO: 26334 - protein, 10 aa, Homo Sapiens
GSYTFDPVTK

SEQ ID NO: 26335 - protein, 10 aa, Homo Sapiens
GTAIIQLPSK

SEQ ID NO: 26336 - protein, 10 aa, Homo Sapiens
GTAIKPLPSY

SEQ ID NO: 26337 - protein, 10 aa, Homo Sapiens
GTAPLVAPPR

SEQ ID NO: 26338 - protein, 10 aa, Homo Sapiens
GTASVLQPVK

SEQ ID NO: 26339 - protein, 10 aa, Homo Sapiens
GTDRTGFTFK

SEQ ID NO: 26340 - protein, 10 aa, Homo Sapiens
GTEEAPKVFK

SEQ ID NO: 26341 - protein, 10 aa, Homo Sapiens
GTEEGQQILK

SEQ ID NO: 26342 - protein, 10 aa, Homo Sapiens
GTEPSLGVKK

SEQ ID NO: 26343 - protein, 10 aa, Homo Sapiens
GTFDPDNLEK

SEQ ID NO: 26344 - protein, 10 aa, Homo Sapiens
GTFGKVKVGK

SEQ ID NO: 26345 - protein, 10 aa, Homo Sapiens
GTFPRAFKKL

SEQ ID NO: 26346 - protein, 10 aa, Homo Sapiens
GTFQQMWISK

SEQ ID NO: 26347 - protein, 10 aa, Homo Sapiens
GTHTFDPVTK

SEQ ID NO: 26348 - protein, 10 aa, Homo Sapiens
GTIAGLNVLR

SEQ ID NO: 26349 - protein, 10 aa, Homo Sapiens
GTIGMRPNAK

SEQ ID NO: 26350 - protein, 10 aa, Homo Sapiens
GTIKKINILK

SEQ ID NO: 26351 - protein, 10 aa, Homo Sapiens
GTILGTRSLK

SEQ ID NO: 26352 - protein, 10 aa, Homo Sapiens
GTILIILTGR

SEQ ID NO: 26353 - protein, 10 aa, Homo Sapiens
GTINIVHPKL

SEQ ID NO: 26354 - protein, 10 aa, Homo Sapiens
GTIPGNPYPK

SEQ ID NO: 26355 - protein, 10 aa, Homo Sapiens
GTKGPSNVFK

SEQ ID NO: 26356 - protein, 10 aa, Homo Sapiens
GTLDFYMARL

SEQ ID NO: 26357 - protein, 10 aa, Homo Sapiens
GTLDYILQRC

SEQ ID NO: 26358 - protein, 10 aa, Homo Sapiens
GTLEIPVAQK

SEQ ID NO: 26359 - protein, 10 aa, Homo Sapiens
GTLQPPFTAR

SEQ ID NO: 26360 - protein, 10 aa, Homo Sapiens
GTMAMTVVTK

SEQ ID NO: 26361 - protein, 10 aa, Homo Sapiens
GTMDMSITRL

SEQ ID NO: 26362 - protein, 10 aa, Homo Sapiens
GTMKMHILQK

SEQ ID NO: 26363 - protein, 10 aa, Homo Sapiens
GTMPLRNIFK

SEQ ID NO: 26364 - protein, 10 aa, Homo Sapiens
GTMPRPSIKK

SEQ ID NO: 26365 - protein, 10 aa, Homo Sapiens
GTNSKPCFQK

SEQ ID NO: 26366 - protein, 10 aa, Homo Sapiens
GTNVNMPVSK

SEQ ID NO: 26367 - protein, 10 aa, Homo Sapiens
GTPAGGGFPR

SEQ ID NO: 26368 - protein, 10 aa, Homo Sapiens
GTPLETIQKK

SEQ ID NO: 26369 - protein, 10 aa, Homo Sapiens
GTQPPGKMEY

SEQ ID NO: 26370 - protein, 10 aa, Homo Sapiens
GTSHLPGLLK

SEQ ID NO: 26371 - protein, 10 aa, Homo Sapiens
GTSSVIVSRK

SEQ ID NO: 26372 - protein, 10 aa, Homo Sapiens
GTVDVTPFIK

SEQ ID NO: 26373 - protein, 10 aa, Homo Sapiens
GTVIHFNNPK

SEQ ID NO: 26374 - protein, 10 aa, Homo Sapiens
GTWKTPSFPK

SEQ ID NO: 26375 - protein, 10 aa, Homo Sapiens
GTYADKLSPK

SEQ ID NO: 26376 - protein, 10 aa, Homo Sapiens
GTYGLDSVKK

SEQ ID NO: 26377 - protein, 10 aa, Homo Sapiens
GTYVKPLSNK

SEQ ID NO: 26378 - protein, 10 aa, Homo Sapiens
GVFEGIPTYR

SEQ ID NO: 26379 - protein, 10 aa, Homo Sapiens
GVFRGPVLPK

SEQ ID NO: 26380 - protein, 10 aa, Homo Sapiens
GVIPYFPYSK

SEQ ID NO: 26381 - protein, 10 aa, Homo Sapiens
GVLDAILATK

SEQ ID NO: 26382 - protein, 10 aa, Homo Sapiens
GVMRIGLVAK

SEQ ID NO: 26383 - protein, 10 aa, Homo Sapiens
GVNDAPALKK

SEQ ID NO: 26384 - protein, 10 aa, Homo Sapiens
GVPAQPLGPR

SEQ ID NO: 26385 - protein, 10 aa, Homo Sapiens
GVYGDVHRVK

SEQ ID NO: 26386 - protein, 10 aa, Homo Sapiens
GVYGDVQRVK

SEQ ID NO: 26387 - protein, 10 aa, Homo Sapiens
GVYNLEIVDK

SEQ ID NO: 26388 - protein, 10 aa, Homo Sapiens
HLLETPLVVK

SEQ ID NO: 26389 - protein, 10 aa, Homo Sapiens
HTSSAIPVPK

SEQ ID NO: 26390 - protein, 10 aa, Homo Sapiens
HVYDGKFLAR

SEQ ID NO: 26391 - protein, 10 aa, Homo Sapiens
IAAAKPTPPK

SEQ ID NO: 26392 - protein, 10 aa, Homo Sapiens
IGIDLNKDKF

SEQ ID NO: 26393 - protein, 10 aa, Homo Sapiens
IGLPAGPPKP

SEQ ID NO: 26394 - protein, 10 aa, Homo Sapiens
IIFAEPTPEK

SEQ ID NO: 26395 - protein, 10 aa, Homo Sapiens
IIFVGTPVQK

SEQ ID NO: 26396 - protein, 10 aa, Homo Sapiens
ILPPLSPYFK

SEQ ID NO: 26397 - protein, 10 aa, Homo Sapiens
ILYGPPGTGK

SEQ ID NO: 26398 - protein, 10 aa, Homo Sapiens
IMPKDIQLAR

SEQ ID NO: 26399 - protein, 10 aa, Homo Sapiens
IQFNPPLSEK

SEQ ID NO: 26400 - protein, 10 aa, Homo Sapiens
ISFPATGCQK

SEQ ID NO: 26401 - protein, 10 aa, Homo Sapiens
ISGPPLKAGK

SEQ ID NO: 26402 - protein, 10 aa, Homo Sapiens
ISMDLQLTNK

SEQ ID NO: 26403 - protein, 10 aa, Homo Sapiens
ITIEIPEVLK

SEQ ID NO: 26404 - protein, 10 aa, Homo Sapiens
ITNDGATILK

SEQ ID NO: 26405 - protein, 10 aa, Homo Sapiens
ITPSTQQHLK

SEQ ID NO: 26406 - protein, 10 aa, Homo Sapiens
IVDTGIGMTK

SEQ ID NO: 26407 - protein, 10 aa, Homo Sapiens
IVENPDGTLK

SEQ ID NO: 26408 - protein, 10 aa, Homo Sapiens
IVVDAIDVLK

SEQ ID NO: 26409 - protein, 10 aa, Homo Sapiens
IVYCGQVFEK

SEQ ID NO: 26410 - protein, 10 aa, Homo Sapiens
KAAVTSLFAK

SEQ ID NO: 26411 - protein, 10 aa, Homo Sapiens
KAFMGTPVQK

SEQ ID NO: 26412 - protein, 10 aa, Homo Sapiens
KAFNQGKIFK

SEQ ID NO: 26413 - protein, 10 aa, Homo Sapiens
KAKEPPFVRK

SEQ ID NO: 26414 - protein, 10 aa, Homo Sapiens
KAMDVLPILK

SEQ ID NO: 26415 - protein, 10 aa, Homo Sapiens
KEKMIHENLR

SEQ ID NO: 26416 - protein, 10 aa, Homo Sapiens
KIIYPTAPPR

SEQ ID NO: 26417 - protein, 10 aa, Homo Sapiens
KIMKDILEKK

SEQ ID NO: 26418 - protein, 10 aa, Homo Sapiens
KLFIPWTNQK

SEQ ID NO: 26419 - protein, 10 aa, Homo Sapiens
KLFPGRPPVK

SEQ ID NO: 26420 - protein, 10 aa, Homo Sapiens
KLMENTFVSK

SEQ ID NO: 26421 - protein, 10 aa, Homo Sapiens
KLPPEKFAPK

SEQ ID NO: 26422 - protein, 10 aa, Homo Sapiens
KLPTEKLPPK

SEQ ID NO: 26423 - protein, 10 aa, Homo Sapiens
KQINLWKIYK

SEQ ID NO: 26424 - protein, 10 aa, Homo Sapiens
KSAFLCGVMK

SEQ ID NO: 26425 - protein, 10 aa, Homo Sapiens
KSFDTSLIRK

SEQ ID NO: 26426 - protein, 10 aa, Homo Sapiens
KSFPGIPLHH

SEQ ID NO: 26427 - protein, 10 aa, Homo Sapiens
KSLDQAISRF

SEQ ID NO: 26428 - protein, 10 aa, Homo Sapiens
KSMNANTITK

SEQ ID NO: 26429 - protein, 10 aa, Homo Sapiens
KTALRAQVKK

SEQ ID NO: 26430 - protein, 10 aa, Homo Sapiens
KTFEGNLTTK

SEQ ID NO: 26431 - protein, 10 aa, Homo Sapiens
KTFSEVLAEK

SEQ ID NO: 26432 - protein, 10 aa, Homo Sapiens
KTGFAEGFLK

SEQ ID NO: 26433 - protein, 10 aa, Homo Sapiens
KTIAPALVSK

SEQ ID NO: 26434 - protein, 10 aa, Homo Sapiens
KTIVNIEMIK

SEQ ID NO: 26435 - protein, 10 aa, Homo Sapiens
KTLDEILQEK

SEQ ID NO: 26436 - protein, 10 aa, Homo Sapiens
KTLETNPYVK

SEQ ID NO: 26437 - protein, 10 aa, Homo Sapiens
KTNMPIITSK

SEQ ID NO: 26438 - protein, 10 aa, Homo Sapiens
KTPTSPLKMK

SEQ ID NO: 26439 - protein, 10 aa, Homo Sapiens
KTYGEIFEKF

SEQ ID NO: 26440 - protein, 10 aa, Homo Sapiens
KVCNPIITKL

SEQ ID NO: 26441 - protein, 10 aa, Homo Sapiens
KVFDGIPPPY

SEQ ID NO: 26442 - protein, 10 aa, Homo Sapiens
KVFEVHVRPK

SEQ ID NO: 26443 - protein, 10 aa, Homo Sapiens
KVGEFSGANK

SEQ ID NO: 26444 - protein, 10 aa, Homo Sapiens
KVGENVLPPK

SEQ ID NO: 26445 - protein, 10 aa, Homo Sapiens
KVLDAIIQEK

SEQ ID NO: 26446 - protein, 10 aa, Homo Sapiens
KVLELQSPPK

SEQ ID NO: 26447 - protein, 10 aa, Homo Sapiens
KVLESIEIFK

SEQ ID NO: 26448 - protein, 10 aa, Homo Sapiens
KVMDLSIVRL

SEQ ID NO: 26449 - protein, 10 aa, Homo Sapiens
KVNIIPIIAK

SEQ ID NO: 26450 - protein, 10 aa, Homo Sapiens
KVNIVPVIAK

SEQ ID NO: 26451 - protein, 10 aa, Homo Sapiens
KVQEKYVWNK

SEQ ID NO: 26452 - protein, 10 aa, Homo Sapiens
KVQEMNYIQK

SEQ ID NO: 26453 - protein, 10 aa, Homo Sapiens
KVTEGSFVYK

SEQ ID NO: 26454 - protein, 10 aa, Homo Sapiens
KVVEGSFVYK

SEQ ID NO: 26455 - protein, 10 aa, Homo Sapiens
KVYLGDIPLK

SEQ ID NO: 26456 - protein, 10 aa, Homo Sapiens
LDSCTKLLQK

SEQ ID NO: 26457 - protein, 10 aa, Homo Sapiens
LFVEEVAASL

SEQ ID NO: 26458 - protein, 10 aa, Homo Sapiens
LGGVAHTLQK

SEQ ID NO: 26459 - protein, 10 aa, Homo Sapiens
LLFPYILPPK

SEQ ID NO: 26460 - protein, 10 aa, Homo Sapiens
LLYYSRTMAK

SEQ ID NO: 26461 - protein, 10 aa, Homo Sapiens
LQNEPLPERL

SEQ ID NO: 26462 - protein, 10 aa, Homo Sapiens
LQNPLLVPVK

SEQ ID NO: 26463 - protein, 10 aa, Homo Sapiens
LSLGVAALYK

SEQ ID NO: 26464 - protein, 10 aa, Homo Sapiens
LSLPYPPKTL

SEQ ID NO: 26465 - protein, 10 aa, Homo Sapiens
LSVPGSCYLK

SEQ ID NO: 26466 - protein, 10 aa, Homo Sapiens
LTFEGTGPTK

SEQ ID NO: 26467 - protein, 10 aa, Homo Sapiens
LTNPKTNIQK

SEQ ID NO: 26468 - protein, 10 aa, Homo Sapiens
LVFEAPNQEK

SEQ ID NO: 26469 - protein, 10 aa, Homo Sapiens
LVFPSEIVGK

SEQ ID NO: 26470 - protein, 10 aa, Homo Sapiens
LVQEQPLPEP

SEQ ID NO: 26471 - protein, 10 aa, Homo Sapiens
LVQMVVDGVK

SEQ ID NO: 26472 - protein, 10 aa, Homo Sapiens
LVQRNVNIFK

SEQ ID NO: 26473 - protein, 10 aa, Homo Sapiens
LVYRDRETLK

SEQ ID NO: 26474 - protein, 10 aa, Homo Sapiens
MFQYDSTHGK

SEQ ID NO: 26475 - protein, 10 aa, Homo Sapiens
MGTSPLQIDR

SEQ ID NO: 26476 - protein, 10 aa, Homo Sapiens
MTVSSDQMAK

SEQ ID NO: 26477 - protein, 10 aa, Homo Sapiens
MVYPFTGDHK

SEQ ID NO: 26478 - protein, 10 aa, Homo Sapiens
NSLQRWEHLK

SEQ ID NO: 26479 - protein, 10 aa, Homo Sapiens
NSTFNQVVLK

SEQ ID NO: 26480 - protein, 10 aa, Homo Sapiens
NVSVVDLTCR

SEQ ID NO: 26481 - protein, 10 aa, Homo Sapiens
PEAGGPPIKK

SEQ ID NO: 26482 - protein, 10 aa, Homo Sapiens
PMTLGYWDIR

SEQ ID NO: 26483 - protein, 10 aa, Homo Sapiens
QIPQLPAPPK

SEQ ID NO: 26484 - protein, 10 aa, Homo Sapiens
QLTSENLQSK

SEQ ID NO: 26485 - protein, 10 aa, Homo Sapiens
QSFDKEWVAK

SEQ ID NO: 26486 - protein, 10 aa, Homo Sapiens
QSNPAPQVQK

SEQ ID NO: 26487 - protein, 10 aa, Homo Sapiens
QTIESINLLK

SEQ ID NO: 26488 - protein, 10 aa, Homo Sapiens
QTIPPPYVVR

SEQ ID NO: 26489 - protein, 10 aa, Homo Sapiens
QTSQPFQVLK

SEQ ID NO: 26490 - protein, 10 aa, Homo Sapiens
QVLDVPLTVK

SEQ ID NO: 26491 - protein, 10 aa, Homo Sapiens
QVLTLPLMLK

SEQ ID NO: 26492 - protein, 10 aa, Homo Sapiens
QVQEGTKVLK

SEQ ID NO: 26493 - protein, 10 aa, Homo Sapiens
QVQKPGPLQK

SEQ ID NO: 26494 - protein, 10 aa, Homo Sapiens
QVQPKPSPPR

SEQ ID NO: 26495 - protein, 10 aa, Homo Sapiens
QVWKPSFCFK

SEQ ID NO: 26496 - protein, 10 aa, Homo Sapiens
RAFNDPFIQK

SEQ ID NO: 26497 - protein, 10 aa, Homo Sapiens
RAFSFSKTPK

SEQ ID NO: 26498 - protein, 10 aa, Homo Sapiens
RAMDVEPRAK

SEQ ID NO: 26499 - protein, 10 aa, Homo Sapiens
RGMGELLPTK

SEQ ID NO: 26500 - protein, 10 aa, Homo Sapiens
RGSGLQLLPR

SEQ ID NO: 26501 - protein, 10 aa, Homo Sapiens
RIFTLKPVRK

SEQ ID NO: 26502 - protein, 10 aa, Homo Sapiens
RIIEETLALK

SEQ ID NO: 26503 - protein, 10 aa, Homo Sapiens
RIMDPEIALK

SEQ ID NO: 26504 - protein, 10 aa, Homo Sapiens
RIPGPGTPVK

SEQ ID NO: 26505 - protein, 10 aa, Homo Sapiens
RIQDGLGELK

SEQ ID NO: 26506 - protein, 10 aa, Homo Sapiens
RIYDYDPLYK

SEQ ID NO: 26507 - protein, 10 aa, Homo Sapiens
RLMSLPIAKK

SEQ ID NO: 26508 - protein, 10 aa, Homo Sapiens
RLPLISGFYK

SEQ ID NO: 26509 - protein, 10 aa, Homo Sapiens
RMFLSFPTTK

SEQ ID NO: 26510 - protein, 10 aa, Homo Sapiens
RQAELAQWQK

SEQ ID NO: 26511 - protein, 10 aa, Homo Sapiens
RSAQPLPLKI

SEQ ID NO: 26512 - protein, 10 aa, Homo Sapiens
RSHYFEGVLK

SEQ ID NO: 26513 - protein, 10 aa, Homo Sapiens
RSLDHPNVLK

SEQ ID NO: 26514 - protein, 10 aa, Homo Sapiens
RTAALPTFRK

SEQ ID NO: 26515 - protein, 10 aa, Homo Sapiens
RTATQLAVNK

SEQ ID NO: 26516 - protein, 10 aa, Homo Sapiens
RTAVPSFLTK

SEQ ID NO: 26517 - protein, 10 aa, Homo Sapiens
RTCEWTGLKF

SEQ ID NO: 26518 - protein, 10 aa, Homo Sapiens
RTDDKVIRFK

SEQ ID NO: 26519 - protein, 10 aa, Homo Sapiens
RTFLLQGLLR

SEQ ID NO: 26520 - protein, 10 aa, Homo Sapiens
RTGPPMGSRF

SEQ ID NO: 26521 - protein, 10 aa, Homo Sapiens
RTISETIERL

SEQ ID NO: 26522 - protein, 10 aa, Homo Sapiens
RTLDAKMPRK

SEQ ID NO: 26523 - protein, 10 aa, Homo Sapiens
RTLGAIVRQK

SEQ ID NO: 26524 - protein, 10 aa, Homo Sapiens
RTLSDYNIQK

SEQ ID NO: 26525 - protein, 10 aa, Homo Sapiens
RTSRPLKILR

SEQ ID NO: 26526 - protein, 10 aa, Homo Sapiens
RTVPVGGVVK

SEQ ID NO: 26527 - protein, 10 aa, Homo Sapiens
RTYDREGFKK

SEQ ID NO: 26528 - protein, 10 aa, Homo Sapiens
RVAEALHKLK

SEQ ID NO: 26529 - protein, 10 aa, Homo Sapiens
RVCDAVKALK

SEQ ID NO: 26530 - protein, 10 aa, Homo Sapiens
RVCDIILPRL

SEQ ID NO: 26531 - protein, 10 aa, Homo Sapiens
RVFAAESIIK

SEQ ID NO: 26532 - protein, 10 aa, Homo Sapiens
RVFQETQKLK

SEQ ID NO: 26533 - protein, 10 aa, Homo Sapiens
RVFQGFFTGR

SEQ ID NO: 26534 - protein, 10 aa, Homo Sapiens
RVFRGRFQGR

SEQ ID NO: 26535 - protein, 10 aa, Homo Sapiens
RVFSNKLLEK

SEQ ID NO: 26536 - protein, 10 aa, Homo Sapiens
RVIFTGGVGK

SEQ ID NO: 26537 - protein, 10 aa, Homo Sapiens
RVINSIPLAK

SEQ ID NO: 26538 - protein, 10 aa, Homo Sapiens
RVIYKPIVEK

SEQ ID NO: 26539 - protein, 10 aa, Homo Sapiens
RVLDFDVKRK

SEQ ID NO: 26540 - protein, 10 aa, Homo Sapiens
RVLDPSKFLK

SEQ ID NO: 26541 - protein, 10 aa, Homo Sapiens
RVLDVGFVGR

SEQ ID NO: 26542 - protein, 10 aa, Homo Sapiens
RVLEAAVAAK

SEQ ID NO: 26543 - protein, 10 aa, Homo Sapiens
RVLKPGGLLK

SEQ ID NO: 26544 - protein, 10 aa, Homo Sapiens
RVLNKLGGVK

SEQ ID NO: 26545 - protein, 10 aa, Homo Sapiens
RVLSKAFSRL

SEQ ID NO: 26546 - protein, 10 aa, Homo Sapiens
RVLVRSTTPK

SEQ ID NO: 26547 - protein, 10 aa, Homo Sapiens
RVMDVQYNKF

SEQ ID NO: 26548 - protein, 10 aa, Homo Sapiens
RVNKVIIGTK

SEQ ID NO: 26549 - protein, 10 aa, Homo Sapiens
RVPDVVLIKK

SEQ ID NO: 26550 - protein, 10 aa, Homo Sapiens
RVPLDPLIGK

SEQ ID NO: 26551 - protein, 10 aa, Homo Sapiens
RVPPPPPIAR

SEQ ID NO: 26552 - protein, 10 aa, Homo Sapiens
RVPQAEGPPK

SEQ ID NO: 26553 - protein, 10 aa, Homo Sapiens
RVPVEKPVYK

SEQ ID NO: 26554 - protein, 10 aa, Homo Sapiens
RVSDCIPLSH

SEQ ID NO: 26555 - protein, 10 aa, Homo Sapiens
RVSECLRVLK

SEQ ID NO: 26556 - protein, 10 aa, Homo Sapiens
RVSNVKSVYK

SEQ ID NO: 26557 - protein, 10 aa, Homo Sapiens
RVWDLPGVLK

SEQ ID NO: 26558 - protein, 10 aa, Homo Sapiens
RVWIQGKFQK

SEQ ID NO: 26559 - protein, 10 aa, Homo Sapiens
RVYPESIPRK

SEQ ID NO: 26560 - protein, 10 aa, Homo Sapiens
RVYYVDHVEK

SEQ ID NO: 26561 - protein, 10 aa, Homo Sapiens
SAAEPVPAAR

SEQ ID NO: 26562 - protein, 10 aa, Homo Sapiens
SAFDNVPRKK

SEQ ID NO: 26563 - protein, 10 aa, Homo Sapiens
SAFDRILSSK

SEQ ID NO: 26564 - protein, 10 aa, Homo Sapiens
SAFGGSLPAK

SEQ ID NO: 26565 - protein, 10 aa, Homo Sapiens
SAFGNILSCK

SEQ ID NO: 26566 - protein, 10 aa, Homo Sapiens
SAFHKVLSEK

SEQ ID NO: 26567 - protein, 10 aa, Homo Sapiens
SAFLLLGLFK

SEQ ID NO: 26568 - protein, 10 aa, Homo Sapiens
SAFQAPAVKK

SEQ ID NO: 26569 - protein, 10 aa, Homo Sapiens
SALTGVLSAK

SEQ ID NO: 26570 - protein, 10 aa, Homo Sapiens
SANIGPFLEK

SEQ ID NO: 26571 - protein, 10 aa, Homo Sapiens
SAQGKPLALK

SEQ ID NO: 26572 - protein, 10 aa, Homo Sapiens
SATFPLSVQK

SEQ ID NO: 26573 - protein, 10 aa, Homo Sapiens
SAVHPREIFK

SEQ ID NO: 26574 - protein, 10 aa, Homo Sapiens
SAYLGSEQYK

SEQ ID NO: 26575 - protein, 10 aa, Homo Sapiens
SAYYPSSFPK

SEQ ID NO: 26576 - protein, 10 aa, Homo Sapiens
SCGEFGHIQK

SEQ ID NO: 26577 - protein, 10 aa, Homo Sapiens
SDPNVSKKLK

SEQ ID NO: 26578 - protein, 10 aa, Homo Sapiens
SEATAAILSR

SEQ ID NO: 26579 - protein, 10 aa, Homo Sapiens
SGLVPAAPPK

SEQ ID NO: 26580 - protein, 10 aa, Homo Sapiens
SIAVKSIHRK

SEQ ID NO: 26581 - protein, 10 aa, Homo Sapiens
SIDGRVVEPK

SEQ ID NO: 26582 - protein, 10 aa, Homo Sapiens
SIFDGRVVAK

SEQ ID NO: 26583 - protein, 10 aa, Homo Sapiens
SIFEPVNLPK

SEQ ID NO: 26584 - protein, 10 aa, Homo Sapiens
SIFFESMPYK

SEQ ID NO: 26585 - protein, 10 aa, Homo Sapiens
SIFGGTDMKK

SEQ ID NO: 26586 - protein, 10 aa, Homo Sapiens
SIFVPPFISK

SEQ ID NO: 26587 - protein, 10 aa, Homo Sapiens
SIKIKTDSAK

SEQ ID NO: 26588 - protein, 10 aa, Homo Sapiens
SILDAKPPKK

SEQ ID NO: 26589 - protein, 10 aa, Homo Sapiens
SILEDYANYK

SEQ ID NO: 26590 - protein, 10 aa, Homo Sapiens
SILEKGFIAK

SEQ ID NO: 26591 - protein, 10 aa, Homo Sapiens
SILQGDSPTK

SEQ ID NO: 26592 - protein, 10 aa, Homo Sapiens
SILRNPVTNK

SEQ ID NO: 26593 - protein, 10 aa, Homo Sapiens
SINDKIIELK

SEQ ID NO: 26594 - protein, 10 aa, Homo Sapiens
SIPQKPQTNK

SEQ ID NO: 26595 - protein, 10 aa, Homo Sapiens
SIPVAPTPPR

SEQ ID NO: 26596 - protein, 10 aa, Homo Sapiens
SISGPISTSK

SEQ ID NO: 26597 - protein, 10 aa, Homo Sapiens
SIYDGDEFRK

SEQ ID NO: 26598 - protein, 10 aa, Homo Sapiens
SIYEHEDIKK

SEQ ID NO: 26599 - protein, 10 aa, Homo Sapiens
SLELEHIEVK

SEQ ID NO: 26600 - protein, 10 aa, Homo Sapiens
SLFDRQGFLK

SEQ ID NO: 26601 - protein, 10 aa, Homo Sapiens
SLFNRRVEEK

SEQ ID NO: 26602 - protein, 10 aa, Homo Sapiens
SLFVFFNHPK

SEQ ID NO: 26603 - protein, 10 aa, Homo Sapiens
SLMDRPLCER

SEQ ID NO: 26604 - protein, 10 aa, Homo Sapiens
SLNGEFGYQK

SEQ ID NO: 26605 - protein, 10 aa, Homo Sapiens
SLPANTPLRK

SEQ ID NO: 26606 - protein, 10 aa, Homo Sapiens
SLPDFPAAAK

SEQ ID NO: 26607 - protein, 10 aa, Homo Sapiens
SLPDIPFDPK

SEQ ID NO: 26608 - protein, 10 aa, Homo Sapiens
SLPDLTTPLK

SEQ ID NO: 26609 - protein, 10 aa, Homo Sapiens
SLPLVDTHSK

SEQ ID NO: 26610 - protein, 10 aa, Homo Sapiens
SLPVEVPLNH

SEQ ID NO: 26611 - protein, 10 aa, Homo Sapiens
SLQEVTIHEK

SEQ ID NO: 26612 - protein, 10 aa, Homo Sapiens
SLQQVRQQLK

SEQ ID NO: 26613 - protein, 10 aa, Homo Sapiens
SLWDRLIFHK

SEQ ID NO: 26614 - protein, 10 aa, Homo Sapiens
SMFHNRHLFK

SEQ ID NO: 26615 - protein, 10 aa, Homo Sapiens
SQCDSPYVTK

SEQ ID NO: 26616 - protein, 10 aa, Homo Sapiens
SQEHPVVLTK

SEQ ID NO: 26617 - protein, 10 aa, Homo Sapiens
SQFKGYFIFK

SEQ ID NO: 26618 - protein, 10 aa, Homo Sapiens
SQFSGKITVK

SEQ ID NO: 26619 - protein, 10 aa, Homo Sapiens
SSAPPTPTRL

SEQ ID NO: 26620 - protein, 10 aa, Homo Sapiens
SSDSGSGFWK

SEQ ID NO: 26621 - protein, 10 aa, Homo Sapiens
SSFSVKPFEK

SEQ ID NO: 26622 - protein, 10 aa, Homo Sapiens
SSGEAFHVGK

SEQ ID NO: 26623 - protein, 10 aa, Homo Sapiens
SSLECIAIPK

SEQ ID NO: 26624 - protein, 10 aa, Homo Sapiens
SSLSLVEIYK

SEQ ID NO: 26625 - protein, 10 aa, Homo Sapiens
SSLSSPLNPK

SEQ ID NO: 26626 - protein, 10 aa, Homo Sapiens
SSMAGVYVCK

SEQ ID NO: 26627 - protein, 10 aa, Homo Sapiens
SSMFGTLPRK

SEQ ID NO: 26628 - protein, 10 aa, Homo Sapiens
SSMTQTPALK

SEQ ID NO: 26629 - protein, 10 aa, Homo Sapiens
SSQALGTIPK

SEQ ID NO: 26630 - protein, 10 aa, Homo Sapiens
SSQIPSSVNK

SEQ ID NO: 26631 - protein, 10 aa, Homo Sapiens
SSQQFSGIGR

SEQ ID NO: 26632 - protein, 10 aa, Homo Sapiens
SSVESIISPK

SEQ ID NO: 26633 - protein, 10 aa, Homo Sapiens
SSVGSVITKK

SEQ ID NO: 26634 - protein, 10 aa, Homo Sapiens
SSYYSVLLQK

SEQ ID NO: 26635 - protein, 10 aa, Homo Sapiens
STANYDFVLK

SEQ ID NO: 26636 - protein, 10 aa, Homo Sapiens
STCNTKLTLK

SEQ ID NO: 26637 - protein, 10 aa, Homo Sapiens
STDPAAPNLK

SEQ ID NO: 26638 - protein, 10 aa, Homo Sapiens
STESNMSVPK

SEQ ID NO: 26639 - protein, 10 aa, Homo Sapiens
STFDTQITKK

SEQ ID NO: 26640 - protein, 10 aa, Homo Sapiens
STFIGRAAAK

SEQ ID NO: 26641 - protein, 10 aa, Homo Sapiens
STFLTFPIYK

SEQ ID NO: 26642 - protein, 10 aa, Homo Sapiens
STFNFHPNVR

SEQ ID NO: 26643 - protein, 10 aa, Homo Sapiens
STFNNDILSK

SEQ ID NO: 26644 - protein, 10 aa, Homo Sapiens
STFNQVVLKR

SEQ ID NO: 26645 - protein, 10 aa, Homo Sapiens
STFQQMWISK

SEQ ID NO: 26646 - protein, 10 aa, Homo Sapiens
STFSGGRIPK

SEQ ID NO: 26647 - protein, 10 aa, Homo Sapiens
STGKFEWGSK

SEQ ID NO: 26648 - protein, 10 aa, Homo Sapiens
STIDDTISKF

SEQ ID NO: 26649 - protein, 10 aa, Homo Sapiens
STIFTLDVYK

SEQ ID NO: 26650 - protein, 10 aa, Homo Sapiens
STLFSALLIK

SEQ ID NO: 26651 - protein, 10 aa, Homo Sapiens
STLRSSCLYR

SEQ ID NO: 26652 - protein, 10 aa, Homo Sapiens
STMAIIVNKL

SEQ ID NO: 26653 - protein, 10 aa, Homo Sapiens
STMEGGTLKY

SEQ ID NO: 26654 - protein, 10 aa, Homo Sapiens
STMGYMAAKK

SEQ ID NO: 26655 - protein, 10 aa, Homo Sapiens
STMGYMMAKK

SEQ ID NO: 26656 - protein, 10 aa, Homo Sapiens
STMRPLATAY

SEQ ID NO: 26657 - protein, 10 aa, Homo Sapiens
STMSAEWVSK

SEQ ID NO: 26658 - protein, 10 aa, Homo Sapiens
STMTTPQVLK

SEQ ID NO: 26659 - protein, 10 aa, Homo Sapiens
STNAYMPLLK

SEQ ID NO: 26660 - protein, 10 aa, Homo Sapiens
STNSPVGVSK

SEQ ID NO: 26661 - protein, 10 aa, Homo Sapiens
STPLAGLAPK

SEQ ID NO: 26662 - protein, 10 aa, Homo Sapiens
STPLHVPVPR

SEQ ID NO: 26663 - protein, 10 aa, Homo Sapiens
STQNGPVFAK

SEQ ID NO: 26664 - protein, 10 aa, Homo Sapiens
STSETPQPPR

SEQ ID NO: 26665 - protein, 10 aa, Homo Sapiens
STSPSVALSK

SEQ ID NO: 26666 - protein, 10 aa, Homo Sapiens
STSVVRPFAK

SEQ ID NO: 26667 - protein, 10 aa, Homo Sapiens
STTQVVGILK

SEQ ID NO: 26668 - protein, 10 aa, Homo Sapiens
STVQILGAEK

SEQ ID NO: 26669 - protein, 10 aa, Homo Sapiens
STVSADPVVK

SEQ ID NO: 26670 - protein, 10 aa, Homo Sapiens
STVSPLPSLK

SEQ ID NO: 26671 - protein, 10 aa, Homo Sapiens
STWTGPPAMK

SEQ ID NO: 26672 - protein, 10 aa, Homo Sapiens
STYDGVFIWK

SEQ ID NO: 26673 - protein, 10 aa, Homo Sapiens
STYDLYTIPK

SEQ ID NO: 26674 - protein, 10 aa, Homo Sapiens
STYGTHIHEK

SEQ ID NO: 26675 - protein, 10 aa, Homo Sapiens
STYNLQILTR

SEQ ID NO: 26676 - protein, 10 aa, Homo Sapiens
STYYGSFVTR

SEQ ID NO: 26677 - protein, 10 aa, Homo Sapiens
SVAETAQTIK

SEQ ID NO: 26678 - protein, 10 aa, Homo Sapiens
SVAGGLFVGK

SEQ ID NO: 26679 - protein, 10 aa, Homo Sapiens
SVAPSPAVDK

SEQ ID NO: 26680 - protein, 10 aa, Homo Sapiens
SVASTPISQR

SEQ ID NO: 26681 - protein, 10 aa, Homo Sapiens
SVATCMAILH

SEQ ID NO: 26682 - protein, 10 aa, Homo Sapiens
SVAVLRGIQK

SEQ ID NO: 26683 - protein, 10 aa, Homo Sapiens
SVCEGKGLHR

SEQ ID NO: 26684 - protein, 10 aa, Homo Sapiens
SVEATQPVLK

SEQ ID NO: 26685 - protein, 10 aa, Homo Sapiens
SVFAEERNLK

SEQ ID NO: 26686 - protein, 10 aa, Homo Sapiens
SVFAGVVGVK

SEQ ID NO: 26687 - protein, 10 aa, Homo Sapiens
SVFDAYVLPK

SEQ ID NO: 26688 - protein, 10 aa, Homo Sapiens
SVFDFQKAYK

SEQ ID NO: 26689 - protein, 10 aa, Homo Sapiens
SVFEDPVISK

SEQ ID NO: 26690 - protein, 10 aa, Homo Sapiens
SVFESLIAKK

SEQ ID NO: 26691 - protein, 10 aa, Homo Sapiens
SVFFGGLSIK

SEQ ID NO: 26692 - protein, 10 aa, Homo Sapiens
SVFNEHPSRR

SEQ ID NO: 26693 - protein, 10 aa, Homo Sapiens
SVFPYNHRMK

SEQ ID NO: 26694 - protein, 10 aa, Homo Sapiens
SVFQQGMKNK

SEQ ID NO: 26695 - protein, 10 aa, Homo Sapiens
SVFSDKLHSK

SEQ ID NO: 26696 - protein, 10 aa, Homo Sapiens
SVFSPSFGLK

SEQ ID NO: 26697 - protein, 10 aa, Homo Sapiens
SVGSDLFVFK

SEQ ID NO: 26698 - protein, 10 aa, Homo Sapiens
SVGTEMIITK

SEQ ID NO: 26699 - protein, 10 aa, Homo Sapiens
SVIATTALDK

SEQ ID NO: 26700 - protein, 10 aa, Homo Sapiens
SVIDEPVRLK

SEQ ID NO: 26701 - protein, 10 aa, Homo Sapiens
SVIGDYLARF

SEQ ID NO: 26702 - protein, 10 aa, Homo Sapiens
SVIKEGWLHK

SEQ ID NO: 26703 - protein, 10 aa, Homo Sapiens
SVINPGAIYR

SEQ ID NO: 26704 - protein, 10 aa, Homo Sapiens
SVIRDYLVQK

SEQ ID NO: 26705 - protein, 10 aa, Homo Sapiens
SVISTDPLKR

SEQ ID NO: 26706 - protein, 10 aa, Homo Sapiens
SVITTSAPNK

SEQ ID NO: 26707 - protein, 10 aa, Homo Sapiens
SVKDGAICYK

SEQ ID NO: 26708 - protein, 10 aa, Homo Sapiens
SVLDLSVHKK

SEQ ID NO: 26709 - protein, 10 aa, Homo Sapiens
SVLDWEDLIR

SEQ ID NO: 26710 - protein, 10 aa, Homo Sapiens
SVLEATRVNR

SEQ ID NO: 26711 - protein, 10 aa, Homo Sapiens
SVLEPPLFLK

SEQ ID NO: 26712 - protein, 10 aa, Homo Sapiens
SVLIQKQIFK

SEQ ID NO: 26713 - protein, 10 aa, Homo Sapiens
SVLKEKITFK

SEQ ID NO: 26714 - protein, 10 aa, Homo Sapiens
SVLLQKQILK

SEQ ID NO: 26715 - protein, 10 aa, Homo Sapiens
SVLNLVIVKK

SEQ ID NO: 26716 - protein, 10 aa, Homo Sapiens
SVLNNSLLLH

SEQ ID NO: 26717 - protein, 10 aa, Homo Sapiens
SVLPTIRVPK

SEQ ID NO: 26718 - protein, 10 aa, Homo Sapiens
SVLPTSKPEK

SEQ ID NO: 26719 - protein, 10 aa, Homo Sapiens
SVLPYFVATK

SEQ ID NO: 26720 - protein, 10 aa, Homo Sapiens
SVLYPSSDPK

SEQ ID NO: 26721 - protein, 10 aa, Homo Sapiens
SVMDQEMRVK

SEQ ID NO: 26722 - protein, 10 aa, Homo Sapiens
SVMGVTVSRL

SEQ ID NO: 26723 - protein, 10 aa, Homo Sapiens
SVMLGGRNIK

SEQ ID NO: 26724 - protein, 10 aa, Homo Sapiens
SVMNLDDLTR

SEQ ID NO: 26725 - protein, 10 aa, Homo Sapiens
SVMPAQKITK

SEQ ID NO: 26726 - protein, 10 aa, Homo Sapiens
SVMPKKSILK

SEQ ID NO: 26727 - protein, 10 aa, Homo Sapiens
SVMQKIIPHY

SEQ ID NO: 26728 - protein, 10 aa, Homo Sapiens
SVMRPEQIMK

SEQ ID NO: 26729 - protein, 10 aa, Homo Sapiens
SVMSTVEWNK

SEQ ID NO: 26730 - protein, 10 aa, Homo Sapiens
SVMYPVDSVK

SEQ ID NO: 26731 - protein, 10 aa, Homo Sapiens
SVMYSTLPGR

SEQ ID NO: 26732 - protein, 10 aa, Homo Sapiens
SVNIQALPDK

SEQ ID NO: 26733 - protein, 10 aa, Homo Sapiens
SVNPSVTTIK

SEQ ID NO: 26734 - protein, 10 aa, Homo Sapiens
SVPCSVAPEK

SEQ ID NO: 26735 - protein, 10 aa, Homo Sapiens
SVPDGKPLVR

SEQ ID NO: 26736 - protein, 10 aa, Homo Sapiens
SVPDYGQRLK

SEQ ID NO: 26737 - protein, 10 aa, Homo Sapiens
SVPGYYPSNK

SEQ ID NO: 26738 - protein, 10 aa, Homo Sapiens
SVPNGQTPLK

SEQ ID NO: 26739 - protein, 10 aa, Homo Sapiens
SVPREPIDRK

SEQ ID NO: 26740 - protein, 10 aa, Homo Sapiens
SVPSTPIAHR

SEQ ID NO: 26741 - protein, 10 aa, Homo Sapiens
SVPVAVVPSK

SEQ ID NO: 26742 - protein, 10 aa, Homo Sapiens
SVQEGIKFKK

SEQ ID NO: 26743 - protein, 10 aa, Homo Sapiens
SVQEKGVLLK

SEQ ID NO: 26744 - protein, 10 aa, Homo Sapiens
SVQLPKPVHK

SEQ ID NO: 26745 - protein, 10 aa, Homo Sapiens
SVQTQPAIKK

SEQ ID NO: 26746 - protein, 10 aa, Homo Sapiens
SVQVPEFTPK

SEQ ID NO: 26747 - protein, 10 aa, Homo Sapiens
SVSDLAPPRK

SEQ ID NO: 26748 - protein, 10 aa, Homo Sapiens
SVSNMVHTAK

SEQ ID NO: 26749 - protein, 10 aa, Homo Sapiens
SVSPPIPHLR

SEQ ID NO: 26750 - protein, 10 aa, Homo Sapiens
SVSQPIMVQR

SEQ ID NO: 26751 - protein, 10 aa, Homo Sapiens
SVSSAPTLLK

SEQ ID NO: 26752 - protein, 10 aa, Homo Sapiens
SVSTITRIYR

SEQ ID NO: 26753 - protein, 10 aa, Homo Sapiens
SVTDVKFAPK

SEQ ID NO: 26754 - protein, 10 aa, Homo Sapiens
SVTEAIPVSR

SEQ ID NO: 26755 - protein, 10 aa, Homo Sapiens
SVVGFPFLDK

SEQ ID NO: 26756 - protein, 10 aa, Homo Sapiens
SVYDALPLTR

SEQ ID NO: 26757 - protein, 10 aa, Homo Sapiens
SVYDHQGIFK

SEQ ID NO: 26758 - protein, 10 aa, Homo Sapiens
SVYDLTPGEK

SEQ ID NO: 26759 - protein, 10 aa, Homo Sapiens
SVYGYGVQKR

SEQ ID NO: 26760 - protein, 10 aa, Homo Sapiens
TAGLPTTLGP

SEQ ID NO: 26761 - protein, 10 aa, Homo Sapiens
TALPASPVAR

SEQ ID NO: 26762 - protein, 10 aa, Homo Sapiens
TALVSWLSAK

SEQ ID NO: 26763 - protein, 10 aa, Homo Sapiens
TAMDVVYALK

SEQ ID NO: 26764 - protein, 10 aa, Homo Sapiens
TAYGGKYSVK

SEQ ID NO: 26765 - protein, 10 aa, Homo Sapiens
TEAELLQLEK

SEQ ID NO: 26766 - protein, 10 aa, Homo Sapiens
TIDERAINKK

SEQ ID NO: 26767 - protein, 10 aa, Homo Sapiens
TILAGDVKVK

SEQ ID NO: 26768 - protein, 10 aa, Homo Sapiens
TIQSGEQPYK

SEQ ID NO: 26769 - protein, 10 aa, Homo Sapiens
TQEKNPLPSK

SEQ ID NO: 26770 - protein, 10 aa, Homo Sapiens
TSFDGSLIQK

SEQ ID NO: 26771 - protein, 10 aa, Homo Sapiens
TSLLGYFPNK

SEQ ID NO: 26772 - protein, 10 aa, Homo Sapiens
TSTCSPIISK

SEQ ID NO: 26773 - protein, 10 aa, Homo Sapiens
TTATGVFSLK

SEQ ID NO: 26774 - protein, 10 aa, Homo Sapiens
TTDSGPYFEK

SEQ ID NO: 26775 - protein, 10 aa, Homo Sapiens
TTEGQVQVLK

SEQ ID NO: 26776 - protein, 10 aa, Homo Sapiens
TTISSFPQLK

SEQ ID NO: 26777 - protein, 10 aa, Homo Sapiens
TTLAFKPIKK

SEQ ID NO: 26778 - protein, 10 aa, Homo Sapiens
TTLCKPLVPR

SEQ ID NO: 26779 - protein, 10 aa, Homo Sapiens
TTLPPPLFSK

SEQ ID NO: 26780 - protein, 10 aa, Homo Sapiens
TTNDIVISKL

SEQ ID NO: 26781 - protein, 10 aa, Homo Sapiens
TTSDPPNICK

SEQ ID NO: 26782 - protein, 10 aa, Homo Sapiens
TVAEISQFLK

SEQ ID NO: 26783 - protein, 10 aa, Homo Sapiens
TVAVPLVGKL

SEQ ID NO: 26784 - protein, 10 aa, Homo Sapiens
TVFKNGKVTK

SEQ ID NO: 26785 - protein, 10 aa, Homo Sapiens
TVFREPIICK

SEQ ID NO: 26786 - protein, 10 aa, Homo Sapiens
TVFTEEDFQK

SEQ ID NO: 26787 - protein, 10 aa, Homo Sapiens
TVISGPGTGK

SEQ ID NO: 26788 - protein, 10 aa, Homo Sapiens
TVLCQPTGGK

SEQ ID NO: 26789 - protein, 10 aa, Homo Sapiens
TVQDGRQFLK

SEQ ID NO: 26790 - protein, 10 aa, Homo Sapiens
TVYRNPESFK

SEQ ID NO: 26791 - protein, 10 aa, Homo Sapiens
VAQRDPIIAK

SEQ ID NO: 26792 - protein, 10 aa, Homo Sapiens
VFAAECILSK

SEQ ID NO: 26793 - protein, 10 aa, Homo Sapiens
VFRDPYRFKK

SEQ ID NO: 26794 - protein, 10 aa, Homo Sapiens
VINEVINSPK

SEQ ID NO: 26795 - protein, 10 aa, Homo Sapiens
VLFSAVMVVF

SEQ ID NO: 26796 - protein, 10 aa, Homo Sapiens
VLINVDPCAK

SEQ ID NO: 26797 - protein, 10 aa, Homo Sapiens
VMLGAETEEK

SEQ ID NO: 26798 - protein, 10 aa, Homo Sapiens
VNEAACDIAR

SEQ ID NO: 26799 - protein, 10 aa, Homo Sapiens
VQEFGLARFK

SEQ ID NO: 26800 - protein, 10 aa, Homo Sapiens
VSILLGTVPK

SEQ ID NO: 26801 - protein, 10 aa, Homo Sapiens
VSQIPPMAVK

SEQ ID NO: 26802 - protein, 10 aa, Homo Sapiens
VTDPSIPIRK

SEQ ID NO: 26803 - protein, 10 aa, Homo Sapiens
VTFGSIFGYK

SEQ ID NO: 26804 - protein, 10 aa, Homo Sapiens
VTGSWDQTVK

SEQ ID NO: 26805 - protein, 10 aa, Homo Sapiens
VTGTPELSAK

SEQ ID NO: 26806 - protein, 10 aa, Homo Sapiens
VTHRPPLSPK

SEQ ID NO: 26807 - protein, 10 aa, Homo Sapiens
VTIFIRGGNK

SEQ ID NO: 26808 - protein, 10 aa, Homo Sapiens
VTIIMNDYPK

SEQ ID NO: 26809 - protein, 10 aa, Homo Sapiens
VTIKEGSQLK

SEQ ID NO: 26810 - protein, 10 aa, Homo Sapiens
VTLSWKPVQK

SEQ ID NO: 26811 - protein, 10 aa, Homo Sapiens
VTMGFTGFGK

SEQ ID NO: 26812 - protein, 10 aa, Homo Sapiens
VTNDGATILK

SEQ ID NO: 26813 - protein, 10 aa, Homo Sapiens
VTQTPPYVKK

SEQ ID NO: 26814 - protein, 10 aa, Homo Sapiens
VTTGSEGLLK

SEQ ID NO: 26815 - protein, 10 aa, Homo Sapiens
VTVDGHLIRK

SEQ ID NO: 26816 - protein, 10 aa, Homo Sapiens
VTVDPKYHPK

SEQ ID NO: 26817 - protein, 10 aa, Homo Sapiens
VTVSIANMAV

SEQ ID NO: 26818 - protein, 10 aa, Homo Sapiens
VTYGGDPIPK

SEQ ID NO: 26819 - protein, 10 aa, Homo Sapiens
VTYNGVDNNK

SEQ ID NO: 26820 - protein, 10 aa, Homo Sapiens
VTYSDVGGCK

SEQ ID NO: 26821 - protein, 10 aa, Homo Sapiens
VTYVPVTTFK

SEQ ID NO: 26822 - protein, 10 aa, Homo Sapiens
VVAGYGDVGK

SEQ ID NO: 26823 - protein, 10 aa, Homo Sapiens
VVAVPLPLHR

SEQ ID NO: 26824 - protein, 10 aa, Homo Sapiens
VVCVEGIVTK

SEQ ID NO: 26825 - protein, 10 aa, Homo Sapiens
VVDVPFGGAK

SEQ ID NO: 26826 - protein, 10 aa, Homo Sapiens
VVGVYRPPPK

SEQ ID NO: 26827 - protein, 10 aa, Homo Sapiens
VVINVNNILK

SEQ ID NO: 26828 - protein, 10 aa, Homo Sapiens
VVLGQFLVLK

SEQ ID NO: 26829 - protein, 10 aa, Homo Sapiens
VVMAADRSLK

SEQ ID NO: 26830 - protein, 10 aa, Homo Sapiens
VVMENVGQQK

SEQ ID NO: 26831 - protein, 10 aa, Homo Sapiens
VVMVNQGLTK

SEQ ID NO: 26832 - protein, 10 aa, Homo Sapiens
VVNKVPLTGK

SEQ ID NO: 26833 - protein, 10 aa, Homo Sapiens
VVPKAAIVAR

SEQ ID NO: 26834 - protein, 10 aa, Homo Sapiens
VVQDMLVPMK

SEQ ID NO: 26835 - protein, 10 aa, Homo Sapiens
VVQEPGQVFK

SEQ ID NO: 26836 - protein, 10 aa, Homo Sapiens
VVQNGFFAHK

SEQ ID NO: 26837 - protein, 10 aa, Homo Sapiens
VVVDPIQSVK

SEQ ID NO: 26838 - protein, 10 aa, Homo Sapiens
VVYEDIFDAK

SEQ ID NO: 26839 - protein, 10 aa, Homo Sapiens
VVYPPPVDPK

SEQ ID NO: 26840 - protein, 10 aa, Homo Sapiens
VVYTSHLQLK

SEQ ID NO: 26841 - protein, 10 aa, Homo Sapiens
VYGQKEIHRK

SEQ ID NO: 26842 - protein, 10 aa, Homo Sapiens
YGLAAAVFTK

SEQ ID NO: 26843 - protein, 10 aa, Homo Sapiens
YIYDGELVSK

SEQ ID NO: 26844 - protein, 11 aa, Homo Sapiens
AACYNNQQVFK

SEQ ID NO: 26845 - protein, 11 aa, Homo Sapiens
AALGQVCSSIK

SEQ ID NO: 26846 - protein, 11 aa, Homo Sapiens
AALQSERLVSK

SEQ ID NO: 26847 - protein, 11 aa, Homo Sapiens
AAMNMGRPFQK

SEQ ID NO: 26848 - protein, 11 aa, Homo Sapiens
AANPDPKKLLK

SEQ ID NO: 26849 - protein, 11 aa, Homo Sapiens
AAQDSTDLVAK

SEQ ID NO: 26850 - protein, 11 aa, Homo Sapiens
AASKERSGVSL

SEQ ID NO: 26851 - protein, 11 aa, Homo Sapiens
AATGATPIAGR

SEQ ID NO: 26852 - protein, 11 aa, Homo Sapiens
ADCGLRPLFEK

SEQ ID NO: 26853 - protein, 11 aa, Homo Sapiens
AEAEAHREAEA

SEQ ID NO: 26854 - protein, 11 aa, Homo Sapiens
AELHLVHWNPK

SEQ ID NO: 26855 - protein, 11 aa, Homo Sapiens
AGFDATNILNK

SEQ ID NO: 26856 - protein, 11 aa, Homo Sapiens
AGSSQSLSFPK

SEQ ID NO: 26857 - protein, 11 aa, Homo Sapiens
AIAPPTSLVEK

SEQ ID NO: 26858 - protein, 11 aa, Homo Sapiens
AIAQAESLRYK

SEQ ID NO: 26859 - protein, 11 aa, Homo Sapiens
AIFEVNTDLQK

SEQ ID NO: 26860 - protein, 11 aa, Homo Sapiens
AIFGNADPAQK

SEQ ID NO: 26861 - protein, 11 aa, Homo Sapiens
AIIGKQGQHIK

SEQ ID NO: 26862 - protein, 11 aa, Homo Sapiens
AIIPSKKLRNK

SEQ ID NO: 26863 - protein, 11 aa, Homo Sapiens
AIMDPLPLRTK

SEQ ID NO: 26864 - protein, 11 aa, Homo Sapiens
AIQAEEIMKLK

SEQ ID NO: 26865 - protein, 11 aa, Homo Sapiens
AIQDLKLLANK

SEQ ID NO: 26866 - protein, 11 aa, Homo Sapiens
AIQQADKLLKK

SEQ ID NO: 26867 - protein, 11 aa, Homo Sapiens
AIYDGFDGFAK

SEQ ID NO: 26868 - protein, 11 aa, Homo Sapiens
AIYKTPPGIQK

SEQ ID NO: 26869 - protein, 11 aa, Homo Sapiens
ALFNPDVCWDR

SEQ ID NO: 26870 - protein, 11 aa, Homo Sapiens
ALLDGSNVVFK

SEQ ID NO: 26871 - protein, 11 aa, Homo Sapiens
ALLRVTPFILK

SEQ ID NO: 26872 - protein, 11 aa, Homo Sapiens
ALLSHQDIHNK

SEQ ID NO: 26873 - protein, 11 aa, Homo Sapiens
ALNEANLSNLK

SEQ ID NO: 26874 - protein, 11 aa, Homo Sapiens
ALPLDTVTFYK

SEQ ID NO: 26875 - protein, 11 aa, Homo Sapiens
ALPVLERLIYK

SEQ ID NO: 26876 - protein, 11 aa, Homo Sapiens
AMMNNNDLVRK

SEQ ID NO: 26877 - protein, 11 aa, Homo Sapiens
AQICSSIRTHK

SEQ ID NO: 26878 - protein, 11 aa, Homo Sapiens
AQIENSAAVEK

SEQ ID NO: 26879 - protein, 11 aa, Homo Sapiens
AQIENSAAVQK

SEQ ID NO: 26880 - protein, 11 aa, Homo Sapiens
AQQEHPRPYFK

SEQ ID NO: 26881 - protein, 11 aa, Homo Sapiens
AQYEQDLQHRK

SEQ ID NO: 26882 - protein, 11 aa, Homo Sapiens
AQYSPQQLAGK

SEQ ID NO: 26883 - protein, 11 aa, Homo Sapiens
ASANLGGVPSK

SEQ ID NO: 26884 - protein, 11 aa, Homo Sapiens
ASDPNVSKKLK

SEQ ID NO: 26885 - protein, 11 aa, Homo Sapiens
ASFDATTCIWK

SEQ ID NO: 26886 - protein, 11 aa, Homo Sapiens
ASFLPPSSVKK

SEQ ID NO: 26887 - protein, 11 aa, Homo Sapiens
ASFNAYENHLK

SEQ ID NO: 26888 - protein, 11 aa, Homo Sapiens
ASFTQKGNLLR

SEQ ID NO: 26889 - protein, 11 aa, Homo Sapiens
ASFVPKPGSLK

SEQ ID NO: 26890 - protein, 11 aa, Homo Sapiens
ASHRPIKGILK

SEQ ID NO: 26891 - protein, 11 aa, Homo Sapiens
ASIAGSSIINK

SEQ ID NO: 26892 - protein, 11 aa, Homo Sapiens
ASIEKGGSLPK

SEQ ID NO: 26893 - protein, 11 aa, Homo Sapiens
ASIFVKDNVTK

SEQ ID NO: 26894 - protein, 11 aa, Homo Sapiens
ASIIGVNLATK

SEQ ID NO: 26895 - protein, 11 aa, Homo Sapiens
ASILVKDYILK

SEQ ID NO: 26896 - protein, 11 aa, Homo Sapiens
ASLDISRKWEK

SEQ ID NO: 26897 - protein, 11 aa, Homo Sapiens
ASLFPDSLIVK

SEQ ID NO: 26898 - protein, 11 aa, Homo Sapiens
ASLLDVFVLTR

SEQ ID NO: 26899 - protein, 11 aa, Homo Sapiens
ASLPSESNEPK

SEQ ID NO: 26900 - protein, 11 aa, Homo Sapiens
ASLREEECVMK

SEQ ID NO: 26901 - protein, 11 aa, Homo Sapiens
ASMPDNTAAQK

SEQ ID NO: 26902 - protein, 11 aa, Homo Sapiens
ASPQLLRIIFK

SEQ ID NO: 26903 - protein, 11 aa, Homo Sapiens
ASQEIAEKALK

SEQ ID NO: 26904 - protein, 11 aa, Homo Sapiens
ASSPGGVYATR

SEQ ID NO: 26905 - protein, 11 aa, Homo Sapiens
ASYPGASVDNY

SEQ ID NO: 26906 - protein, 11 aa, Homo Sapiens
ATAAAIGATPR

SEQ ID NO: 26907 - protein, 11 aa, Homo Sapiens
ATAASSSSLEK

SEQ ID NO: 26908 - protein, 11 aa, Homo Sapiens
ATADDFLVFLR

SEQ ID NO: 26909 - protein, 11 aa, Homo Sapiens
ATAGIIGVNRK

SEQ ID NO: 26910 - protein, 11 aa, Homo Sapiens
ATAGKDDCLLK

SEQ ID NO: 26911 - protein, 11 aa, Homo Sapiens
ATALFGQPPFK

SEQ ID NO: 26912 - protein, 11 aa, Homo Sapiens
ATAPPHVTVVR

SEQ ID NO: 26913 - protein, 11 aa, Homo Sapiens
ATASAIEAMKK

SEQ ID NO: 26914 - protein, 11 aa, Homo Sapiens
ATASPFSGLQK

SEQ ID NO: 26915 - protein, 11 aa, Homo Sapiens
ATATANQIILK

SEQ ID NO: 26916 - protein, 11 aa, Homo Sapiens
ATATVAALQEK

SEQ ID NO: 26917 - protein, 11 aa, Homo Sapiens
ATCEQLTYYSK

SEQ ID NO: 26918 - protein, 11 aa, Homo Sapiens
ATCFATKNGIK

SEQ ID NO: 26919 - protein, 11 aa, Homo Sapiens
ATCLPNQTVLK

SEQ ID NO: 26920 - protein, 11 aa, Homo Sapiens
ATDDSLHQLRK

SEQ ID NO: 26921 - protein, 11 aa, Homo Sapiens
ATDELSSALAK

SEQ ID NO: 26922 - protein, 11 aa, Homo Sapiens
ATDPNILGRTW

SEQ ID NO: 26923 - protein, 11 aa, Homo Sapiens
ATETVELHKLK

SEQ ID NO: 26924 - protein, 11 aa, Homo Sapiens
ATFEQPSRQVK

SEQ ID NO: 26925 - protein, 11 aa, Homo Sapiens
ATFNEDVQALK

SEQ ID NO: 26926 - protein, 11 aa, Homo Sapiens
ATFPVAPRYAK

SEQ ID NO: 26927 - protein, 11 aa, Homo Sapiens
ATFRFPGALQH

SEQ ID NO: 26928 - protein, 11 aa, Homo Sapiens
ATGATFAHICK

SEQ ID NO: 26929 - protein, 11 aa, Homo Sapiens
ATGGAGFCINR

SEQ ID NO: 26930 - protein, 11 aa, Homo Sapiens
ATHSSRFIPLK

SEQ ID NO: 26931 - protein, 11 aa, Homo Sapiens
ATIDLNSVLER

SEQ ID NO: 26932 - protein, 11 aa, Homo Sapiens
ATIEVDQIHTH

SEQ ID NO: 26933 - protein, 11 aa, Homo Sapiens
ATIFGPNLLHK

SEQ ID NO: 26934 - protein, 11 aa, Homo Sapiens
ATIGHVEKFLR

SEQ ID NO: 26935 - protein, 11 aa, Homo Sapiens
ATIKDGKSLTK

SEQ ID NO: 26936 - protein, 11 aa, Homo Sapiens
ATILAGDIKVK

SEQ ID NO: 26937 - protein, 11 aa, Homo Sapiens
ATILAGDVKVK

SEQ ID NO: 26938 - protein, 11 aa, Homo Sapiens
ATIRVLEAIQK

SEQ ID NO: 26939 - protein, 11 aa, Homo Sapiens
ATITDKELLKK

SEQ ID NO: 26940 - protein, 11 aa, Homo Sapiens
ATITDKEMLKK

SEQ ID NO: 26941 - protein, 11 aa, Homo Sapiens
ATITERGITSR

SEQ ID NO: 26942 - protein, 11 aa, Homo Sapiens
ATKGPSYEDLY

SEQ ID NO: 26943 - protein, 11 aa, Homo Sapiens
ATLDVGGLVFK

SEQ ID NO: 26944 - protein, 11 aa, Homo Sapiens
ATLEETLVKKK

SEQ ID NO: 26945 - protein, 11 aa, Homo Sapiens
ATLGDLKLVEK

SEQ ID NO: 26946 - protein, 11 aa, Homo Sapiens
ATLIGLSIKVK

SEQ ID NO: 26947 - protein, 11 aa, Homo Sapiens
ATLKDITRRLK

SEQ ID NO: 26948 - protein, 11 aa, Homo Sapiens
ATLLASNEAFK

SEQ ID NO: 26949 - protein, 11 aa, Homo Sapiens
ATLPDLKTMEK

SEQ ID NO: 26950 - protein, 11 aa, Homo Sapiens
ATLSELKTVLK

SEQ ID NO: 26951 - protein, 11 aa, Homo Sapiens
ATLTTTSATSK

SEQ ID NO: 26952 - protein, 11 aa, Homo Sapiens
ATMGETVMSVK

SEQ ID NO: 26953 - protein, 11 aa, Homo Sapiens
ATMKPHPTVQK

SEQ ID NO: 26954 - protein, 11 aa, Homo Sapiens
ATMPASVVGQR

SEQ ID NO: 26955 - protein, 11 aa, Homo Sapiens
ATMSEVEWRGR

SEQ ID NO: 26956 - protein, 11 aa, Homo Sapiens
ATMTIEELLTR

SEQ ID NO: 26957 - protein, 11 aa, Homo Sapiens
ATMVPSVLWPR

SEQ ID NO: 26958 - protein, 11 aa, Homo Sapiens
ATNNLMKLVQK

SEQ ID NO: 26959 - protein, 11 aa, Homo Sapiens
ATPELGSSLKK

SEQ ID NO: 26960 - protein, 11 aa, Homo Sapiens
ATPGADVCFAR

SEQ ID NO: 26961 - protein, 11 aa, Homo Sapiens
ATPSPSNETPK

SEQ ID NO: 26962 - protein, 11 aa, Homo Sapiens
ATQAIFEILEK

SEQ ID NO: 26963 - protein, 11 aa, Homo Sapiens
ATQEGEWKALK

SEQ ID NO: 26964 - protein, 11 aa, Homo Sapiens
ATQGELVRSLK

SEQ ID NO: 26965 - protein, 11 aa, Homo Sapiens
ATQLAADLLKY

SEQ ID NO: 26966 - protein, 11 aa, Homo Sapiens
ATQLPESTSLR

SEQ ID NO: 26967 - protein, 11 aa, Homo Sapiens
ATQMLESMIKK

SEQ ID NO: 26968 - protein, 11 aa, Homo Sapiens
ATQPGTTILQY

SEQ ID NO: 26969 - protein, 11 aa, Homo Sapiens
ATQPWNRIQRR

SEQ ID NO: 26970 - protein, 11 aa, Homo Sapiens
ATQSAQVLLEK

SEQ ID NO: 26971 - protein, 11 aa, Homo Sapiens
ATSDAVGSSLK

SEQ ID NO: 26972 - protein, 11 aa, Homo Sapiens
ATSESIFSTCK

SEQ ID NO: 26973 - protein, 11 aa, Homo Sapiens
ATSIDRLKVFK

SEQ ID NO: 26974 - protein, 11 aa, Homo Sapiens
ATSPHLESLLK

SEQ ID NO: 26975 - protein, 11 aa, Homo Sapiens
ATSYFGKQFLR

SEQ ID NO: 26976 - protein, 11 aa, Homo Sapiens
ATTSELEAINK

SEQ ID NO: 26977 - protein, 11 aa, Homo Sapiens
ATVEETVVRDK

SEQ ID NO: 26978 - protein, 11 aa, Homo Sapiens
ATVGKATGFLK

SEQ ID NO: 26979 - protein, 11 aa, Homo Sapiens
ATVILANHVAK

SEQ ID NO: 26980 - protein, 11 aa, Homo Sapiens
ATVLKEGVLEK

SEQ ID NO: 26981 - protein, 11 aa, Homo Sapiens
ATYAPVISAEK

SEQ ID NO: 26982 - protein, 11 aa, Homo Sapiens
ATYEAGALSLK

SEQ ID NO: 26983 - protein, 11 aa, Homo Sapiens
ATYFDSEVVPR

SEQ ID NO: 26984 - protein, 11 aa, Homo Sapiens
ATYFPSFQGPK

SEQ ID NO: 26985 - protein, 11 aa, Homo Sapiens
ATYHGNKEIVK

SEQ ID NO: 26986 - protein, 11 aa, Homo Sapiens
ATYPDVNNSIK

SEQ ID NO: 26987 - protein, 11 aa, Homo Sapiens
ATYPYQVVRAR

SEQ ID NO: 26988 - protein, 11 aa, Homo Sapiens
AVADKVHLMYK

SEQ ID NO: 26989 - protein, 11 aa, Homo Sapiens
AVAEEVNAILK

SEQ ID NO: 26990 - protein, 11 aa, Homo Sapiens
AVAELKDCIEK

SEQ ID NO: 26991 - protein, 11 aa, Homo Sapiens
AVAEVRAENLK

SEQ ID NO: 26992 - protein, 11 aa, Homo Sapiens
AVAGDFALINK

SEQ ID NO: 26993 - protein, 11 aa, Homo Sapiens
AVAGQELCQPR

SEQ ID NO: 26994 - protein, 11 aa, Homo Sapiens
AVALINAAIQK

SEQ ID NO: 26995 - protein, 11 aa, Homo Sapiens
AVANAQELLQR

SEQ ID NO: 26996 - protein, 11 aa, Homo Sapiens
AVAPVASALEK

SEQ ID NO: 26997 - protein, 11 aa, Homo Sapiens
AVASEDSVLLY

SEQ ID NO: 26998 - protein, 11 aa, Homo Sapiens
AVDPRQGRARG

SEQ ID NO: 26999 - protein, 11 aa, Homo Sapiens
AVELPEASAPK

SEQ ID NO: 27000 - protein, 11 aa, Homo Sapiens
AVFDHPAKIAK

SEQ ID NO: 27001 - protein, 11 aa, Homo Sapiens
AVFILTDNISK

SEQ ID NO: 27002 - protein, 11 aa, Homo Sapiens
AVFISDIRNCK

SEQ ID NO: 27003 - protein, 11 aa, Homo Sapiens
AVFLAEMTVKV

SEQ ID NO: 27004 - protein, 11 aa, Homo Sapiens
AVFPSLLTNPK

SEQ ID NO: 27005 - protein, 11 aa, Homo Sapiens
AVGEVEDSIFK

SEQ ID NO: 27006 - protein, 11 aa, Homo Sapiens
AVHDIAEKLIK

SEQ ID NO: 27007 - protein, 11 aa, Homo Sapiens
AVHEAWAGMLK

SEQ ID NO: 27008 - protein, 11 aa, Homo Sapiens
AVHPQFKEIQK

SEQ ID NO: 27009 - protein, 11 aa, Homo Sapiens
AVHRITPEEAK

SEQ ID NO: 27010 - protein, 11 aa, Homo Sapiens
AVIGADSVTLK

SEQ ID NO: 27011 - protein, 11 aa, Homo Sapiens
AVINAYTEINK

SEQ ID NO: 27012 - protein, 11 aa, Homo Sapiens
AVIPEKQLVEK

SEQ ID NO: 27013 - protein, 11 aa, Homo Sapiens
AVISQCIYRHR

SEQ ID NO: 27014 - protein, 11 aa, Homo Sapiens
AVLEKQDISDK

SEQ ID NO: 27015 - protein, 11 aa, Homo Sapiens
AVLGLGHVRYK

SEQ ID NO: 27016 - protein, 11 aa, Homo Sapiens
AVLKPRRVCVG

SEQ ID NO: 27017 - protein, 11 aa, Homo Sapiens
AVLSKGEIVVK

SEQ ID NO: 27018 - protein, 11 aa, Homo Sapiens
AVLSKSELLTK

SEQ ID NO: 27019 - protein, 11 aa, Homo Sapiens
AVLSSGLTAAR

SEQ ID NO: 27020 - protein, 11 aa, Homo Sapiens
AVLTALDVLQK

SEQ ID NO: 27021 - protein, 11 aa, Homo Sapiens
AVLTHSGFPAK

SEQ ID NO: 27022 - protein, 11 aa, Homo Sapiens
AVMAESAFSFK

SEQ ID NO: 27023 - protein, 11 aa, Homo Sapiens
AVMDGNVITAK

SEQ ID NO: 27024 - protein, 11 aa, Homo Sapiens
AVMDNKNPTIK

SEQ ID NO: 27025 - protein, 11 aa, Homo Sapiens
AVMKDVVLIRK

SEQ ID NO: 27026 - protein, 11 aa, Homo Sapiens
AVPEIMDRIYK

SEQ ID NO: 27027 - protein, 11 aa, Homo Sapiens
AVPEKQDIMKK

SEQ ID NO: 27028 - protein, 11 aa, Homo Sapiens
AVQGISGLPLK

SEQ ID NO: 27029 - protein, 11 aa, Homo Sapiens
AVQLLQFLAPK

SEQ ID NO: 27030 - protein, 11 aa, Homo Sapiens
AVQTAAKELLK

SEQ ID NO: 27031 - protein, 11 aa, Homo Sapiens
AVQVVADVLSK

SEQ ID NO: 27032 - protein, 11 aa, Homo Sapiens
AVSEGTKAVTK

SEQ ID NO: 27033 - protein, 11 aa, Homo Sapiens
AVSKDIANWQK

SEQ ID NO: 27034 - protein, 11 aa, Homo Sapiens
AVSSYISYQQK

SEQ ID NO: 27035 - protein, 11 aa, Homo Sapiens
AVTEAEIQQLK

SEQ ID NO: 27036 - protein, 11 aa, Homo Sapiens
AVVDVRIGMTR

SEQ ID NO: 27037 - protein, 11 aa, Homo Sapiens
AVVGGLDIHKK

SEQ ID NO: 27038 - protein, 11 aa, Homo Sapiens
AVVQVALDKAR

SEQ ID NO: 27039 - protein, 11 aa, Homo Sapiens
AVVVPSGEEQR

SEQ ID NO: 27040 - protein, 11 aa, Homo Sapiens
AVYADSGNFKR

SEQ ID NO: 27041 - protein, 11 aa, Homo Sapiens
AVYDRPGASPK

SEQ ID NO: 27042 - protein, 11 aa, Homo Sapiens
AVYEGHVSCVK

SEQ ID NO: 27043 - protein, 11 aa, Homo Sapiens
AVYELERILNR

SEQ ID NO: 27044 - protein, 11 aa, Homo Sapiens
AVYGMLNLTPK

SEQ ID NO: 27045 - protein, 11 aa, Homo Sapiens
AVYGQKEIHRK

SEQ ID NO: 27046 - protein, 11 aa, Homo Sapiens
AVYGQNDIHHK

SEQ ID NO: 27047 - protein, 11 aa, Homo Sapiens
AVYLSTCKDSK

SEQ ID NO: 27048 - protein, 11 aa, Homo Sapiens
DGWLHTGDIGK

SEQ ID NO: 27049 - protein, 11 aa, Homo Sapiens
ETFAPILYVFK

SEQ ID NO: 27050 - protein, 11 aa, Homo Sapiens
FDVKSGSAVHK

SEQ ID NO: 27051 - protein, 11 aa, Homo Sapiens
FLYSFCQQSRR

SEQ ID NO: 27052 - protein, 11 aa, Homo Sapiens
FSYSFSYKHLK

SEQ ID NO: 27053 - protein, 11 aa, Homo Sapiens
FVAVTSTNAAK

SEQ ID NO: 27054 - protein, 11 aa, Homo Sapiens
GAYSQSPAIKK

SEQ ID NO: 27055 - protein, 11 aa, Homo Sapiens
GHQQLYWSHPR

SEQ ID NO: 27056 - protein, 11 aa, Homo Sapiens
GLLKVHYSDRL

SEQ ID NO: 27057 - protein, 11 aa, Homo Sapiens
GQNPTNAEVLK

SEQ ID NO: 27058 - protein, 11 aa, Homo Sapiens
GSFASIFWLKK

SEQ ID NO: 27059 - protein, 11 aa, Homo Sapiens
GSFEVVSTLIK

SEQ ID NO: 27060 - protein, 11 aa, Homo Sapiens
GSLPGDKIRNK

SEQ ID NO: 27061 - protein, 11 aa, Homo Sapiens
GSLPGGSVISR

SEQ ID NO: 27062 - protein, 11 aa, Homo Sapiens
GSQGVRDFIEK

SEQ ID NO: 27063 - protein, 11 aa, Homo Sapiens
GSSPEQVVRPK

SEQ ID NO: 27064 - protein, 11 aa, Homo Sapiens
GSSSDTYLFKK

SEQ ID NO: 27065 - protein, 11 aa, Homo Sapiens
GSVPNGQTPLK

SEQ ID NO: 27066 - protein, 11 aa, Homo Sapiens
GSYIELPAYLK

SEQ ID NO: 27067 - protein, 11 aa, Homo Sapiens
GTAAIGYLAYK

SEQ ID NO: 27068 - protein, 11 aa, Homo Sapiens
GTAPSKPPLTK

SEQ ID NO: 27069 - protein, 11 aa, Homo Sapiens
GTASVLQPVKK

SEQ ID NO: 27070 - protein, 11 aa, Homo Sapiens
GTAYCTALYLR

SEQ ID NO: 27071 - protein, 11 aa, Homo Sapiens
GTCHNLPGLFR

SEQ ID NO: 27072 - protein, 11 aa, Homo Sapiens
GTEFGGSIYQK

SEQ ID NO: 27073 - protein, 11 aa, Homo Sapiens
GTFASVEQFWR

SEQ ID NO: 27074 - protein, 11 aa, Homo Sapiens
GTFGGLGSKSK

SEQ ID NO: 27075 - protein, 11 aa, Homo Sapiens
GTFIWNKALEK

SEQ ID NO: 27076 - protein, 11 aa, Homo Sapiens
GTFSTVTSTVK

SEQ ID NO: 27077 - protein, 11 aa, Homo Sapiens
GTFVSPEVFLK

SEQ ID NO: 27078 - protein, 11 aa, Homo Sapiens
GTIEKSKLITK

SEQ ID NO: 27079 - protein, 11 aa, Homo Sapiens
GTIFAELATKK

SEQ ID NO: 27080 - protein, 11 aa, Homo Sapiens
GTIFIIKGVRK

SEQ ID NO: 27081 - protein, 11 aa, Homo Sapiens
GTIIVSGSTEK

SEQ ID NO: 27082 - protein, 11 aa, Homo Sapiens
GTIRSRSFIFK

SEQ ID NO: 27083 - protein, 11 aa, Homo Sapiens
GTISLWSIISK

SEQ ID NO: 27084 - protein, 11 aa, Homo Sapiens
GTLGFGDKFKR

SEQ ID NO: 27085 - protein, 11 aa, Homo Sapiens
GTLREYKVVGR

SEQ ID NO: 27086 - protein, 11 aa, Homo Sapiens
GTLSPLDIYPK

SEQ ID NO: 27087 - protein, 11 aa, Homo Sapiens
GTLTVEAPMPK

SEQ ID NO: 27088 - protein, 11 aa, Homo Sapiens
GTMNLGGSLTR

SEQ ID NO: 27089 - protein, 11 aa, Homo Sapiens
GTPGPSITGVP

SEQ ID NO: 27090 - protein, 11 aa, Homo Sapiens
GTQAIAHIHNK

SEQ ID NO: 27091 - protein, 11 aa, Homo Sapiens
GTQTDLFTCGK

SEQ ID NO: 27092 - protein, 11 aa, Homo Sapiens
GTSDRFSRILK

SEQ ID NO: 27093 - protein, 11 aa, Homo Sapiens
GTSPTAETILK

SEQ ID NO: 27094 - protein, 11 aa, Homo Sapiens
GTSSAASSPLK

SEQ ID NO: 27095 - protein, 11 aa, Homo Sapiens
GTVAGAAVLLK

SEQ ID NO: 27096 - protein, 11 aa, Homo Sapiens
GTVDVTPFIKK

SEQ ID NO: 27097 - protein, 11 aa, Homo Sapiens
GTYGLDSVKKK

SEQ ID NO: 27098 - protein, 11 aa, Homo Sapiens
GVAGAVAVFPK

SEQ ID NO: 27099 - protein, 11 aa, Homo Sapiens
GVDSSIFQNPK

SEQ ID NO: 27100 - protein, 11 aa, Homo Sapiens
GVFEGKLNVIK

SEQ ID NO: 27101 - protein, 11 aa, Homo Sapiens
GVFTPGAAFSK

SEQ ID NO: 27102 - protein, 11 aa, Homo Sapiens
GVFWTGSGFAK

SEQ ID NO: 27103 - protein, 11 aa, Homo Sapiens
GVIGLLEPMKK

SEQ ID NO: 27104 - protein, 11 aa, Homo Sapiens
GVIGQDGLLFK

SEQ ID NO: 27105 - protein, 11 aa, Homo Sapiens
GVIPESVILLK

SEQ ID NO: 27106 - protein, 11 aa, Homo Sapiens
GVLGSSKVLAK

SEQ ID NO: 27107 - protein, 11 aa, Homo Sapiens
GVLQLGNIVFK

SEQ ID NO: 27108 - protein, 11 aa, Homo Sapiens
GVQEPGVFISK

SEQ ID NO: 27109 - protein, 11 aa, Homo Sapiens
GVQGFQEFLEK

SEQ ID NO: 27110 - protein, 11 aa, Homo Sapiens
GVRGMDGPQGP

SEQ ID NO: 27111 - protein, 11 aa, Homo Sapiens
HLDIEAFTMDR

SEQ ID NO: 27112 - protein, 11 aa, Homo Sapiens
HLGLPVFNTVK

SEQ ID NO: 27113 - protein, 11 aa, Homo Sapiens
HSIDGRVVEPK

SEQ ID NO: 27114 - protein, 11 aa, Homo Sapiens
HSMDTLLATLK

SEQ ID NO: 27115 - protein, 11 aa, Homo Sapiens
HTLDSYRILQK

SEQ ID NO: 27116 - protein, 11 aa, Homo Sapiens
HTMNVPSLFSK

SEQ ID NO: 27117 - protein, 11 aa, Homo Sapiens
HVLEAQDLIAK

SEQ ID NO: 27118 - protein, 11 aa, Homo Sapiens
HVLEDIAKFFK

SEQ ID NO: 27119 - protein, 11 aa, Homo Sapiens
IGIPSEIISPK

SEQ ID NO: 27120 - protein, 11 aa, Homo Sapiens
IIAEILSVYQK

SEQ ID NO: 27121 - protein, 11 aa, Homo Sapiens
IILEPDKNPKK

SEQ ID NO: 27122 - protein, 11 aa, Homo Sapiens
IIYDPKLQTPK

SEQ ID NO: 27123 - protein, 11 aa, Homo Sapiens
IQEDPDELLFK

SEQ ID NO: 27124 - protein, 11 aa, Homo Sapiens
ISDPTSPLRTR

SEQ ID NO: 27125 - protein, 11 aa, Homo Sapiens
ITDPHSPSRFR

SEQ ID NO: 27126 - protein, 11 aa, Homo Sapiens
KASSEMALYQK

SEQ ID NO: 27127 - protein, 11 aa, Homo Sapiens
KGVPGKEGVPG

SEQ ID NO: 27128 - protein, 11 aa, Homo Sapiens
KILERDQQICK

SEQ ID NO: 27129 - protein, 11 aa, Homo Sapiens
KIPDLKLLVEK

SEQ ID NO: 27130 - protein, 11 aa, Homo Sapiens
KLFPGSPAIYK

SEQ ID NO: 27131 - protein, 11 aa, Homo Sapiens
KLISEEDLLRK

SEQ ID NO: 27132 - protein, 11 aa, Homo Sapiens
KQQAHDLLINK

SEQ ID NO: 27133 - protein, 11 aa, Homo Sapiens
KSFEDRVGTIK

SEQ ID NO: 27134 - protein, 11 aa, Homo Sapiens
KSLGHGLINKK

SEQ ID NO: 27135 - protein, 11 aa, Homo Sapiens
KSLPAEINRMK

SEQ ID NO: 27136 - protein, 11 aa, Homo Sapiens
KTAEDAKDFFK

SEQ ID NO: 27137 - protein, 11 aa, Homo Sapiens
KTFANRVNNLK

SEQ ID NO: 27138 - protein, 11 aa, Homo Sapiens
KTFGETHPFTK

SEQ ID NO: 27139 - protein, 11 aa, Homo Sapiens
KTFTIKRFLAK

SEQ ID NO: 27140 - protein, 11 aa, Homo Sapiens
KTIDMELVKRK

SEQ ID NO: 27141 - protein, 11 aa, Homo Sapiens
KTLAYRGFIFK

SEQ ID NO: 27142 - protein, 11 aa, Homo Sapiens
KTLDEILQEKK

SEQ ID NO: 27143 - protein, 11 aa, Homo Sapiens
KTLDQAKAVLK

SEQ ID NO: 27144 - protein, 11 aa, Homo Sapiens
KTLPADVQNYY

SEQ ID NO: 27145 - protein, 11 aa, Homo Sapiens
KTLPAMLGTGK

SEQ ID NO: 27146 - protein, 11 aa, Homo Sapiens
KTLVAELLILK

SEQ ID NO: 27147 - protein, 11 aa, Homo Sapiens
KTMDVSKVKLK

SEQ ID NO: 27148 - protein, 11 aa, Homo Sapiens
KTMEDTLMTVK

SEQ ID NO: 27149 - protein, 11 aa, Homo Sapiens
KTQEPDNLLFY

SEQ ID NO: 27150 - protein, 11 aa, Homo Sapiens
KTQEPFSVRNK

SEQ ID NO: 27151 - protein, 11 aa, Homo Sapiens
KTSGSNVKIVK

SEQ ID NO: 27152 - protein, 11 aa, Homo Sapiens
KTSTVPPSLRK

SEQ ID NO: 27153 - protein, 11 aa, Homo Sapiens
KTVAGGAWTYK

SEQ ID NO: 27154 - protein, 11 aa, Homo Sapiens
KTYGCVPVANK

SEQ ID NO: 27155 - protein, 11 aa, Homo Sapiens
KTYGVSFFLVK

SEQ ID NO: 27156 - protein, 11 aa, Homo Sapiens
KTYHALSNLPK

SEQ ID NO: 27157 - protein, 11 aa, Homo Sapiens
KTYIPPKGETK

SEQ ID NO: 27158 - protein, 11 aa, Homo Sapiens
KVFDPSCGLPY

SEQ ID NO: 27159 - protein, 11 aa, Homo Sapiens
KVFGNEIKLEK

SEQ ID NO: 27160 - protein, 11 aa, Homo Sapiens
KVFHAERIVRK

SEQ ID NO: 27161 - protein, 11 aa, Homo Sapiens
KVFPEDMAKYR

SEQ ID NO: 27162 - protein, 11 aa, Homo Sapiens
KVFVKSSDLLK

SEQ ID NO: 27163 - protein, 11 aa, Homo Sapiens
KVIDGERVIGR

SEQ ID NO: 27164 - protein, 11 aa, Homo Sapiens
KVITSSSSFAK

SEQ ID NO: 27165 - protein, 11 aa, Homo Sapiens
KVLGQGKWNLK

SEQ ID NO: 27166 - protein, 11 aa, Homo Sapiens
KVLPGDHEYPK

SEQ ID NO: 27167 - protein, 11 aa, Homo Sapiens
KVLPSHLITYK

SEQ ID NO: 27168 - protein, 11 aa, Homo Sapiens
KVNPIQGLASK

SEQ ID NO: 27169 - protein, 11 aa, Homo Sapiens
KVQDVKKTIQK

SEQ ID NO: 27170 - protein, 11 aa, Homo Sapiens
KVSSINSRFAK

SEQ ID NO: 27171 - protein, 11 aa, Homo Sapiens
KVVPEMTEILK

SEQ ID NO: 27172 - protein, 11 aa, Homo Sapiens
KVYEGERPLTK

SEQ ID NO: 27173 - protein, 11 aa, Homo Sapiens
LEVDPNIQAVR

SEQ ID NO: 27174 - protein, 11 aa, Homo Sapiens
LGVDFIDVATK

SEQ ID NO: 27175 - protein, 11 aa, Homo Sapiens
LIIFADCDLNK

SEQ ID NO: 27176 - protein, 11 aa, Homo Sapiens
LISGSLDNIVK

SEQ ID NO: 27177 - protein, 11 aa, Homo Sapiens
LLGASVVPFMK

SEQ ID NO: 27178 - protein, 11 aa, Homo Sapiens
LTGLTVAEYFR

SEQ ID NO: 27179 - protein, 11 aa, Homo Sapiens
LTIQSGEQPYK

SEQ ID NO: 27180 - protein, 11 aa, Homo Sapiens
LVIDNGSGMCK

SEQ ID NO: 27181 - protein, 11 aa, Homo Sapiens
LVMGTDAKMHK

SEQ ID NO: 27182 - protein, 11 aa, Homo Sapiens
LVVDNGSGMCK

SEQ ID NO: 27183 - protein, 11 aa, Homo Sapiens
MPSSPSVLRWP

SEQ ID NO: 27184 - protein, 11 aa, Homo Sapiens
MQIAWSREFLK

SEQ ID NO: 27185 - protein, 11 aa, Homo Sapiens
MTMDKSELVQK

SEQ ID NO: 27186 - protein, 11 aa, Homo Sapiens
NSFDPSKITRK

SEQ ID NO: 27187 - protein, 11 aa, Homo Sapiens
PMFIVNTNVPR

SEQ ID NO: 27188 - protein, 11 aa, Homo Sapiens
PRGSPPPPHAD

SEQ ID NO: 27189 - protein, 11 aa, Homo Sapiens
QIVSVAARMLK

SEQ ID NO: 27190 - protein, 11 aa, Homo Sapiens
QLATPNEIFLK

SEQ ID NO: 27191 - protein, 11 aa, Homo Sapiens
QLFRGDTVLLK

SEQ ID NO: 27192 - protein, 11 aa, Homo Sapiens
QTFPSVSAPSK

SEQ ID NO: 27193 - protein, 11 aa, Homo Sapiens
QTLSLKQLFRK

SEQ ID NO: 27194 - protein, 11 aa, Homo Sapiens
QTMAYNITPLR

SEQ ID NO: 27195 - protein, 11 aa, Homo Sapiens
QTQPATPSLWK

SEQ ID NO: 27196 - protein, 11 aa, Homo Sapiens
QVADSTFTVLK

SEQ ID NO: 27197 - protein, 11 aa, Homo Sapiens
QVLNADAIVVK

SEQ ID NO: 27198 - protein, 11 aa, Homo Sapiens
QVLSAATIVAK

SEQ ID NO: 27199 - protein, 11 aa, Homo Sapiens
QVQPVDGATRK

SEQ ID NO: 27200 - protein, 11 aa, Homo Sapiens
RALDVNVALRK

SEQ ID NO: 27201 - protein, 11 aa, Homo Sapiens
RALPKSYQQPK

SEQ ID NO: 27202 - protein, 11 aa, Homo Sapiens
RGLGVAHLARA

SEQ ID NO: 27203 - protein, 11 aa, Homo Sapiens
RIDPFVRTFLK

SEQ ID NO: 27204 - protein, 11 aa, Homo Sapiens
RIFANTESYLK

SEQ ID NO: 27205 - protein, 11 aa, Homo Sapiens
RIFAPNHVVAK

SEQ ID NO: 27206 - protein, 11 aa, Homo Sapiens
RIFGQANTTLK

SEQ ID NO: 27207 - protein, 11 aa, Homo Sapiens
RIGAEVYHNLK

SEQ ID NO: 27208 - protein, 11 aa, Homo Sapiens
RILEMNDKYVK

SEQ ID NO: 27209 - protein, 11 aa, Homo Sapiens
RIMDPDVITGY

SEQ ID NO: 27210 - protein, 11 aa, Homo Sapiens
RIMLAEILTTK

SEQ ID NO: 27211 - protein, 11 aa, Homo Sapiens
RINEILSNALK

SEQ ID NO: 27212 - protein, 11 aa, Homo Sapiens
RIQEAGTEVVK

SEQ ID NO: 27213 - protein, 11 aa, Homo Sapiens
RIQELEDLLAK

SEQ ID NO: 27214 - protein, 11 aa, Homo Sapiens
RIVLPEDLQLK

SEQ ID NO: 27215 - protein, 11 aa, Homo Sapiens
RLADKSVLVCK

SEQ ID NO: 27216 - protein, 11 aa, Homo Sapiens
RLINTQAIFAK

SEQ ID NO: 27217 - protein, 11 aa, Homo Sapiens
RLLPGNATISK

SEQ ID NO: 27218 - protein, 11 aa, Homo Sapiens
RLPATGTFKAK

SEQ ID NO: 27219 - protein, 11 aa, Homo Sapiens
RLVPREIIVEK

SEQ ID NO: 27220 - protein, 11 aa, Homo Sapiens
RMFAPTKTWRR

SEQ ID NO: 27221 - protein, 11 aa, Homo Sapiens
RQLEEKDRVLK

SEQ ID NO: 27222 - protein, 11 aa, Homo Sapiens
RQLPQCALREK

SEQ ID NO: 27223 - protein, 11 aa, Homo Sapiens
RSFPWQSLEAK

SEQ ID NO: 27224 - protein, 11 aa, Homo Sapiens
RSIQVDGKTIK

SEQ ID NO: 27225 - protein, 11 aa, Homo Sapiens
RSMEAHNILSK

SEQ ID NO: 27226 - protein, 11 aa, Homo Sapiens
RSQEYKIVLRK

SEQ ID NO: 27227 - protein, 11 aa, Homo Sapiens
RSQPSKTLFVK

SEQ ID NO: 27228 - protein, 11 aa, Homo Sapiens
RSYSESEKQWK

SEQ ID NO: 27229 - protein, 11 aa, Homo Sapiens
RTFGNDARFIR

SEQ ID NO: 27230 - protein, 11 aa, Homo Sapiens
RTFQPPATGHK

SEQ ID NO: 27231 - protein, 11 aa, Homo Sapiens
RTFSWASVTSK

SEQ ID NO: 27232 - protein, 11 aa, Homo Sapiens
RTIRYPDPLIK

SEQ ID NO: 27233 - protein, 11 aa, Homo Sapiens
RTISGNVYILK

SEQ ID NO: 27234 - protein, 11 aa, Homo Sapiens
RTIVSIGDPKK

SEQ ID NO: 27235 - protein, 11 aa, Homo Sapiens
RTLGSDSVILK

SEQ ID NO: 27236 - protein, 11 aa, Homo Sapiens
RTLKPEGNILR

SEQ ID NO: 27237 - protein, 11 aa, Homo Sapiens
RTLMPEKLSHK

SEQ ID NO: 27238 - protein, 11 aa, Homo Sapiens
RTLTGQDTMLK

SEQ ID NO: 27239 - protein, 11 aa, Homo Sapiens
RTLTPISGGQR

SEQ ID NO: 27240 - protein, 11 aa, Homo Sapiens
RTMPLLSLHSR

SEQ ID NO: 27241 - protein, 11 aa, Homo Sapiens
RTMSCSDKILR

SEQ ID NO: 27242 - protein, 11 aa, Homo Sapiens
RTMWFAGGFHR

SEQ ID NO: 27243 - protein, 11 aa, Homo Sapiens
RTQMPDPKTFK

SEQ ID NO: 27244 - protein, 11 aa, Homo Sapiens
RTSGSVYITLK

SEQ ID NO: 27245 - protein, 11 aa, Homo Sapiens
RTVLKNLSLLK

SEQ ID NO: 27246 - protein, 11 aa, Homo Sapiens
RTYTEEELNAK

SEQ ID NO: 27247 - protein, 11 aa, Homo Sapiens
RVAAILQGVYK

SEQ ID NO: 27248 - protein, 11 aa, Homo Sapiens
RVADRLYGVYK

SEQ ID NO: 27249 - protein, 11 aa, Homo Sapiens
RVAPAHGLFLK

SEQ ID NO: 27250 - protein, 11 aa, Homo Sapiens
RVAQKKASFLR

SEQ ID NO: 27251 - protein, 11 aa, Homo Sapiens
RVEEGWLSLAK

SEQ ID NO: 27252 - protein, 11 aa, Homo Sapiens
RVFAAESIIKR

SEQ ID NO: 27253 - protein, 11 aa, Homo Sapiens
RVFNETPINPR

SEQ ID NO: 27254 - protein, 11 aa, Homo Sapiens
RVFPMPLPRKA

SEQ ID NO: 27255 - protein, 11 aa, Homo Sapiens
RVFPVRPGSGR

SEQ ID NO: 27256 - protein, 11 aa, Homo Sapiens
RVFQETQKLKK

SEQ ID NO: 27257 - protein, 11 aa, Homo Sapiens
RVFTTVGSAEK

SEQ ID NO: 27258 - protein, 11 aa, Homo Sapiens
RVIDHSQYLCR

SEQ ID NO: 27259 - protein, 11 aa, Homo Sapiens
RVIEDNEYTAR

SEQ ID NO: 27260 - protein, 11 aa, Homo Sapiens
RVINEEYKIWK

SEQ ID NO: 27261 - protein, 11 aa, Homo Sapiens
RVIPRITIEMK

SEQ ID NO: 27262 - protein, 11 aa, Homo Sapiens
RVIQASEKLFK

SEQ ID NO: 27263 - protein, 11 aa, Homo Sapiens
RVISEGMLWKK

SEQ ID NO: 27264 - protein, 11 aa, Homo Sapiens
RVITEEEKNFK

SEQ ID NO: 27265 - protein, 11 aa, Homo Sapiens
RVIVNHRIYYK

SEQ ID NO: 27266 - protein, 11 aa, Homo Sapiens
RVLDALVAREK

SEQ ID NO: 27267 - protein, 11 aa, Homo Sapiens
RVLDTNDRFLR

SEQ ID NO: 27268 - protein, 11 aa, Homo Sapiens
RVLKKQDAFYK

SEQ ID NO: 27269 - protein, 11 aa, Homo Sapiens
RVNETTEFLSK

SEQ ID NO: 27270 - protein, 11 aa, Homo Sapiens
RVPVYAHITHK

SEQ ID NO: 27271 - protein, 11 aa, Homo Sapiens
RVPWVKMILNK

SEQ ID NO: 27272 - protein, 11 aa, Homo Sapiens
RVQEAVESMVK

SEQ ID NO: 27273 - protein, 11 aa, Homo Sapiens
RVQPGLLQWVK

SEQ ID NO: 27274 - protein, 11 aa, Homo Sapiens
RVQPNEAVYTK

SEQ ID NO: 27275 - protein, 11 aa, Homo Sapiens
RVSTEVTLAVK

SEQ ID NO: 27276 - protein, 11 aa, Homo Sapiens
RVVDGKDLTTK

SEQ ID NO: 27277 - protein, 11 aa, Homo Sapiens
RVWDVRPFAPK

SEQ ID NO: 27278 - protein, 11 aa, Homo Sapiens
RVYAENAIRKK

SEQ ID NO: 27279 - protein, 11 aa, Homo Sapiens
RVYDPASPQRR

SEQ ID NO: 27280 - protein, 11 aa, Homo Sapiens
RVYSHLKSVLK

SEQ ID NO: 27281 - protein, 11 aa, Homo Sapiens
RVYSPPEWISR

SEQ ID NO: 27282 - protein, 11 aa, Homo Sapiens
RVYWSTTDARK

SEQ ID NO: 27283 - protein, 11 aa, Homo Sapiens
RVYYVSEKIMK

SEQ ID NO: 27284 - protein, 11 aa, Homo Sapiens
SAAAATAELLK

SEQ ID NO: 27285 - protein, 11 aa, Homo Sapiens
SAEPAAVIVEK

SEQ ID NO: 27286 - protein, 11 aa, Homo Sapiens
SAFKADPKISK

SEQ ID NO: 27287 - protein, 11 aa, Homo Sapiens
SAFPESDNLFK

SEQ ID NO: 27288 - protein, 11 aa, Homo Sapiens
SAIDSVNATSK

SEQ ID NO: 27289 - protein, 11 aa, Homo Sapiens
SAINDKSIVKK

SEQ ID NO: 27290 - protein, 11 aa, Homo Sapiens
SALEGFKVMCK

SEQ ID NO: 27291 - protein, 11 aa, Homo Sapiens
SALTDKAIVKK

SEQ ID NO: 27292 - protein, 11 aa, Homo Sapiens
SALTNKAIVKK

SEQ ID NO: 27293 - protein, 11 aa, Homo Sapiens
SAQELKSLFEK

SEQ ID NO: 27294 - protein, 11 aa, Homo Sapiens
SAYYPSSFPKK

SEQ ID NO: 27295 - protein, 11 aa, Homo Sapiens
SGGPVSLDFVK

SEQ ID NO: 27296 - protein, 11 aa, Homo Sapiens
SIASSASMPYK

SEQ ID NO: 27297 - protein, 11 aa, Homo Sapiens
SICENARRYAK

SEQ ID NO: 27298 - protein, 11 aa, Homo Sapiens
SICFTLGSFAK

SEQ ID NO: 27299 - protein, 11 aa, Homo Sapiens
SIFAGQNDPLK

SEQ ID NO: 27300 - protein, 11 aa, Homo Sapiens
SIFDDFAHYEK

SEQ ID NO: 27301 - protein, 11 aa, Homo Sapiens
SIFDDFSHYEK

SEQ ID NO: 27302 - protein, 11 aa, Homo Sapiens
SIFEPAKGGEK

SEQ ID NO: 27303 - protein, 11 aa, Homo Sapiens
SIFIGGSFILK

SEQ ID NO: 27304 - protein, 11 aa, Homo Sapiens
SIFSGTEKGSK

SEQ ID NO: 27305 - protein, 11 aa, Homo Sapiens
SIHDARSWVPK

SEQ ID NO: 27306 - protein, 11 aa, Homo Sapiens
SIIGKGGQRIK

SEQ ID NO: 27307 - protein, 11 aa, Homo Sapiens
SIIGKKGESVK

SEQ ID NO: 27308 - protein, 11 aa, Homo Sapiens
SIINISSIVGK

SEQ ID NO: 27309 - protein, 11 aa, Homo Sapiens
SIIPRGSLSLK

SEQ ID NO: 27310 - protein, 11 aa, Homo Sapiens
SILASLDTFKK

SEQ ID NO: 27311 - protein, 11 aa, Homo Sapiens
SILEDYANYKK

SEQ ID NO: 27312 - protein, 11 aa, Homo Sapiens
SILGEAEYIQR

SEQ ID NO: 27313 - protein, 11 aa, Homo Sapiens
SILGKGSMRDK

SEQ ID NO: 27314 - protein, 11 aa, Homo Sapiens
SILKTPLPKKI

SEQ ID NO: 27315 - protein, 11 aa, Homo Sapiens
SIMKCDVDIRK

SEQ ID NO: 27316 - protein, 11 aa, Homo Sapiens
SIPEPIDPLFK

SEQ ID NO: 27317 - protein, 11 aa, Homo Sapiens
SIQEPSFRMEK

SEQ ID NO: 27318 - protein, 11 aa, Homo Sapiens
SIQEYWKCVKK

SEQ ID NO: 27319 - protein, 11 aa, Homo Sapiens
SIQGVSTVTVK

SEQ ID NO: 27320 - protein, 11 aa, Homo Sapiens
SISDVGFGMLK

SEQ ID NO: 27321 - protein, 11 aa, Homo Sapiens
SIVDVEGVVRK

SEQ ID NO: 27322 - protein, 11 aa, Homo Sapiens
SIYHTTRLLEK

SEQ ID NO: 27323 - protein, 11 aa, Homo Sapiens
SIYPSSAEVLK

SEQ ID NO: 27324 - protein, 11 aa, Homo Sapiens
SIYRPSKNLDK

SEQ ID NO: 27325 - protein, 11 aa, Homo Sapiens
SLAERSSLLQK

SEQ ID NO: 27326 - protein, 11 aa, Homo Sapiens
SLLTPILGIQK

SEQ ID NO: 27327 - protein, 11 aa, Homo Sapiens
SLYSVPEGQSK

SEQ ID NO: 27328 - protein, 11 aa, Homo Sapiens
SMMDVDHQIAK

SEQ ID NO: 27329 - protein, 11 aa, Homo Sapiens
SQFLAPKAMKK

SEQ ID NO: 27330 - protein, 11 aa, Homo Sapiens
SQLPAEKLPPK

SEQ ID NO: 27331 - protein, 11 aa, Homo Sapiens
SQMIGKKLFTK

SEQ ID NO: 27332 - protein, 11 aa, Homo Sapiens
SSADAILGNPK

SEQ ID NO: 27333 - protein, 11 aa, Homo Sapiens
SSASANDVRKK

SEQ ID NO: 27334 - protein, 11 aa, Homo Sapiens
SSATLNSIVAK

SEQ ID NO: 27335 - protein, 11 aa, Homo Sapiens
SSINEARINAK

SEQ ID NO: 27336 - protein, 11 aa, Homo Sapiens
SSLPKKLALLK

SEQ ID NO: 27337 - protein, 11 aa, Homo Sapiens
SSLPTVGVFAK

SEQ ID NO: 27338 - protein, 11 aa, Homo Sapiens
SSLSAEAIRQR

SEQ ID NO: 27339 - protein, 11 aa, Homo Sapiens
SSLSGEELVTK

SEQ ID NO: 27340 - protein, 11 aa, Homo Sapiens
SSLSGPRLLFK

SEQ ID NO: 27341 - protein, 11 aa, Homo Sapiens
SSMTEEEQIAY

SEQ ID NO: 27342 - protein, 11 aa, Homo Sapiens
SSMVGVNLPQK

SEQ ID NO: 27343 - protein, 11 aa, Homo Sapiens
SSTPATGVFLK

SEQ ID NO: 27344 - protein, 11 aa, Homo Sapiens
STAKPPKEILK

SEQ ID NO: 27345 - protein, 11 aa, Homo Sapiens
STASEDQIVSK

SEQ ID NO: 27346 - protein, 11 aa, Homo Sapiens
STAVVVAELLK

SEQ ID NO: 27347 - protein, 11 aa, Homo Sapiens
STDSSIPWFLR

SEQ ID NO: 27348 - protein, 11 aa, Homo Sapiens
STFEQCQEWLK

SEQ ID NO: 27349 - protein, 11 aa, Homo Sapiens
STFEVNSINPK

SEQ ID NO: 27350 - protein, 11 aa, Homo Sapiens
STFKLKSEVNK

SEQ ID NO: 27351 - protein, 11 aa, Homo Sapiens
STFPGAEHCLR

SEQ ID NO: 27352 - protein, 11 aa, Homo Sapiens
STFQPANKLNK

SEQ ID NO: 27353 - protein, 11 aa, Homo Sapiens
STFQYDRFFEK

SEQ ID NO: 27354 - protein, 11 aa, Homo Sapiens
STFRVDTAVIK

SEQ ID NO: 27355 - protein, 11 aa, Homo Sapiens
STFSTLVTVLK

SEQ ID NO: 27356 - protein, 11 aa, Homo Sapiens
STIAILNSVKK

SEQ ID NO: 27357 - protein, 11 aa, Homo Sapiens
STIDWNKLYRR

SEQ ID NO: 27358 - protein, 11 aa, Homo Sapiens
STIMLDNIVRK

SEQ ID NO: 27359 - protein, 11 aa, Homo Sapiens
STINSIKKVLK

SEQ ID NO: 27360 - protein, 11 aa, Homo Sapiens
STIPPELVKQK

SEQ ID NO: 27361 - protein, 11 aa, Homo Sapiens
STIVNRGITPK

SEQ ID NO: 27362 - protein, 11 aa, Homo Sapiens
STLPALTALQK

SEQ ID NO: 27363 - protein, 11 aa, Homo Sapiens
STLPGQSLIDK

SEQ ID NO: 27364 - protein, 11 aa, Homo Sapiens
STLQVGSLNVK

SEQ ID NO: 27365 - protein, 11 aa, Homo Sapiens
STLTASEIRQR

SEQ ID NO: 27366 - protein, 11 aa, Homo Sapiens
STMELDEALRK

SEQ ID NO: 27367 - protein, 11 aa, Homo Sapiens
STMPHTSGMNR

SEQ ID NO: 27368 - protein, 11 aa, Homo Sapiens
STMVDVRVMKK

SEQ ID NO: 27369 - protein, 11 aa, Homo Sapiens
STMYPGLPSRL

SEQ ID NO: 27370 - protein, 11 aa, Homo Sapiens
STQDTGKLPVK

SEQ ID NO: 27371 - protein, 11 aa, Homo Sapiens
STQLEDSLLGK

SEQ ID NO: 27372 - protein, 11 aa, Homo Sapiens
STQRDLWNIFK

SEQ ID NO: 27373 - protein, 11 aa, Homo Sapiens
STTEELHKYQK

SEQ ID NO: 27374 - protein, 11 aa, Homo Sapiens
STTRSGAIFTK

SEQ ID NO: 27375 - protein, 11 aa, Homo Sapiens
STVGAGAYAYK

SEQ ID NO: 27376 - protein, 11 aa, Homo Sapiens
STYAPIGEVHK

SEQ ID NO: 27377 - protein, 11 aa, Homo Sapiens
STYATTIRDSK

SEQ ID NO: 27378 - protein, 11 aa, Homo Sapiens
STYDETLHVAK

SEQ ID NO: 27379 - protein, 11 aa, Homo Sapiens
STYPPEIVVPK

SEQ ID NO: 27380 - protein, 11 aa, Homo Sapiens
SVADLAESIMK

SEQ ID NO: 27381 - protein, 11 aa, Homo Sapiens
SVAGLKKQFYK

SEQ ID NO: 27382 - protein, 11 aa, Homo Sapiens
SVAIPGFTINR

SEQ ID NO: 27383 - protein, 11 aa, Homo Sapiens
SVASAAAVLSH

SEQ ID NO: 27384 - protein, 11 aa, Homo Sapiens
SVASSRSSVLK

SEQ ID NO: 27385 - protein, 11 aa, Homo Sapiens
SVCSSGPEYLK

SEQ ID NO: 27386 - protein, 11 aa, Homo Sapiens
SVDEESYKTLK

SEQ ID NO: 27387 - protein, 11 aa, Homo Sapiens
SVEERITQVAK

SEQ ID NO: 27388 - protein, 11 aa, Homo Sapiens
SVFDSSSDMEK

SEQ ID NO: 27389 - protein, 11 aa, Homo Sapiens
SVFEVDGKKNK

SEQ ID NO: 27390 - protein, 11 aa, Homo Sapiens
SVFFPESGLAK

SEQ ID NO: 27391 - protein, 11 aa, Homo Sapiens
SVFPSLNMAVK

SEQ ID NO: 27392 - protein, 11 aa, Homo Sapiens
SVFPYNHRMKK

SEQ ID NO: 27393 - protein, 11 aa, Homo Sapiens
SVFQTTDTKSK

SEQ ID NO: 27394 - protein, 11 aa, Homo Sapiens
SVFSPYWLINK

SEQ ID NO: 27395 - protein, 11 aa, Homo Sapiens
SVFTNERFPLR

SEQ ID NO: 27396 - protein, 11 aa, Homo Sapiens
SVGGREILKGK

SEQ ID NO: 27397 - protein, 11 aa, Homo Sapiens
SVIDRKDLIIK

SEQ ID NO: 27398 - protein, 11 aa, Homo Sapiens
SVIGFRILLLK

SEQ ID NO: 27399 - protein, 11 aa, Homo Sapiens
SVISIMKPVRK

SEQ ID NO: 27400 - protein, 11 aa, Homo Sapiens
SVITKKLEDVK

SEQ ID NO: 27401 - protein, 11 aa, Homo Sapiens
SVIVTPLDVVK

SEQ ID NO: 27402 - protein, 11 aa, Homo Sapiens
SVKPGAHLTVK

SEQ ID NO: 27403 - protein, 11 aa, Homo Sapiens
SVKSVPENLLK

SEQ ID NO: 27404 - protein, 11 aa, Homo Sapiens
SVLEARDLAPK

SEQ ID NO: 27405 - protein, 11 aa, Homo Sapiens
SVLEATRVNRR

SEQ ID NO: 27406 - protein, 11 aa, Homo Sapiens
SVLGKDEQINK

SEQ ID NO: 27407 - protein, 11 aa, Homo Sapiens
SVLGKGSMRDK

SEQ ID NO: 27408 - protein, 11 aa, Homo Sapiens
SVLGKVNEIAK

SEQ ID NO: 27409 - protein, 11 aa, Homo Sapiens
SVMEVNSGIYR

SEQ ID NO: 27410 - protein, 11 aa, Homo Sapiens
SVMPKKSILKK

SEQ ID NO: 27411 - protein, 11 aa, Homo Sapiens
SVMVPKSILAK

SEQ ID NO: 27412 - protein, 11 aa, Homo Sapiens
SVNKPGQLVNK

SEQ ID NO: 27413 - protein, 11 aa, Homo Sapiens
SVNKPVIGSLK

SEQ ID NO: 27414 - protein, 11 aa, Homo Sapiens
SVNPGMARWIK

SEQ ID NO: 27415 - protein, 11 aa, Homo Sapiens
SVNVDYSKLKK

SEQ ID NO: 27416 - protein, 11 aa, Homo Sapiens
SVPEAGGPPIK

SEQ ID NO: 27417 - protein, 11 aa, Homo Sapiens
SVPEFPLSPPK

SEQ ID NO: 27418 - protein, 11 aa, Homo Sapiens
SVPEVLGARYE

SEQ ID NO: 27419 - protein, 11 aa, Homo Sapiens
SVPLSDALLNK

SEQ ID NO: 27420 - protein, 11 aa, Homo Sapiens
SVPRDGASYPK

SEQ ID NO: 27421 - protein, 11 aa, Homo Sapiens
SVPSSETVICR

SEQ ID NO: 27422 - protein, 11 aa, Homo Sapiens
SVQGNFDLNSK

SEQ ID NO: 27423 - protein, 11 aa, Homo Sapiens
SVQKEVEKNLK

SEQ ID NO: 27424 - protein, 11 aa, Homo Sapiens
SVQPAANCSIK

SEQ ID NO: 27425 - protein, 11 aa, Homo Sapiens
SVQPSSSLSAR

SEQ ID NO: 27426 - protein, 11 aa, Homo Sapiens
SVQTADHRFLR

SEQ ID NO: 27427 - protein, 11 aa, Homo Sapiens
SVQVPRNLVGK

SEQ ID NO: 27428 - protein, 11 aa, Homo Sapiens
SVSTENGITLK

SEQ ID NO: 27429 - protein, 11 aa, Homo Sapiens
SVYDALPLTRL

SEQ ID NO: 27430 - protein, 11 aa, Homo Sapiens
SVYDHQGIFKR

SEQ ID NO: 27431 - protein, 11 aa, Homo Sapiens
SVYGEWVPVEK

SEQ ID NO: 27432 - protein, 11 aa, Homo Sapiens
SVYGGGGIHEY

SEQ ID NO: 27433 - protein, 11 aa, Homo Sapiens
SVYPMPRVIFR

SEQ ID NO: 27434 - protein, 11 aa, Homo Sapiens
SVYSPESNVRK

SEQ ID NO: 27435 - protein, 11 aa, Homo Sapiens
SVYSPESSVRK

SEQ ID NO: 27436 - protein, 11 aa, Homo Sapiens
SVYSPSGPVNR

SEQ ID NO: 27437 - protein, 11 aa, Homo Sapiens
SVYYNEATGGK

SEQ ID NO: 27438 - protein, 11 aa, Homo Sapiens
SWGSGLDMHTK

SEQ ID NO: 27439 - protein, 11 aa, Homo Sapiens
TAFRNKSMLFK

SEQ ID NO: 27440 - protein, 11 aa, Homo Sapiens
TAGDGLIELRK

SEQ ID NO: 27441 - protein, 11 aa, Homo Sapiens
TIITAESIFYK

SEQ ID NO: 27442 - protein, 11 aa, Homo Sapiens
TIMDRSIILRH

SEQ ID NO: 27443 - protein, 11 aa, Homo Sapiens
TIMPKDIQLAR

SEQ ID NO: 27444 - protein, 11 aa, Homo Sapiens
TIYSEADLRKK

SEQ ID NO: 27445 - protein, 11 aa, Homo Sapiens
TVDKNMPKFNK

SEQ ID NO: 27446 - protein, 11 aa, Homo Sapiens
TVFDAKRLIGR

SEQ ID NO: 27447 - protein, 11 aa, Homo Sapiens
TVFNAHEPFRR

SEQ ID NO: 27448 - protein, 11 aa, Homo Sapiens
TVFPKAKQVKK

SEQ ID NO: 27449 - protein, 11 aa, Homo Sapiens
TVIQLQNIAEK

SEQ ID NO: 27450 - protein, 11 aa, Homo Sapiens
TVIRDVEQQFK

SEQ ID NO: 27451 - protein, 11 aa, Homo Sapiens
TVISAVGTIVK

SEQ ID NO: 27452 - protein, 11 aa, Homo Sapiens
TVISQEPFVPK

SEQ ID NO: 27453 - protein, 11 aa, Homo Sapiens
TVLEKFRYLPK

SEQ ID NO: 27454 - protein, 11 aa, Homo Sapiens
TVLGGVYILGK

SEQ ID NO: 27455 - protein, 11 aa, Homo Sapiens
TVMDEIHTVLK

SEQ ID NO: 27456 - protein, 11 aa, Homo Sapiens
TVMELVKIIYK

SEQ ID NO: 27457 - protein, 11 aa, Homo Sapiens
TVQGDIDAIFK

SEQ ID NO: 27458 - protein, 11 aa, Homo Sapiens
TVQTTEDQILK

SEQ ID NO: 27459 - protein, 11 aa, Homo Sapiens
TVSEVIQGLLK

SEQ ID NO: 27460 - protein, 11 aa, Homo Sapiens
TVYTTLIDVTK

SEQ ID NO: 27461 - protein, 11 aa, Homo Sapiens
VAVAGVVLAKG

SEQ ID NO: 27462 - protein, 11 aa, Homo Sapiens
VILPPLSPYFK

SEQ ID NO: 27463 - protein, 11 aa, Homo Sapiens
VLAPEGSVPNK

SEQ ID NO: 27464 - protein, 11 aa, Homo Sapiens
VLDLSENQLQK

SEQ ID NO: 27465 - protein, 11 aa, Homo Sapiens
VLQAADILLYK

SEQ ID NO: 27466 - protein, 11 aa, Homo Sapiens
VPPVQVSPLIK

SEQ ID NO: 27467 - protein, 11 aa, Homo Sapiens
VQEDQRDLIFK

SEQ ID NO: 27468 - protein, 11 aa, Homo Sapiens
VQFVTGTFIEK

SEQ ID NO: 27469 - protein, 11 aa, Homo Sapiens
VSDPSSPQYGK

SEQ ID NO: 27470 - protein, 11 aa, Homo Sapiens
VSSPVSAWKTS

SEQ ID NO: 27471 - protein, 11 aa, Homo Sapiens
VTDNPRELQVK

SEQ ID NO: 27472 - protein, 11 aa, Homo Sapiens
VTDPSIPIRKK

SEQ ID NO: 27473 - protein, 11 aa, Homo Sapiens
VTEDFTTYINR

SEQ ID NO: 27474 - protein, 11 aa, Homo Sapiens
VTFEDQQKINK

SEQ ID NO: 27475 - protein, 11 aa, Homo Sapiens
VTFPDIIRNYK

SEQ ID NO: 27476 - protein, 11 aa, Homo Sapiens
VTLDKDAYYRR

SEQ ID NO: 27477 - protein, 11 aa, Homo Sapiens
VTMSKKLLIEK

SEQ ID NO: 27478 - protein, 11 aa, Homo Sapiens
VTMTMSSIVMK

SEQ ID NO: 27479 - protein, 11 aa, Homo Sapiens
VTQPSELLQQK

SEQ ID NO: 27480 - protein, 11 aa, Homo Sapiens
VTQPTVGMNFK

SEQ ID NO: 27481 - protein, 11 aa, Homo Sapiens
VTSTESMDFLK

SEQ ID NO: 27482 - protein, 11 aa, Homo Sapiens
VTVGVDGTLYK

SEQ ID NO: 27483 - protein, 11 aa, Homo Sapiens
VVCDNGTGFVK

SEQ ID NO: 27484 - protein, 11 aa, Homo Sapiens
VVCPVSDILYK

SEQ ID NO: 27485 - protein, 11 aa, Homo Sapiens
VVFAVKQYISK

SEQ ID NO: 27486 - protein, 11 aa, Homo Sapiens
VVFDTSLQVKK

SEQ ID NO: 27487 - protein, 11 aa, Homo Sapiens
VVFSGKAYSPK

SEQ ID NO: 27488 - protein, 11 aa, Homo Sapiens
VVFSVTTVDLK

SEQ ID NO: 27489 - protein, 11 aa, Homo Sapiens
VVFVIDPGFAK

SEQ ID NO: 27490 - protein, 11 aa, Homo Sapiens
VVIDLGEAFTK

SEQ ID NO: 27491 - protein, 11 aa, Homo Sapiens
VVIGRSGEMIK

SEQ ID NO: 27492 - protein, 11 aa, Homo Sapiens
VVLGSATLRRK

SEQ ID NO: 27493 - protein, 11 aa, Homo Sapiens
VVMAADRSLKK

SEQ ID NO: 27494 - protein, 11 aa, Homo Sapiens
VVMKASSSLPK

SEQ ID NO: 27495 - protein, 11 aa, Homo Sapiens
VVMNYSEIESK

SEQ ID NO: 27496 - protein, 11 aa, Homo Sapiens
VVMTPVPLFSK

SEQ ID NO: 27497 - protein, 11 aa, Homo Sapiens
VVQDGITLITK

SEQ ID NO: 27498 - protein, 11 aa, Homo Sapiens
VVQSVEKFIQK

SEQ ID NO: 27499 - protein, 11 aa, Homo Sapiens
VVQWADLVICK

SEQ ID NO: 27500 - protein, 11 aa, Homo Sapiens
VVSPSSFENVK

SEQ ID NO: 27501 - protein, 11 aa, Homo Sapiens
VVVDEADTMLK

SEQ ID NO: 27502 - protein, 11 aa, Homo Sapiens
VVVGVYRPPPK

SEQ ID NO: 27503 - protein, 11 aa, Homo Sapiens
VVYSGLENIKK

SEQ ID NO: 27504 - protein, 11 aa, Homo Sapiens
YDGHAGSQVAK

SEQ ID NO: 27505 - protein, 11 aa, Homo Sapiens
YLLGTSLARPC

SEQ ID NO: 27506 - protein, 8 aa, Homo Sapiens
AGGAWTYK

SEQ ID NO: 27507 - protein, 8 aa, Homo Sapiens
EFGLARFK

SEQ ID NO: 27508 - protein, 8 aa, Homo Sapiens
ERQFSSRS

SEQ ID NO: 27509 - protein, 8 aa, Homo Sapiens
FDGRVVAK

SEQ ID NO: 27510 - protein, 8 aa, Homo Sapiens
FDKAKLKK

SEQ ID NO: 27511 - protein, 8 aa, Homo Sapiens
FEDPVISK

SEQ ID NO: 27512 - protein, 8 aa, Homo Sapiens
FPKPFVEK

SEQ ID NO: 27513 - protein, 8 aa, Homo Sapiens
FQQGMKNK

SEQ ID NO: 27514 - protein, 8 aa, Homo Sapiens
GAGAYAYK

SEQ ID NO: 27515 - protein, 8 aa, Homo Sapiens
GSWDSFLK

SEQ ID NO: 27516 - protein, 8 aa, Homo Sapiens
IDGSVNPK

SEQ ID NO: 27517 - protein, 8 aa, Homo Sapiens
IFKQPVTK

SEQ ID NO: 27518 - protein, 8 aa, Homo Sapiens
INIVHPKL

SEQ ID NO: 27519 - protein, 8 aa, Homo Sapiens
KCRLTLQK

SEQ ID NO: 27520 - protein, 8 aa, Homo Sapiens
LGPNLGDK

SEQ ID NO: 27521 - protein, 8 aa, Homo Sapiens
LYDHAHVK

SEQ ID NO: 27522 - protein, 8 aa, Homo Sapiens
MGAYVLLK

SEQ ID NO: 27523 - protein, 8 aa, Homo Sapiens
MLDTVVFK

SEQ ID NO: 27524 - protein, 8 aa, Homo Sapiens
NAHSNILK

SEQ ID NO: 27525 - protein, 8 aa, Homo Sapiens
NDSPALKK

SEQ ID NO: 27526 - protein, 8 aa, Homo Sapiens
PKDIQLAR

SEQ ID NO: 27527 - protein, 8 aa, Homo Sapiens
PLAGLAPK

SEQ ID NO: 27528 - protein, 8 aa, Homo Sapiens
PLDFPSKK

SEQ ID NO: 27529 - protein, 8 aa, Homo Sapiens
PPELVKQK

SEQ ID NO: 27530 - protein, 8 aa, Homo Sapiens
PPLSPYFK

SEQ ID NO: 27531 - protein, 8 aa, Homo Sapiens
PSLLTNPK

SEQ ID NO: 27532 - protein, 8 aa, Homo Sapiens
PSTPIAHR

SEQ ID NO: 27533 - protein, 8 aa, Homo Sapiens
PTNIIAAK

SEQ ID NO: 27534 - protein, 8 aa, Homo Sapiens
PVAPTPPR

SEQ ID NO: 27535 - protein, 8 aa, Homo Sapiens
QNSVKILK

SEQ ID NO: 27536 - protein, 8 aa, Homo Sapiens
QSGEQPYK

SEQ ID NO: 27537 - protein, 8 aa, Homo Sapiens
SDFHPVKK

SEQ ID NO: 27538 - protein, 8 aa, Homo Sapiens
SFDKAKLK

SEQ ID NO: 27539 - protein, 8 aa, Homo Sapiens
SNFKSPVK

SEQ ID NO: 27540 - protein, 8 aa, Homo Sapiens
SSHVPIQK

SEQ ID NO: 27541 - protein, 8 aa, Homo Sapiens
SSPKLAPK

SEQ ID NO: 27542 - protein, 8 aa, Homo Sapiens
TADVHFER

SEQ ID NO: 27543 - protein, 8 aa, Homo Sapiens
TDKSFVEK

SEQ ID NO: 27544 - protein, 8 aa, Homo Sapiens
TEAPLNPK

SEQ ID NO: 27545 - protein, 8 aa, Homo Sapiens
TVDIFHKK

SEQ ID NO: 27546 - protein, 8 aa, Homo Sapiens
TVLYIVKK

SEQ ID NO: 27547 - protein, 8 aa, Homo Sapiens
VCEYIVKK

SEQ ID NO: 27548 - protein, 8 aa, Homo Sapiens
VIHFNNPK

SEQ ID NO: 27549 - protein, 8 aa, Homo Sapiens
VINKVHLK

SEQ ID NO: 27550 - protein, 8 aa, Homo Sapiens
VMRDPASK

SEQ ID NO: 27551 - protein, 8 aa, Homo Sapiens
VMRDPNTK

SEQ ID NO: 27552 - protein, 8 aa, Homo Sapiens
VSDQVQIK

SEQ ID NO: 27553 - protein, 8 aa, Homo Sapiens
VSEKQFSK

SEQ ID NO: 27554 - protein, 8 aa, Homo Sapiens
VSLTACKV

SEQ ID NO: 27555 - protein, 9 aa, Homo Sapiens
AAAKVILKK

SEQ ID NO: 27556 - protein, 9 aa, Homo Sapiens
AAAPVTPLR

SEQ ID NO: 27557 - protein, 9 aa, Homo Sapiens
AAATSVLKT

SEQ ID NO: 27558 - protein, 9 aa, Homo Sapiens
AAIATIKTK

SEQ ID NO: 27559 - protein, 9 aa, Homo Sapiens
AAITLAFSK

SEQ ID NO: 27560 - protein, 9 aa, Homo Sapiens
AALAKAIEK

SEQ ID NO: 27561 - protein, 9 aa, Homo Sapiens
AALDWVTKK

SEQ ID NO: 27562 - protein, 9 aa, Homo Sapiens
AALEKPLSH

SEQ ID NO: 27563 - protein, 9 aa, Homo Sapiens
AALKVLPPT

SEQ ID NO: 27564 - protein, 9 aa, Homo Sapiens
AAMEPLTAR

SEQ ID NO: 27565 - protein, 9 aa, Homo Sapiens
AAMLMPHQK

SEQ ID NO: 27566 - protein, 9 aa, Homo Sapiens
AAPIRLLAA

SEQ ID NO: 27567 - protein, 9 aa, Homo Sapiens
AAVGYIMEK

SEQ ID NO: 27568 - protein, 9 aa, Homo Sapiens
AAYAHELPK

SEQ ID NO: 27569 - protein, 9 aa, Homo Sapiens
AGMALGIQK

SEQ ID NO: 27570 - protein, 9 aa, Homo Sapiens
AGMGFGLER

SEQ ID NO: 27571 - protein, 9 aa, Homo Sapiens
AGPEPLPPK

SEQ ID NO: 27572 - protein, 9 aa, Homo Sapiens
AGVFVDATK

SEQ ID NO: 27573 - protein, 9 aa, Homo Sapiens
AICQWERNK

SEQ ID NO: 27574 - protein, 9 aa, Homo Sapiens
AIFKDLVGK

SEQ ID NO: 27575 - protein, 9 aa, Homo Sapiens
AIFKPVMSK

SEQ ID NO: 27576 - protein, 9 aa, Homo Sapiens
AIFPRAFPK

SEQ ID NO: 27577 - protein, 9 aa, Homo Sapiens
AIFTKAYQR

SEQ ID NO: 27578 - protein, 9 aa, Homo Sapiens
AIIDTVINY

SEQ ID NO: 27579 - protein, 9 aa, Homo Sapiens
AIITPPPAK

SEQ ID NO: 27580 - protein, 9 aa, Homo Sapiens
AILDKNFRK

SEQ ID NO: 27581 - protein, 9 aa, Homo Sapiens
AILDYLITK

SEQ ID NO: 27582 - protein, 9 aa, Homo Sapiens
AILLPQPPK

SEQ ID NO: 27583 - protein, 9 aa, Homo Sapiens
AIMDPLPLR

SEQ ID NO: 27584 - protein, 9 aa, Homo Sapiens
AINDKSIVK

SEQ ID NO: 27585 - protein, 9 aa, Homo Sapiens
AISEYIATK

SEQ ID NO: 27586 - protein, 9 aa, Homo Sapiens
AIVAYGLYK

SEQ ID NO: 27587 - protein, 9 aa, Homo Sapiens
AIVKLFLKK

SEQ ID NO: 27588 - protein, 9 aa, Homo Sapiens
AIYEPKTFK

SEQ ID NO: 27589 - protein, 9 aa, Homo Sapiens
ALFDGVVSK

SEQ ID NO: 27590 - protein, 9 aa, Homo Sapiens
ALFSRIFGK

SEQ ID NO: 27591 - protein, 9 aa, Homo Sapiens
ALLKWCQKK

SEQ ID NO: 27592 - protein, 9 aa, Homo Sapiens
ALMEKFKKK

SEQ ID NO: 27593 - protein, 9 aa, Homo Sapiens
ALQEIYNQK

SEQ ID NO: 27594 - protein, 9 aa, Homo Sapiens
AMIEVNINK

SEQ ID NO: 27595 - protein, 9 aa, Homo Sapiens
AMLDTVVFK

SEQ ID NO: 27596 - protein, 9 aa, Homo Sapiens
AQADPLVRR

SEQ ID NO: 27597 - protein, 9 aa, Homo Sapiens
AQAESLRYK

SEQ ID NO: 27598 - protein, 9 aa, Homo Sapiens
AQATISFPK

SEQ ID NO: 27599 - protein, 9 aa, Homo Sapiens
AQCGKAFPK

SEQ ID NO: 27600 - protein, 9 aa, Homo Sapiens
AQCQIFMEK

SEQ ID NO: 27601 - protein, 9 aa, Homo Sapiens
AQFIPKFFK

SEQ ID NO: 27602 - protein, 9 aa, Homo Sapiens
AQGEMFTVK

SEQ ID NO: 27603 - protein, 9 aa, Homo Sapiens
AQGKPLALK

SEQ ID NO: 27604 - protein, 9 aa, Homo Sapiens
AQIKEHLLK

SEQ ID NO: 27605 - protein, 9 aa, Homo Sapiens
AQNEPLTQK

SEQ ID NO: 27606 - protein, 9 aa, Homo Sapiens
AQNPSLFVK

SEQ ID NO: 27607 - protein, 9 aa, Homo Sapiens
AQQKVTLPK

SEQ ID NO: 27608 - protein, 9 aa, Homo Sapiens
ASAPVTVKR

SEQ ID NO: 27609 - protein, 9 aa, Homo Sapiens
ASATALVSR

SEQ ID NO: 27610 - protein, 9 aa, Homo Sapiens
ASAYSIAQK

SEQ ID NO: 27611 - protein, 9 aa, Homo Sapiens
ASDPHIIIK

SEQ ID NO: 27612 - protein, 9 aa, Homo Sapiens
ASDPTVFHK

SEQ ID NO: 27613 - protein, 9 aa, Homo Sapiens
ASEVLKHLK

SEQ ID NO: 27614 - protein, 9 aa, Homo Sapiens
ASFALKKIK

SEQ ID NO: 27615 - protein, 9 aa, Homo Sapiens
ASFCGAVFR

SEQ ID NO: 27616 - protein, 9 aa, Homo Sapiens
ASFDKAKLK

SEQ ID NO: 27617 - protein, 9 aa, Homo Sapiens
ASFENVRAK

SEQ ID NO: 27618 - protein, 9 aa, Homo Sapiens
ASFFGVHPK

SEQ ID NO: 27619 - protein, 9 aa, Homo Sapiens
ASFNDTFVH

SEQ ID NO: 27620 - protein, 9 aa, Homo Sapiens
ASFPKVFIK

SEQ ID NO: 27621 - protein, 9 aa, Homo Sapiens
ASFQSTSVK

SEQ ID NO: 27622 - protein, 9 aa, Homo Sapiens
ASGSFKLNK

SEQ ID NO: 27623 - protein, 9 aa, Homo Sapiens
ASGSTTFTK

SEQ ID NO: 27624 - protein, 9 aa, Homo Sapiens
ASIDATYAK

SEQ ID NO: 27625 - protein, 9 aa, Homo Sapiens
ASIDWLAQR

SEQ ID NO: 27626 - protein, 9 aa, Homo Sapiens
ASIPHVIAR

SEQ ID NO: 27627 - protein, 9 aa, Homo Sapiens
ASIPTILTH

SEQ ID NO: 27628 - protein, 9 aa, Homo Sapiens
ASIQHPLIK

SEQ ID NO: 27629 - protein, 9 aa, Homo Sapiens
ASLADIMAK

SEQ ID NO: 27630 - protein, 9 aa, Homo Sapiens
ASLATTLTK

SEQ ID NO: 27631 - protein, 9 aa, Homo Sapiens
ASLGASVHK

SEQ ID NO: 27632 - protein, 9 aa, Homo Sapiens
ASLGLKFNK

SEQ ID NO: 27633 - protein, 9 aa, Homo Sapiens
ASLGNLFAR

SEQ ID NO: 27634 - protein, 9 aa, Homo Sapiens
ASLIRLVPK

SEQ ID NO: 27635 - protein, 9 aa, Homo Sapiens
ASLPLAVTK

SEQ ID NO: 27636 - protein, 9 aa, Homo Sapiens
ASLPVRNAK

SEQ ID NO: 27637 - protein, 9 aa, Homo Sapiens
ASLQSVVHK

SEQ ID NO: 27638 - protein, 9 aa, Homo Sapiens
ASLSDREVK

SEQ ID NO: 27639 - protein, 9 aa, Homo Sapiens
ASLTDTVNK

SEQ ID NO: 27640 - protein, 9 aa, Homo Sapiens
ASMAIKNPK

SEQ ID NO: 27641 - protein, 9 aa, Homo Sapiens
ASMPVDIAK

SEQ ID NO: 27642 - protein, 9 aa, Homo Sapiens
ASNFKSPVK

SEQ ID NO: 27643 - protein, 9 aa, Homo Sapiens
ASNGCVLVH

SEQ ID NO: 27644 - protein, 9 aa, Homo Sapiens
ASNPAMLLY

SEQ ID NO: 27645 - protein, 9 aa, Homo Sapiens
ASNPATFQR

SEQ ID NO: 27646 - protein, 9 aa, Homo Sapiens
ASQELWLNH

SEQ ID NO: 27647 - protein, 9 aa, Homo Sapiens
ASQGFRFLR

SEQ ID NO: 27648 - protein, 9 aa, Homo Sapiens
ASSGTCFPR

SEQ ID NO: 27649 - protein, 9 aa, Homo Sapiens
ASSHVPIQK

SEQ ID NO: 27650 - protein, 9 aa, Homo Sapiens
ASSPPAIPK

SEQ ID NO: 27651 - protein, 9 aa, Homo Sapiens
ASSSVSISH

SEQ ID NO: 27652 - protein, 9 aa, Homo Sapiens
ASTFVDQCK

SEQ ID NO: 27653 - protein, 9 aa, Homo Sapiens
ASTPPLPRR

SEQ ID NO: 27654 - protein, 9 aa, Homo Sapiens
ASTRTIFKK

SEQ ID NO: 27655 - protein, 9 aa, Homo Sapiens
ASTTVLALK

SEQ ID NO: 27656 - protein, 9 aa, Homo Sapiens
ASVFQVKLG

SEQ ID NO: 27657 - protein, 9 aa, Homo Sapiens
ASVGYAVTK

SEQ ID NO: 27658 - protein, 9 aa, Homo Sapiens
ASVNTLVNK

SEQ ID NO: 27659 - protein, 9 aa, Homo Sapiens
ASVPAQAPK

SEQ ID NO: 27660 - protein, 9 aa, Homo Sapiens
ASVQPPPRP

SEQ ID NO: 27661 - protein, 9 aa, Homo Sapiens
ASYPQPLLR

SEQ ID NO: 27662 - protein, 9 aa, Homo Sapiens
ASYTKIVVK

SEQ ID NO: 27663 - protein, 9 aa, Homo Sapiens
ATAALLRHK

SEQ ID NO: 27664 - protein, 9 aa, Homo Sapiens
ATAAVIFLH

SEQ ID NO: 27665 - protein, 9 aa, Homo Sapiens
ATAEECLKH

SEQ ID NO: 27666 - protein, 9 aa, Homo Sapiens
ATAELIMSR

SEQ ID NO: 27667 - protein, 9 aa, Homo Sapiens
ATAEVGYNR

SEQ ID NO: 27668 - protein, 9 aa, Homo Sapiens
ATAGFTIGR

SEQ ID NO: 27669 - protein, 9 aa, Homo Sapiens
ATALEYVYK

SEQ ID NO: 27670 - protein, 9 aa, Homo Sapiens
ATANQIILK

SEQ ID NO: 27671 - protein, 9 aa, Homo Sapiens
ATAPPAPAY

SEQ ID NO: 27672 - protein, 9 aa, Homo Sapiens
ATAQFKINK

SEQ ID NO: 27673 - protein, 9 aa, Homo Sapiens
ATASPIVAR

SEQ ID NO: 27674 - protein, 9 aa, Homo Sapiens
ATATELTTK

SEQ ID NO: 27675 - protein, 9 aa, Homo Sapiens
ATATLIIEH

SEQ ID NO: 27676 - protein, 9 aa, Homo Sapiens
ATATPVPPR

SEQ ID NO: 27677 - protein, 9 aa, Homo Sapiens
ATATVYFKR

SEQ ID NO: 27678 - protein, 9 aa, Homo Sapiens
ATCELPLQK

SEQ ID NO: 27679 - protein, 9 aa, Homo Sapiens
ATCLPLSVR

SEQ ID NO: 27680 - protein, 9 aa, Homo Sapiens
ATCYPDFSK

SEQ ID NO: 27681 - protein, 9 aa, Homo Sapiens
ATDIPSSQK

SEQ ID NO: 27682 - protein, 9 aa, Homo Sapiens
ATDPNILGR

SEQ ID NO: 27683 - protein, 9 aa, Homo Sapiens
ATEQPLTAK

SEQ ID NO: 27684 - protein, 9 aa, Homo Sapiens
ATESGMLYH

SEQ ID NO: 27685 - protein, 9 aa, Homo Sapiens
ATEVAPLYK

SEQ ID NO: 27686 - protein, 9 aa, Homo Sapiens
ATFFGEVVK

SEQ ID NO: 27687 - protein, 9 aa, Homo Sapiens
ATFHTPFSH

SEQ ID NO: 27688 - protein, 9 aa, Homo Sapiens
ATFLDPRYK

SEQ ID NO: 27689 - protein, 9 aa, Homo Sapiens
ATFLIQLER

SEQ ID NO: 27690 - protein, 9 aa, Homo Sapiens
ATFPDPNVK

SEQ ID NO: 27691 - protein, 9 aa, Homo Sapiens
ATFPGMWER

SEQ ID NO: 27692 - protein, 9 aa, Homo Sapiens
ATFPLSVQK

SEQ ID NO: 27693 - protein, 9 aa, Homo Sapiens
ATFQFTVER

SEQ ID NO: 27694 - protein, 9 aa, Homo Sapiens
ATFSSSHRY

SEQ ID NO: 27695 - protein, 9 aa, Homo Sapiens
ATFTNVFGK

SEQ ID NO: 27696 - protein, 9 aa, Homo Sapiens
ATFTVMGLK

SEQ ID NO: 27697 - protein, 9 aa, Homo Sapiens
ATFYGPVKK

SEQ ID NO: 27698 - protein, 9 aa, Homo Sapiens
ATGDVALLR

SEQ ID NO: 27699 - protein, 9 aa, Homo Sapiens
ATGESIAVK

SEQ ID NO: 27700 - protein, 9 aa, Homo Sapiens
ATGFLEQLK

SEQ ID NO: 27701 - protein, 9 aa, Homo Sapiens
ATGQLPVKK

SEQ ID NO: 27702 - protein, 9 aa, Homo Sapiens
ATGQWTRFK

SEQ ID NO: 27703 - protein, 9 aa, Homo Sapiens
ATGSVFTGK

SEQ ID NO: 27704 - protein, 9 aa, Homo Sapiens
ATHTAFVAK

SEQ ID NO: 27705 - protein, 9 aa, Homo Sapiens
ATIALMIQR

SEQ ID NO: 27706 - protein, 9 aa, Homo Sapiens
ATIEELTEK

SEQ ID NO: 27707 - protein, 9 aa, Homo Sapiens
ATIEKIRTK

SEQ ID NO: 27708 - protein, 9 aa, Homo Sapiens
ATIKDVFGR

SEQ ID NO: 27709 - protein, 9 aa, Homo Sapiens
ATINYSLLR

SEQ ID NO: 27710 - protein, 9 aa, Homo Sapiens
ATIQGAYAR

SEQ ID NO: 27711 - protein, 9 aa, Homo Sapiens
ATIQNETPK

SEQ ID NO: 27712 - protein, 9 aa, Homo Sapiens
ATISFPKRK

SEQ ID NO: 27713 - protein, 9 aa, Homo Sapiens
ATIVYHLAR

SEQ ID NO: 27714 - protein, 9 aa, Homo Sapiens
ATKIKNYYK

SEQ ID NO: 27715 - protein, 9 aa, Homo Sapiens
ATLAAVLQR

SEQ ID NO: 27716 - protein, 9 aa, Homo Sapiens
ATLDLNAVK

SEQ ID NO: 27717 - protein, 9 aa, Homo Sapiens
ATLDQFYDK

SEQ ID NO: 27718 - protein, 9 aa, Homo Sapiens
ATLDVAVRR

SEQ ID NO: 27719 - protein, 9 aa, Homo Sapiens
ATLEETLVK

SEQ ID NO: 27720 - protein, 9 aa, Homo Sapiens
ATLEIVTDK

SEQ ID NO: 27721 - protein, 9 aa, Homo Sapiens
ATLETILRH

SEQ ID NO: 27722 - protein, 9 aa, Homo Sapiens
ATLFFILRK

SEQ ID NO: 27723 - protein, 9 aa, Homo Sapiens
ATLGAILNR

SEQ ID NO: 27724 - protein, 9 aa, Homo Sapiens
ATLHHVIDK

SEQ ID NO: 27725 - protein, 9 aa, Homo Sapiens
ATLLIFANK

SEQ ID NO: 27726 - protein, 9 aa, Homo Sapiens
ATLNSFIHV

SEQ ID NO: 27727 - protein, 9 aa, Homo Sapiens
ATLNSIVAK

SEQ ID NO: 27728 - protein, 9 aa, Homo Sapiens
ATLNVSTTR

SEQ ID NO: 27729 - protein, 9 aa, Homo Sapiens
ATLQDIIRR

SEQ ID NO: 27730 - protein, 9 aa, Homo Sapiens
ATLQEALAH

SEQ ID NO: 27731 - protein, 9 aa, Homo Sapiens
ATLQNVLRK

SEQ ID NO: 27732 - protein, 9 aa, Homo Sapiens
ATLQYIVGR

SEQ ID NO: 27733 - protein, 9 aa, Homo Sapiens
ATLRLIIRH

SEQ ID NO: 27734 - protein, 9 aa, Homo Sapiens
ATLSICSPK

SEQ ID NO: 27735 - protein, 9 aa, Homo Sapiens
ATLTKDVPK

SEQ ID NO: 27736 - protein, 9 aa, Homo Sapiens
ATLTNILEH

SEQ ID NO: 27737 - protein, 9 aa, Homo Sapiens
ATMEDTVEY

SEQ ID NO: 27738 - protein, 9 aa, Homo Sapiens
ATNGAKFLK

SEQ ID NO: 27739 - protein, 9 aa, Homo Sapiens
ATNSSMFLK

SEQ ID NO: 27740 - protein, 9 aa, Homo Sapiens
ATNYITRNK

SEQ ID NO: 27741 - protein, 9 aa, Homo Sapiens
ATPNEIFLK

SEQ ID NO: 27742 - protein, 9 aa, Homo Sapiens
ATPPFTHSK

SEQ ID NO: 27743 - protein, 9 aa, Homo Sapiens
ATPSSSLPK

SEQ ID NO: 27744 - protein, 9 aa, Homo Sapiens
ATQAHSLSY

SEQ ID NO: 27745 - protein, 9 aa, Homo Sapiens
ATQAVFQKR

SEQ ID NO: 27746 - protein, 9 aa, Homo Sapiens
ATQDPAALR

SEQ ID NO: 27747 - protein, 9 aa, Homo Sapiens
ATQFENWYK

SEQ ID NO: 27748 - protein, 9 aa, Homo Sapiens
ATQILSVPK

SEQ ID NO: 27749 - protein, 9 aa, Homo Sapiens
ATQLLKLAH

SEQ ID NO: 27750 - protein, 9 aa, Homo Sapiens
ATQNQLLFH

SEQ ID NO: 27751 - protein, 9 aa, Homo Sapiens
ATQQDVFQH

SEQ ID NO: 27752 - protein, 9 aa, Homo Sapiens
ATQSFSTFR

SEQ ID NO: 27753 - protein, 9 aa, Homo Sapiens
ATQTSVVVK

SEQ ID NO: 27754 - protein, 9 aa, Homo Sapiens
ATSAPLVSR

SEQ ID NO: 27755 - protein, 9 aa, Homo Sapiens
ATSAVTVTR

SEQ ID NO: 27756 - protein, 9 aa, Homo Sapiens
ATSDMDIGK

SEQ ID NO: 27757 - protein, 9 aa, Homo Sapiens
ATSEIFASK

SEQ ID NO: 27758 - protein, 9 aa, Homo Sapiens
ATSGVVAVR

SEQ ID NO: 27759 - protein, 9 aa, Homo Sapiens
ATSGYCVGR

SEQ ID NO: 27760 - protein, 9 aa, Homo Sapiens
ATSKVALVY

SEQ ID NO: 27761 - protein, 9 aa, Homo Sapiens
ATSLGHFTK

SEQ ID NO: 27762 - protein, 9 aa, Homo Sapiens
ATSLVFKQK

SEQ ID NO: 27763 - protein, 9 aa, Homo Sapiens
ATSNFARVK

SEQ ID NO: 27764 - protein, 9 aa, Homo Sapiens
ATSPALFNR

SEQ ID NO: 27765 - protein, 9 aa, Homo Sapiens
ATSPIIIHR

SEQ ID NO: 27766 - protein, 9 aa, Homo Sapiens
ATSPVVYTR

SEQ ID NO: 27767 - protein, 9 aa, Homo Sapiens
ATSRTYLYR

SEQ ID NO: 27768 - protein, 9 aa, Homo Sapiens
ATSSVSALK

SEQ ID NO: 27769 - protein, 9 aa, Homo Sapiens
ATSTPCVSR

SEQ ID NO: 27770 - protein, 9 aa, Homo Sapiens
ATSVITIVK

SEQ ID NO: 27771 - protein, 9 aa, Homo Sapiens
ATTALAIYH

SEQ ID NO: 27772 - protein, 9 aa, Homo Sapiens
ATTGKILEK

SEQ ID NO: 27773 - protein, 9 aa, Homo Sapiens
ATTLPIRNK

SEQ ID NO: 27774 - protein, 9 aa, Homo Sapiens
ATTPELLLK

SEQ ID NO: 27775 - protein, 9 aa, Homo Sapiens
ATTQTIMQK

SEQ ID NO: 27776 - protein, 9 aa, Homo Sapiens
ATTSLSLRR

SEQ ID NO: 27777 - protein, 9 aa, Homo Sapiens
ATTTVMNPK

SEQ ID NO: 27778 - protein, 9 aa, Homo Sapiens
ATVAALQEK

SEQ ID NO: 27779 - protein, 9 aa, Homo Sapiens
ATVDIVQKK

SEQ ID NO: 27780 - protein, 9 aa, Homo Sapiens
ATVITTEKR

SEQ ID NO: 27781 - protein, 9 aa, Homo Sapiens
ATVKEQIVK

SEQ ID NO: 27782 - protein, 9 aa, Homo Sapiens
ATVLTSVKK

SEQ ID NO: 27783 - protein, 9 aa, Homo Sapiens
ATVLYIVKK

SEQ ID NO: 27784 - protein, 9 aa, Homo Sapiens
ATYERVVYK

SEQ ID NO: 27785 - protein, 9 aa, Homo Sapiens
ATYGLNVER

SEQ ID NO: 27786 - protein, 9 aa, Homo Sapiens
ATYILEAGK

SEQ ID NO: 27787 - protein, 9 aa, Homo Sapiens
ATYPMPTAK

SEQ ID NO: 27788 - protein, 9 aa, Homo Sapiens
ATYPYQVVR

SEQ ID NO: 27789 - protein, 9 aa, Homo Sapiens
ATYSVGMQK

SEQ ID NO: 27790 - protein, 9 aa, Homo Sapiens
ATYTPQAPK

SEQ ID NO: 27791 - protein, 9 aa, Homo Sapiens
AVAAFQVEK

SEQ ID NO: 27792 - protein, 9 aa, Homo Sapiens
AVAAFVLYK

SEQ ID NO: 27793 - protein, 9 aa, Homo Sapiens
AVADAVIEK

SEQ ID NO: 27794 - protein, 9 aa, Homo Sapiens
AVAELWLQH

SEQ ID NO: 27795 - protein, 9 aa, Homo Sapiens
AVAIKAMAK

SEQ ID NO: 27796 - protein, 9 aa, Homo Sapiens
AVAIPSWGK

SEQ ID NO: 27797 - protein, 9 aa, Homo Sapiens
AVALPLQTK

SEQ ID NO: 27798 - protein, 9 aa, Homo Sapiens
AVAPLSASK

SEQ ID NO: 27799 - protein, 9 aa, Homo Sapiens
AVASAAKLG

SEQ ID NO: 27800 - protein, 9 aa, Homo Sapiens
AVAVTMGPK

SEQ ID NO: 27801 - protein, 9 aa, Homo Sapiens
AVCEVALDY

SEQ ID NO: 27802 - protein, 9 aa, Homo Sapiens
AVCSDFFNK

SEQ ID NO: 27803 - protein, 9 aa, Homo Sapiens
AVDQIAFQK

SEQ ID NO: 27804 - protein, 9 aa, Homo Sapiens
AVDTAYVAK

SEQ ID NO: 27805 - protein, 9 aa, Homo Sapiens
AVDVSPLRR

SEQ ID NO: 27806 - protein, 9 aa, Homo Sapiens
AVFASEVKK

SEQ ID NO: 27807 - protein, 9 aa, Homo Sapiens
AVFEDLSLK

SEQ ID NO: 27808 - protein, 9 aa, Homo Sapiens
AVFEETLEK

SEQ ID NO: 27809 - protein, 9 aa, Homo Sapiens
AVFEWHITK

SEQ ID NO: 27810 - protein, 9 aa, Homo Sapiens
AVFGVPASK

SEQ ID NO: 27811 - protein, 9 aa, Homo Sapiens
AVFSKSVQK

SEQ ID NO: 27812 - protein, 9 aa, Homo Sapiens
AVGNIKVTK

SEQ ID NO: 27813 - protein, 9 aa, Homo Sapiens
AVGPHLTAK

SEQ ID NO: 27814 - protein, 9 aa, Homo Sapiens
AVGPKVALK

SEQ ID NO: 27815 - protein, 9 aa, Homo Sapiens
AVIDVGINR

SEQ ID NO: 27816 - protein, 9 aa, Homo Sapiens
AVIEDTWHY

SEQ ID NO: 27817 - protein, 9 aa, Homo Sapiens
AVIEFLLDK

SEQ ID NO: 27818 - protein, 9 aa, Homo Sapiens
AVIENLPKK

SEQ ID NO: 27819 - protein, 9 aa, Homo Sapiens
AVIGNVQEK

SEQ ID NO: 27820 - protein, 9 aa, Homo Sapiens
AVIQVGKEK

SEQ ID NO: 27821 - protein, 9 aa, Homo Sapiens
AVIRGVTTK

SEQ ID NO: 27822 - protein, 9 aa, Homo Sapiens
AVISQCIYR

SEQ ID NO: 27823 - protein, 9 aa, Homo Sapiens
AVLDFVKQK

SEQ ID NO: 27824 - protein, 9 aa, Homo Sapiens
AVLDKVKTK

SEQ ID NO: 27825 - protein, 9 aa, Homo Sapiens
AVLDLSWNK

SEQ ID NO: 27826 - protein, 9 aa, Homo Sapiens
AVLDYVMTR

SEQ ID NO: 27827 - protein, 9 aa, Homo Sapiens
AVLEADFAK

SEQ ID NO: 27828 - protein, 9 aa, Homo Sapiens
AVLGTHKLK

SEQ ID NO: 27829 - protein, 9 aa, Homo Sapiens
AVLKHIENK

SEQ ID NO: 27830 - protein, 9 aa, Homo Sapiens
AVLLPQPPK

SEQ ID NO: 27831 - protein, 9 aa, Homo Sapiens
AVLLVFANK

SEQ ID NO: 27832 - protein, 9 aa, Homo Sapiens
AVLPAVIPK

SEQ ID NO: 27833 - protein, 9 aa, Homo Sapiens
AVLPSVLNK

SEQ ID NO: 27834 - protein, 9 aa, Homo Sapiens
AVLSWKLAK

SEQ ID NO: 27835 - protein, 9 aa, Homo Sapiens
AVMEMMSQK

SEQ ID NO: 27836 - protein, 9 aa, Homo Sapiens
AVMGNPVTR

SEQ ID NO: 27837 - protein, 9 aa, Homo Sapiens
AVMNFVVRY

SEQ ID NO: 27838 - protein, 9 aa, Homo Sapiens
AVMPDGQFK

SEQ ID NO: 27839 - protein, 9 aa, Homo Sapiens
AVMRCLLAY

SEQ ID NO: 27840 - protein, 9 aa, Homo Sapiens
AVNIVCHSK

SEQ ID NO: 27841 - protein, 9 aa, Homo Sapiens
AVNMVPFPR

SEQ ID NO: 27842 - protein, 9 aa, Homo Sapiens
AVQHFSLLY

SEQ ID NO: 27843 - protein, 9 aa, Homo Sapiens
AVQRTLLEK

SEQ ID NO: 27844 - protein, 9 aa, Homo Sapiens
AVSAVVHEY

SEQ ID NO: 27845 - protein, 9 aa, Homo Sapiens
AVSSLIRNK

SEQ ID NO: 27846 - protein, 9 aa, Homo Sapiens
AVSTFAMVK

SEQ ID NO: 27847 - protein, 9 aa, Homo Sapiens
AVSTLGISK

SEQ ID NO: 27848 - protein, 9 aa, Homo Sapiens
AVSTPNTPR

SEQ ID NO: 27849 - protein, 9 aa, Homo Sapiens
AVTAFVTFR

SEQ ID NO: 27850 - protein, 9 aa, Homo Sapiens
AVVAATALK

SEQ ID NO: 27851 - protein, 9 aa, Homo Sapiens
AVVDIYHSR

SEQ ID NO: 27852 - protein, 9 aa, Homo Sapiens
AVWDTCLEY

SEQ ID NO: 27853 - protein, 9 aa, Homo Sapiens
AVYDFFIGR

SEQ ID NO: 27854 - protein, 9 aa, Homo Sapiens
AVYETPTAH

SEQ ID NO: 27855 - protein, 9 aa, Homo Sapiens
AVYLLPVPK

SEQ ID NO: 27856 - protein, 9 aa, Homo Sapiens
AVYTKMMTK

SEQ ID NO: 27857 - protein, 9 aa, Homo Sapiens
DPNVSKKLK

SEQ ID NO: 27858 - protein, 9 aa, Homo Sapiens
EGGPILPKK

SEQ ID NO: 27859 - protein, 9 aa, Homo Sapiens
EIMPPPPKP

SEQ ID NO: 27860 - protein, 9 aa, Homo Sapiens
EKQSCLKFK

SEQ ID NO: 27861 - protein, 9 aa, Homo Sapiens
ELMPPPPPK

SEQ ID NO: 27862 - protein, 9 aa, Homo Sapiens
ETFLLPHLK

SEQ ID NO: 27863 - protein, 9 aa, Homo Sapiens
ETFSGVYKK

SEQ ID NO: 27864 - protein, 9 aa, Homo Sapiens
ETMNIFLEK

SEQ ID NO: 27865 - protein, 9 aa, Homo Sapiens
ETQPPVALK

SEQ ID NO: 27866 - protein, 9 aa, Homo Sapiens
EVNSGFFYK

SEQ ID NO: 27867 - protein, 9 aa, Homo Sapiens
FEPAKGGEK

SEQ ID NO: 27868 - protein, 9 aa, Homo Sapiens
FLSAVFFAK

SEQ ID NO: 27869 - protein, 9 aa, Homo Sapiens
FPSLLTNPK

SEQ ID NO: 27870 - protein, 9 aa, Homo Sapiens
FQYDRFFEK

SEQ ID NO: 27871 - protein, 9 aa, Homo Sapiens
FSTVTSTVK

SEQ ID NO: 27872 - protein, 9 aa, Homo Sapiens
FTAPSTVGK

SEQ ID NO: 27873 - protein, 9 aa, Homo Sapiens
FTNERFPLR

SEQ ID NO: 27874 - protein, 9 aa, Homo Sapiens
FTQKPGFPK

SEQ ID NO: 27875 - protein, 9 aa, Homo Sapiens
FTSPPSLFK

SEQ ID NO: 27876 - protein, 9 aa, Homo Sapiens
FVQGIFVEK

SEQ ID NO: 27877 - protein, 9 aa, Homo Sapiens
GAFYKGFIK

SEQ ID NO: 27878 - protein, 9 aa, Homo Sapiens
GAFYKGFVK

SEQ ID NO: 27879 - protein, 9 aa, Homo Sapiens
GALPYAVGK

SEQ ID NO: 27880 - protein, 9 aa, Homo Sapiens
GANIPVTEK

SEQ ID NO: 27881 - protein, 9 aa, Homo Sapiens
GAQPPSILK

SEQ ID NO: 27882 - protein, 9 aa, Homo Sapiens
GAYDGKFEK

SEQ ID NO: 27883 - protein, 9 aa, Homo Sapiens
GAYGEPRVK

SEQ ID NO: 27884 - protein, 9 aa, Homo Sapiens
GIFPGTPLK

SEQ ID NO: 27885 - protein, 9 aa, Homo Sapiens
GIFSAEFLK

SEQ ID NO: 27886 - protein, 9 aa, Homo Sapiens
GILKPLPKK

SEQ ID NO: 27887 - protein, 9 aa, Homo Sapiens
GILTVRHLK

SEQ ID NO: 27888 - protein, 9 aa, Homo Sapiens
GIMSPLAKK

SEQ ID NO: 27889 - protein, 9 aa, Homo Sapiens
GINKPGFYK

SEQ ID NO: 27890 - protein, 9 aa, Homo Sapiens
GIVECLGPK

SEQ ID NO: 27891 - protein, 9 aa, Homo Sapiens
GIYSVIQKK

SEQ ID NO: 27892 - protein, 9 aa, Homo Sapiens
GIYSVMIQK

SEQ ID NO: 27893 - protein, 9 aa, Homo Sapiens
GLGEPLALK

SEQ ID NO: 27894 - protein, 9 aa, Homo Sapiens
GLGPLVPGK

SEQ ID NO: 27895 - protein, 9 aa, Homo Sapiens
GLMGFIVYK

SEQ ID NO: 27896 - protein, 9 aa, Homo Sapiens
GLVPAAPPK

SEQ ID NO: 27897 - protein, 9 aa, Homo Sapiens
GLYEFPLNK

SEQ ID NO: 27898 - protein, 9 aa, Homo Sapiens
GQCSVPLKK

SEQ ID NO: 27899 - protein, 9 aa, Homo Sapiens
GQFGLSSRK

SEQ ID NO: 27900 - protein, 9 aa, Homo Sapiens
GQHTVLLVK

SEQ ID NO: 27901 - protein, 9 aa, Homo Sapiens
GQSPFQQRK

SEQ ID NO: 27902 - protein, 9 aa, Homo Sapiens
GQYGNPLNK

SEQ ID NO: 27903 - protein, 9 aa, Homo Sapiens
GSACIKVTK

SEQ ID NO: 27904 - protein, 9 aa, Homo Sapiens
GSCGPIKVK

SEQ ID NO: 27905 - protein, 9 aa, Homo Sapiens
GSCKVFFKR

SEQ ID NO: 27906 - protein, 9 aa, Homo Sapiens
GSDLPIIEK

SEQ ID NO: 27907 - protein, 9 aa, Homo Sapiens
GSFKQLTVK

SEQ ID NO: 27908 - protein, 9 aa, Homo Sapiens
GSGKVTFPK

SEQ ID NO: 27909 - protein, 9 aa, Homo Sapiens
GSIDIQHLK

SEQ ID NO: 27910 - protein, 9 aa, Homo Sapiens
GSIGSSFPR

SEQ ID NO: 27911 - protein, 9 aa, Homo Sapiens
GSLASVYHK

SEQ ID NO: 27912 - protein, 9 aa, Homo Sapiens
GSLFLQTPK

SEQ ID NO: 27913 - protein, 9 aa, Homo Sapiens
GSLFLRTPK

SEQ ID NO: 27914 - protein, 9 aa, Homo Sapiens
GSLGGQINK

SEQ ID NO: 27915 - protein, 9 aa, Homo Sapiens
GSLKQFLKK

SEQ ID NO: 27916 - protein, 9 aa, Homo Sapiens
GSLQLPPPR

SEQ ID NO: 27917 - protein, 9 aa, Homo Sapiens
GSLRPFVQK

SEQ ID NO: 27918 - protein, 9 aa, Homo Sapiens
GSMEPAFHR

SEQ ID NO: 27919 - protein, 9 aa, Homo Sapiens
GSMEPGFAK

SEQ ID NO: 27920 - protein, 9 aa, Homo Sapiens
GSMGSFSEK

SEQ ID NO: 27921 - protein, 9 aa, Homo Sapiens
GSNGDTFLK

SEQ ID NO: 27922 - protein, 9 aa, Homo Sapiens
GSNGYILNK

SEQ ID NO: 27923 - protein, 9 aa, Homo Sapiens
GSQFFITTK

SEQ ID NO: 27924 - protein, 9 aa, Homo Sapiens
GSSAINILK

SEQ ID NO: 27925 - protein, 9 aa, Homo Sapiens
GSSDFFTTK

SEQ ID NO: 27926 - protein, 9 aa, Homo Sapiens
GSSDVIIHR

SEQ ID NO: 27927 - protein, 9 aa, Homo Sapiens
GSSKIAIQK

SEQ ID NO: 27928 - protein, 9 aa, Homo Sapiens
GSSTPLIPK

SEQ ID NO: 27929 - protein, 9 aa, Homo Sapiens
GSTHVLTPK

SEQ ID NO: 27930 - protein, 9 aa, Homo Sapiens
GSVYITLKK

SEQ ID NO: 27931 - protein, 9 aa, Homo Sapiens
GSYSKAFAR

SEQ ID NO: 27932 - protein, 9 aa, Homo Sapiens
GTAACIPQK

SEQ ID NO: 27933 - protein, 9 aa, Homo Sapiens
GTADVHFER

SEQ ID NO: 27934 - protein, 9 aa, Homo Sapiens
GTAEVELKK

SEQ ID NO: 27935 - protein, 9 aa, Homo Sapiens
GTAKSQFLK

SEQ ID NO: 27936 - protein, 9 aa, Homo Sapiens
GTAPCPPQR

SEQ ID NO: 27937 - protein, 9 aa, Homo Sapiens
GTATTMVSK

SEQ ID NO: 27938 - protein, 9 aa, Homo Sapiens
GTCFGKFTK

SEQ ID NO: 27939 - protein, 9 aa, Homo Sapiens
GTCLLIANK

SEQ ID NO: 27940 - protein, 9 aa, Homo Sapiens
GTCSSVPPR

SEQ ID NO: 27941 - protein, 9 aa, Homo Sapiens
GTFALNLLK

SEQ ID NO: 27942 - protein, 9 aa, Homo Sapiens
GTFEYIRHK

SEQ ID NO: 27943 - protein, 9 aa, Homo Sapiens
GTFGGLGSK

SEQ ID NO: 27944 - protein, 9 aa, Homo Sapiens
GTFLEGVAK

SEQ ID NO: 27945 - protein, 9 aa, Homo Sapiens
GTFPRAFKK

SEQ ID NO: 27946 - protein, 9 aa, Homo Sapiens
GTFSRLFQK

SEQ ID NO: 27947 - protein, 9 aa, Homo Sapiens
GTGKTLIGK

SEQ ID NO: 27948 - protein, 9 aa, Homo Sapiens
GTGKTTFVK

SEQ ID NO: 27949 - protein, 9 aa, Homo Sapiens
GTGPLCSGK

SEQ ID NO: 27950 - protein, 9 aa, Homo Sapiens
GTGPNVPPR

SEQ ID NO: 27951 - protein, 9 aa, Homo Sapiens
GTIDPWCPK

SEQ ID NO: 27952 - protein, 9 aa, Homo Sapiens
GTIKDIVTR

SEQ ID NO: 27953 - protein, 9 aa, Homo Sapiens
GTINIVHPK

SEQ ID NO: 27954 - protein, 9 aa, Homo Sapiens
GTIPQIFGK

SEQ ID NO: 27955 - protein, 9 aa, Homo Sapiens
GTIPVPKGK

SEQ ID NO: 27956 - protein, 9 aa, Homo Sapiens
GTLAEFIQK

SEQ ID NO: 27957 - protein, 9 aa, Homo Sapiens
GTLASVYHK

SEQ ID NO: 27958 - protein, 9 aa, Homo Sapiens
GTLDFYMAR

SEQ ID NO: 27959 - protein, 9 aa, Homo Sapiens
GTLDSVLRY

SEQ ID NO: 27960 - protein, 9 aa, Homo Sapiens
GTLDYILQR

SEQ ID NO: 27961 - protein, 9 aa, Homo Sapiens
GTLGGMLTR

SEQ ID NO: 27962 - protein, 9 aa, Homo Sapiens
GTLGVAQHR

SEQ ID NO: 27963 - protein, 9 aa, Homo Sapiens
GTLNQPLTK

SEQ ID NO: 27964 - protein, 9 aa, Homo Sapiens
GTLPAKLLK

SEQ ID NO: 27965 - protein, 9 aa, Homo Sapiens
GTLPKALTK

SEQ ID NO: 27966 - protein, 9 aa, Homo Sapiens
GTLPVSQPK

SEQ ID NO: 27967 - protein, 9 aa, Homo Sapiens
GTLSSWNLK

SEQ ID NO: 27968 - protein, 9 aa, Homo Sapiens
GTMDMSITR

SEQ ID NO: 27969 - protein, 9 aa, Homo Sapiens
GTMEWIMIK

SEQ ID NO: 27970 - protein, 9 aa, Homo Sapiens
GTMPVSLLK

SEQ ID NO: 27971 - protein, 9 aa, Homo Sapiens
GTMTGMLYK

SEQ ID NO: 27972 - protein, 9 aa, Homo Sapiens
GTNFTKLEK

SEQ ID NO: 27973 - protein, 9 aa, Homo Sapiens
GTNPGIITK

SEQ ID NO: 27974 - protein, 9 aa, Homo Sapiens
GTNSVICSK

SEQ ID NO: 27975 - protein, 9 aa, Homo Sapiens
GTPEKPLYH

SEQ ID NO: 27976 - protein, 9 aa, Homo Sapiens
GTPLETIQK

SEQ ID NO: 27977 - protein, 9 aa, Homo Sapiens
GTQNRPLLR

SEQ ID NO: 27978 - protein, 9 aa, Homo Sapiens
GTQPYFFNK

SEQ ID NO: 27979 - protein, 9 aa, Homo Sapiens
GTQSFVFQR

SEQ ID NO: 27980 - protein, 9 aa, Homo Sapiens
GTQSKAFYK

SEQ ID NO: 27981 - protein, 9 aa, Homo Sapiens
GTQSVTLTH

SEQ ID NO: 27982 - protein, 9 aa, Homo Sapiens
GTSDEFIEK

SEQ ID NO: 27983 - protein, 9 aa, Homo Sapiens
GTSGLILKR

SEQ ID NO: 27984 - protein, 9 aa, Homo Sapiens
GTSITVPQK

SEQ ID NO: 27985 - protein, 9 aa, Homo Sapiens
GTSPPLTPR

SEQ ID NO: 27986 - protein, 9 aa, Homo Sapiens
GTSSAVSLK

SEQ ID NO: 27987 - protein, 9 aa, Homo Sapiens
GTSSMIVPK

SEQ ID NO: 27988 - protein, 9 aa, Homo Sapiens
GTSSVIVSR

SEQ ID NO: 27989 - protein, 9 aa, Homo Sapiens
GTTAYISLK

SEQ ID NO: 27990 - protein, 9 aa, Homo Sapiens
GTTEWFHLK

SEQ ID NO: 27991 - protein, 9 aa, Homo Sapiens
GTTKVDALK

SEQ ID NO: 27992 - protein, 9 aa, Homo Sapiens
GTTRFAHLK

SEQ ID NO: 27993 - protein, 9 aa, Homo Sapiens
GTTSDQFLR

SEQ ID NO: 27994 - protein, 9 aa, Homo Sapiens
GTVLFEIKK

SEQ ID NO: 27995 - protein, 9 aa, Homo Sapiens
GTVSPLFQK

SEQ ID NO: 27996 - protein, 9 aa, Homo Sapiens
GTVTKVIPK

SEQ ID NO: 27997 - protein, 9 aa, Homo Sapiens
GTWIYSVNK

SEQ ID NO: 27998 - protein, 9 aa, Homo Sapiens
GTYGFWYPK

SEQ ID NO: 27999 - protein, 9 aa, Homo Sapiens
GTYHGMTLK

SEQ ID NO: 28000 - protein, 9 aa, Homo Sapiens
GTYPWVVDR

SEQ ID NO: 28001 - protein, 9 aa, Homo Sapiens
GTYQDRLTK

SEQ ID NO: 28002 - protein, 9 aa, Homo Sapiens
GTYRDANIK

SEQ ID NO: 28003 - protein, 9 aa, Homo Sapiens
GTYSIGKEK

SEQ ID NO: 28004 - protein, 9 aa, Homo Sapiens
GTYSKIMNH

SEQ ID NO: 28005 - protein, 9 aa, Homo Sapiens
GTYTDVTPR

SEQ ID NO: 28006 - protein, 9 aa, Homo Sapiens
GTYVSSVPR

SEQ ID NO: 28007 - protein, 9 aa, Homo Sapiens
GVADKILKK

SEQ ID NO: 28008 - protein, 9 aa, Homo Sapiens
GVAFIFNQK

SEQ ID NO: 28009 - protein, 9 aa, Homo Sapiens
GVAGGSILK

SEQ ID NO: 28010 - protein, 9 aa, Homo Sapiens
GVAGPLGQK

SEQ ID NO: 28011 - protein, 9 aa, Homo Sapiens
GVANALAHR

SEQ ID NO: 28012 - protein, 9 aa, Homo Sapiens
GVCGPPPSK

SEQ ID NO: 28013 - protein, 9 aa, Homo Sapiens
GVCTKITQK

SEQ ID NO: 28014 - protein, 9 aa, Homo Sapiens
GVDDKFYSK

SEQ ID NO: 28015 - protein, 9 aa, Homo Sapiens
GVDPNQYTK

SEQ ID NO: 28016 - protein, 9 aa, Homo Sapiens
GVEGPRTPK

SEQ ID NO: 28017 - protein, 9 aa, Homo Sapiens
GVFEPTIVK

SEQ ID NO: 28018 - protein, 9 aa, Homo Sapiens
GVFEYFNAK

SEQ ID NO: 28019 - protein, 9 aa, Homo Sapiens
GVIIVGNPK

SEQ ID NO: 28020 - protein, 9 aa, Homo Sapiens
GVIVHIIEK

SEQ ID NO: 28021 - protein, 9 aa, Homo Sapiens
GVLAWVKEK

SEQ ID NO: 28022 - protein, 9 aa, Homo Sapiens
GVLGPIINK

SEQ ID NO: 28023 - protein, 9 aa, Homo Sapiens
GVMPSHFSR

SEQ ID NO: 28024 - protein, 9 aa, Homo Sapiens
GVMSPPLSR

SEQ ID NO: 28025 - protein, 9 aa, Homo Sapiens
GVMTVLIKR

SEQ ID NO: 28026 - protein, 9 aa, Homo Sapiens
GVMVYGIKK

SEQ ID NO: 28027 - protein, 9 aa, Homo Sapiens
GVNPYILKK

SEQ ID NO: 28028 - protein, 9 aa, Homo Sapiens
GVSAATFLK

SEQ ID NO: 28029 - protein, 9 aa, Homo Sapiens
GVSSVIHPK

SEQ ID NO: 28030 - protein, 9 aa, Homo Sapiens
GVTRVTIRK

SEQ ID NO: 28031 - protein, 9 aa, Homo Sapiens
GVVPFSQRK

SEQ ID NO: 28032 - protein, 9 aa, Homo Sapiens
GVVRIYHRK

SEQ ID NO: 28033 - protein, 9 aa, Homo Sapiens
GVYDVVELK

SEQ ID NO: 28034 - protein, 9 aa, Homo Sapiens
HAVPPLVPK

SEQ ID NO: 28035 - protein, 9 aa, Homo Sapiens
HIAEPNYGK

SEQ ID NO: 28036 - protein, 9 aa, Homo Sapiens
HIFMKVFPK

SEQ ID NO: 28037 - protein, 9 aa, Homo Sapiens
HSMDFVAYR

SEQ ID NO: 28038 - protein, 9 aa, Homo Sapiens
HSQPFAWKK

SEQ ID NO: 28039 - protein, 9 aa, Homo Sapiens
HTDKGSFLK

SEQ ID NO: 28040 - protein, 9 aa, Homo Sapiens
HTIDWVREK

SEQ ID NO: 28041 - protein, 9 aa, Homo Sapiens
HTLEPLIPR

SEQ ID NO: 28042 - protein, 9 aa, Homo Sapiens
HTSQVLVDK

SEQ ID NO: 28043 - protein, 9 aa, Homo Sapiens
HTYYKFDYK

SEQ ID NO: 28044 - protein, 9 aa, Homo Sapiens
HVIETLIGK

SEQ ID NO: 28045 - protein, 9 aa, Homo Sapiens
HVYRERFPK

SEQ ID NO: 28046 - protein, 9 aa, Homo Sapiens
IAQPQLPPK

SEQ ID NO: 28047 - protein, 9 aa, Homo Sapiens
IIGTIFIIK

SEQ ID NO: 28048 - protein, 9 aa, Homo Sapiens
ILGPNLGDK

SEQ ID NO: 28049 - protein, 9 aa, Homo Sapiens
ILYDHAHVK

SEQ ID NO: 28050 - protein, 9 aa, Homo Sapiens
IPEKQLVEK

SEQ ID NO: 28051 - protein, 9 aa, Homo Sapiens
IQATPLELK

SEQ ID NO: 28052 - protein, 9 aa, Homo Sapiens
IQNVPLSEK

SEQ ID NO: 28053 - protein, 9 aa, Homo Sapiens
ISQEPFVPK

SEQ ID NO: 28054 - protein, 9 aa, Homo Sapiens
ISYPLHHPK

SEQ ID NO: 28055 - protein, 9 aa, Homo Sapiens
ITGPNMGGK

SEQ ID NO: 28056 - protein, 9 aa, Homo Sapiens
ITGPTGVGK

SEQ ID NO: 28057 - protein, 9 aa, Homo Sapiens
ITSPVVTQK

SEQ ID NO: 28058 - protein, 9 aa, Homo Sapiens
ITVAYTIPK

SEQ ID NO: 28059 - protein, 9 aa, Homo Sapiens
ITVGDIGPK

SEQ ID NO: 28060 - protein, 9 aa, Homo Sapiens
IVAGSLITK

SEQ ID NO: 28061 - protein, 9 aa, Homo Sapiens
IVAGTLTNK

SEQ ID NO: 28062 - protein, 9 aa, Homo Sapiens
IVFSLTFFK

SEQ ID NO: 28063 - protein, 9 aa, Homo Sapiens
IVGDPSTAK

SEQ ID NO: 28064 - protein, 9 aa, Homo Sapiens
IVGPNGVGK

SEQ ID NO: 28065 - protein, 9 aa, Homo Sapiens
IVGTVLIIK

SEQ ID NO: 28066 - protein, 9 aa, Homo Sapiens
IVIETGPLK

SEQ ID NO: 28067 - protein, 9 aa, Homo Sapiens
IVIPPATEK

SEQ ID NO: 28068 - protein, 9 aa, Homo Sapiens
IVMETGNTK

SEQ ID NO: 28069 - protein, 9 aa, Homo Sapiens
IVSAPVPKK

SEQ ID NO: 28070 - protein, 9 aa, Homo Sapiens
IVSQVKVPK

SEQ ID NO: 28071 - protein, 9 aa, Homo Sapiens
IVVPPLPEK

SEQ ID NO: 28072 - protein, 9 aa, Homo Sapiens
IVYPPPPAK

SEQ ID NO: 28073 - protein, 9 aa, Homo Sapiens
KAFVGAFKK

SEQ ID NO: 28074 - protein, 9 aa, Homo Sapiens
KAGEVFIHK

SEQ ID NO: 28075 - protein, 9 aa, Homo Sapiens
KAMESCAFK

SEQ ID NO: 28076 - protein, 9 aa, Homo Sapiens
KAVDITTPK

SEQ ID NO: 28077 - protein, 9 aa, Homo Sapiens
KIADMGHLK

SEQ ID NO: 28078 - protein, 9 aa, Homo Sapiens
KIIAPPERK

SEQ ID NO: 28079 - protein, 9 aa, Homo Sapiens
KILGPFHKR

SEQ ID NO: 28080 - protein, 9 aa, Homo Sapiens
KIMEYYEKK

SEQ ID NO: 28081 - protein, 9 aa, Homo Sapiens
KIQPALQEK

SEQ ID NO: 28082 - protein, 9 aa, Homo Sapiens
KITAPLINK

SEQ ID NO: 28083 - protein, 9 aa, Homo Sapiens
KIYNANYLK

SEQ ID NO: 28084 - protein, 9 aa, Homo Sapiens
KLFDFVNAK

SEQ ID NO: 28085 - protein, 9 aa, Homo Sapiens
KLFNGTFLK

SEQ ID NO: 28086 - protein, 9 aa, Homo Sapiens
KLFNKFIGK

SEQ ID NO: 28087 - protein, 9 aa, Homo Sapiens
KLFSEYHEK

SEQ ID NO: 28088 - protein, 9 aa, Homo Sapiens
KNYYQDTPK

SEQ ID NO: 28089 - protein, 9 aa, Homo Sapiens
KQDSNPLYK

SEQ ID NO: 28090 - protein, 9 aa, Homo Sapiens
KQFENPIIK

SEQ ID NO: 28091 - protein, 9 aa, Homo Sapiens
KQFSKRYLK

SEQ ID NO: 28092 - protein, 9 aa, Homo Sapiens
KSFGELVHK

SEQ ID NO: 28093 - protein, 9 aa, Homo Sapiens
KSIDFPLTK

SEQ ID NO: 28094 - protein, 9 aa, Homo Sapiens
KSINEFWNK

SEQ ID NO: 28095 - protein, 9 aa, Homo Sapiens
KSSDFAVLK

SEQ ID NO: 28096 - protein, 9 aa, Homo Sapiens
KSTEILLRK

SEQ ID NO: 28097 - protein, 9 aa, Homo Sapiens
KTAEISLLK

SEQ ID NO: 28098 - protein, 9 aa, Homo Sapiens
KTCEEILNY

SEQ ID NO: 28099 - protein, 9 aa, Homo Sapiens
KTETPIVSK

SEQ ID NO: 28100 - protein, 9 aa, Homo Sapiens
KTFPYQHRY

SEQ ID NO: 28101 - protein, 9 aa, Homo Sapiens
KTFWQSVSK

SEQ ID NO: 28102 - protein, 9 aa, Homo Sapiens
KTIQVPQQK

SEQ ID NO: 28103 - protein, 9 aa, Homo Sapiens
KTISEAWIK

SEQ ID NO: 28104 - protein, 9 aa, Homo Sapiens
KTIVFVETK

SEQ ID NO: 28105 - protein, 9 aa, Homo Sapiens
KTLGPILKK

SEQ ID NO: 28106 - protein, 9 aa, Homo Sapiens
KTLQDIVYK

SEQ ID NO: 28107 - protein, 9 aa, Homo Sapiens
KTLYPIIGK

SEQ ID NO: 28108 - protein, 9 aa, Homo Sapiens
KTMKDFVRR

SEQ ID NO: 28109 - protein, 9 aa, Homo Sapiens
KTMPTTFNR

SEQ ID NO: 28110 - protein, 9 aa, Homo Sapiens
KTNLTSVTK

SEQ ID NO: 28111 - protein, 9 aa, Homo Sapiens
KTQEPFSVR

SEQ ID NO: 28112 - protein, 9 aa, Homo Sapiens
KTSNCVVLK

SEQ ID NO: 28113 - protein, 9 aa, Homo Sapiens
KTSNLLLSH

SEQ ID NO: 28114 - protein, 9 aa, Homo Sapiens
KTSPPVFSK

SEQ ID NO: 28115 - protein, 9 aa, Homo Sapiens
KVAVVLIQK

SEQ ID NO: 28116 - protein, 9 aa, Homo Sapiens
KVCDIYINY

SEQ ID NO: 28117 - protein, 9 aa, Homo Sapiens
KVCMYFTYK

SEQ ID NO: 28118 - protein, 9 aa, Homo Sapiens
KVCNPIITK

SEQ ID NO: 28119 - protein, 9 aa, Homo Sapiens
KVFAGYYTK

SEQ ID NO: 28120 - protein, 9 aa, Homo Sapiens
KVFGGTVHK

SEQ ID NO: 28121 - protein, 9 aa, Homo Sapiens
KVFHRPWRR

SEQ ID NO: 28122 - protein, 9 aa, Homo Sapiens
KVFKQIFSK

SEQ ID NO: 28123 - protein, 9 aa, Homo Sapiens
KVGEVIVTK

SEQ ID NO: 28124 - protein, 9 aa, Homo Sapiens
KVIDPVTGK

SEQ ID NO: 28125 - protein, 9 aa, Homo Sapiens
KVLDHFRRK

SEQ ID NO: 28126 - protein, 9 aa, Homo Sapiens
KVMGILINR

SEQ ID NO: 28127 - protein, 9 aa, Homo Sapiens
KVQPPGPVK

SEQ ID NO: 28128 - protein, 9 aa, Homo Sapiens
KVSDLTIPK

SEQ ID NO: 28129 - protein, 9 aa, Homo Sapiens
KVSGDIFSR

SEQ ID NO: 28130 - protein, 9 aa, Homo Sapiens
KVSQVIMEK

SEQ ID NO: 28131 - protein, 9 aa, Homo Sapiens
KVSTSPLTK

SEQ ID NO: 28132 - protein, 9 aa, Homo Sapiens
KVVDSLYNK

SEQ ID NO: 28133 - protein, 9 aa, Homo Sapiens
KVVKVTIMK

SEQ ID NO: 28134 - protein, 9 aa, Homo Sapiens
KVVNLPFEK

SEQ ID NO: 28135 - protein, 9 aa, Homo Sapiens
KVYGPGVAK

SEQ ID NO: 28136 - protein, 9 aa, Homo Sapiens
KVYNGILEK

SEQ ID NO: 28137 - protein, 9 aa, Homo Sapiens
KVYTPSISK

SEQ ID NO: 28138 - protein, 9 aa, Homo Sapiens
LAAPPALEK

SEQ ID NO: 28139 - protein, 9 aa, Homo Sapiens
LICDVALGK

SEQ ID NO: 28140 - protein, 9 aa, Homo Sapiens
LINAFHTPK

SEQ ID NO: 28141 - protein, 9 aa, Homo Sapiens
LIQQATTVK

SEQ ID NO: 28142 - protein, 9 aa, Homo Sapiens
LPALKQTPK

SEQ ID NO: 28143 - protein, 9 aa, Homo Sapiens
LPPLSPYFK

SEQ ID NO: 28144 - protein, 9 aa, Homo Sapiens
LQNEPIPER

SEQ ID NO: 28145 - protein, 9 aa, Homo Sapiens
LREDGALSI

SEQ ID NO: 28146 - protein, 9 aa, Homo Sapiens
LSQDCFWTK

SEQ ID NO: 28147 - protein, 9 aa, Homo Sapiens
LTDTSKYPK

SEQ ID NO: 28148 - protein, 9 aa, Homo Sapiens
LTEAPLNPK

SEQ ID NO: 28149 - protein, 9 aa, Homo Sapiens
LTGPPGVGK

SEQ ID NO: 28150 - protein, 9 aa, Homo Sapiens
LTGPVMPVR

SEQ ID NO: 28151 - protein, 9 aa, Homo Sapiens
LTIPEIPPK

SEQ ID NO: 28152 - protein, 9 aa, Homo Sapiens
LTMDKLWRK

SEQ ID NO: 28153 - protein, 9 aa, Homo Sapiens
LTMPGGVAK

SEQ ID NO: 28154 - protein, 9 aa, Homo Sapiens
LTNHFSFEK

SEQ ID NO: 28155 - protein, 9 aa, Homo Sapiens
LTTAVITNK

SEQ ID NO: 28156 - protein, 9 aa, Homo Sapiens
LTYEFVKQK

SEQ ID NO: 28157 - protein, 9 aa, Homo Sapiens
LTYNDFINK

SEQ ID NO: 28158 - protein, 9 aa, Homo Sapiens
LVANFFPKK

SEQ ID NO: 28159 - protein, 9 aa, Homo Sapiens
LVFDVELLK

SEQ ID NO: 28160 - protein, 9 aa, Homo Sapiens
LVFDWNTPK

SEQ ID NO: 28161 - protein, 9 aa, Homo Sapiens
LVFEWTIVK

SEQ ID NO: 28162 - protein, 9 aa, Homo Sapiens
LVIDSAVEK

SEQ ID NO: 28163 - protein, 9 aa, Homo Sapiens
LVIPFTIKK

SEQ ID NO: 28164 - protein, 9 aa, Homo Sapiens
LVMEGHLFK

SEQ ID NO: 28165 - protein, 9 aa, Homo Sapiens
LVMTHLILK

SEQ ID NO: 28166 - protein, 9 aa, Homo Sapiens
LVQQSCNYK

SEQ ID NO: 28167 - protein, 9 aa, Homo Sapiens
LVSTPVRTK

SEQ ID NO: 28168 - protein, 9 aa, Homo Sapiens
MAAAAFAEK

SEQ ID NO: 28169 - protein, 9 aa, Homo Sapiens
MIFHSPYCK

SEQ ID NO: 28170 - protein, 9 aa, Homo Sapiens
MMFSATFPK

SEQ ID NO: 28171 - protein, 9 aa, Homo Sapiens
MPKDIQLAR

SEQ ID NO: 28172 - protein, 9 aa, Homo Sapiens
MSQDFGWNK

SEQ ID NO: 28173 - protein, 9 aa, Homo Sapiens
MTYAQKIFK

SEQ ID NO: 28174 - protein, 9 aa, Homo Sapiens
MVANLLYEK

SEQ ID NO: 28175 - protein, 9 aa, Homo Sapiens
MVGVNLPQK

SEQ ID NO: 28176 - protein, 9 aa, Homo Sapiens
MVMDKKHFK

SEQ ID NO: 28177 - protein, 9 aa, Homo Sapiens
MVQQDYFPK

SEQ ID NO: 28178 - protein, 9 aa, Homo Sapiens
NAIKWNFTK

SEQ ID NO: 28179 - protein, 9 aa, Homo Sapiens
NFFASPMLK

SEQ ID NO: 28180 - protein, 9 aa, Homo Sapiens
NICSIYNLK

SEQ ID NO: 28181 - protein, 9 aa, Homo Sapiens
NSLIFLKPN

SEQ ID NO: 28182 - protein, 9 aa, Homo Sapiens
NSMGLFLQK

SEQ ID NO: 28183 - protein, 9 aa, Homo Sapiens
NTMNQFVNK

SEQ ID NO: 28184 - protein, 9 aa, Homo Sapiens
NTMQQFLQK

SEQ ID NO: 28185 - protein, 9 aa, Homo Sapiens
NVGPLIIKK

SEQ ID NO: 28186 - protein, 9 aa, Homo Sapiens
NVYEVVNPK

SEQ ID NO: 28187 - protein, 9 aa, Homo Sapiens
PEFPLSPPK

SEQ ID NO: 28188 - protein, 9 aa, Homo Sapiens
QAADILLYK

SEQ ID NO: 28189 - protein, 9 aa, Homo Sapiens
QAFAQVFNK

SEQ ID NO: 28190 - protein, 9 aa, Homo Sapiens
QAQEVFFLK

SEQ ID NO: 28191 - protein, 9 aa, Homo Sapiens
QEFGLARFK

SEQ ID NO: 28192 - protein, 9 aa, Homo Sapiens
QICDTYNQK

SEQ ID NO: 28193 - protein, 9 aa, Homo Sapiens
QIFIPMVNK

SEQ ID NO: 28194 - protein, 9 aa, Homo Sapiens
QIFKPIISK

SEQ ID NO: 28195 - protein, 9 aa, Homo Sapiens
QIFSEFLLK

SEQ ID NO: 28196 - protein, 9 aa, Homo Sapiens
QIGPAPPLK

SEQ ID NO: 28197 - protein, 9 aa, Homo Sapiens
QINGEIICK

SEQ ID NO: 28198 - protein, 9 aa, Homo Sapiens
QISEVVVVK

SEQ ID NO: 28199 - protein, 9 aa, Homo Sapiens
QITLPTVQK

SEQ ID NO: 28200 - protein, 9 aa, Homo Sapiens
QIYTYFVYK

SEQ ID NO: 28201 - protein, 9 aa, Homo Sapiens
QLYWSHPRK

SEQ ID NO: 28202 - protein, 9 aa, Homo Sapiens
QQLYWSHPR

SEQ ID NO: 28203 - protein, 9 aa, Homo Sapiens
QSCYIIISK

SEQ ID NO: 28204 - protein, 9 aa, Homo Sapiens
QTAGNVFLK

SEQ ID NO: 28205 - protein, 9 aa, Homo Sapiens
QTCRLLLSY

SEQ ID NO: 28206 - protein, 9 aa, Homo Sapiens
QTGPVPPGR

SEQ ID NO: 28207 - protein, 9 aa, Homo Sapiens
QTLSPQMWK

SEQ ID NO: 28208 - protein, 9 aa, Homo Sapiens
QTQPIYLAK

SEQ ID NO: 28209 - protein, 9 aa, Homo Sapiens
QTQSIYIPR

SEQ ID NO: 28210 - protein, 9 aa, Homo Sapiens
QTYGQQLQK

SEQ ID NO: 28211 - protein, 9 aa, Homo Sapiens
QTYVGITEK

SEQ ID NO: 28212 - protein, 9 aa, Homo Sapiens
QVADVVVSR

SEQ ID NO: 28213 - protein, 9 aa, Homo Sapiens
QVDPNFYSK

SEQ ID NO: 28214 - protein, 9 aa, Homo Sapiens
QVFEFTEPK

SEQ ID NO: 28215 - protein, 9 aa, Homo Sapiens
QVFQKSLPK

SEQ ID NO: 28216 - protein, 9 aa, Homo Sapiens
QVIPASEPK

SEQ ID NO: 28217 - protein, 9 aa, Homo Sapiens
QVQAAQFAK

SEQ ID NO: 28218 - protein, 9 aa, Homo Sapiens
QVQDCHVLK

SEQ ID NO: 28219 - protein, 9 aa, Homo Sapiens
QVTDFGFAK

SEQ ID NO: 28220 - protein, 9 aa, Homo Sapiens
RAAIPIAKR

SEQ ID NO: 28221 - protein, 9 aa, Homo Sapiens
RAAPFSLEY

SEQ ID NO: 28222 - protein, 9 aa, Homo Sapiens
RAMEWITAK

SEQ ID NO: 28223 - protein, 9 aa, Homo Sapiens
RAPEPLPPK

SEQ ID NO: 28224 - protein, 9 aa, Homo Sapiens
RAQDLPLKK

SEQ ID NO: 28225 - protein, 9 aa, Homo Sapiens
RAVPFNAPK

SEQ ID NO: 28226 - protein, 9 aa, Homo Sapiens
RAYHLLVKK

SEQ ID NO: 28227 - protein, 9 aa, Homo Sapiens
RAYPHVFTK

SEQ ID NO: 28228 - protein, 9 aa, Homo Sapiens
RESASAKIK

SEQ ID NO: 28229 - protein, 9 aa, Homo Sapiens
RIAEFAFEY

SEQ ID NO: 28230 - protein, 9 aa, Homo Sapiens
RIAKNLVEK

SEQ ID NO: 28231 - protein, 9 aa, Homo Sapiens
RICEILLQY

SEQ ID NO: 28232 - protein, 9 aa, Homo Sapiens
RIFDLGRKK

SEQ ID NO: 28233 - protein, 9 aa, Homo Sapiens
RIFEPPPPK

SEQ ID NO: 28234 - protein, 9 aa, Homo Sapiens
RIIDEVVNK

SEQ ID NO: 28235 - protein, 9 aa, Homo Sapiens
RIIDLVLQK

SEQ ID NO: 28236 - protein, 9 aa, Homo Sapiens
RIIEPLTSR

SEQ ID NO: 28237 - protein, 9 aa, Homo Sapiens
RIKEIFCPK

SEQ ID NO: 28238 - protein, 9 aa, Homo Sapiens
RILACGVAK

SEQ ID NO: 28239 - protein, 9 aa, Homo Sapiens
RILFFNTPK

SEQ ID NO: 28240 - protein, 9 aa, Homo Sapiens
RIQINPQNK

SEQ ID NO: 28241 - protein, 9 aa, Homo Sapiens
RIQLPVVSK

SEQ ID NO: 28242 - protein, 9 aa, Homo Sapiens
RITTHFELK

SEQ ID NO: 28243 - protein, 9 aa, Homo Sapiens
RIYDIFRSK

SEQ ID NO: 28244 - protein, 9 aa, Homo Sapiens
RLADSLIGK

SEQ ID NO: 28245 - protein, 9 aa, Homo Sapiens
RLCDQKFPK

SEQ ID NO: 28246 - protein, 9 aa, Homo Sapiens
RLFCVGFTK

SEQ ID NO: 28247 - protein, 9 aa, Homo Sapiens
RLFHLHSQK

SEQ ID NO: 28248 - protein, 9 aa, Homo Sapiens
RLFLFQIQK

SEQ ID NO: 28249 - protein, 9 aa, Homo Sapiens
RLFVGSIPK

SEQ ID NO: 28250 - protein, 9 aa, Homo Sapiens
RLMEIYQEK

SEQ ID NO: 28251 - protein, 9 aa, Homo Sapiens
RLMSLPIAK

SEQ ID NO: 28252 - protein, 9 aa, Homo Sapiens
RLQEIFTEK

SEQ ID NO: 28253 - protein, 9 aa, Homo Sapiens
RQFWTRTKK

SEQ ID NO: 28254 - protein, 9 aa, Homo Sapiens
RQIPYTMMK

SEQ ID NO: 28255 - protein, 9 aa, Homo Sapiens
RQVIPIIGK

SEQ ID NO: 28256 - protein, 9 aa, Homo Sapiens
RSCVVIIQK

SEQ ID NO: 28257 - protein, 9 aa, Homo Sapiens
RSDTPLIYK

SEQ ID NO: 28258 - protein, 9 aa, Homo Sapiens
RSFEEAFQK

SEQ ID NO: 28259 - protein, 9 aa, Homo Sapiens
RSLDNFFAK

SEQ ID NO: 28260 - protein, 9 aa, Homo Sapiens
RSMHEFSAK

SEQ ID NO: 28261 - protein, 9 aa, Homo Sapiens
RSNPYYIVK

SEQ ID NO: 28262 - protein, 9 aa, Homo Sapiens
RSVSIPAPA

SEQ ID NO: 28263 - protein, 9 aa, Homo Sapiens
RTAHVILRY

SEQ ID NO: 28264 - protein, 9 aa, Homo Sapiens
RTDKRFFLK

SEQ ID NO: 28265 - protein, 9 aa, Homo Sapiens
RTFSYIKNK

SEQ ID NO: 28266 - protein, 9 aa, Homo Sapiens
RTFTWLVGK

SEQ ID NO: 28267 - protein, 9 aa, Homo Sapiens
RTIAPIIGR

SEQ ID NO: 28268 - protein, 9 aa, Homo Sapiens
RTIDRSVFK

SEQ ID NO: 28269 - protein, 9 aa, Homo Sapiens
RTIFPLFMK

SEQ ID NO: 28270 - protein, 9 aa, Homo Sapiens
RTIQTFVKK

SEQ ID NO: 28271 - protein, 9 aa, Homo Sapiens
RTLEPLAKK

SEQ ID NO: 28272 - protein, 9 aa, Homo Sapiens
RTNWPNTGK

SEQ ID NO: 28273 - protein, 9 aa, Homo Sapiens
RTQNVLGEK

SEQ ID NO: 28274 - protein, 9 aa, Homo Sapiens
RTSEIYVHR

SEQ ID NO: 28275 - protein, 9 aa, Homo Sapiens
RTYYSPVYR

SEQ ID NO: 28276 - protein, 9 aa, Homo Sapiens
RVARYFEYK

SEQ ID NO: 28277 - protein, 9 aa, Homo Sapiens
RVFNIMREK

SEQ ID NO: 28278 - protein, 9 aa, Homo Sapiens
RVFPWFSVK

SEQ ID NO: 28279 - protein, 9 aa, Homo Sapiens
RVHSIFVLR

SEQ ID NO: 28280 - protein, 9 aa, Homo Sapiens
RVIAKALEK

SEQ ID NO: 28281 - protein, 9 aa, Homo Sapiens
RVIAPPLIK

SEQ ID NO: 28282 - protein, 9 aa, Homo Sapiens
RVLEDRALK

SEQ ID NO: 28283 - protein, 9 aa, Homo Sapiens
RVLPEFKKK

SEQ ID NO: 28284 - protein, 9 aa, Homo Sapiens
RVLPYPFTH

SEQ ID NO: 28285 - protein, 9 aa, Homo Sapiens
RVLSKAFSR

SEQ ID NO: 28286 - protein, 9 aa, Homo Sapiens
RVMGIRVLR

SEQ ID NO: 28287 - protein, 9 aa, Homo Sapiens
RVMKALVNR

SEQ ID NO: 28288 - protein, 9 aa, Homo Sapiens
RVMQDIVYK

SEQ ID NO: 28289 - protein, 9 aa, Homo Sapiens
RVNKLICVK

SEQ ID NO: 28290 - protein, 9 aa, Homo Sapiens
RVNKPPYPK

SEQ ID NO: 28291 - protein, 9 aa, Homo Sapiens
RVQEVPKLK

SEQ ID NO: 28292 - protein, 9 aa, Homo Sapiens
RVQGFQVEY

SEQ ID NO: 28293 - protein, 9 aa, Homo Sapiens
RVSYQKLLK

SEQ ID NO: 28294 - protein, 9 aa, Homo Sapiens
RVTDLFIGK

SEQ ID NO: 28295 - protein, 9 aa, Homo Sapiens
RVTPFILKK

SEQ ID NO: 28296 - protein, 9 aa, Homo Sapiens
RVVDLLVIK

SEQ ID NO: 28297 - protein, 9 aa, Homo Sapiens
RVYHYFQWR

SEQ ID NO: 28298 - protein, 9 aa, Homo Sapiens
RVYNIYIRR

SEQ ID NO: 28299 - protein, 9 aa, Homo Sapiens
RVYPESIPR

SEQ ID NO: 28300 - protein, 9 aa, Homo Sapiens
SAAAALVLK

SEQ ID NO: 28301 - protein, 9 aa, Homo Sapiens
SAAPAITCR

SEQ ID NO: 28302 - protein, 9 aa, Homo Sapiens
SAAVITPFK

SEQ ID NO: 28303 - protein, 9 aa, Homo Sapiens
SAFGQAFSK

SEQ ID NO: 28304 - protein, 9 aa, Homo Sapiens
SAFGVIIEK

SEQ ID NO: 28305 - protein, 9 aa, Homo Sapiens
SAFQHFWNR

SEQ ID NO: 28306 - protein, 9 aa, Homo Sapiens
SAFSTSISK

SEQ ID NO: 28307 - protein, 9 aa, Homo Sapiens
SAFVERVRK

SEQ ID NO: 28308 - protein, 9 aa, Homo Sapiens
SAFYVPFAK

SEQ ID NO: 28309 - protein, 9 aa, Homo Sapiens
SAGPHLPLK

SEQ ID NO: 28310 - protein, 9 aa, Homo Sapiens
SAGPPSLRK

SEQ ID NO: 28311 - protein, 9 aa, Homo Sapiens
SAITGPVAK

SEQ ID NO: 28312 - protein, 9 aa, Homo Sapiens
SALDFLHNK

SEQ ID NO: 28313 - protein, 9 aa, Homo Sapiens
SALDYNEAK

SEQ ID NO: 28314 - protein, 9 aa, Homo Sapiens
SALGSSSYK

SEQ ID NO: 28315 - protein, 9 aa, Homo Sapiens
SALHIAIEK

SEQ ID NO: 28316 - protein, 9 aa, Homo Sapiens
SALSVAPSK

SEQ ID NO: 28317 - protein, 9 aa, Homo Sapiens
SAMERICEK

SEQ ID NO: 28318 - protein, 9 aa, Homo Sapiens
SAPKPGPLK

SEQ ID NO: 28319 - protein, 9 aa, Homo Sapiens
SAPSSSTPF

SEQ ID NO: 28320 - protein, 9 aa, Homo Sapiens
SAQGNVYVK

SEQ ID NO: 28321 - protein, 9 aa, Homo Sapiens
SAQNTKFFK

SEQ ID NO: 28322 - protein, 9 aa, Homo Sapiens
SAQSFFENK

SEQ ID NO: 28323 - protein, 9 aa, Homo Sapiens
SASASLPTK

SEQ ID NO: 28324 - protein, 9 aa, Homo Sapiens
SATQAVFQK

SEQ ID NO: 28325 - protein, 9 aa, Homo Sapiens
SATTSPFFK

SEQ ID NO: 28326 - protein, 9 aa, Homo Sapiens
SAVDPVQMK

SEQ ID NO: 28327 - protein, 9 aa, Homo Sapiens
SAVGTIVKK

SEQ ID NO: 28328 - protein, 9 aa, Homo Sapiens
SAVLFTITK

SEQ ID NO: 28329 - protein, 9 aa, Homo Sapiens
SAVRPVIEK

SEQ ID NO: 28330 - protein, 9 aa, Homo Sapiens
SDQFPLPLK

SEQ ID NO: 28331 - protein, 9 aa, Homo Sapiens
SGIQVRYLK

SEQ ID NO: 28332 - protein, 9 aa, Homo Sapiens
SGMDYWIVK

SEQ ID NO: 28333 - protein, 9 aa, Homo Sapiens
SGSPATPLK

SEQ ID NO: 28334 - protein, 9 aa, Homo Sapiens
SIAAAVAPK

SEQ ID NO: 28335 - protein, 9 aa, Homo Sapiens
SIAPPVPLK

SEQ ID NO: 28336 - protein, 9 aa, Homo Sapiens
SICGKMFKK

SEQ ID NO: 28337 - protein, 9 aa, Homo Sapiens
SICGKSFTK

SEQ ID NO: 28338 - protein, 9 aa, Homo Sapiens
SICGKTFNK

SEQ ID NO: 28339 - protein, 9 aa, Homo Sapiens
SIDEHFQPK

SEQ ID NO: 28340 - protein, 9 aa, Homo Sapiens
SIFDKIREK

SEQ ID NO: 28341 - protein, 9 aa, Homo Sapiens
SIFKQPVTK

SEQ ID NO: 28342 - protein, 9 aa, Homo Sapiens
SIFPYVTTK

SEQ ID NO: 28343 - protein, 9 aa, Homo Sapiens
SIFRTPISK

SEQ ID NO: 28344 - protein, 9 aa, Homo Sapiens
SIFSKFTSK

SEQ ID NO: 28345 - protein, 9 aa, Homo Sapiens
SIGPSIVCK

SEQ ID NO: 28346 - protein, 9 aa, Homo Sapiens
SIGTPLDPK

SEQ ID NO: 28347 - protein, 9 aa, Homo Sapiens
SIIETLRQK

SEQ ID NO: 28348 - protein, 9 aa, Homo Sapiens
SIISVLPWK

SEQ ID NO: 28349 - protein, 9 aa, Homo Sapiens
SILKESKYK

SEQ ID NO: 28350 - protein, 9 aa, Homo Sapiens
SILNNPIVK

SEQ ID NO: 28351 - protein, 9 aa, Homo Sapiens
SILNWVKFK

SEQ ID NO: 28352 - protein, 9 aa, Homo Sapiens
SILPAIFQK

SEQ ID NO: 28353 - protein, 9 aa, Homo Sapiens
SILSGGTPK

SEQ ID NO: 28354 - protein, 9 aa, Homo Sapiens
SIMDFNSEK

SEQ ID NO: 28355 - protein, 9 aa, Homo Sapiens
SIMKWNRER

SEQ ID NO: 28356 - protein, 9 aa, Homo Sapiens
SIMSSHVMK

SEQ ID NO: 28357 - protein, 9 aa, Homo Sapiens
SIPTFYFPR

SEQ ID NO: 28358 - protein, 9 aa, Homo Sapiens
SIQHPLIKK

SEQ ID NO: 28359 - protein, 9 aa, Homo Sapiens
SISAVVMEK

SEQ ID NO: 28360 - protein, 9 aa, Homo Sapiens
SISSPQPGK

SEQ ID NO: 28361 - protein, 9 aa, Homo Sapiens
SITGFFQRK

SEQ ID NO: 28362 - protein, 9 aa, Homo Sapiens
SITSVFITK

SEQ ID NO: 28363 - protein, 9 aa, Homo Sapiens
SIVSQTIPK

SEQ ID NO: 28364 - protein, 9 aa, Homo Sapiens
SIWDETLYK

SEQ ID NO: 28365 - protein, 9 aa, Homo Sapiens
SIWDYFIAK

SEQ ID NO: 28366 - protein, 9 aa, Homo Sapiens
SIYVYKVLK

SEQ ID NO: 28367 - protein, 9 aa, Homo Sapiens
SIYYVDVQK

SEQ ID NO: 28368 - protein, 9 aa, Homo Sapiens
SLADFQIEK

SEQ ID NO: 28369 - protein, 9 aa, Homo Sapiens
SLAPVNIFK

SEQ ID NO: 28370 - protein, 9 aa, Homo Sapiens
SLFGSPVAK

SEQ ID NO: 28371 - protein, 9 aa, Homo Sapiens
SLFNTGFLK

SEQ ID NO: 28372 - protein, 9 aa, Homo Sapiens
SLFSRLFGK

SEQ ID NO: 28373 - protein, 9 aa, Homo Sapiens
SLGQVVITK

SEQ ID NO: 28374 - protein, 9 aa, Homo Sapiens
SLLGHVYCK

SEQ ID NO: 28375 - protein, 9 aa, Homo Sapiens
SLLGYFPNK

SEQ ID NO: 28376 - protein, 9 aa, Homo Sapiens
SLLNVSTPK

SEQ ID NO: 28377 - protein, 9 aa, Homo Sapiens
SLLRDLTPK

SEQ ID NO: 28378 - protein, 9 aa, Homo Sapiens
SLMHSFILK

SEQ ID NO: 28379 - protein, 9 aa, Homo Sapiens
SLMNVPLFK

SEQ ID NO: 28380 - protein, 9 aa, Homo Sapiens
SLMPWFHGK

SEQ ID NO: 28381 - protein, 9 aa, Homo Sapiens
SLPYPPKTL

SEQ ID NO: 28382 - protein, 9 aa, Homo Sapiens
SLQDYIAVK

SEQ ID NO: 28383 - protein, 9 aa, Homo Sapiens
SLQELFLAH

SEQ ID NO: 28384 - protein, 9 aa, Homo Sapiens
SLQPSISQK

SEQ ID NO: 28385 - protein, 9 aa, Homo Sapiens
SLQRWEHLK

SEQ ID NO: 28386 - protein, 9 aa, Homo Sapiens
SLSEKTWSK

SEQ ID NO: 28387 - protein, 9 aa, Homo Sapiens
SLSPVILIK

SEQ ID NO: 28388 - protein, 9 aa, Homo Sapiens
SLSSPLNPK

SEQ ID NO: 28389 - protein, 9 aa, Homo Sapiens
SLTPVTPQK

SEQ ID NO: 28390 - protein, 9 aa, Homo Sapiens
SLTQKEIAK

SEQ ID NO: 28391 - protein, 9 aa, Homo Sapiens
SLYWLSTQK

SEQ ID NO: 28392 - protein, 9 aa, Homo Sapiens
SMWDYFVAK

SEQ ID NO: 28393 - protein, 9 aa, Homo Sapiens
SNDGATILK

SEQ ID NO: 28394 - protein, 9 aa, Homo Sapiens
SQCGSLIGK

SEQ ID NO: 28395 - protein, 9 aa, Homo Sapiens
SQFSLPVQK

SEQ ID NO: 28396 - protein, 9 aa, Homo Sapiens
SQGTPISLK

SEQ ID NO: 28397 - protein, 9 aa, Homo Sapiens
SQLGIFISK

SEQ ID NO: 28398 - protein, 9 aa, Homo Sapiens
SQMEQFPVK

SEQ ID NO: 28399 - protein, 9 aa, Homo Sapiens
SQNPRFYHK

SEQ ID NO: 28400 - protein, 9 aa, Homo Sapiens
SQPGLVHPK

SEQ ID NO: 28401 - protein, 9 aa, Homo Sapiens
SQQKAFFAK

SEQ ID NO: 28402 - protein, 9 aa, Homo Sapiens
SSAGPGLLK

SEQ ID NO: 28403 - protein, 9 aa, Homo Sapiens
SSAHWPIFK

SEQ ID NO: 28404 - protein, 9 aa, Homo Sapiens
SSAPPLTGK

SEQ ID NO: 28405 - protein, 9 aa, Homo Sapiens
SSAPQNIPK

SEQ ID NO: 28406 - protein, 9 aa, Homo Sapiens
SSCPQQWIK

SEQ ID NO: 28407 - protein, 9 aa, Homo Sapiens
SSCQTIIPK

SEQ ID NO: 28408 - protein, 9 aa, Homo Sapiens
SSFEHEFKK

SEQ ID NO: 28409 - protein, 9 aa, Homo Sapiens
SSFGNMIYK

SEQ ID NO: 28410 - protein, 9 aa, Homo Sapiens
SSFGTILRK

SEQ ID NO: 28411 - protein, 9 aa, Homo Sapiens
SSFLIKRNK

SEQ ID NO: 28412 - protein, 9 aa, Homo Sapiens
SSFPAYMSK

SEQ ID NO: 28413 - protein, 9 aa, Homo Sapiens
SSFQFSIQK

SEQ ID NO: 28414 - protein, 9 aa, Homo Sapiens
SSFSGLLRK

SEQ ID NO: 28415 - protein, 9 aa, Homo Sapiens
SSFSSPHMK

SEQ ID NO: 28416 - protein, 9 aa, Homo Sapiens
SSGDIFLEK

SEQ ID NO: 28417 - protein, 9 aa, Homo Sapiens
SSGPSTPLK

SEQ ID NO: 28418 - protein, 9 aa, Homo Sapiens
SSGVPNPPK

SEQ ID NO: 28419 - protein, 9 aa, Homo Sapiens
SSHLPPPPK

SEQ ID NO: 28420 - protein, 9 aa, Homo Sapiens
SSIFVAPRK

SEQ ID NO: 28421 - protein, 9 aa, Homo Sapiens
SSINSRFAK

SEQ ID NO: 28422 - protein, 9 aa, Homo Sapiens
SSIQGQWPK

SEQ ID NO: 28423 - protein, 9 aa, Homo Sapiens
SSIRHMIRK

SEQ ID NO: 28424 - protein, 9 aa, Homo Sapiens
SSKLLATSK

SEQ ID NO: 28425 - protein, 9 aa, Homo Sapiens
SSLFSLLSK

SEQ ID NO: 28426 - protein, 9 aa, Homo Sapiens
SSLKGGLLK

SEQ ID NO: 28427 - protein, 9 aa, Homo Sapiens
SSLNHIVEK

SEQ ID NO: 28428 - protein, 9 aa, Homo Sapiens
SSLPGVFKK

SEQ ID NO: 28429 - protein, 9 aa, Homo Sapiens
SSLPTQLFK

SEQ ID NO: 28430 - protein, 9 aa, Homo Sapiens
SSLQPLPPR

SEQ ID NO: 28431 - protein, 9 aa, Homo Sapiens
SSLSLFFRK

SEQ ID NO: 28432 - protein, 9 aa, Homo Sapiens
SSLTNDVAK

SEQ ID NO: 28433 - protein, 9 aa, Homo Sapiens
SSLYIILKK

SEQ ID NO: 28434 - protein, 9 aa, Homo Sapiens
SSMFGTLPR

SEQ ID NO: 28435 - protein, 9 aa, Homo Sapiens
SSNFYITEK

SEQ ID NO: 28436 - protein, 9 aa, Homo Sapiens
SSNIFTVAK

SEQ ID NO: 28437 - protein, 9 aa, Homo Sapiens
SSNLPVNNK

SEQ ID NO: 28438 - protein, 9 aa, Homo Sapiens
SSNSYAIKK

SEQ ID NO: 28439 - protein, 9 aa, Homo Sapiens
SSQSLSFPK

SEQ ID NO: 28440 - protein, 9 aa, Homo Sapiens
SSRGPLPVK

SEQ ID NO: 28441 - protein, 9 aa, Homo Sapiens
SSSGSLPPR

SEQ ID NO: 28442 - protein, 9 aa, Homo Sapiens
SSSNVRVIK

SEQ ID NO: 28443 - protein, 9 aa, Homo Sapiens
SSSSPTFPK

SEQ ID NO: 28444 - protein, 9 aa, Homo Sapiens
SSVGSVITK

SEQ ID NO: 28445 - protein, 9 aa, Homo Sapiens
SSVPYSTAK

SEQ ID NO: 28446 - protein, 9 aa, Homo Sapiens
SSVVPSVYK

SEQ ID NO: 28447 - protein, 9 aa, Homo Sapiens
SSYGNQEFK

SEQ ID NO: 28448 - protein, 9 aa, Homo Sapiens
SSYPNPVAH

SEQ ID NO: 28449 - protein, 9 aa, Homo Sapiens
SSYPVCVSK

SEQ ID NO: 28450 - protein, 9 aa, Homo Sapiens
SSYQDFYCK

SEQ ID NO: 28451 - protein, 9 aa, Homo Sapiens
STAAFFLLR

SEQ ID NO: 28452 - protein, 9 aa, Homo Sapiens
STAAVGVLK

SEQ ID NO: 28453 - protein, 9 aa, Homo Sapiens
STADLIRCK

SEQ ID NO: 28454 - protein, 9 aa, Homo Sapiens
STANIDDLK

SEQ ID NO: 28455 - protein, 9 aa, Homo Sapiens
STAPAQLGK

SEQ ID NO: 28456 - protein, 9 aa, Homo Sapiens
STARHLYLR

SEQ ID NO: 28457 - protein, 9 aa, Homo Sapiens
STASELSPK

SEQ ID NO: 28458 - protein, 9 aa, Homo Sapiens
STCSPIISK

SEQ ID NO: 28459 - protein, 9 aa, Homo Sapiens
STDNVSITK

SEQ ID NO: 28460 - protein, 9 aa, Homo Sapiens
STDPSVLGK

SEQ ID NO: 28461 - protein, 9 aa, Homo Sapiens
STDSDSFVK

SEQ ID NO: 28462 - protein, 9 aa, Homo Sapiens
STEEPMPTK

SEQ ID NO: 28463 - protein, 9 aa, Homo Sapiens
STEKIYIRK

SEQ ID NO: 28464 - protein, 9 aa, Homo Sapiens
STEPPYSQK

SEQ ID NO: 28465 - protein, 9 aa, Homo Sapiens
STFDTPYCR

SEQ ID NO: 28466 - protein, 9 aa, Homo Sapiens
STFDTQITK

SEQ ID NO: 28467 - protein, 9 aa, Homo Sapiens
STFFYPKLK

SEQ ID NO: 28468 - protein, 9 aa, Homo Sapiens
STFNQVVLK

SEQ ID NO: 28469 - protein, 9 aa, Homo Sapiens
STFRESFKK

SEQ ID NO: 28470 - protein, 9 aa, Homo Sapiens
STFSAPLNK

SEQ ID NO: 28471 - protein, 9 aa, Homo Sapiens
STFSATWNR

SEQ ID NO: 28472 - protein, 9 aa, Homo Sapiens
STFSEIFKK

SEQ ID NO: 28473 - protein, 9 aa, Homo Sapiens
STGPITKPK

SEQ ID NO: 28474 - protein, 9 aa, Homo Sapiens
STHGTFLNK

SEQ ID NO: 28475 - protein, 9 aa, Homo Sapiens
STIAGSKLK

SEQ ID NO: 28476 - protein, 9 aa, Homo Sapiens
STICKYYQK

SEQ ID NO: 28477 - protein, 9 aa, Homo Sapiens
STIDDTISK

SEQ ID NO: 28478 - protein, 9 aa, Homo Sapiens
STIEYVIQR

SEQ ID NO: 28479 - protein, 9 aa, Homo Sapiens
STIHGKLQE

SEQ ID NO: 28480 - protein, 9 aa, Homo Sapiens
STIPPELVK

SEQ ID NO: 28481 - protein, 9 aa, Homo Sapiens
STIRLPHVK

SEQ ID NO: 28482 - protein, 9 aa, Homo Sapiens
STISEVLGR

SEQ ID NO: 28483 - protein, 9 aa, Homo Sapiens
STLHHVLQR

SEQ ID NO: 28484 - protein, 9 aa, Homo Sapiens
STLMSLPTK

SEQ ID NO: 28485 - protein, 9 aa, Homo Sapiens
STLNVGVNK

SEQ ID NO: 28486 - protein, 9 aa, Homo Sapiens
STLPKPVQK

SEQ ID NO: 28487 - protein, 9 aa, Homo Sapiens
STLPKSLLK

SEQ ID NO: 28488 - protein, 9 aa, Homo Sapiens
STLPPVKSK

SEQ ID NO: 28489 - protein, 9 aa, Homo Sapiens
STLPVTVKK

SEQ ID NO: 28490 - protein, 9 aa, Homo Sapiens
STLSPIAPR

SEQ ID NO: 28491 - protein, 9 aa, Homo Sapiens
STMAIIVNK

SEQ ID NO: 28492 - protein, 9 aa, Homo Sapiens
STMGYMAAK

SEQ ID NO: 28493 - protein, 9 aa, Homo Sapiens
STMGYMMAK

SEQ ID NO: 28494 - protein, 9 aa, Homo Sapiens
STMPGLPTR

SEQ ID NO: 28495 - protein, 9 aa, Homo Sapiens
STNNWVLIK

SEQ ID NO: 28496 - protein, 9 aa, Homo Sapiens
STNPFRPQK

SEQ ID NO: 28497 - protein, 9 aa, Homo Sapiens
STNSFALNK

SEQ ID NO: 28498 - protein, 9 aa, Homo Sapiens
STNSSPVLK

SEQ ID NO: 28499 - protein, 9 aa, Homo Sapiens
STNWSDVGK

SEQ ID NO: 28500 - protein, 9 aa, Homo Sapiens
STPETPLTK

SEQ ID NO: 28501 - protein, 9 aa, Homo Sapiens
STPETTLKP

SEQ ID NO: 28502 - protein, 9 aa, Homo Sapiens
STQPENFLK

SEQ ID NO: 28503 - protein, 9 aa, Homo Sapiens
STQQLQEVK

SEQ ID NO: 28504 - protein, 9 aa, Homo Sapiens
STSCPVVQK

SEQ ID NO: 28505 - protein, 9 aa, Homo Sapiens
STSDSVRLK

SEQ ID NO: 28506 - protein, 9 aa, Homo Sapiens
STSNSFNLK

SEQ ID NO: 28507 - protein, 9 aa, Homo Sapiens
STSPYFLEH

SEQ ID NO: 28508 - protein, 9 aa, Homo Sapiens
STSVPLGDK

SEQ ID NO: 28509 - protein, 9 aa, Homo Sapiens
STTGCVLNK

SEQ ID NO: 28510 - protein, 9 aa, Homo Sapiens
STTRLYLRK

SEQ ID NO: 28511 - protein, 9 aa, Homo Sapiens
STVEAFFKK

SEQ ID NO: 28512 - protein, 9 aa, Homo Sapiens
STVEKIAMK

SEQ ID NO: 28513 - protein, 9 aa, Homo Sapiens
STVGWASQK

SEQ ID NO: 28514 - protein, 9 aa, Homo Sapiens
STVLPLYAK

SEQ ID NO: 28515 - protein, 9 aa, Homo Sapiens
STVPPSLRK

SEQ ID NO: 28516 - protein, 9 aa, Homo Sapiens
STYKEAFRK

SEQ ID NO: 28517 - protein, 9 aa, Homo Sapiens
SVAALPVCK

SEQ ID NO: 28518 - protein, 9 aa, Homo Sapiens
SVAAPITVR

SEQ ID NO: 28519 - protein, 9 aa, Homo Sapiens
SVADPHNLK

SEQ ID NO: 28520 - protein, 9 aa, Homo Sapiens
SVAECQLMK

SEQ ID NO: 28521 - protein, 9 aa, Homo Sapiens
SVAKNFFTK

SEQ ID NO: 28522 - protein, 9 aa, Homo Sapiens
SVAKTILKR

SEQ ID NO: 28523 - protein, 9 aa, Homo Sapiens
SVAQLLLSK

SEQ ID NO: 28524 - protein, 9 aa, Homo Sapiens
SVASKALQK

SEQ ID NO: 28525 - protein, 9 aa, Homo Sapiens
SVASPFTSK

SEQ ID NO: 28526 - protein, 9 aa, Homo Sapiens
SVCGKGFSR

SEQ ID NO: 28527 - protein, 9 aa, Homo Sapiens
SVCVLDLRK

SEQ ID NO: 28528 - protein, 9 aa, Homo Sapiens
SVDKIVIQK

SEQ ID NO: 28529 - protein, 9 aa, Homo Sapiens
SVDLPKHAK

SEQ ID NO: 28530 - protein, 9 aa, Homo Sapiens
SVDPKNYPK

SEQ ID NO: 28531 - protein, 9 aa, Homo Sapiens
SVDPNQYYK

SEQ ID NO: 28532 - protein, 9 aa, Homo Sapiens
SVDRPIIDR

SEQ ID NO: 28533 - protein, 9 aa, Homo Sapiens
SVEEFQVFK

SEQ ID NO: 28534 - protein, 9 aa, Homo Sapiens
SVELPIVGK

SEQ ID NO: 28535 - protein, 9 aa, Homo Sapiens
SVEMPLTGK

SEQ ID NO: 28536 - protein, 9 aa, Homo Sapiens
SVESIISPK

SEQ ID NO: 28537 - protein, 9 aa, Homo Sapiens
SVFACPILR

SEQ ID NO: 28538 - protein, 9 aa, Homo Sapiens
SVFAFGENK

SEQ ID NO: 28539 - protein, 9 aa, Homo Sapiens
SVFGTMPLK

SEQ ID NO: 28540 - protein, 9 aa, Homo Sapiens
SVFKELLGK

SEQ ID NO: 28541 - protein, 9 aa, Homo Sapiens
SVFLALPCK

SEQ ID NO: 28542 - protein, 9 aa, Homo Sapiens
SVFNHAIRH

SEQ ID NO: 28543 - protein, 9 aa, Homo Sapiens
SVFQTTDTK

SEQ ID NO: 28544 - protein, 9 aa, Homo Sapiens
SVFTSVRQK

SEQ ID NO: 28545 - protein, 9 aa, Homo Sapiens
SVFVATFLR

SEQ ID NO: 28546 - protein, 9 aa, Homo Sapiens
SVGQTVITK

SEQ ID NO: 28547 - protein, 9 aa, Homo Sapiens
SVGSVITKK

SEQ ID NO: 28548 - protein, 9 aa, Homo Sapiens
SVHWFPVQK

SEQ ID NO: 28549 - protein, 9 aa, Homo Sapiens
SVIAKYPHK

SEQ ID NO: 28550 - protein, 9 aa, Homo Sapiens
SVIDSVTKK

SEQ ID NO: 28551 - protein, 9 aa, Homo Sapiens
SVIELLLKK

SEQ ID NO: 28552 - protein, 9 aa, Homo Sapiens
SVIELTCTK

SEQ ID NO: 28553 - protein, 9 aa, Homo Sapiens
SVIEQILHY

SEQ ID NO: 28554 - protein, 9 aa, Homo Sapiens
SVIKNVSTK

SEQ ID NO: 28555 - protein, 9 aa, Homo Sapiens
SVILPILKK

SEQ ID NO: 28556 - protein, 9 aa, Homo Sapiens
SVINKVTEK

SEQ ID NO: 28557 - protein, 9 aa, Homo Sapiens
SVINVFVGR

SEQ ID NO: 28558 - protein, 9 aa, Homo Sapiens
SVIPEHPKK

SEQ ID NO: 28559 - protein, 9 aa, Homo Sapiens
SVIRPILKR

SEQ ID NO: 28560 - protein, 9 aa, Homo Sapiens
SVITIVKSK

SEQ ID NO: 28561 - protein, 9 aa, Homo Sapiens
SVITQVLNK

SEQ ID NO: 28562 - protein, 9 aa, Homo Sapiens
SVIVQPFSK

SEQ ID NO: 28563 - protein, 9 aa, Homo Sapiens
SVLAETIKK

SEQ ID NO: 28564 - protein, 9 aa, Homo Sapiens
SVLDKSLTK

SEQ ID NO: 28565 - protein, 9 aa, Homo Sapiens
SVLDLSVHK

SEQ ID NO: 28566 - protein, 9 aa, Homo Sapiens
SVLDSFLKY

SEQ ID NO: 28567 - protein, 9 aa, Homo Sapiens
SVLDYFSER

SEQ ID NO: 28568 - protein, 9 aa, Homo Sapiens
SVLDYGNTK

SEQ ID NO: 28569 - protein, 9 aa, Homo Sapiens
SVLEFLSQK

SEQ ID NO: 28570 - protein, 9 aa, Homo Sapiens
SVLENFVGR

SEQ ID NO: 28571 - protein, 9 aa, Homo Sapiens
SVLEPGTAK

SEQ ID NO: 28572 - protein, 9 aa, Homo Sapiens
SVLEQSFLR

SEQ ID NO: 28573 - protein, 9 aa, Homo Sapiens
SVLEVVSEK

SEQ ID NO: 28574 - protein, 9 aa, Homo Sapiens
SVLGISTPK

SEQ ID NO: 28575 - protein, 9 aa, Homo Sapiens
SVLHGMVFK

SEQ ID NO: 28576 - protein, 9 aa, Homo Sapiens
SVLKGAVTK

SEQ ID NO: 28577 - protein, 9 aa, Homo Sapiens
SVLLFVTKK

SEQ ID NO: 28578 - protein, 9 aa, Homo Sapiens
SVLNFATNR

SEQ ID NO: 28579 - protein, 9 aa, Homo Sapiens
SVLNIPMAK

SEQ ID NO: 28580 - protein, 9 aa, Homo Sapiens
SVLNLVIVK

SEQ ID NO: 28581 - protein, 9 aa, Homo Sapiens
SVLPFQIYY

SEQ ID NO: 28582 - protein, 9 aa, Homo Sapiens
SVLPWIILH

SEQ ID NO: 28583 - protein, 9 aa, Homo Sapiens
SVLSPLLNK

SEQ ID NO: 28584 - protein, 9 aa, Homo Sapiens
SVLWPWINR

SEQ ID NO: 28585 - protein, 9 aa, Homo Sapiens
SVMAQVRQK

SEQ ID NO: 28586 - protein, 9 aa, Homo Sapiens
SVMDHHFRK

SEQ ID NO: 28587 - protein, 9 aa, Homo Sapiens
SVMELARLK

SEQ ID NO: 28588 - protein, 9 aa, Homo Sapiens
SVMGVTVSR

SEQ ID NO: 28589 - protein, 9 aa, Homo Sapiens
SVMRLTISY

SEQ ID NO: 28590 - protein, 9 aa, Homo Sapiens
SVNGKVLSK

SEQ ID NO: 28591 - protein, 9 aa, Homo Sapiens
SVNLKVSPK

SEQ ID NO: 28592 - protein, 9 aa, Homo Sapiens
SVNPNCYAK

SEQ ID NO: 28593 - protein, 9 aa, Homo Sapiens
SVPLPISHK

SEQ ID NO: 28594 - protein, 9 aa, Homo Sapiens
SVPSTPIAH

SEQ ID NO: 28595 - protein, 9 aa, Homo Sapiens
SVQAPEVAK

SEQ ID NO: 28596 - protein, 9 aa, Homo Sapiens
SVQCMPVAK

SEQ ID NO: 28597 - protein, 9 aa, Homo Sapiens
SVQDGSVLK

SEQ ID NO: 28598 - protein, 9 aa, Homo Sapiens
SVQEGIKFK

SEQ ID NO: 28599 - protein, 9 aa, Homo Sapiens
SVQENIQQK

SEQ ID NO: 28600 - protein, 9 aa, Homo Sapiens
SVQEYFVRK

SEQ ID NO: 28601 - protein, 9 aa, Homo Sapiens
SVQGFFLNH

SEQ ID NO: 28602 - protein, 9 aa, Homo Sapiens
SVQGIIIYR

SEQ ID NO: 28603 - protein, 9 aa, Homo Sapiens
SVQKPKFPK

SEQ ID NO: 28604 - protein, 9 aa, Homo Sapiens
SVQKPLDYY

SEQ ID NO: 28605 - protein, 9 aa, Homo Sapiens
SVQVFGRKK

SEQ ID NO: 28606 - protein, 9 aa, Homo Sapiens
SVSAVNLPK

SEQ ID NO: 28607 - protein, 9 aa, Homo Sapiens
SVSDLAPPR

SEQ ID NO: 28608 - protein, 9 aa, Homo Sapiens
SVSDLFNTK

SEQ ID NO: 28609 - protein, 9 aa, Homo Sapiens
SVSDQFYRY

SEQ ID NO: 28610 - protein, 9 aa, Homo Sapiens
SVSEVVVNR

SEQ ID NO: 28611 - protein, 9 aa, Homo Sapiens
SVSGYIYHK

SEQ ID NO: 28612 - protein, 9 aa, Homo Sapiens
SVSKLSTPK

SEQ ID NO: 28613 - protein, 9 aa, Homo Sapiens
SVSLPSVKK

SEQ ID NO: 28614 - protein, 9 aa, Homo Sapiens
SVSLPVRKK

SEQ ID NO: 28615 - protein, 9 aa, Homo Sapiens
SVSNVVITK

SEQ ID NO: 28616 - protein, 9 aa, Homo Sapiens
SVSPVVHVR

SEQ ID NO: 28617 - protein, 9 aa, Homo Sapiens
SVSQKLMAK

SEQ ID NO: 28618 - protein, 9 aa, Homo Sapiens
SVSTHLITK

SEQ ID NO: 28619 - protein, 9 aa, Homo Sapiens
SVSTPLIIK

SEQ ID NO: 28620 - protein, 9 aa, Homo Sapiens
SVTNVSVAK

SEQ ID NO: 28621 - protein, 9 aa, Homo Sapiens
SVVEDMILK

SEQ ID NO: 28622 - protein, 9 aa, Homo Sapiens
SVVGELMYK

SEQ ID NO: 28623 - protein, 9 aa, Homo Sapiens
SVVGLFLRH

SEQ ID NO: 28624 - protein, 9 aa, Homo Sapiens
SVVPSVILK

SEQ ID NO: 28625 - protein, 9 aa, Homo Sapiens
SVVSSVTTK

SEQ ID NO: 28626 - protein, 9 aa, Homo Sapiens
SVWHGTLSK

SEQ ID NO: 28627 - protein, 9 aa, Homo Sapiens
SVYGDFSCK

SEQ ID NO: 28628 - protein, 9 aa, Homo Sapiens
SVYGYGVQK

SEQ ID NO: 28629 - protein, 9 aa, Homo Sapiens
SVYSGIRHK

SEQ ID NO: 28630 - protein, 9 aa, Homo Sapiens
SVYVLVRQK

SEQ ID NO: 28631 - protein, 9 aa, Homo Sapiens
SVYVYKVLK

SEQ ID NO: 28632 - protein, 9 aa, Homo Sapiens
TAMPPGTAR

SEQ ID NO: 28633 - protein, 9 aa, Homo Sapiens
TAQFKINKK

SEQ ID NO: 28634 - protein, 9 aa, Homo Sapiens
TCLKSFIQK

SEQ ID NO: 28635 - protein, 9 aa, Homo Sapiens
TGFSYAFPK

SEQ ID NO: 28636 - protein, 9 aa, Homo Sapiens
TIAASLAFK

SEQ ID NO: 28637 - protein, 9 aa, Homo Sapiens
TIFGKIIRK

SEQ ID NO: 28638 - protein, 9 aa, Homo Sapiens
TIFLMGPVK

SEQ ID NO: 28639 - protein, 9 aa, Homo Sapiens
TIKEGSQLK

SEQ ID NO: 28640 - protein, 9 aa, Homo Sapiens
TILEKFKEK

SEQ ID NO: 28641 - protein, 9 aa, Homo Sapiens
TIRTIDYRK

SEQ ID NO: 28642 - protein, 9 aa, Homo Sapiens
TISPPLQPK

SEQ ID NO: 28643 - protein, 9 aa, Homo Sapiens
TITPVVGKK

SEQ ID NO: 28644 - protein, 9 aa, Homo Sapiens
TLCKPLVPR

SEQ ID NO: 28645 - protein, 9 aa, Homo Sapiens
TLFYSEIPK

SEQ ID NO: 28646 - protein, 9 aa, Homo Sapiens
TLLDKYWTK

SEQ ID NO: 28647 - protein, 9 aa, Homo Sapiens
TQATIYVHK

SEQ ID NO: 28648 - protein, 9 aa, Homo Sapiens
TQCGSLIGK

SEQ ID NO: 28649 - protein, 9 aa, Homo Sapiens
TQMGPVAAK

SEQ ID NO: 28650 - protein, 9 aa, Homo Sapiens
TSALPIIQK

SEQ ID NO: 28651 - protein, 9 aa, Homo Sapiens
TSGAAVIKQ

SEQ ID NO: 28652 - protein, 9 aa, Homo Sapiens
TSIQPGAPK

SEQ ID NO: 28653 - protein, 9 aa, Homo Sapiens
TSLDKFYRK

SEQ ID NO: 28654 - protein, 9 aa, Homo Sapiens
TSLPPLPFK

SEQ ID NO: 28655 - protein, 9 aa, Homo Sapiens
TSLSVSTPK

SEQ ID NO: 28656 - protein, 9 aa, Homo Sapiens
TSPIIIHRL

SEQ ID NO: 28657 - protein, 9 aa, Homo Sapiens
TSQEPSPPK

SEQ ID NO: 28658 - protein, 9 aa, Homo Sapiens
TSSDVIEMK

SEQ ID NO: 28659 - protein, 9 aa, Homo Sapiens
TSSQPVIAK

SEQ ID NO: 28660 - protein, 9 aa, Homo Sapiens
TTDCPVPPK

SEQ ID NO: 28661 - protein, 9 aa, Homo Sapiens
TTFSPSISK

SEQ ID NO: 28662 - protein, 9 aa, Homo Sapiens
TTFTKIVNK

SEQ ID NO: 28663 - protein, 9 aa, Homo Sapiens
TTGEPATPK

SEQ ID NO: 28664 - protein, 9 aa, Homo Sapiens
TTLGHAVLK

SEQ ID NO: 28665 - protein, 9 aa, Homo Sapiens
TTMQALAEK

SEQ ID NO: 28666 - protein, 9 aa, Homo Sapiens
TTNDIVISK

SEQ ID NO: 28667 - protein, 9 aa, Homo Sapiens
TTQDPLSNK

SEQ ID NO: 28668 - protein, 9 aa, Homo Sapiens
TTSNFTFSK

SEQ ID NO: 28669 - protein, 9 aa, Homo Sapiens
TTTGHLIYK

SEQ ID NO: 28670 - protein, 9 aa, Homo Sapiens
TTVDIFHKK

SEQ ID NO: 28671 - protein, 9 aa, Homo Sapiens
TTVPHVFSK

SEQ ID NO: 28672 - protein, 9 aa, Homo Sapiens
TVAKSIDLK

SEQ ID NO: 28673 - protein, 9 aa, Homo Sapiens
TVAVPLVGK

SEQ ID NO: 28674 - protein, 9 aa, Homo Sapiens
TVCDLIQSK

SEQ ID NO: 28675 - protein, 9 aa, Homo Sapiens
TVCLTLTAK

SEQ ID NO: 28676 - protein, 9 aa, Homo Sapiens
TVFEHTFHV

SEQ ID NO: 28677 - protein, 9 aa, Homo Sapiens
TVFENLINK

SEQ ID NO: 28678 - protein, 9 aa, Homo Sapiens
TVFLSTWNK

SEQ ID NO: 28679 - protein, 9 aa, Homo Sapiens
TVHPKFHYK

SEQ ID NO: 28680 - protein, 9 aa, Homo Sapiens
TVIHFNNPK

SEQ ID NO: 28681 - protein, 9 aa, Homo Sapiens
TVILPIKKK

SEQ ID NO: 28682 - protein, 9 aa, Homo Sapiens
TVISLLVYK

SEQ ID NO: 28683 - protein, 9 aa, Homo Sapiens
TVLGYFIGR

SEQ ID NO: 28684 - protein, 9 aa, Homo Sapiens
TVLQYVVGR

SEQ ID NO: 28685 - protein, 9 aa, Homo Sapiens
TVLRPSLGK

SEQ ID NO: 28686 - protein, 9 aa, Homo Sapiens
TVNSPAIYK

SEQ ID NO: 28687 - protein, 9 aa, Homo Sapiens
TVPRRLGPK

SEQ ID NO: 28688 - protein, 9 aa, Homo Sapiens
TVQEHLIEK

SEQ ID NO: 28689 - protein, 9 aa, Homo Sapiens
TVQEKTFNK

SEQ ID NO: 28690 - protein, 9 aa, Homo Sapiens
TVQELAIYK

SEQ ID NO: 28691 - protein, 9 aa, Homo Sapiens
TVQVYIITK

SEQ ID NO: 28692 - protein, 9 aa, Homo Sapiens
TVSADPVVK

SEQ ID NO: 28693 - protein, 9 aa, Homo Sapiens
TVSDAILRY

SEQ ID NO: 28694 - protein, 9 aa, Homo Sapiens
TVSEPAVIK

SEQ ID NO: 28695 - protein, 9 aa, Homo Sapiens
TVTAQILLK

SEQ ID NO: 28696 - protein, 9 aa, Homo Sapiens
TVTSYVFLK

SEQ ID NO: 28697 - protein, 9 aa, Homo Sapiens
TVVDCPVCK

SEQ ID NO: 28698 - protein, 9 aa, Homo Sapiens
TVYECVVEK

SEQ ID NO: 28699 - protein, 9 aa, Homo Sapiens
TVYEEMMAK

SEQ ID NO: 28700 - protein, 9 aa, Homo Sapiens
TVYRGLVQK

SEQ ID NO: 28701 - protein, 9 aa, Homo Sapiens
VAGTPAPPK

SEQ ID NO: 28702 - protein, 9 aa, Homo Sapiens
VASTPISQR

SEQ ID NO: 28703 - protein, 9 aa, Homo Sapiens
VAVDVAVPK

SEQ ID NO: 28704 - protein, 9 aa, Homo Sapiens
VAYHQPTLK

SEQ ID NO: 28705 - protein, 9 aa, Homo Sapiens
VGGSTRIPK

SEQ ID NO: 28706 - protein, 9 aa, Homo Sapiens
VGVYRPPPK

SEQ ID NO: 28707 - protein, 9 aa, Homo Sapiens
VIFCNTKRK

SEQ ID NO: 28708 - protein, 9 aa, Homo Sapiens
VIFIIICLR

SEQ ID NO: 28709 - protein, 9 aa, Homo Sapiens
VIIAKVTAK

SEQ ID NO: 28710 - protein, 9 aa, Homo Sapiens
VILESIFLK

SEQ ID NO: 28711 - protein, 9 aa, Homo Sapiens
VILLPQPPK

SEQ ID NO: 28712 - protein, 9 aa, Homo Sapiens
VIMNSLITK

SEQ ID NO: 28713 - protein, 9 aa, Homo Sapiens
VIQDPMGQK

SEQ ID NO: 28714 - protein, 9 aa, Homo Sapiens
VISPPTVPK

SEQ ID NO: 28715 - protein, 9 aa, Homo Sapiens
VIYFPPLQK

SEQ ID NO: 28716 - protein, 9 aa, Homo Sapiens
VLAPVIDLK

SEQ ID NO: 28717 - protein, 9 aa, Homo Sapiens
VLKVLSSLK

SEQ ID NO: 28718 - protein, 9 aa, Homo Sapiens
VLYENPNLK

SEQ ID NO: 28719 - protein, 9 aa, Homo Sapiens
VNKVPLTGK

SEQ ID NO: 28720 - protein, 9 aa, Homo Sapiens
VQNGSTFVK

SEQ ID NO: 28721 - protein, 9 aa, Homo Sapiens
VSFPIGIYK

SEQ ID NO: 28722 - protein, 9 aa, Homo Sapiens
VSFSDVFFK

SEQ ID NO: 28723 - protein, 9 aa, Homo Sapiens
VSLDYAISK

SEQ ID NO: 28724 - protein, 9 aa, Homo Sapiens
VSLEGEPRK

SEQ ID NO: 28725 - protein, 9 aa, Homo Sapiens
VSLGLVVSK

SEQ ID NO: 28726 - protein, 9 aa, Homo Sapiens
VSLGTPIMK

SEQ ID NO: 28727 - protein, 9 aa, Homo Sapiens
VSLWLPVSK

SEQ ID NO: 28728 - protein, 9 aa, Homo Sapiens
VSMDYAISK

SEQ ID NO: 28729 - protein, 9 aa, Homo Sapiens
VSMLNVYLK

SEQ ID NO: 28730 - protein, 9 aa, Homo Sapiens
VSMPSKYRK

SEQ ID NO: 28731 - protein, 9 aa, Homo Sapiens
VSMPVIQTK

SEQ ID NO: 28732 - protein, 9 aa, Homo Sapiens
VSQEPFPNK

SEQ ID NO: 28733 - protein, 9 aa, Homo Sapiens
VSQLPLTER

SEQ ID NO: 28734 - protein, 9 aa, Homo Sapiens
VSSPKLAPK

SEQ ID NO: 28735 - protein, 9 aa, Homo Sapiens
VSSWLPLAK

SEQ ID NO: 28736 - protein, 9 aa, Homo Sapiens
VTFEKQWFY

SEQ ID NO: 28737 - protein, 9 aa, Homo Sapiens
VTFVPGLYK

SEQ ID NO: 28738 - protein, 9 aa, Homo Sapiens
VTGPNMGGK

SEQ ID NO: 28739 - protein, 9 aa, Homo Sapiens
VTISFRIYK

SEQ ID NO: 28740 - protein, 9 aa, Homo Sapiens
VTISSIEKK

SEQ ID NO: 28741 - protein, 9 aa, Homo Sapiens
VTISTSPPK

SEQ ID NO: 28742 - protein, 9 aa, Homo Sapiens
VTLTTQHVK

SEQ ID NO: 28743 - protein, 9 aa, Homo Sapiens
VTMKQICKK

SEQ ID NO: 28744 - protein, 9 aa, Homo Sapiens
VTMPATETK

SEQ ID NO: 28745 - protein, 9 aa, Homo Sapiens
VTNDFVMLK

SEQ ID NO: 28746 - protein, 9 aa, Homo Sapiens
VTNWDDMEK

SEQ ID NO: 28747 - protein, 9 aa, Homo Sapiens
VTQAPISAR

SEQ ID NO: 28748 - protein, 9 aa, Homo Sapiens
VTQDFMMYR

SEQ ID NO: 28749 - protein, 9 aa, Homo Sapiens
VTQSEIGQK

SEQ ID NO: 28750 - protein, 9 aa, Homo Sapiens
VTSEVPFSK

SEQ ID NO: 28751 - protein, 9 aa, Homo Sapiens
VTSTFIIEK

SEQ ID NO: 28752 - protein, 9 aa, Homo Sapiens
VTSTSLTIK

SEQ ID NO: 28753 - protein, 9 aa, Homo Sapiens
VTTEKRFLK

SEQ ID NO: 28754 - protein, 9 aa, Homo Sapiens
VTVKSAIRR

SEQ ID NO: 28755 - protein, 9 aa, Homo Sapiens
VTVSGGTPK

SEQ ID NO: 28756 - protein, 9 aa, Homo Sapiens
VVAAGGVEK

SEQ ID NO: 28757 - protein, 9 aa, Homo Sapiens
VVAAVIWRK

SEQ ID NO: 28758 - protein, 9 aa, Homo Sapiens
VVAAVMWRK

SEQ ID NO: 28759 - protein, 9 aa, Homo Sapiens
VVAPPGAPK

SEQ ID NO: 28760 - protein, 9 aa, Homo Sapiens
VVCEYIVKK

SEQ ID NO: 28761 - protein, 9 aa, Homo Sapiens
VVDIPIVEK

SEQ ID NO: 28762 - protein, 9 aa, Homo Sapiens
VVDPHSFPR

SEQ ID NO: 28763 - protein, 9 aa, Homo Sapiens
VVDPVVREK

SEQ ID NO: 28764 - protein, 9 aa, Homo Sapiens
VVDQTTLMK

SEQ ID NO: 28765 - protein, 9 aa, Homo Sapiens
VVDYPNSAK

SEQ ID NO: 28766 - protein, 9 aa, Homo Sapiens
VVFEKAIQR

SEQ ID NO: 28767 - protein, 9 aa, Homo Sapiens
VVFTTYTQK

SEQ ID NO: 28768 - protein, 9 aa, Homo Sapiens
VVGAVVFQK

SEQ ID NO: 28769 - protein, 9 aa, Homo Sapiens
VVGLPNVGK

SEQ ID NO: 28770 - protein, 9 aa, Homo Sapiens
VVGPVGAGK

SEQ ID NO: 28771 - protein, 9 aa, Homo Sapiens
VVGPVSLPR

SEQ ID NO: 28772 - protein, 9 aa, Homo Sapiens
VVINFDFPK

SEQ ID NO: 28773 - protein, 9 aa, Homo Sapiens
VVLENAAKK

SEQ ID NO: 28774 - protein, 9 aa, Homo Sapiens
VVLTYIYFK

SEQ ID NO: 28775 - protein, 9 aa, Homo Sapiens
VVLYPLVAK

SEQ ID NO: 28776 - protein, 9 aa, Homo Sapiens
VVMADPKGK

SEQ ID NO: 28777 - protein, 9 aa, Homo Sapiens
VVMLESPPK

SEQ ID NO: 28778 - protein, 9 aa, Homo Sapiens
VVMRDPASK

SEQ ID NO: 28779 - protein, 9 aa, Homo Sapiens
VVMRDPNTK

SEQ ID NO: 28780 - protein, 9 aa, Homo Sapiens
VVMRDPQTK

SEQ ID NO: 28781 - protein, 9 aa, Homo Sapiens
VVQEVLSIK

SEQ ID NO: 28782 - protein, 9 aa, Homo Sapiens
VVSEKQFSK

SEQ ID NO: 28783 - protein, 9 aa, Homo Sapiens
VVVDPILSK

SEQ ID NO: 28784 - protein, 9 aa, Homo Sapiens
VVVVNPQTK

SEQ ID NO: 28785 - protein, 9 aa, Homo Sapiens
VVYQYWNTK

SEQ ID NO: 28786 - protein, 9 aa, Homo Sapiens
YDRPGASPK

SEQ ID NO: 28787 - protein, 9 aa, Homo Sapiens
YEGHVSCVK

SEQ ID NO: 28788 - protein, 9 aa, Homo Sapiens
YILSPLSYK

SEQ ID NO: 28789 - protein, 9 aa, Homo Sapiens
YSFSYKHLK

SEQ ID NO: 28790 - protein, 9 aa, Homo Sapiens
YTAPPLQSK

SEQ ID NO: 28791 - protein, 9 aa, Homo Sapiens
YTLSNSKGP

SEQ ID NO: 28792 - protein, 10 aa, Homo Sapiens
AAAAAATAKR

SEQ ID NO: 28793 - protein, 10 aa, Homo Sapiens
AAFDGGFTVK

SEQ ID NO: 28794 - protein, 10 aa, Homo Sapiens
AAIVAYGLYK

SEQ ID NO: 28795 - protein, 10 aa, Homo Sapiens
AAMLDTVVFK

SEQ ID NO: 28796 - protein, 10 aa, Homo Sapiens
AATTPLDVCK

SEQ ID NO: 28797 - protein, 10 aa, Homo Sapiens
AAYAARWVAK

SEQ ID NO: 28798 - protein, 10 aa, Homo Sapiens
AGDGLIELRK

SEQ ID NO: 28799 - protein, 10 aa, Homo Sapiens
AGFPSIPVGK

SEQ ID NO: 28800 - protein, 10 aa, Homo Sapiens
AIETMPCVKK

SEQ ID NO: 28801 - protein, 10 aa, Homo Sapiens
AIFKGVFVHR

SEQ ID NO: 28802 - protein, 10 aa, Homo Sapiens
AIFPATFCQK

SEQ ID NO: 28803 - protein, 10 aa, Homo Sapiens
AIFPRAFPKK

SEQ ID NO: 28804 - protein, 10 aa, Homo Sapiens
AIIDHIFASK

SEQ ID NO: 28805 - protein, 10 aa, Homo Sapiens
AIIDTVINYK

SEQ ID NO: 28806 - protein, 10 aa, Homo Sapiens
AIIERIPPPK

SEQ ID NO: 28807 - protein, 10 aa, Homo Sapiens
AIITPPPAKK

SEQ ID NO: 28808 - protein, 10 aa, Homo Sapiens
AIQDAVGPPK

SEQ ID NO: 28809 - protein, 10 aa, Homo Sapiens
AIYATIPVYK

SEQ ID NO: 28810 - protein, 10 aa, Homo Sapiens
AIYDHINEGK

SEQ ID NO: 28811 - protein, 10 aa, Homo Sapiens
ALADFLPVMK

SEQ ID NO: 28812 - protein, 10 aa, Homo Sapiens
ALFAKPLKGK

SEQ ID NO: 28813 - protein, 10 aa, Homo Sapiens
ALGALATLNL

SEQ ID NO: 28814 - protein, 10 aa, Homo Sapiens
ALKNPPINTK

SEQ ID NO: 28815 - protein, 10 aa, Homo Sapiens
AQAQEVFFLK

SEQ ID NO: 28816 - protein, 10 aa, Homo Sapiens
AQMRAAINQK

SEQ ID NO: 28817 - protein, 10 aa, Homo Sapiens
AQNNPLPKGK

SEQ ID NO: 28818 - protein, 10 aa, Homo Sapiens
AQNSVIIVDK

SEQ ID NO: 28819 - protein, 10 aa, Homo Sapiens
AQVVMPPIPK

SEQ ID NO: 28820 - protein, 10 aa, Homo Sapiens
AQYQFTGIKK

SEQ ID NO: 28821 - protein, 10 aa, Homo Sapiens
ASAGPPSLRK

SEQ ID NO: 28822 - protein, 10 aa, Homo Sapiens
ASALGSSSYK

SEQ ID NO: 28823 - protein, 10 aa, Homo Sapiens
ASALPTGSPK

SEQ ID NO: 28824 - protein, 10 aa, Homo Sapiens
ASASASLPTK

SEQ ID NO: 28825 - protein, 10 aa, Homo Sapiens
ASCVPVNNPK

SEQ ID NO: 28826 - protein, 10 aa, Homo Sapiens
ASFDGTFLWK

SEQ ID NO: 28827 - protein, 10 aa, Homo Sapiens
ASFDKAKLKK

SEQ ID NO: 28828 - protein, 10 aa, Homo Sapiens
ASFPKVFIKK

SEQ ID NO: 28829 - protein, 10 aa, Homo Sapiens
ASFPSPPLSK

SEQ ID NO: 28830 - protein, 10 aa, Homo Sapiens
ASFYSVSQPK

SEQ ID NO: 28831 - protein, 10 aa, Homo Sapiens
ASIAAAVAPK

SEQ ID NO: 28832 - protein, 10 aa, Homo Sapiens
ASILPSSWIG

SEQ ID NO: 28833 - protein, 10 aa, Homo Sapiens
ASIQHPLIKK

SEQ ID NO: 28834 - protein, 10 aa, Homo Sapiens
ASIQPSKVGK

SEQ ID NO: 28835 - protein, 10 aa, Homo Sapiens
ASLEGKGQLK

SEQ ID NO: 28836 - protein, 10 aa, Homo Sapiens
ASLELPAAKK

SEQ ID NO: 28837 - protein, 10 aa, Homo Sapiens
ASLGGFLAQK

SEQ ID NO: 28838 - protein, 10 aa, Homo Sapiens
ASLHGRIYCK

SEQ ID NO: 28839 - protein, 10 aa, Homo Sapiens
ASLIDLLVSK

SEQ ID NO: 28840 - protein, 10 aa, Homo Sapiens
ASLMHSFILK

SEQ ID NO: 28841 - protein, 10 aa, Homo Sapiens
ASLVGQTSPK

SEQ ID NO: 28842 - protein, 10 aa, Homo Sapiens
ASMRYTPVGR

SEQ ID NO: 28843 - protein, 10 aa, Homo Sapiens
ASNPCGNIQR

SEQ ID NO: 28844 - protein, 10 aa, Homo Sapiens
ASQCGSLIGK

SEQ ID NO: 28845 - protein, 10 aa, Homo Sapiens
ASQDIIPQLK

SEQ ID NO: 28846 - protein, 10 aa, Homo Sapiens
ASSAPPLTGK

SEQ ID NO: 28847 - protein, 10 aa, Homo Sapiens
ASSARTQNLK

SEQ ID NO: 28848 - protein, 10 aa, Homo Sapiens
ASSGVPNPPK

SEQ ID NO: 28849 - protein, 10 aa, Homo Sapiens
ASSIFVAPRK

SEQ ID NO: 28850 - protein, 10 aa, Homo Sapiens
ASSTIVPSLK

SEQ ID NO: 28851 - protein, 10 aa, Homo Sapiens
ASVAALPVCK

SEQ ID NO: 28852 - protein, 10 aa, Homo Sapiens
ASVFGTMPLK

SEQ ID NO: 28853 - protein, 10 aa, Homo Sapiens
ASVNFSEFSK

SEQ ID NO: 28854 - protein, 10 aa, Homo Sapiens
ASVSVTLKGS

SEQ ID NO: 28855 - protein, 10 aa, Homo Sapiens
ASYAAVPLYR

SEQ ID NO: 28856 - protein, 10 aa, Homo Sapiens
ATAAVTAAVK

SEQ ID NO: 28857 - protein, 10 aa, Homo Sapiens
ATAEVLNIGK

SEQ ID NO: 28858 - protein, 10 aa, Homo Sapiens
ATAGIIGVNR

SEQ ID NO: 28859 - protein, 10 aa, Homo Sapiens
ATAIGMPVEK

SEQ ID NO: 28860 - protein, 10 aa, Homo Sapiens
ATALGEQPVK

SEQ ID NO: 28861 - protein, 10 aa, Homo Sapiens
ATALPTGTSK

SEQ ID NO: 28862 - protein, 10 aa, Homo Sapiens
ATAMLQSLLK

SEQ ID NO: 28863 - protein, 10 aa, Homo Sapiens
ATANMLGIRK

SEQ ID NO: 28864 - protein, 10 aa, Homo Sapiens
ATAQFKINKK

SEQ ID NO: 28865 - protein, 10 aa, Homo Sapiens
ATASIPSLVK

SEQ ID NO: 28866 - protein, 10 aa, Homo Sapiens
ATASLGVIHK

SEQ ID NO: 28867 - protein, 10 aa, Homo Sapiens
ATATGTEILK

SEQ ID NO: 28868 - protein, 10 aa, Homo Sapiens
ATAYLPMLEK

SEQ ID NO: 28869 - protein, 10 aa, Homo Sapiens
ATCDFPLLNR

SEQ ID NO: 28870 - protein, 10 aa, Homo Sapiens
ATCDHPYIVK

SEQ ID NO: 28871 - protein, 10 aa, Homo Sapiens
ATCLPLSVRR

SEQ ID NO: 28872 - protein, 10 aa, Homo Sapiens
ATDAAANLTK

SEQ ID NO: 28873 - protein, 10 aa, Homo Sapiens
ATDFAPGFQK

SEQ ID NO: 28874 - protein, 10 aa, Homo Sapiens
ATDFGQTNQK

SEQ ID NO: 28875 - protein, 10 aa, Homo Sapiens
ATDILMGVLK

SEQ ID NO: 28876 - protein, 10 aa, Homo Sapiens
ATEGPNIVCK

SEQ ID NO: 28877 - protein, 10 aa, Homo Sapiens
ATEHIPSPAK

SEQ ID NO: 28878 - protein, 10 aa, Homo Sapiens
ATENPGALIK

SEQ ID NO: 28879 - protein, 10 aa, Homo Sapiens
ATFDIWKFRK

SEQ ID NO: 28880 - protein, 10 aa, Homo Sapiens
ATFEKIPFER

SEQ ID NO: 28881 - protein, 10 aa, Homo Sapiens
ATFPLSVQKF

SEQ ID NO: 28882 - protein, 10 aa, Homo Sapiens
ATFPSSAFLR

SEQ ID NO: 28883 - protein, 10 aa, Homo Sapiens
ATFQFTVERF

SEQ ID NO: 28884 - protein, 10 aa, Homo Sapiens
ATFRVKNPDK

SEQ ID NO: 28885 - protein, 10 aa, Homo Sapiens
ATFTNVFGKK

SEQ ID NO: 28886 - protein, 10 aa, Homo Sapiens
ATFTYFYKKF

SEQ ID NO: 28887 - protein, 10 aa, Homo Sapiens
ATGDMSGLLK

SEQ ID NO: 28888 - protein, 10 aa, Homo Sapiens
ATGESIAVKK

SEQ ID NO: 28889 - protein, 10 aa, Homo Sapiens
ATGKWKQISK

SEQ ID NO: 28890 - protein, 10 aa, Homo Sapiens
ATGQWTRFKK

SEQ ID NO: 28891 - protein, 10 aa, Homo Sapiens
ATGSWDSFLK

SEQ ID NO: 28892 - protein, 10 aa, Homo Sapiens
ATIDGSVNPK

SEQ ID NO: 28893 - protein, 10 aa, Homo Sapiens
ATIRNVLREK

SEQ ID NO: 28894 - protein, 10 aa, Homo Sapiens
ATITDKELLK

SEQ ID NO: 28895 - protein, 10 aa, Homo Sapiens
ATLDIDGVRK

SEQ ID NO: 28896 - protein, 10 aa, Homo Sapiens
ATLEETLVKK

SEQ ID NO: 28897 - protein, 10 aa, Homo Sapiens
ATLGAILNRL

SEQ ID NO: 28898 - protein, 10 aa, Homo Sapiens
ATLGLVDIVK

SEQ ID NO: 28899 - protein, 10 aa, Homo Sapiens
ATLGSGNLRQ

SEQ ID NO: 28900 - protein, 10 aa, Homo Sapiens
ATLKWILENK

SEQ ID NO: 28901 - protein, 10 aa, Homo Sapiens
ATLLPDLIQK

SEQ ID NO: 28902 - protein, 10 aa, Homo Sapiens
ATLPKNPPPK

SEQ ID NO: 28903 - protein, 10 aa, Homo Sapiens
ATLPNQPVEK

SEQ ID NO: 28904 - protein, 10 aa, Homo Sapiens
ATLQESTFSK

SEQ ID NO: 28905 - protein, 10 aa, Homo Sapiens
ATLSLEKLLK

SEQ ID NO: 28906 - protein, 10 aa, Homo Sapiens
ATLYIQMNEK

SEQ ID NO: 28907 - protein, 10 aa, Homo Sapiens
ATMLATGGNR

SEQ ID NO: 28908 - protein, 10 aa, Homo Sapiens
ATMQESLRVK

SEQ ID NO: 28909 - protein, 10 aa, Homo Sapiens
ATNAAVTVLR

SEQ ID NO: 28910 - protein, 10 aa, Homo Sapiens
ATNGPPVLVK

SEQ ID NO: 28911 - protein, 10 aa, Homo Sapiens
ATNKITIIFK

SEQ ID NO: 28912 - protein, 10 aa, Homo Sapiens
ATNPESKVFY

SEQ ID NO: 28913 - protein, 10 aa, Homo Sapiens
ATNTVYVFAK

SEQ ID NO: 28914 - protein, 10 aa, Homo Sapiens
ATPELGSSLK

SEQ ID NO: 28915 - protein, 10 aa, Homo Sapiens
ATPEQVGKMK

SEQ ID NO: 28916 - protein, 10 aa, Homo Sapiens
ATPLDFPSKK

SEQ ID NO: 28917 - protein, 10 aa, Homo Sapiens
ATPLSTLSLK

SEQ ID NO: 28918 - protein, 10 aa, Homo Sapiens
ATPTSPIRVK

SEQ ID NO: 28919 - protein, 10 aa, Homo Sapiens
ATQDPPLPTR

SEQ ID NO: 28920 - protein, 10 aa, Homo Sapiens
ATQLAADLLK

SEQ ID NO: 28921 - protein, 10 aa, Homo Sapiens
ATQLLKLAHK

SEQ ID NO: 28922 - protein, 10 aa, Homo Sapiens
ATQMVRMILK

SEQ ID NO: 28923 - protein, 10 aa, Homo Sapiens
ATQTQFFHVK

SEQ ID NO: 28924 - protein, 10 aa, Homo Sapiens
ATQVAVSVPK

SEQ ID NO: 28925 - protein, 10 aa, Homo Sapiens
ATSPIIIHRL

SEQ ID NO: 28926 - protein, 10 aa, Homo Sapiens
ATSPPFQLTK

SEQ ID NO: 28927 - protein, 10 aa, Homo Sapiens
ATSPPGAIPK

SEQ ID NO: 28928 - protein, 10 aa, Homo Sapiens
ATSSDVIEMK

SEQ ID NO: 28929 - protein, 10 aa, Homo Sapiens
ATSTGGIVNK

SEQ ID NO: 28930 - protein, 10 aa, Homo Sapiens
ATTSNFTFSK

SEQ ID NO: 28931 - protein, 10 aa, Homo Sapiens
ATTSVITIVK

SEQ ID NO: 28932 - protein, 10 aa, Homo Sapiens
ATVAVPLVGK

SEQ ID NO: 28933 - protein, 10 aa, Homo Sapiens
ATVFPSPCQK

SEQ ID NO: 28934 - protein, 10 aa, Homo Sapiens
ATWATKELRK

SEQ ID NO: 28935 - protein, 10 aa, Homo Sapiens
ATYEDIVTLR

SEQ ID NO: 28936 - protein, 10 aa, Homo Sapiens
ATYSEDGLLK

SEQ ID NO: 28937 - protein, 10 aa, Homo Sapiens
ATYYGAFIKK

SEQ ID NO: 28938 - protein, 10 aa, Homo Sapiens
AVAALQDLRY

SEQ ID NO: 28939 - protein, 10 aa, Homo Sapiens
AVALNYGIYK

SEQ ID NO: 28940 - protein, 10 aa, Homo Sapiens
AVANIVNSVK

SEQ ID NO: 28941 - protein, 10 aa, Homo Sapiens
AVAVDVAVPK

SEQ ID NO: 28942 - protein, 10 aa, Homo Sapiens
AVCEVALDYK

SEQ ID NO: 28943 - protein, 10 aa, Homo Sapiens
AVDNADPILK

SEQ ID NO: 28944 - protein, 10 aa, Homo Sapiens
AVFDRDINCR

SEQ ID NO: 28945 - protein, 10 aa, Homo Sapiens
AVFGVIGSQK

SEQ ID NO: 28946 - protein, 10 aa, Homo Sapiens
AVFPKPFVEK

SEQ ID NO: 28947 - protein, 10 aa, Homo Sapiens
AVFRGRMSMK

SEQ ID NO: 28948 - protein, 10 aa, Homo Sapiens
AVIEKFAPIK

SEQ ID NO: 28949 - protein, 10 aa, Homo Sapiens
AVIKEKIEEK

SEQ ID NO: 28950 - protein, 10 aa, Homo Sapiens
AVIPCFPYAR

SEQ ID NO: 28951 - protein, 10 aa, Homo Sapiens
AVISPPTVPK

SEQ ID NO: 28952 - protein, 10 aa, Homo Sapiens
AVITNKDVRK

SEQ ID NO: 28953 - protein, 10 aa, Homo Sapiens
AVIVDKKMQK

SEQ ID NO: 28954 - protein, 10 aa, Homo Sapiens
AVLDLSWNKL

SEQ ID NO: 28955 - protein, 10 aa, Homo Sapiens
AVLNFKLKKK

SEQ ID NO: 28956 - protein, 10 aa, Homo Sapiens
AVLYQPLFDK

SEQ ID NO: 28957 - protein, 10 aa, Homo Sapiens
AVMDITDIIK

SEQ ID NO: 28958 - protein, 10 aa, Homo Sapiens
AVMDVVKKQK

SEQ ID NO: 28959 - protein, 10 aa, Homo Sapiens
AVMGAYVLLK

SEQ ID NO: 28960 - protein, 10 aa, Homo Sapiens
AVMSATFAKF

SEQ ID NO: 28961 - protein, 10 aa, Homo Sapiens
AVNAHSNILK

SEQ ID NO: 28962 - protein, 10 aa, Homo Sapiens
AVNMVPFPRL

SEQ ID NO: 28963 - protein, 10 aa, Homo Sapiens
AVNPKEIASK

SEQ ID NO: 28964 - protein, 10 aa, Homo Sapiens
AVNPYFDIPK

SEQ ID NO: 28965 - protein, 10 aa, Homo Sapiens
AVPNGPQSPK

SEQ ID NO: 28966 - protein, 10 aa, Homo Sapiens
AVPTNIIAAK

SEQ ID NO: 28967 - protein, 10 aa, Homo Sapiens
AVQAITGNFK

SEQ ID NO: 28968 - protein, 10 aa, Homo Sapiens
AVQKAIPMYK

SEQ ID NO: 28969 - protein, 10 aa, Homo Sapiens
AVRGSVVLEK

SEQ ID NO: 28970 - protein, 10 aa, Homo Sapiens
AVSDFHPVKK

SEQ ID NO: 28971 - protein, 10 aa, Homo Sapiens
AVVGPVGAGK

SEQ ID NO: 28972 - protein, 10 aa, Homo Sapiens
AVYADSGNFK

SEQ ID NO: 28973 - protein, 10 aa, Homo Sapiens
AVYGQKEIHR

SEQ ID NO: 28974 - protein, 10 aa, Homo Sapiens
EVAPPEYHRK

SEQ ID NO: 28975 - protein, 10 aa, Homo Sapiens
GAYDQQIWEK

SEQ ID NO: 28976 - protein, 10 aa, Homo Sapiens
GIFPGTPLKK

SEQ ID NO: 28977 - protein, 10 aa, Homo Sapiens
GIISSPLTGK

SEQ ID NO: 28978 - protein, 10 aa, Homo Sapiens
GIVPVPLAEK

SEQ ID NO: 28979 - protein, 10 aa, Homo Sapiens
GLAAGTVPEK

SEQ ID NO: 28980 - protein, 10 aa, Homo Sapiens
GQCGDILTNK

SEQ ID NO: 28981 - protein, 10 aa, Homo Sapiens
GQFIGPHRIK

SEQ ID NO: 28982 - protein, 10 aa, Homo Sapiens
GQFSGFPFEK

SEQ ID NO: 28983 - protein, 10 aa, Homo Sapiens
GQGTFTKIFK

SEQ ID NO: 28984 - protein, 10 aa, Homo Sapiens
GQNVFGSFLK

SEQ ID NO: 28985 - protein, 10 aa, Homo Sapiens
GQPLVVIPPK

SEQ ID NO: 28986 - protein, 10 aa, Homo Sapiens
GSFASIFWLK

SEQ ID NO: 28987 - protein, 10 aa, Homo Sapiens
GSFVGELMYK

SEQ ID NO: 28988 - protein, 10 aa, Homo Sapiens
GSMSTVVSTK

SEQ ID NO: 28989 - protein, 10 aa, Homo Sapiens
GSSANIPPLK

SEQ ID NO: 28990 - protein, 10 aa, Homo Sapiens
GSTYFERCLK

SEQ ID NO: 28991 - protein, 10 aa, Homo Sapiens
GSVELPIVGK

SEQ ID NO: 28992 - protein, 10 aa, Homo Sapiens
GSYDPQQIFK

SEQ ID NO: 28993 - protein, 10 aa, Homo Sapiens
GSYNKVFLAK

SEQ ID NO: 28994 - protein, 10 aa, Homo Sapiens
GSYTFDPVTK

SEQ ID NO: 28995 - protein, 10 aa, Homo Sapiens
GTAIIQLPSK

SEQ ID NO: 28996 - protein, 10 aa, Homo Sapiens
GTAIKPLPSY

SEQ ID NO: 28997 - protein, 10 aa, Homo Sapiens
GTAPLVAPPR

SEQ ID NO: 28998 - protein, 10 aa, Homo Sapiens
GTASVLQPVK

SEQ ID NO: 28999 - protein, 10 aa, Homo Sapiens
GTDRTGFTFK

SEQ ID NO: 29000 - protein, 10 aa, Homo Sapiens
GTEEAPKVFK

SEQ ID NO: 29001 - protein, 10 aa, Homo Sapiens
GTFDPDNLEK

SEQ ID NO: 29002 - protein, 10 aa, Homo Sapiens
GTFPRAFKKL

SEQ ID NO: 29003 - protein, 10 aa, Homo Sapiens
GTFQQMWISK

SEQ ID NO: 29004 - protein, 10 aa, Homo Sapiens
GTIAGLNVLR

SEQ ID NO: 29005 - protein, 10 aa, Homo Sapiens
GTIGMRPNAK

SEQ ID NO: 29006 - protein, 10 aa, Homo Sapiens
GTILGTRSLK

SEQ ID NO: 29007 - protein, 10 aa, Homo Sapiens
GTINIVHPKL

SEQ ID NO: 29008 - protein, 10 aa, Homo Sapiens
GTIPGNPYPK

SEQ ID NO: 29009 - protein, 10 aa, Homo Sapiens
GTKGPSNVFK

SEQ ID NO: 29010 - protein, 10 aa, Homo Sapiens
GTLDYILQRC

SEQ ID NO: 29011 - protein, 10 aa, Homo Sapiens
GTLEIPVAQK

SEQ ID NO: 29012 - protein, 10 aa, Homo Sapiens
GTLQPPFTAR

SEQ ID NO: 29013 - protein, 10 aa, Homo Sapiens
GTMDMSITRL

SEQ ID NO: 29014 - protein, 10 aa, Homo Sapiens
GTMPLRNIFK

SEQ ID NO: 29015 - protein, 10 aa, Homo Sapiens
GTNFPNKIEK

SEQ ID NO: 29016 - protein, 10 aa, Homo Sapiens
GTNSKPCFQK

SEQ ID NO: 29017 - protein, 10 aa, Homo Sapiens
GTNVNMPVSK

SEQ ID NO: 29018 - protein, 10 aa, Homo Sapiens
GTPAGGGFPR

SEQ ID NO: 29019 - protein, 10 aa, Homo Sapiens
GTPLETIQKK

SEQ ID NO: 29020 - protein, 10 aa, Homo Sapiens
GTSHLPGLLK

SEQ ID NO: 29021 - protein, 10 aa, Homo Sapiens
GTSSVIVSRK

SEQ ID NO: 29022 - protein, 10 aa, Homo Sapiens
GTVDVTPFIK

SEQ ID NO: 29023 - protein, 10 aa, Homo Sapiens
GTVIHFNNPK

SEQ ID NO: 29024 - protein, 10 aa, Homo Sapiens
GTYGLDSVKK

SEQ ID NO: 29025 - protein, 10 aa, Homo Sapiens
GTYVKPLSNK

SEQ ID NO: 29026 - protein, 10 aa, Homo Sapiens
GVFEGIPTYR

SEQ ID NO: 29027 - protein, 10 aa, Homo Sapiens
GVFRGPVLPK

SEQ ID NO: 29028 - protein, 10 aa, Homo Sapiens
GVIPYFPYSK

SEQ ID NO: 29029 - protein, 10 aa, Homo Sapiens
GVMRIGLVAK

SEQ ID NO: 29030 - protein, 10 aa, Homo Sapiens
GVNDAPALKK

SEQ ID NO: 29031 - protein, 10 aa, Homo Sapiens
GVNDSPALKK

SEQ ID NO: 29032 - protein, 10 aa, Homo Sapiens
GVPAQPLGPR

SEQ ID NO: 29033 - protein, 10 aa, Homo Sapiens
GVYGDVQRVK

SEQ ID NO: 29034 - protein, 10 aa, Homo Sapiens
GVYNLEIVDK

SEQ ID NO: 29035 - protein, 10 aa, Homo Sapiens
HLLETPLVVK

SEQ ID NO: 29036 - protein, 10 aa, Homo Sapiens
HVYDGKFLAR

SEQ ID NO: 29037 - protein, 10 aa, Homo Sapiens
IAAAKPTPPK

SEQ ID NO: 29038 - protein, 10 aa, Homo Sapiens
IGLPAGPPKP

SEQ ID NO: 29039 - protein, 10 aa, Homo Sapiens
IIFAEPTPEK

SEQ ID NO: 29040 - protein, 10 aa, Homo Sapiens
IIFVGTPVQK

SEQ ID NO: 29041 - protein, 10 aa, Homo Sapiens
IMPKDIQLAR

SEQ ID NO: 29042 - protein, 10 aa, Homo Sapiens
IQFNPPLSEK

SEQ ID NO: 29043 - protein, 10 aa, Homo Sapiens
ISFPATGCQK

SEQ ID NO: 29044 - protein, 10 aa, Homo Sapiens
ISMDLQLTNK

SEQ ID NO: 29045 - protein, 10 aa, Homo Sapiens
ITNDGATILK

SEQ ID NO: 29046 - protein, 10 aa, Homo Sapiens
IVDTGIGMTK

SEQ ID NO: 29047 - protein, 10 aa, Homo Sapiens
IVYCGQVFEK

SEQ ID NO: 29048 - protein, 10 aa, Homo Sapiens
KAFNQGKIFK

SEQ ID NO: 29049 - protein, 10 aa, Homo Sapiens
KAKEPPFVRK

SEQ ID NO: 29050 - protein, 10 aa, Homo Sapiens
KAMDVLPILK

SEQ ID NO: 29051 - protein, 10 aa, Homo Sapiens
KIMKDILEKK

SEQ ID NO: 29052 - protein, 10 aa, Homo Sapiens
KLFPGRPPVK

SEQ ID NO: 29053 - protein, 10 aa, Homo Sapiens
KMMADYGIRK

SEQ ID NO: 29054 - protein, 10 aa, Homo Sapiens
KQGVKSVAGK

SEQ ID NO: 29055 - protein, 10 aa, Homo Sapiens
KQINLWKIYK

SEQ ID NO: 29056 - protein, 10 aa, Homo Sapiens
KSFDTSLIRK

SEQ ID NO: 29057 - protein, 10 aa, Homo Sapiens
KSFPGIPLHH

SEQ ID NO: 29058 - protein, 10 aa, Homo Sapiens
KSLDQAISRF

SEQ ID NO: 29059 - protein, 10 aa, Homo Sapiens
KSMNANTITK

SEQ ID NO: 29060 - protein, 10 aa, Homo Sapiens
KSNGTIIHVK

SEQ ID NO: 29061 - protein, 10 aa, Homo Sapiens
KSPSEPLIPK

SEQ ID NO: 29062 - protein, 10 aa, Homo Sapiens
KTALRAQVKK

SEQ ID NO: 29063 - protein, 10 aa, Homo Sapiens
KTFEGNLTTK

SEQ ID NO: 29064 - protein, 10 aa, Homo Sapiens
KTFSEVLAEK

SEQ ID NO: 29065 - protein, 10 aa, Homo Sapiens
KTIAPALVSK

SEQ ID NO: 29066 - protein, 10 aa, Homo Sapiens
KTIDKKTFYK

SEQ ID NO: 29067 - protein, 10 aa, Homo Sapiens
KTLDEILQEK

SEQ ID NO: 29068 - protein, 10 aa, Homo Sapiens
KTLETNPYVK

SEQ ID NO: 29069 - protein, 10 aa, Homo Sapiens
KTNMPIITSK

SEQ ID NO: 29070 - protein, 10 aa, Homo Sapiens
KTYGEIFEKF

SEQ ID NO: 29071 - protein, 10 aa, Homo Sapiens
KVCNPIITKL

SEQ ID NO: 29072 - protein, 10 aa, Homo Sapiens
KVFDGIPPPY

SEQ ID NO: 29073 - protein, 10 aa, Homo Sapiens
KVGENVLPPK

SEQ ID NO: 29074 - protein, 10 aa, Homo Sapiens
KVKPPHGFQK

SEQ ID NO: 29075 - protein, 10 aa, Homo Sapiens
KVLDAIIQEK

SEQ ID NO: 29076 - protein, 10 aa, Homo Sapiens
KVLELQSPPK

SEQ ID NO: 29077 - protein, 10 aa, Homo Sapiens
KVNIIPIIAK

SEQ ID NO: 29078 - protein, 10 aa, Homo Sapiens
KVNTVPLKNK

SEQ ID NO: 29079 - protein, 10 aa, Homo Sapiens
KVQEMNYIQK

SEQ ID NO: 29080 - protein, 10 aa, Homo Sapiens
KVTEGSFVYK

SEQ ID NO: 29081 - protein, 10 aa, Homo Sapiens
KVVEGSFVYK

SEQ ID NO: 29082 - protein, 10 aa, Homo Sapiens
KVYLGDIPLK

SEQ ID NO: 29083 - protein, 10 aa, Homo Sapiens
LDSCTKLLQK

SEQ ID NO: 29084 - protein, 10 aa, Homo Sapiens
LQNEPLPERL

SEQ ID NO: 29085 - protein, 10 aa, Homo Sapiens
LQNPLLVPVK

SEQ ID NO: 29086 - protein, 10 aa, Homo Sapiens
LSLGVAALYK

SEQ ID NO: 29087 - protein, 10 aa, Homo Sapiens
LTFEGTGPTK

SEQ ID NO: 29088 - protein, 10 aa, Homo Sapiens
LTNPKTNIQK

SEQ ID NO: 29089 - protein, 10 aa, Homo Sapiens
LVFPSEIVGK

SEQ ID NO: 29090 - protein, 10 aa, Homo Sapiens
MQFSGSLHTK

SEQ ID NO: 29091 - protein, 10 aa, Homo Sapiens
MTGGGSKVMK

SEQ ID NO: 29092 - protein, 10 aa, Homo Sapiens
MTTAGKTNQK

SEQ ID NO: 29093 - protein, 10 aa, Homo Sapiens
MVYPFTGDHK

SEQ ID NO: 29094 - protein, 10 aa, Homo Sapiens
NSTFNQVVLK

SEQ ID NO: 29095 - protein, 10 aa, Homo Sapiens
PEAGGPPIKK

SEQ ID NO: 29096 - protein, 10 aa, Homo Sapiens
QIPQLPAPPK

SEQ ID NO: 29097 - protein, 10 aa, Homo Sapiens
QLLSQLKHPN

SEQ ID NO: 29098 - protein, 10 aa, Homo Sapiens
QSFDKEWVAK

SEQ ID NO: 29099 - protein, 10 aa, Homo Sapiens
QSNPAPQVQK

SEQ ID NO: 29100 - protein, 10 aa, Homo Sapiens
QTIPPPYVVR

SEQ ID NO: 29101 - protein, 10 aa, Homo Sapiens
QVQEGTKVLK

SEQ ID NO: 29102 - protein, 10 aa, Homo Sapiens
QVQKPGPLQK

SEQ ID NO: 29103 - protein, 10 aa, Homo Sapiens
QVQPKPSPPR

SEQ ID NO: 29104 - protein, 10 aa, Homo Sapiens
RAAVPDAVGK

SEQ ID NO: 29105 - protein, 10 aa, Homo Sapiens
RAFSFSKTPK

SEQ ID NO: 29106 - protein, 10 aa, Homo Sapiens
RAMDVEPRAK

SEQ ID NO: 29107 - protein, 10 aa, Homo Sapiens
RGMGELLPTK

SEQ ID NO: 29108 - protein, 10 aa, Homo Sapiens
RIFTLKPVRK

SEQ ID NO: 29109 - protein, 10 aa, Homo Sapiens
RIIEETLALK

SEQ ID NO: 29110 - protein, 10 aa, Homo Sapiens
RIMDPEIALK

SEQ ID NO: 29111 - protein, 10 aa, Homo Sapiens
RIQDGLGELK

SEQ ID NO: 29112 - protein, 10 aa, Homo Sapiens
RIYDVGMQLK

SEQ ID NO: 29113 - protein, 10 aa, Homo Sapiens
RLMSLPIAKK

SEQ ID NO: 29114 - protein, 10 aa, Homo Sapiens
RMFLSFPTTK

SEQ ID NO: 29115 - protein, 10 aa, Homo Sapiens
RSAQPLPLKI

SEQ ID NO: 29116 - protein, 10 aa, Homo Sapiens
RTAALPTFRK

SEQ ID NO: 29117 - protein, 10 aa, Homo Sapiens
RTATQLAVNK

SEQ ID NO: 29118 - protein, 10 aa, Homo Sapiens
RTAVPSFLTK

SEQ ID NO: 29119 - protein, 10 aa, Homo Sapiens
RTDDKVIRFK

SEQ ID NO: 29120 - protein, 10 aa, Homo Sapiens
RTFMIKFPWK

SEQ ID NO: 29121 - protein, 10 aa, Homo Sapiens
RTGPPMGSRF

SEQ ID NO: 29122 - protein, 10 aa, Homo Sapiens
RTLDAKMPRK

SEQ ID NO: 29123 - protein, 10 aa, Homo Sapiens
RTLSDYNIQK

SEQ ID NO: 29124 - protein, 10 aa, Homo Sapiens
RTSRPLKILR

SEQ ID NO: 29125 - protein, 10 aa, Homo Sapiens
RTVPVGGVVK

SEQ ID NO: 29126 - protein, 10 aa, Homo Sapiens
RTYDREGFKK

SEQ ID NO: 29127 - protein, 10 aa, Homo Sapiens
RVCDAVKALK

SEQ ID NO: 29128 - protein, 10 aa, Homo Sapiens
RVCDIILPRL

SEQ ID NO: 29129 - protein, 10 aa, Homo Sapiens
RVFQETQKLK

SEQ ID NO: 29130 - protein, 10 aa, Homo Sapiens
RVFTGQAKVK

SEQ ID NO: 29131 - protein, 10 aa, Homo Sapiens
RVINSIPLAK

SEQ ID NO: 29132 - protein, 10 aa, Homo Sapiens
RVIYKPIVEK

SEQ ID NO: 29133 - protein, 10 aa, Homo Sapiens
RVLDFDVKRK

SEQ ID NO: 29134 - protein, 10 aa, Homo Sapiens
RVLDVGFVGR

SEQ ID NO: 29135 - protein, 10 aa, Homo Sapiens
RVLEAAVAAK

SEQ ID NO: 29136 - protein, 10 aa, Homo Sapiens
RVLEALLPLK

SEQ ID NO: 29137 - protein, 10 aa, Homo Sapiens
RVLKPGGLLK

SEQ ID NO: 29138 - protein, 10 aa, Homo Sapiens
RVLSKAFSRL

SEQ ID NO: 29139 - protein, 10 aa, Homo Sapiens
RVMDVQYNKF

SEQ ID NO: 29140 - protein, 10 aa, Homo Sapiens
RVNKVIIGTK

SEQ ID NO: 29141 - protein, 10 aa, Homo Sapiens
RVPLDPLIGK

SEQ ID NO: 29142 - protein, 10 aa, Homo Sapiens
RVPQAEGPPK

SEQ ID NO: 29143 - protein, 10 aa, Homo Sapiens
RVSNVKSVYK

SEQ ID NO: 29144 - protein, 10 aa, Homo Sapiens
RVWDLPGVLK

SEQ ID NO: 29145 - protein, 10 aa, Homo Sapiens
SAAEPVPAAR

SEQ ID NO: 29146 - protein, 10 aa, Homo Sapiens
SAFDRILSSK

SEQ ID NO: 29147 - protein, 10 aa, Homo Sapiens
SAFGNILSCK

SEQ ID NO: 29148 - protein, 10 aa, Homo Sapiens
SAFHKVLSEK

SEQ ID NO: 29149 - protein, 10 aa, Homo Sapiens
SAFLLLGLFK

SEQ ID NO: 29150 - protein, 10 aa, Homo Sapiens
SAFQAPAVKK

SEQ ID NO: 29151 - protein, 10 aa, Homo Sapiens
SALTGVLSAK

SEQ ID NO: 29152 - protein, 10 aa, Homo Sapiens
SANIGPFLEK

SEQ ID NO: 29153 - protein, 10 aa, Homo Sapiens
SAQGKPLALK

SEQ ID NO: 29154 - protein, 10 aa, Homo Sapiens
SAYLGSEQYK

SEQ ID NO: 29155 - protein, 10 aa, Homo Sapiens
SAYYPSSFPK

SEQ ID NO: 29156 - protein, 10 aa, Homo Sapiens
SDPNVSKKLK

SEQ ID NO: 29157 - protein, 10 aa, Homo Sapiens
SGFAGVYFEK

SEQ ID NO: 29158 - protein, 10 aa, Homo Sapiens
SGLVPAAPPK

SEQ ID NO: 29159 - protein, 10 aa, Homo Sapiens
SIAVKSIHRK

SEQ ID NO: 29160 - protein, 10 aa, Homo Sapiens
SIDGRVVEPK

SEQ ID NO: 29161 - protein, 10 aa, Homo Sapiens
SIFDGRVVAK

SEQ ID NO: 29162 - protein, 10 aa, Homo Sapiens
SIFEPVNLPK

SEQ ID NO: 29163 - protein, 10 aa, Homo Sapiens
SIFFESMPYK

SEQ ID NO: 29164 - protein, 10 aa, Homo Sapiens
SIFGGTDMKK

SEQ ID NO: 29165 - protein, 10 aa, Homo Sapiens
SIFVPPFISK

SEQ ID NO: 29166 - protein, 10 aa, Homo Sapiens
SIKIKTDSAK

SEQ ID NO: 29167 - protein, 10 aa, Homo Sapiens
SILEDYANYK

SEQ ID NO: 29168 - protein, 10 aa, Homo Sapiens
SILEKGFIAK

SEQ ID NO: 29169 - protein, 10 aa, Homo Sapiens
SILRNPVTNK

SEQ ID NO: 29170 - protein, 10 aa, Homo Sapiens
SIPQKPQTNK

SEQ ID NO: 29171 - protein, 10 aa, Homo Sapiens
SIPVAPTPPR

SEQ ID NO: 29172 - protein, 10 aa, Homo Sapiens
SIYDGDEFRK

SEQ ID NO: 29173 - protein, 10 aa, Homo Sapiens
SLFDRQGFLK

SEQ ID NO: 29174 - protein, 10 aa, Homo Sapiens
SLFVFFNHPK

SEQ ID NO: 29175 - protein, 10 aa, Homo Sapiens
SLMDRPLCER

SEQ ID NO: 29176 - protein, 10 aa, Homo Sapiens
SLNGEFGYQK

SEQ ID NO: 29177 - protein, 10 aa, Homo Sapiens
SLPANTPLRK

SEQ ID NO: 29178 - protein, 10 aa, Homo Sapiens
SLPDFPAAAK

SEQ ID NO: 29179 - protein, 10 aa, Homo Sapiens
SLPDIPFDPK

SEQ ID NO: 29180 - protein, 10 aa, Homo Sapiens
SLPDLTTPLK

SEQ ID NO: 29181 - protein, 10 aa, Homo Sapiens
SLPEQPCTKK

SEQ ID NO: 29182 - protein, 10 aa, Homo Sapiens
SLPLVDTHSK

SEQ ID NO: 29183 - protein, 10 aa, Homo Sapiens
SLPTVIMRNK

SEQ ID NO: 29184 - protein, 10 aa, Homo Sapiens
SLPVEVPLNH

SEQ ID NO: 29185 - protein, 10 aa, Homo Sapiens
SLQEVTIHEK

SEQ ID NO: 29186 - protein, 10 aa, Homo Sapiens
SQCDSPYVTK

SEQ ID NO: 29187 - protein, 10 aa, Homo Sapiens
SQFKGYFIFK

SEQ ID NO: 29188 - protein, 10 aa, Homo Sapiens
SQFSGKITVK

SEQ ID NO: 29189 - protein, 10 aa, Homo Sapiens
SQPTSLAPEK

SEQ ID NO: 29190 - protein, 10 aa, Homo Sapiens
SSAPPTPTRL

SEQ ID NO: 29191 - protein, 10 aa, Homo Sapiens
SSATTSPFFK

SEQ ID NO: 29192 - protein, 10 aa, Homo Sapiens
SSFSVKPFEK

SEQ ID NO: 29193 - protein, 10 aa, Homo Sapiens
SSLECIAIPK

SEQ ID NO: 29194 - protein, 10 aa, Homo Sapiens
SSLSLVEIYK

SEQ ID NO: 29195 - protein, 10 aa, Homo Sapiens
SSLSSPLNPK

SEQ ID NO: 29196 - protein, 10 aa, Homo Sapiens
SSMAGVYVCK

SEQ ID NO: 29197 - protein, 10 aa, Homo Sapiens
SSMFGTLPRK

SEQ ID NO: 29198 - protein, 10 aa, Homo Sapiens
SSMTQTPALK

SEQ ID NO: 29199 - protein, 10 aa, Homo Sapiens
SSQIPSSVNK

SEQ ID NO: 29200 - protein, 10 aa, Homo Sapiens
SSVESIISPK

SEQ ID NO: 29201 - protein, 10 aa, Homo Sapiens
SSVGSVITKK

SEQ ID NO: 29202 - protein, 10 aa, Homo Sapiens
SSYYSVLLQK

SEQ ID NO: 29203 - protein, 10 aa, Homo Sapiens
STADGSALVK

SEQ ID NO: 29204 - protein, 10 aa, Homo Sapiens
STAMNGNLAK

SEQ ID NO: 29205 - protein, 10 aa, Homo Sapiens
STANIDDLKK

SEQ ID NO: 29206 - protein, 10 aa, Homo Sapiens
STCNTKLTLK

SEQ ID NO: 29207 - protein, 10 aa, Homo Sapiens
STDPAAPNLK

SEQ ID NO: 29208 - protein, 10 aa, Homo Sapiens
STESNMSVPK

SEQ ID NO: 29209 - protein, 10 aa, Homo Sapiens
STFDTQITKK

SEQ ID NO: 29210 - protein, 10 aa, Homo Sapiens
STFLTFPIYK

SEQ ID NO: 29211 - protein, 10 aa, Homo Sapiens
STFNFHPNVR

SEQ ID NO: 29212 - protein, 10 aa, Homo Sapiens
STFNNDILSK

SEQ ID NO: 29213 - protein, 10 aa, Homo Sapiens
STFQQMWISK

SEQ ID NO: 29214 - protein, 10 aa, Homo Sapiens
STFSGGRIPK

SEQ ID NO: 29215 - protein, 10 aa, Homo Sapiens
STGKFEWGSK

SEQ ID NO: 29216 - protein, 10 aa, Homo Sapiens
STGVFTTMEK

SEQ ID NO: 29217 - protein, 10 aa, Homo Sapiens
STIDDTISKF

SEQ ID NO: 29218 - protein, 10 aa, Homo Sapiens
STLEHGTSLK

SEQ ID NO: 29219 - protein, 10 aa, Homo Sapiens
STLFSALLIK

SEQ ID NO: 29220 - protein, 10 aa, Homo Sapiens
STLTNPRQSP

SEQ ID NO: 29221 - protein, 10 aa, Homo Sapiens
STMEGGTLKY

SEQ ID NO: 29222 - protein, 10 aa, Homo Sapiens
STMGYMMAKK

SEQ ID NO: 29223 - protein, 10 aa, Homo Sapiens
STMTTPQVLK

SEQ ID NO: 29224 - protein, 10 aa, Homo Sapiens
STMYPGLPSR

SEQ ID NO: 29225 - protein, 10 aa, Homo Sapiens
STNSPVGVSK

SEQ ID NO: 29226 - protein, 10 aa, Homo Sapiens
STPLAGLAPK

SEQ ID NO: 29227 - protein, 10 aa, Homo Sapiens
STQNGPVFAK

SEQ ID NO: 29228 - protein, 10 aa, Homo Sapiens
STSETPQPPR

SEQ ID NO: 29229 - protein, 10 aa, Homo Sapiens
STSPSVALSK

SEQ ID NO: 29230 - protein, 10 aa, Homo Sapiens
STSVVRPFAK

SEQ ID NO: 29231 - protein, 10 aa, Homo Sapiens
STTQVVGILK

SEQ ID NO: 29232 - protein, 10 aa, Homo Sapiens
STVSADPVVK

SEQ ID NO: 29233 - protein, 10 aa, Homo Sapiens
STWEGIQAGK

SEQ ID NO: 29234 - protein, 10 aa, Homo Sapiens
STWTGPPAMK

SEQ ID NO: 29235 - protein, 10 aa, Homo Sapiens
STYDGVFIWK

SEQ ID NO: 29236 - protein, 10 aa, Homo Sapiens
STYGTHIHEK

SEQ ID NO: 29237 - protein, 10 aa, Homo Sapiens
STYYGSFVTR

SEQ ID NO: 29238 - protein, 10 aa, Homo Sapiens
SVAETAQTIK

SEQ ID NO: 29239 - protein, 10 aa, Homo Sapiens
SVAGGLFVGK

SEQ ID NO: 29240 - protein, 10 aa, Homo Sapiens
SVASTPISQR

SEQ ID NO: 29241 - protein, 10 aa, Homo Sapiens
SVCEGKGLHR

SEQ ID NO: 29242 - protein, 10 aa, Homo Sapiens
SVCPAGMIVK

SEQ ID NO: 29243 - protein, 10 aa, Homo Sapiens
SVFAGVVGVK

SEQ ID NO: 29244 - protein, 10 aa, Homo Sapiens
SVFDAYVLPK

SEQ ID NO: 29245 - protein, 10 aa, Homo Sapiens
SVFDFQKAYK

SEQ ID NO: 29246 - protein, 10 aa, Homo Sapiens
SVFEDPVISK

SEQ ID NO: 29247 - protein, 10 aa, Homo Sapiens
SVFESLIAKK

SEQ ID NO: 29248 - protein, 10 aa, Homo Sapiens
SVFNEHPSRR

SEQ ID NO: 29249 - protein, 10 aa, Homo Sapiens
SVFPYNHRMK

SEQ ID NO: 29250 - protein, 10 aa, Homo Sapiens
SVFQQGMKNK

SEQ ID NO: 29251 - protein, 10 aa, Homo Sapiens
SVFSDKLHSK

SEQ ID NO: 29252 - protein, 10 aa, Homo Sapiens
SVGTEMIITK

SEQ ID NO: 29253 - protein, 10 aa, Homo Sapiens
SVIDEPVRLK

SEQ ID NO: 29254 - protein, 10 aa, Homo Sapiens
SVIKEGWLHK

SEQ ID NO: 29255 - protein, 10 aa, Homo Sapiens
SVINPGAIYR

SEQ ID NO: 29256 - protein, 10 aa, Homo Sapiens
SVIRDYLVQK

SEQ ID NO: 29257 - protein, 10 aa, Homo Sapiens
SVISTDPLKR

SEQ ID NO: 29258 - protein, 10 aa, Homo Sapiens
SVLDLSVHKK

SEQ ID NO: 29259 - protein, 10 aa, Homo Sapiens
SVLDWEDLIR

SEQ ID NO: 29260 - protein, 10 aa, Homo Sapiens
SVLEPPLFLK

SEQ ID NO: 29261 - protein, 10 aa, Homo Sapiens
SVLNLVIVKK

SEQ ID NO: 29262 - protein, 10 aa, Homo Sapiens
SVLPTIRVPK

SEQ ID NO: 29263 - protein, 10 aa, Homo Sapiens
SVLPTSKPEK

SEQ ID NO: 29264 - protein, 10 aa, Homo Sapiens
SVLPYFVATK

SEQ ID NO: 29265 - protein, 10 aa, Homo Sapiens
SVMDQEMRVK

SEQ ID NO: 29266 - protein, 10 aa, Homo Sapiens
SVMLGGRNIK

SEQ ID NO: 29267 - protein, 10 aa, Homo Sapiens
SVMPKKSILK

SEQ ID NO: 29268 - protein, 10 aa, Homo Sapiens
SVMQKIIPHY

SEQ ID NO: 29269 - protein, 10 aa, Homo Sapiens
SVMRPEQIMK

SEQ ID NO: 29270 - protein, 10 aa, Homo Sapiens
SVMSTVEWNK

SEQ ID NO: 29271 - protein, 10 aa, Homo Sapiens
SVMYPVDSVK

SEQ ID NO: 29272 - protein, 10 aa, Homo Sapiens
SVMYSTLPGR

SEQ ID NO: 29273 - protein, 10 aa, Homo Sapiens
SVNIQALPDK

SEQ ID NO: 29274 - protein, 10 aa, Homo Sapiens
SVPREPIDRK

SEQ ID NO: 29275 - protein, 10 aa, Homo Sapiens
SVPSTPIAHR

SEQ ID NO: 29276 - protein, 10 aa, Homo Sapiens
SVPVAVVPSK

SEQ ID NO: 29277 - protein, 10 aa, Homo Sapiens
SVQEGIKFKK

SEQ ID NO: 29278 - protein, 10 aa, Homo Sapiens
SVQIPTGQNK

SEQ ID NO: 29279 - protein, 10 aa, Homo Sapiens
SVQLPKPVHK

SEQ ID NO: 29280 - protein, 10 aa, Homo Sapiens
SVQTQPAIKK

SEQ ID NO: 29281 - protein, 10 aa, Homo Sapiens
SVQVPEFTPK

SEQ ID NO: 29282 - protein, 10 aa, Homo Sapiens
SVSNMVHTAK

SEQ ID NO: 29283 - protein, 10 aa, Homo Sapiens
SVSQPIMVQR

SEQ ID NO: 29284 - protein, 10 aa, Homo Sapiens
SVSTITRIYR

SEQ ID NO: 29285 - protein, 10 aa, Homo Sapiens
SVTDVKFAPK

SEQ ID NO: 29286 - protein, 10 aa, Homo Sapiens
SVVGFPFLDK

SEQ ID NO: 29287 - protein, 10 aa, Homo Sapiens
SVYDALPLTR

SEQ ID NO: 29288 - protein, 10 aa, Homo Sapiens
SVYDHQGIFK

SEQ ID NO: 29289 - protein, 10 aa, Homo Sapiens
TALPASPVAR

SEQ ID NO: 29290 - protein, 10 aa, Homo Sapiens
TAMDVVYALK

SEQ ID NO: 29291 - protein, 10 aa, Homo Sapiens
TIDERAINKK

SEQ ID NO: 29292 - protein, 10 aa, Homo Sapiens
TIDERTINKK

SEQ ID NO: 29293 - protein, 10 aa, Homo Sapiens
TIQSGEQPYK

SEQ ID NO: 29294 - protein, 10 aa, Homo Sapiens
TQEKNPLPSK

SEQ ID NO: 29295 - protein, 10 aa, Homo Sapiens
TSFDGSLIQK

SEQ ID NO: 29296 - protein, 10 aa, Homo Sapiens
TSLLGYFPNK

SEQ ID NO: 29297 - protein, 10 aa, Homo Sapiens
TSTCSPIISK

SEQ ID NO: 29298 - protein, 10 aa, Homo Sapiens
TTATGVFSLK

SEQ ID NO: 29299 - protein, 10 aa, Homo Sapiens
TTISSFPQLK

SEQ ID NO: 29300 - protein, 10 aa, Homo Sapiens
TTLAFKPIKK

SEQ ID NO: 29301 - protein, 10 aa, Homo Sapiens
TTNDIVISKL

SEQ ID NO: 29302 - protein, 10 aa, Homo Sapiens
TTSDPPNICK

SEQ ID NO: 29303 - protein, 10 aa, Homo Sapiens
TTYPQTTIRK

SEQ ID NO: 29304 - protein, 10 aa, Homo Sapiens
TVAEISQFLK

SEQ ID NO: 29305 - protein, 10 aa, Homo Sapiens
TVAVPLVGKL

SEQ ID NO: 29306 - protein, 10 aa, Homo Sapiens
TVFREPIICK

SEQ ID NO: 29307 - protein, 10 aa, Homo Sapiens
TVISGPGTGK

SEQ ID NO: 29308 - protein, 10 aa, Homo Sapiens
TVLCQPTGGK

SEQ ID NO: 29309 - protein, 10 aa, Homo Sapiens
TVQDGRQFLK

SEQ ID NO: 29310 - protein, 10 aa, Homo Sapiens
TVYRNPESFK

SEQ ID NO: 29311 - protein, 10 aa, Homo Sapiens
VLINVDPCAK

SEQ ID NO: 29312 - protein, 10 aa, Homo Sapiens
VQEFGLARFK

SEQ ID NO: 29313 - protein, 10 aa, Homo Sapiens
VSILLGTVPK

SEQ ID NO: 29314 - protein, 10 aa, Homo Sapiens
VSISADGRIS

SEQ ID NO: 29315 - protein, 10 aa, Homo Sapiens
VSQIPPMAVK

SEQ ID NO: 29316 - protein, 10 aa, Homo Sapiens
VTASTGLLWK

SEQ ID NO: 29317 - protein, 10 aa, Homo Sapiens
VTDPSIPIRK

SEQ ID NO: 29318 - protein, 10 aa, Homo Sapiens
VTFGSIFGYK

SEQ ID NO: 29319 - protein, 10 aa, Homo Sapiens
VTGGPWPTRL

SEQ ID NO: 29320 - protein, 10 aa, Homo Sapiens
VTHRPPLSPK

SEQ ID NO: 29321 - protein, 10 aa, Homo Sapiens
VTIFIRGGNK

SEQ ID NO: 29322 - protein, 10 aa, Homo Sapiens
VTIIMNDYPK

SEQ ID NO: 29323 - protein, 10 aa, Homo Sapiens
VTIKEGSQLK

SEQ ID NO: 29324 - protein, 10 aa, Homo Sapiens
VTLSWKPVQK

SEQ ID NO: 29325 - protein, 10 aa, Homo Sapiens
VTMGFTGFGK

SEQ ID NO: 29326 - protein, 10 aa, Homo Sapiens
VTNDGATILK

SEQ ID NO: 29327 - protein, 10 aa, Homo Sapiens
VTTGSEGLLK

SEQ ID NO: 29328 - protein, 10 aa, Homo Sapiens
VTVDGHLIRK

SEQ ID NO: 29329 - protein, 10 aa, Homo Sapiens
VTVDPKYHPK

SEQ ID NO: 29330 - protein, 10 aa, Homo Sapiens
VTYNGVDNNK

SEQ ID NO: 29331 - protein, 10 aa, Homo Sapiens
VTYSDVGGCK

SEQ ID NO: 29332 - protein, 10 aa, Homo Sapiens
VTYVPVTTFK

SEQ ID NO: 29333 - protein, 10 aa, Homo Sapiens
VVCVEGIVTK

SEQ ID NO: 29334 - protein, 10 aa, Homo Sapiens
VVGVYRPPPK

SEQ ID NO: 29335 - protein, 10 aa, Homo Sapiens
VVINVNNILK

SEQ ID NO: 29336 - protein, 10 aa, Homo Sapiens
VVLGQFLVLK

SEQ ID NO: 29337 - protein, 10 aa, Homo Sapiens
VVMAADRSLK

SEQ ID NO: 29338 - protein, 10 aa, Homo Sapiens
VVMENVGQQK

SEQ ID NO: 29339 - protein, 10 aa, Homo Sapiens
VVMVNQGLTK

SEQ ID NO: 29340 - protein, 10 aa, Homo Sapiens
VVNKVPLTGK

SEQ ID NO: 29341 - protein, 10 aa, Homo Sapiens
VVQDMLVPMK

SEQ ID NO: 29342 - protein, 10 aa, Homo Sapiens
VVQEPGQVFK

SEQ ID NO: 29343 - protein, 10 aa, Homo Sapiens
VVVDPIQSVK

SEQ ID NO: 29344 - protein, 10 aa, Homo Sapiens
VVYPPPVDPK

SEQ ID NO: 29345 - protein, 10 aa, Homo Sapiens
VVYTSHLQLK

SEQ ID NO: 29346 - protein, 10 aa, Homo Sapiens
YIYDGELVSK

SEQ ID NO: 29347 - protein, 11 aa, Homo Sapiens
AAMNMGRPFQK

SEQ ID NO: 29348 - protein, 11 aa, Homo Sapiens
AAQDSTDLVAK

SEQ ID NO: 29349 - protein, 11 aa, Homo Sapiens
AGSSQSLSFPK

SEQ ID NO: 29350 - protein, 11 aa, Homo Sapiens
AIAQAESLRYK

SEQ ID NO: 29351 - protein, 11 aa, Homo Sapiens
AIFEVNTDLQK

SEQ ID NO: 29352 - protein, 11 aa, Homo Sapiens
AIIGKQGQHIK

SEQ ID NO: 29353 - protein, 11 aa, Homo Sapiens
AIIPSKKLRNK

SEQ ID NO: 29354 - protein, 11 aa, Homo Sapiens
AILHPSTYLNK

SEQ ID NO: 29355 - protein, 11 aa, Homo Sapiens
AIMDPLPLRTK

SEQ ID NO: 29356 - protein, 11 aa, Homo Sapiens
AIMISTYEFGK

SEQ ID NO: 29357 - protein, 11 aa, Homo Sapiens
AIQAEEIMKLK

SEQ ID NO: 29358 - protein, 11 aa, Homo Sapiens
AIYDGFDGFAK

SEQ ID NO: 29359 - protein, 11 aa, Homo Sapiens
AIYKTPPGIQK

SEQ ID NO: 29360 - protein, 11 aa, Homo Sapiens
ALLDGSNVVFK

SEQ ID NO: 29361 - protein, 11 aa, Homo Sapiens
ALPLDTVTFYK

SEQ ID NO: 29362 - protein, 11 aa, Homo Sapiens
ALQTAADAFYK

SEQ ID NO: 29363 - protein, 11 aa, Homo Sapiens
AMLPYDQYLHR

SEQ ID NO: 29364 - protein, 11 aa, Homo Sapiens
AMMNNNDLVRK

SEQ ID NO: 29365 - protein, 11 aa, Homo Sapiens
AQICSSIRTHK

SEQ ID NO: 29366 - protein, 11 aa, Homo Sapiens
AQIENSAAVEK

SEQ ID NO: 29367 - protein, 11 aa, Homo Sapiens
AQIENSAAVQK

SEQ ID NO: 29368 - protein, 11 aa, Homo Sapiens
AQNNPPVPPKP

SEQ ID NO: 29369 - protein, 11 aa, Homo Sapiens
AQQEHPRPYFK

SEQ ID NO: 29370 - protein, 11 aa, Homo Sapiens
AQYEQDLQHRK

SEQ ID NO: 29371 - protein, 11 aa, Homo Sapiens
AQYSPQQLAGK

SEQ ID NO: 29372 - protein, 11 aa, Homo Sapiens
ASALGSSSYKK

SEQ ID NO: 29373 - protein, 11 aa, Homo Sapiens
ASANLGGVPSK

SEQ ID NO: 29374 - protein, 11 aa, Homo Sapiens
ASDPNVSKKLK

SEQ ID NO: 29375 - protein, 11 aa, Homo Sapiens
ASFDATTCIWK

SEQ ID NO: 29376 - protein, 11 aa, Homo Sapiens
ASFLPPSSVKK

SEQ ID NO: 29377 - protein, 11 aa, Homo Sapiens
ASFNAYENHLK

SEQ ID NO: 29378 - protein, 11 aa, Homo Sapiens
ASFVPKPGSLK

SEQ ID NO: 29379 - protein, 11 aa, Homo Sapiens
ASHRPIKGILK

SEQ ID NO: 29380 - protein, 11 aa, Homo Sapiens
ASIAGSSIINK

SEQ ID NO: 29381 - protein, 11 aa, Homo Sapiens
ASIFVKDNVTK

SEQ ID NO: 29382 - protein, 11 aa, Homo Sapiens
ASIIGVNLATK

SEQ ID NO: 29383 - protein, 11 aa, Homo Sapiens
ASILVKDYILK

SEQ ID NO: 29384 - protein, 11 aa, Homo Sapiens
ASKKTAMAAAK

SEQ ID NO: 29385 - protein, 11 aa, Homo Sapiens
ASLDISRKWEK

SEQ ID NO: 29386 - protein, 11 aa, Homo Sapiens
ASLFPDSLIVK

SEQ ID NO: 29387 - protein, 11 aa, Homo Sapiens
ASLPSESNEPK

SEQ ID NO: 29388 - protein, 11 aa, Homo Sapiens
ASLREEECVMK

SEQ ID NO: 29389 - protein, 11 aa, Homo Sapiens
ASMPDNTAAQK

SEQ ID NO: 29390 - protein, 11 aa, Homo Sapiens
ASQEIAEKALK

SEQ ID NO: 29391 - protein, 11 aa, Homo Sapiens
ATAAAIGATPR

SEQ ID NO: 29392 - protein, 11 aa, Homo Sapiens
ATAASSSSLEK

SEQ ID NO: 29393 - protein, 11 aa, Homo Sapiens
ATAGIIGVNRK

SEQ ID NO: 29394 - protein, 11 aa, Homo Sapiens
ATAGKDDCLLK

SEQ ID NO: 29395 - protein, 11 aa, Homo Sapiens
ATASPFSGLQK

SEQ ID NO: 29396 - protein, 11 aa, Homo Sapiens
ATATVAALQEK

SEQ ID NO: 29397 - protein, 11 aa, Homo Sapiens
ATCEQLTYYSK

SEQ ID NO: 29398 - protein, 11 aa, Homo Sapiens
ATCFATKNGIK

SEQ ID NO: 29399 - protein, 11 aa, Homo Sapiens
ATDDSLHQLRK

SEQ ID NO: 29400 - protein, 11 aa, Homo Sapiens
ATEPPTESLLK

SEQ ID NO: 29401 - protein, 11 aa, Homo Sapiens
ATFKDLLTRHK

SEQ ID NO: 29402 - protein, 11 aa, Homo Sapiens
ATFNEDVQALK

SEQ ID NO: 29403 - protein, 11 aa, Homo Sapiens
ATFPVAPRYAK

SEQ ID NO: 29404 - protein, 11 aa, Homo Sapiens
ATGATFAHICK

SEQ ID NO: 29405 - protein, 11 aa, Homo Sapiens
ATGGAGFCINR

SEQ ID NO: 29406 - protein, 11 aa, Homo Sapiens
ATIDLNSVLER

SEQ ID NO: 29407 - protein, 11 aa, Homo Sapiens
ATIFGPNLLHK

SEQ ID NO: 29408 - protein, 11 aa, Homo Sapiens
ATIGHVEKFLR

SEQ ID NO: 29409 - protein, 11 aa, Homo Sapiens
ATIKDGKSLTK

SEQ ID NO: 29410 - protein, 11 aa, Homo Sapiens
ATILAGDIKVK

SEQ ID NO: 29411 - protein, 11 aa, Homo Sapiens
ATILAGDVKVK

SEQ ID NO: 29412 - protein, 11 aa, Homo Sapiens
ATIRVLEAIQK

SEQ ID NO: 29413 - protein, 11 aa, Homo Sapiens
ATIRVLESVQK

SEQ ID NO: 29414 - protein, 11 aa, Homo Sapiens
ATITDKELLKK

SEQ ID NO: 29415 - protein, 11 aa, Homo Sapiens
ATITDKEMLKK

SEQ ID NO: 29416 - protein, 11 aa, Homo Sapiens
ATITERGITSR

SEQ ID NO: 29417 - protein, 11 aa, Homo Sapiens
ATLEETLVKKK

SEQ ID NO: 29418 - protein, 11 aa, Homo Sapiens
ATLGDLKLVEK

SEQ ID NO: 29419 - protein, 11 aa, Homo Sapiens
ATLKELTSLVK

SEQ ID NO: 29420 - protein, 11 aa, Homo Sapiens
ATLLASNEAFK

SEQ ID NO: 29421 - protein, 11 aa, Homo Sapiens
ATLMPTKDVDK

SEQ ID NO: 29422 - protein, 11 aa, Homo Sapiens
ATLTTTSATSK

SEQ ID NO: 29423 - protein, 11 aa, Homo Sapiens
ATMKPHPTVQK

SEQ ID NO: 29424 - protein, 11 aa, Homo Sapiens
ATMLATGGNRK

SEQ ID NO: 29425 - protein, 11 aa, Homo Sapiens
ATMPASVVGQR

SEQ ID NO: 29426 - protein, 11 aa, Homo Sapiens
ATMSEVEWRGR

SEQ ID NO: 29427 - protein, 11 aa, Homo Sapiens
ATMVPSVLWPR

SEQ ID NO: 29428 - protein, 11 aa, Homo Sapiens
ATNEDSSLLAK

SEQ ID NO: 29429 - protein, 11 aa, Homo Sapiens
ATNNLMKLVQK

SEQ ID NO: 29430 - protein, 11 aa, Homo Sapiens
ATPGADVCFAR

SEQ ID NO: 29431 - protein, 11 aa, Homo Sapiens
ATPSPSNETPK

SEQ ID NO: 29432 - protein, 11 aa, Homo Sapiens
ATQAIFEILEK

SEQ ID NO: 29433 - protein, 11 aa, Homo Sapiens
ATQEGEWKALK

SEQ ID NO: 29434 - protein, 11 aa, Homo Sapiens
ATQLPESTSLR

SEQ ID NO: 29435 - protein, 11 aa, Homo Sapiens
ATQPWNRIQRR

SEQ ID NO: 29436 - protein, 11 aa, Homo Sapiens
ATQSAQVLLEK

SEQ ID NO: 29437 - protein, 11 aa, Homo Sapiens
ATSGCFTTAQK

SEQ ID NO: 29438 - protein, 11 aa, Homo Sapiens
ATSIDRLKVFK

SEQ ID NO: 29439 - protein, 11 aa, Homo Sapiens
ATSPHLESLLK

SEQ ID NO: 29440 - protein, 11 aa, Homo Sapiens
ATSYFGKQFLR

SEQ ID NO: 29441 - protein, 11 aa, Homo Sapiens
ATTSELEAINK

SEQ ID NO: 29442 - protein, 11 aa, Homo Sapiens
ATVGKATGFLK

SEQ ID NO: 29443 - protein, 11 aa, Homo Sapiens
ATYEAGALSLK

SEQ ID NO: 29444 - protein, 11 aa, Homo Sapiens
ATYFDSEVVPR

SEQ ID NO: 29445 - protein, 11 aa, Homo Sapiens
ATYPDVNNSIK

SEQ ID NO: 29446 - protein, 11 aa, Homo Sapiens
ATYPYQVVRAR

SEQ ID NO: 29447 - protein, 11 aa, Homo Sapiens
AVADKVHLMYK

SEQ ID NO: 29448 - protein, 11 aa, Homo Sapiens
AVAEEVNAILK

SEQ ID NO: 29449 - protein, 11 aa, Homo Sapiens
AVAEGAKNVMK

SEQ ID NO: 29450 - protein, 11 aa, Homo Sapiens
AVAELKDCIEK

SEQ ID NO: 29451 - protein, 11 aa, Homo Sapiens
AVAGDFALINK

SEQ ID NO: 29452 - protein, 11 aa, Homo Sapiens
AVAGQELCQPR

SEQ ID NO: 29453 - protein, 11 aa, Homo Sapiens
AVANAQELLQR

SEQ ID NO: 29454 - protein, 11 aa, Homo Sapiens
AVAPVASALEK

SEQ ID NO: 29455 - protein, 11 aa, Homo Sapiens
AVFDHPAKIAK

SEQ ID NO: 29456 - protein, 11 aa, Homo Sapiens
AVFILTDNISK

SEQ ID NO: 29457 - protein, 11 aa, Homo Sapiens
AVFISDIRNCK

SEQ ID NO: 29458 - protein, 11 aa, Homo Sapiens
AVFPSLLTNPK

SEQ ID NO: 29459 - protein, 11 aa, Homo Sapiens
AVHEAWAGMLK

SEQ ID NO: 29460 - protein, 11 aa, Homo Sapiens
AVHRITPEEAK

SEQ ID NO: 29461 - protein, 11 aa, Homo Sapiens
AVIGADSVTLK

SEQ ID NO: 29462 - protein, 11 aa, Homo Sapiens
AVINAYTEINK

SEQ ID NO: 29463 - protein, 11 aa, Homo Sapiens
AVIPEKQLVEK

SEQ ID NO: 29464 - protein, 11 aa, Homo Sapiens
AVISGEALGIK

SEQ ID NO: 29465 - protein, 11 aa, Homo Sapiens
AVISQCIYRHR

SEQ ID NO: 29466 - protein, 11 aa, Homo Sapiens
AVLEKQDISDK

SEQ ID NO: 29467 - protein, 11 aa, Homo Sapiens
AVLTHSGFPAK

SEQ ID NO: 29468 - protein, 11 aa, Homo Sapiens
AVMAESAFSFK

SEQ ID NO: 29469 - protein, 11 aa, Homo Sapiens
AVMDGNVITAK

SEQ ID NO: 29470 - protein, 11 aa, Homo Sapiens
AVMDNKNPTIK

SEQ ID NO: 29471 - protein, 11 aa, Homo Sapiens
AVMKDVVLIRK

SEQ ID NO: 29472 - protein, 11 aa, Homo Sapiens
AVPEIMDRIYK

SEQ ID NO: 29473 - protein, 11 aa, Homo Sapiens
AVQGISGLPLK

SEQ ID NO: 29474 - protein, 11 aa, Homo Sapiens
AVQLLQFLAPK

SEQ ID NO: 29475 - protein, 11 aa, Homo Sapiens
AVQTAAKELLK

SEQ ID NO: 29476 - protein, 11 aa, Homo Sapiens
AVQVVADVLSK

SEQ ID NO: 29477 - protein, 11 aa, Homo Sapiens
AVSEGTKAVTK

SEQ ID NO: 29478 - protein, 11 aa, Homo Sapiens
AVSKDIANWQK

SEQ ID NO: 29479 - protein, 11 aa, Homo Sapiens
AVTEAEIQQLK

SEQ ID NO: 29480 - protein, 11 aa, Homo Sapiens
AVVGGLDIHKK

SEQ ID NO: 29481 - protein, 11 aa, Homo Sapiens
AVVNSPHRQYK

SEQ ID NO: 29482 - protein, 11 aa, Homo Sapiens
AVVPLASVIVK

SEQ ID NO: 29483 - protein, 11 aa, Homo Sapiens
AVVSGESCPGK

SEQ ID NO: 29484 - protein, 11 aa, Homo Sapiens
AVYDRPGASPK

SEQ ID NO: 29485 - protein, 11 aa, Homo Sapiens
AVYEGHVSCVK

SEQ ID NO: 29486 - protein, 11 aa, Homo Sapiens
AVYGMLNLTPK

SEQ ID NO: 29487 - protein, 11 aa, Homo Sapiens
AVYGQKEIHRK

SEQ ID NO: 29488 - protein, 11 aa, Homo Sapiens
AVYGQNDIHHK

SEQ ID NO: 29489 - protein, 11 aa, Homo Sapiens
AVYLSTCKDSK

SEQ ID NO: 29490 - protein, 11 aa, Homo Sapiens
AVYSMVEFNGK

SEQ ID NO: 29491 - protein, 11 aa, Homo Sapiens
DEPQNLIKQNC

SEQ ID NO: 29492 - protein, 11 aa, Homo Sapiens
FDVKSGSAVHK

SEQ ID NO: 29493 - protein, 11 aa, Homo Sapiens
FLYQQQGRLDK

SEQ ID NO: 29494 - protein, 11 aa, Homo Sapiens
FSYSFSYKHLK

SEQ ID NO: 29495 - protein, 11 aa, Homo Sapiens
GAYSQSPAIKK

SEQ ID NO: 29496 - protein, 11 aa, Homo Sapiens
GQNPTNAEVLK

SEQ ID NO: 29497 - protein, 11 aa, Homo Sapiens
GSFASIFWLKK

SEQ ID NO: 29498 - protein, 11 aa, Homo Sapiens
GSLPGDKIRNK

SEQ ID NO: 29499 - protein, 11 aa, Homo Sapiens
GSMPELKKYMK

SEQ ID NO: 29500 - protein, 11 aa, Homo Sapiens
GSSPEQVVRPK

SEQ ID NO: 29501 - protein, 11 aa, Homo Sapiens
GSYIELPAYLK

SEQ ID NO: 29502 - protein, 11 aa, Homo Sapiens
GTAAIGYLAYK

SEQ ID NO: 29503 - protein, 11 aa, Homo Sapiens
GTAPSKPPLTK

SEQ ID NO: 29504 - protein, 11 aa, Homo Sapiens
GTASVLQPVKK

SEQ ID NO: 29505 - protein, 11 aa, Homo Sapiens
GTAYCTALYLR

SEQ ID NO: 29506 - protein, 11 aa, Homo Sapiens
GTCHNLPGLFR

SEQ ID NO: 29507 - protein, 11 aa, Homo Sapiens
GTEFGGSIYQK

SEQ ID NO: 29508 - protein, 11 aa, Homo Sapiens
GTFASVEQFWR

SEQ ID NO: 29509 - protein, 11 aa, Homo Sapiens
GTFEMAKVLCK

SEQ ID NO: 29510 - protein, 11 aa, Homo Sapiens
GTFGGLGSKSK

SEQ ID NO: 29511 - protein, 11 aa, Homo Sapiens
GTFSTVTSTVK

SEQ ID NO: 29512 - protein, 11 aa, Homo Sapiens
GTFVSPEVFLK

SEQ ID NO: 29513 - protein, 11 aa, Homo Sapiens
GTIEKSKLITK

SEQ ID NO: 29514 - protein, 11 aa, Homo Sapiens
GTIFAELATKK

SEQ ID NO: 29515 - protein, 11 aa, Homo Sapiens
GTIFIIKGVRK

SEQ ID NO: 29516 - protein, 11 aa, Homo Sapiens
GTIIVSGSTEK

SEQ ID NO: 29517 - protein, 11 aa, Homo Sapiens
GTIRSRSFIFK

SEQ ID NO: 29518 - protein, 11 aa, Homo Sapiens
GTLREYKVVGR

SEQ ID NO: 29519 - protein, 11 aa, Homo Sapiens
GTLSPLDIYPK

SEQ ID NO: 29520 - protein, 11 aa, Homo Sapiens
GTLTVEAPMPK

SEQ ID NO: 29521 - protein, 11 aa, Homo Sapiens
GTPGPSITGVP

SEQ ID NO: 29522 - protein, 11 aa, Homo Sapiens
GTSDRFSRILK

SEQ ID NO: 29523 - protein, 11 aa, Homo Sapiens
GTVAGAAVLLK

SEQ ID NO: 29524 - protein, 11 aa, Homo Sapiens
GTVDVTPFIKK

SEQ ID NO: 29525 - protein, 11 aa, Homo Sapiens
GTYGLDSVKKK

SEQ ID NO: 29526 - protein, 11 aa, Homo Sapiens
GVAGAVAVFPK

SEQ ID NO: 29527 - protein, 11 aa, Homo Sapiens
GVDSSIFQNPK

SEQ ID NO: 29528 - protein, 11 aa, Homo Sapiens
GVIGLLEPMKK

SEQ ID NO: 29529 - protein, 11 aa, Homo Sapiens
GVIGQDGLLFK

SEQ ID NO: 29530 - protein, 11 aa, Homo Sapiens
GVLGSSKVLAK

SEQ ID NO: 29531 - protein, 11 aa, Homo Sapiens
GVLQLGNIVFK

SEQ ID NO: 29532 - protein, 11 aa, Homo Sapiens
GVMTPCDKILK

SEQ ID NO: 29533 - protein, 11 aa, Homo Sapiens
GVRGMDGPQGP

SEQ ID NO: 29534 - protein, 11 aa, Homo Sapiens
HSIDGRVVEPK

SEQ ID NO: 29535 - protein, 11 aa, Homo Sapiens
HSMDTLLATLK

SEQ ID NO: 29536 - protein, 11 aa, Homo Sapiens
HTLDSYRILQK

SEQ ID NO: 29537 - protein, 11 aa, Homo Sapiens
HTMNVPSLFSK

SEQ ID NO: 29538 - protein, 11 aa, Homo Sapiens
HVLEAQDLIAK

SEQ ID NO: 29539 - protein, 11 aa, Homo Sapiens
IILEPDKNPKK

SEQ ID NO: 29540 - protein, 11 aa, Homo Sapiens
IIYDPKLQTPK

SEQ ID NO: 29541 - protein, 11 aa, Homo Sapiens
ISDPTSPLRTR

SEQ ID NO: 29542 - protein, 11 aa, Homo Sapiens
ITDPHSPSRFR

SEQ ID NO: 29543 - protein, 11 aa, Homo Sapiens
KASSEMALYQK

SEQ ID NO: 29544 - protein, 11 aa, Homo Sapiens
KAYEQAGMMLK

SEQ ID NO: 29545 - protein, 11 aa, Homo Sapiens
KGGGKKSALKK

SEQ ID NO: 29546 - protein, 11 aa, Homo Sapiens
KLFPGSPAIYK

SEQ ID NO: 29547 - protein, 11 aa, Homo Sapiens
KQQAHDLLINK

SEQ ID NO: 29548 - protein, 11 aa, Homo Sapiens
KSLGHGLINKK

SEQ ID NO: 29549 - protein, 11 aa, Homo Sapiens
KSLPAEINRMK

SEQ ID NO: 29550 - protein, 11 aa, Homo Sapiens
KSTTTGHLIYK

SEQ ID NO: 29551 - protein, 11 aa, Homo Sapiens
KTAEDAKDFFK

SEQ ID NO: 29552 - protein, 11 aa, Homo Sapiens
KTFGETHPFTK

SEQ ID NO: 29553 - protein, 11 aa, Homo Sapiens
KTFTIKRFLAK

SEQ ID NO: 29554 - protein, 11 aa, Homo Sapiens
KTIDMELVKRK

SEQ ID NO: 29555 - protein, 11 aa, Homo Sapiens
KTLAYRGFIFK

SEQ ID NO: 29556 - protein, 11 aa, Homo Sapiens
KTLDEILQEKK

SEQ ID NO: 29557 - protein, 11 aa, Homo Sapiens
KTLDQAKAVLK

SEQ ID NO: 29558 - protein, 11 aa, Homo Sapiens
KTLPAMLGTGK

SEQ ID NO: 29559 - protein, 11 aa, Homo Sapiens
KTMEDTLMTVK

SEQ ID NO: 29560 - protein, 11 aa, Homo Sapiens
KTQEPFSVRNK

SEQ ID NO: 29561 - protein, 11 aa, Homo Sapiens
KTSGSNVKIVK

SEQ ID NO: 29562 - protein, 11 aa, Homo Sapiens
KTSTVPPSLRK

SEQ ID NO: 29563 - protein, 11 aa, Homo Sapiens
KTVAGGAWTYK

SEQ ID NO: 29564 - protein, 11 aa, Homo Sapiens
KTYHALSNLPK

SEQ ID NO: 29565 - protein, 11 aa, Homo Sapiens
KTYIPPKGETK

SEQ ID NO: 29566 - protein, 11 aa, Homo Sapiens
KVFHAERIVRK

SEQ ID NO: 29567 - protein, 11 aa, Homo Sapiens
KVFPEDMAKYR

SEQ ID NO: 29568 - protein, 11 aa, Homo Sapiens
KVFVKSSDLLK

SEQ ID NO: 29569 - protein, 11 aa, Homo Sapiens
KVIDGERVIGR

SEQ ID NO: 29570 - protein, 11 aa, Homo Sapiens
KVLDHKDRVLK

SEQ ID NO: 29571 - protein, 11 aa, Homo Sapiens
KVLGQGKWNLK

SEQ ID NO: 29572 - protein, 11 aa, Homo Sapiens
KVLPGDHEYPK

SEQ ID NO: 29573 - protein, 11 aa, Homo Sapiens
KVLSIDQRNFK

SEQ ID NO: 29574 - protein, 11 aa, Homo Sapiens
KVQDVKKTIQK

SEQ ID NO: 29575 - protein, 11 aa, Homo Sapiens
KVSSINSRFAK

SEQ ID NO: 29576 - protein, 11 aa, Homo Sapiens
KVVPEMTEILK

SEQ ID NO: 29577 - protein, 11 aa, Homo Sapiens
KVYEGERPLTK

SEQ ID NO: 29578 - protein, 11 aa, Homo Sapiens
KVYLAQDIKTK

SEQ ID NO: 29579 - protein, 11 aa, Homo Sapiens
LGFLLLWERIE

SEQ ID NO: 29580 - protein, 11 aa, Homo Sapiens
LLGASVVPFMK

SEQ ID NO: 29581 - protein, 11 aa, Homo Sapiens
LTIQSGEQPYK

SEQ ID NO: 29582 - protein, 11 aa, Homo Sapiens
LVIDNGSGMCK

SEQ ID NO: 29583 - protein, 11 aa, Homo Sapiens
LVVDNGSGMCK

SEQ ID NO: 29584 - protein, 11 aa, Homo Sapiens
MQIAWSREFLK

SEQ ID NO: 29585 - protein, 11 aa, Homo Sapiens
MSMVANLLYEK

SEQ ID NO: 29586 - protein, 11 aa, Homo Sapiens
MTMDKSELVQK

SEQ ID NO: 29587 - protein, 11 aa, Homo Sapiens
NTSRESTMYPK

SEQ ID NO: 29588 - protein, 11 aa, Homo Sapiens
PRGSPPPPHAD

SEQ ID NO: 29589 - protein, 11 aa, Homo Sapiens
QIVSVAARMLK

SEQ ID NO: 29590 - protein, 11 aa, Homo Sapiens
QQFAQSTEMLK

SEQ ID NO: 29591 - protein, 11 aa, Homo Sapiens
QTFPSVSAPSK

SEQ ID NO: 29592 - protein, 11 aa, Homo Sapiens
QTMAYNITPLR

SEQ ID NO: 29593 - protein, 11 aa, Homo Sapiens
QVADSTFTVLK

SEQ ID NO: 29594 - protein, 11 aa, Homo Sapiens
QVLNADAIVVK

SEQ ID NO: 29595 - protein, 11 aa, Homo Sapiens
QVLSAATIVAK

SEQ ID NO: 29596 - protein, 11 aa, Homo Sapiens
QVQPVDGATRK

SEQ ID NO: 29597 - protein, 11 aa, Homo Sapiens
RALPKSYQQPK

SEQ ID NO: 29598 - protein, 11 aa, Homo Sapiens
RIFAPNHVVAK

SEQ ID NO: 29599 - protein, 11 aa, Homo Sapiens
RIGAEVYHNLK

SEQ ID NO: 29600 - protein, 11 aa, Homo Sapiens
RILEAWEMNEK

SEQ ID NO: 29601 - protein, 11 aa, Homo Sapiens
RIMDPDVITGY

SEQ ID NO: 29602 - protein, 11 aa, Homo Sapiens
RIMSETYMLIK

SEQ ID NO: 29603 - protein, 11 aa, Homo Sapiens
RIQEAGTEVVK

SEQ ID NO: 29604 - protein, 11 aa, Homo Sapiens
RIQELEDLLAK

SEQ ID NO: 29605 - protein, 11 aa, Homo Sapiens
RLADKSVLVCK

SEQ ID NO: 29606 - protein, 11 aa, Homo Sapiens
RLINTQAIFAK

SEQ ID NO: 29607 - protein, 11 aa, Homo Sapiens
RQLEEKDRVLK

SEQ ID NO: 29608 - protein, 11 aa, Homo Sapiens
RSFPWQSLEAK

SEQ ID NO: 29609 - protein, 11 aa, Homo Sapiens
RSIQVDGKTIK

SEQ ID NO: 29610 - protein, 11 aa, Homo Sapiens
RSMEAHNILSK

SEQ ID NO: 29611 - protein, 11 aa, Homo Sapiens
RSMGDYAQTLK

SEQ ID NO: 29612 - protein, 11 aa, Homo Sapiens
RTFSWASVTSK

SEQ ID NO: 29613 - protein, 11 aa, Homo Sapiens
RTLGSDSVILK

SEQ ID NO: 29614 - protein, 11 aa, Homo Sapiens
RTMPLLSLHSR

SEQ ID NO: 29615 - protein, 11 aa, Homo Sapiens
RTQMPDPKTFK

SEQ ID NO: 29616 - protein, 11 aa, Homo Sapiens
RTSGSVYITLK

SEQ ID NO: 29617 - protein, 11 aa, Homo Sapiens
RVADRLYGVYK

SEQ ID NO: 29618 - protein, 11 aa, Homo Sapiens
RVANHQKDLFR

SEQ ID NO: 29619 - protein, 11 aa, Homo Sapiens
RVAPAHGLFLK

SEQ ID NO: 29620 - protein, 11 aa, Homo Sapiens
RVAPRSGLAAK

SEQ ID NO: 29621 - protein, 11 aa, Homo Sapiens
RVFAAESIIKR

SEQ ID NO: 29622 - protein, 11 aa, Homo Sapiens
RVFQETQKLKK

SEQ ID NO: 29623 - protein, 11 aa, Homo Sapiens
RVFTTVGSAEK

SEQ ID NO: 29624 - protein, 11 aa, Homo Sapiens
RVIEDNEYTAR

SEQ ID NO: 29625 - protein, 11 aa, Homo Sapiens
RVINEEYKIWK

SEQ ID NO: 29626 - protein, 11 aa, Homo Sapiens
RVITEEEKNFK

SEQ ID NO: 29627 - protein, 11 aa, Homo Sapiens
RVIVNHRIYYK

SEQ ID NO: 29628 - protein, 11 aa, Homo Sapiens
RVLDALVAREK

SEQ ID NO: 29629 - protein, 11 aa, Homo Sapiens
RVLDTNDRFLR

SEQ ID NO: 29630 - protein, 11 aa, Homo Sapiens
RVLPSSLMLPK

SEQ ID NO: 29631 - protein, 11 aa, Homo Sapiens
RVPWVKMILNK

SEQ ID NO: 29632 - protein, 11 aa, Homo Sapiens
RVQEAVESMVK

SEQ ID NO: 29633 - protein, 11 aa, Homo Sapiens
RVQPGLLQWVK

SEQ ID NO: 29634 - protein, 11 aa, Homo Sapiens
RVSTEVTLAVK

SEQ ID NO: 29635 - protein, 11 aa, Homo Sapiens
RVVDGKDLTTK

SEQ ID NO: 29636 - protein, 11 aa, Homo Sapiens
RVWPGTKMPGK

SEQ ID NO: 29637 - protein, 11 aa, Homo Sapiens
RVYAENAIRKK

SEQ ID NO: 29638 - protein, 11 aa, Homo Sapiens
RVYDPASPQRR

SEQ ID NO: 29639 - protein, 11 aa, Homo Sapiens
RVYSPPEWISR

SEQ ID NO: 29640 - protein, 11 aa, Homo Sapiens
RVYWSTTDARK

SEQ ID NO: 29641 - protein, 11 aa, Homo Sapiens
SAAAATAELLK

SEQ ID NO: 29642 - protein, 11 aa, Homo Sapiens
SAEPAAVIVEK

SEQ ID NO: 29643 - protein, 11 aa, Homo Sapiens
SAFKADPKISK

SEQ ID NO: 29644 - protein, 11 aa, Homo Sapiens
SAFPESDNLFK

SEQ ID NO: 29645 - protein, 11 aa, Homo Sapiens
SAIDSVNATSK

SEQ ID NO: 29646 - protein, 11 aa, Homo Sapiens
SAINDKSIVKK

SEQ ID NO: 29647 - protein, 11 aa, Homo Sapiens
SALEGFKVMCK

SEQ ID NO: 29648 - protein, 11 aa, Homo Sapiens
SALTDKAIVKK

SEQ ID NO: 29649 - protein, 11 aa, Homo Sapiens
SICENARRYAK

SEQ ID NO: 29650 - protein, 11 aa, Homo Sapiens
SIDERMKKLGK

SEQ ID NO: 29651 - protein, 11 aa, Homo Sapiens
SIFDDFAHYEK

SEQ ID NO: 29652 - protein, 11 aa, Homo Sapiens
SIFDDFSHYEK

SEQ ID NO: 29653 - protein, 11 aa, Homo Sapiens
SIFEPAKGGEK

SEQ ID NO: 29654 - protein, 11 aa, Homo Sapiens
SIFIGGSFILK

SEQ ID NO: 29655 - protein, 11 aa, Homo Sapiens
SIHDARSWVPK

SEQ ID NO: 29656 - protein, 11 aa, Homo Sapiens
SIIGKKGESVK

SEQ ID NO: 29657 - protein, 11 aa, Homo Sapiens
SIIPRGSLSLK

SEQ ID NO: 29658 - protein, 11 aa, Homo Sapiens
SILEDYANYKK

SEQ ID NO: 29659 - protein, 11 aa, Homo Sapiens
SILGEAEYIQR

SEQ ID NO: 29660 - protein, 11 aa, Homo Sapiens
SILKTPLPKKI

SEQ ID NO: 29661 - protein, 11 aa, Homo Sapiens
SIMKCDVDIRK

SEQ ID NO: 29662 - protein, 11 aa, Homo Sapiens
SIPEPIDPLFK

SEQ ID NO: 29663 - protein, 11 aa, Homo Sapiens
SIQEPSFRMEK

SEQ ID NO: 29664 - protein, 11 aa, Homo Sapiens
SIQEYWKCVKK

SEQ ID NO: 29665 - protein, 11 aa, Homo Sapiens
SIQGVSTVTVK

SEQ ID NO: 29666 - protein, 11 aa, Homo Sapiens
SISDVGFGMLK

SEQ ID NO: 29667 - protein, 11 aa, Homo Sapiens
SIYRPSKNLDK

SEQ ID NO: 29668 - protein, 11 aa, Homo Sapiens
SLLTPILGIQK

SEQ ID NO: 29669 - protein, 11 aa, Homo Sapiens
SLYSVPEGQSK

SEQ ID NO: 29670 - protein, 11 aa, Homo Sapiens
SMLPGSGSVPK

SEQ ID NO: 29671 - protein, 11 aa, Homo Sapiens
SMMDVDHQIAK

SEQ ID NO: 29672 - protein, 11 aa, Homo Sapiens
SQFLAPKAMKK

SEQ ID NO: 29673 - protein, 11 aa, Homo Sapiens
SQISSGTQVEK

SEQ ID NO: 29674 - protein, 11 aa, Homo Sapiens
SQMIGKKLFTK

SEQ ID NO: 29675 - protein, 11 aa, Homo Sapiens
SSADAILGNPK

SEQ ID NO: 29676 - protein, 11 aa, Homo Sapiens
SSASALTGLTK

SEQ ID NO: 29677 - protein, 11 aa, Homo Sapiens
SSASANDVRKK

SEQ ID NO: 29678 - protein, 11 aa, Homo Sapiens
SSATLNSIVAK

SEQ ID NO: 29679 - protein, 11 aa, Homo Sapiens
SSINEARINAK

SEQ ID NO: 29680 - protein, 11 aa, Homo Sapiens
SSLPKKLALLK

SEQ ID NO: 29681 - protein, 11 aa, Homo Sapiens
SSLPSEPIFEK

SEQ ID NO: 29682 - protein, 11 aa, Homo Sapiens
SSLPTVGVFAK

SEQ ID NO: 29683 - protein, 11 aa, Homo Sapiens
SSLSAEAIRQR

SEQ ID NO: 29684 - protein, 11 aa, Homo Sapiens
SSLSGEELVTK

SEQ ID NO: 29685 - protein, 11 aa, Homo Sapiens
SSMTEEEQIAY

SEQ ID NO: 29686 - protein, 11 aa, Homo Sapiens
SSMVGVNLPQK

SEQ ID NO: 29687 - protein, 11 aa, Homo Sapiens
STAKPPKEILK

SEQ ID NO: 29688 - protein, 11 aa, Homo Sapiens
STAKVSPLTPK

SEQ ID NO: 29689 - protein, 11 aa, Homo Sapiens
STASEDQIVSK

SEQ ID NO: 29690 - protein, 11 aa, Homo Sapiens
STAVVVAELLK

SEQ ID NO: 29691 - protein, 11 aa, Homo Sapiens
STDPVAASIMK

SEQ ID NO: 29692 - protein, 11 aa, Homo Sapiens
STFEQCQEWLK

SEQ ID NO: 29693 - protein, 11 aa, Homo Sapiens
STFEVNSINPK

SEQ ID NO: 29694 - protein, 11 aa, Homo Sapiens
STFGGLHQHER

SEQ ID NO: 29695 - protein, 11 aa, Homo Sapiens
STFKLKSEVNK

SEQ ID NO: 29696 - protein, 11 aa, Homo Sapiens
STFQPANKLNK

SEQ ID NO: 29697 - protein, 11 aa, Homo Sapiens
STFQYDRFFEK

SEQ ID NO: 29698 - protein, 11 aa, Homo Sapiens
STFSTLVTVLK

SEQ ID NO: 29699 - protein, 11 aa, Homo Sapiens
STIAILNSVKK

SEQ ID NO: 29700 - protein, 11 aa, Homo Sapiens
STIPPELVKQK

SEQ ID NO: 29701 - protein, 11 aa, Homo Sapiens
STLPALTALQK

SEQ ID NO: 29702 - protein, 11 aa, Homo Sapiens
STLPGQSLIDK

SEQ ID NO: 29703 - protein, 11 aa, Homo Sapiens
STMELDEALRK

SEQ ID NO: 29704 - protein, 11 aa, Homo Sapiens
STMKTNLESLK

SEQ ID NO: 29705 - protein, 11 aa, Homo Sapiens
STMPHTSGMNR

SEQ ID NO: 29706 - protein, 11 aa, Homo Sapiens
STMVDVRVMKK

SEQ ID NO: 29707 - protein, 11 aa, Homo Sapiens
STMYPGLPSRL

SEQ ID NO: 29708 - protein, 11 aa, Homo Sapiens
STQLEDSLLGK

SEQ ID NO: 29709 - protein, 11 aa, Homo Sapiens
STQRDLWNIFK

SEQ ID NO: 29710 - protein, 11 aa, Homo Sapiens
STTEELHKYQK

SEQ ID NO: 29711 - protein, 11 aa, Homo Sapiens
STVAPPQGVVK

SEQ ID NO: 29712 - protein, 11 aa, Homo Sapiens
STVGAGAYAYK

SEQ ID NO: 29713 - protein, 11 aa, Homo Sapiens
STYAPIGEVHK

SEQ ID NO: 29714 - protein, 11 aa, Homo Sapiens
STYATTIRDSK

SEQ ID NO: 29715 - protein, 11 aa, Homo Sapiens
STYPAQNGQVK

SEQ ID NO: 29716 - protein, 11 aa, Homo Sapiens
STYPPEIVVPK

SEQ ID NO: 29717 - protein, 11 aa, Homo Sapiens
SVADLAESIMK

SEQ ID NO: 29718 - protein, 11 aa, Homo Sapiens
SVAPARAQPPK

SEQ ID NO: 29719 - protein, 11 aa, Homo Sapiens
SVCSSGPEYLK

SEQ ID NO: 29720 - protein, 11 aa, Homo Sapiens
SVDEESYKTLK

SEQ ID NO: 29721 - protein, 11 aa, Homo Sapiens
SVEERITQVAK

SEQ ID NO: 29722 - protein, 11 aa, Homo Sapiens
SVFDSSSDMEK

SEQ ID NO: 29723 - protein, 11 aa, Homo Sapiens
SVFEVDGKKNK

SEQ ID NO: 29724 - protein, 11 aa, Homo Sapiens
SVFFPESGLAK

SEQ ID NO: 29725 - protein, 11 aa, Homo Sapiens
SVFQTTDTKSK

SEQ ID NO: 29726 - protein, 11 aa, Homo Sapiens
SVFTNERFPLR

SEQ ID NO: 29727 - protein, 11 aa, Homo Sapiens
SVGGREILKGK

SEQ ID NO: 29728 - protein, 11 aa, Homo Sapiens
SVIDRKDLIIK

SEQ ID NO: 29729 - protein, 11 aa, Homo Sapiens
SVIGASSQFTR

SEQ ID NO: 29730 - protein, 11 aa, Homo Sapiens
SVIGFRILLLK

SEQ ID NO: 29731 - protein, 11 aa, Homo Sapiens
SVIISPFPGLK

SEQ ID NO: 29732 - protein, 11 aa, Homo Sapiens
SVISIMKPVRK

SEQ ID NO: 29733 - protein, 11 aa, Homo Sapiens
SVKPGAHLTVK

SEQ ID NO: 29734 - protein, 11 aa, Homo Sapiens
SVKSVPENLLK

SEQ ID NO: 29735 - protein, 11 aa, Homo Sapiens
SVLEATRVNRR

SEQ ID NO: 29736 - protein, 11 aa, Homo Sapiens
SVLGKDEQINK

SEQ ID NO: 29737 - protein, 11 aa, Homo Sapiens
SVLGKGSMRDK

SEQ ID NO: 29738 - protein, 11 aa, Homo Sapiens
SVLGKVNEIAK

SEQ ID NO: 29739 - protein, 11 aa, Homo Sapiens
SVMEVNSGIYR

SEQ ID NO: 29740 - protein, 11 aa, Homo Sapiens
SVNPGMARWIK

SEQ ID NO: 29741 - protein, 11 aa, Homo Sapiens
SVNVDYSKLKK

SEQ ID NO: 29742 - protein, 11 aa, Homo Sapiens
SVPEAGGPPIK

SEQ ID NO: 29743 - protein, 11 aa, Homo Sapiens
SVPEFPLSPPK

SEQ ID NO: 29744 - protein, 11 aa, Homo Sapiens
SVPLSDALLNK

SEQ ID NO: 29745 - protein, 11 aa, Homo Sapiens
SVPRDGASYPK

SEQ ID NO: 29746 - protein, 11 aa, Homo Sapiens
SVPSSETVICR

SEQ ID NO: 29747 - protein, 11 aa, Homo Sapiens
SVQKEVEKNLK

SEQ ID NO: 29748 - protein, 11 aa, Homo Sapiens
SVQPAANCSIK

SEQ ID NO: 29749 - protein, 11 aa, Homo Sapiens
SVQPSSSLSAR

SEQ ID NO: 29750 - protein, 11 aa, Homo Sapiens
SVQTADHRFLR

SEQ ID NO: 29751 - protein, 11 aa, Homo Sapiens
SVQVPRNLVGK

SEQ ID NO: 29752 - protein, 11 aa, Homo Sapiens
SVYDHQGIFKR

SEQ ID NO: 29753 - protein, 11 aa, Homo Sapiens
SVYGEWVPVEK

SEQ ID NO: 29754 - protein, 11 aa, Homo Sapiens
SVYGGGGIHEY

SEQ ID NO: 29755 - protein, 11 aa, Homo Sapiens
SVYPMPRVIFR

SEQ ID NO: 29756 - protein, 11 aa, Homo Sapiens
SVYSETVDLIK

SEQ ID NO: 29757 - protein, 11 aa, Homo Sapiens
SVYSPESNVRK

SEQ ID NO: 29758 - protein, 11 aa, Homo Sapiens
SVYSPESSVRK

SEQ ID NO: 29759 - protein, 11 aa, Homo Sapiens
SVYYNEATGGK

SEQ ID NO: 29760 - protein, 11 aa, Homo Sapiens
TAGDGLIELRK

SEQ ID NO: 29761 - protein, 11 aa, Homo Sapiens
TIFDLSEVLCK

SEQ ID NO: 29762 - protein, 11 aa, Homo Sapiens
TIMPKDIQLAR

SEQ ID NO: 29763 - protein, 11 aa, Homo Sapiens
TTQGELIKHYK

SEQ ID NO: 29764 - protein, 11 aa, Homo Sapiens
TVDKNMPKFNK

SEQ ID NO: 29765 - protein, 11 aa, Homo Sapiens
TVFDAKRLIGR

SEQ ID NO: 29766 - protein, 11 aa, Homo Sapiens
TVFPKAKQVKK

SEQ ID NO: 29767 - protein, 11 aa, Homo Sapiens
TVIQLQNIAEK

SEQ ID NO: 29768 - protein, 11 aa, Homo Sapiens
TVIRDVEQQFK

SEQ ID NO: 29769 - protein, 11 aa, Homo Sapiens
TVISAVGTIVK

SEQ ID NO: 29770 - protein, 11 aa, Homo Sapiens
TVISQEPFVPK

SEQ ID NO: 29771 - protein, 11 aa, Homo Sapiens
TVLEKFRYLPK

SEQ ID NO: 29772 - protein, 11 aa, Homo Sapiens
TVLGGVYILGK

SEQ ID NO: 29773 - protein, 11 aa, Homo Sapiens
TVMELVKIIYK

SEQ ID NO: 29774 - protein, 11 aa, Homo Sapiens
TVSEVIQGLLK

SEQ ID NO: 29775 - protein, 11 aa, Homo Sapiens
TVYPKPEEWPK

SEQ ID NO: 29776 - protein, 11 aa, Homo Sapiens
VAVAGVVLAKG

SEQ ID NO: 29777 - protein, 11 aa, Homo Sapiens
VGLSKCEIKVA

SEQ ID NO: 29778 - protein, 11 aa, Homo Sapiens
VILPPLSPYFK

SEQ ID NO: 29779 - protein, 11 aa, Homo Sapiens
VLAPEGSVPNK

SEQ ID NO: 29780 - protein, 11 aa, Homo Sapiens
VLQAADILLYK

SEQ ID NO: 29781 - protein, 11 aa, Homo Sapiens
VLSAADKGNVK

SEQ ID NO: 29782 - protein, 11 aa, Homo Sapiens
VQEDQRDLIFK

SEQ ID NO: 29783 - protein, 11 aa, Homo Sapiens
VSDPSSPQYGK

SEQ ID NO: 29784 - protein, 11 aa, Homo Sapiens
VSSPVSAWKTS

SEQ ID NO: 29785 - protein, 11 aa, Homo Sapiens
VSTASLTSVPS

SEQ ID NO: 29786 - protein, 11 aa, Homo Sapiens
VTDPSIPIRKK

SEQ ID NO: 29787 - protein, 11 aa, Homo Sapiens
VTFEDQQKINK

SEQ ID NO: 29788 - protein, 11 aa, Homo Sapiens
VTFPDIIRNYK

SEQ ID NO: 29789 - protein, 11 aa, Homo Sapiens
VTLDKDAYYRR

SEQ ID NO: 29790 - protein, 11 aa, Homo Sapiens
VTMSKKLLIEK

SEQ ID NO: 29791 - protein, 11 aa, Homo Sapiens
VTMTMSSIVMK

SEQ ID NO: 29792 - protein, 11 aa, Homo Sapiens
VTQPTVGMNFK

SEQ ID NO: 29793 - protein, 11 aa, Homo Sapiens
VTSTESMDFLK

SEQ ID NO: 29794 - protein, 11 aa, Homo Sapiens
VTVGVDGTLYK

SEQ ID NO: 29795 - protein, 11 aa, Homo Sapiens
VVCDNGTGFVK

SEQ ID NO: 29796 - protein, 11 aa, Homo Sapiens
VVCPVSDILYK

SEQ ID NO: 29797 - protein, 11 aa, Homo Sapiens
VVFAVKQYISK

SEQ ID NO: 29798 - protein, 11 aa, Homo Sapiens
VVFDTSLQVKK

SEQ ID NO: 29799 - protein, 11 aa, Homo Sapiens
VVFSGKAYSPK

SEQ ID NO: 29800 - protein, 11 aa, Homo Sapiens
VVFVIDPGFAK

SEQ ID NO: 29801 - protein, 11 aa, Homo Sapiens
VVIGRSGEMIK

SEQ ID NO: 29802 - protein, 11 aa, Homo Sapiens
VVMAADRSLKK

SEQ ID NO: 29803 - protein, 11 aa, Homo Sapiens
VVMKASSSLPK

SEQ ID NO: 29804 - protein, 11 aa, Homo Sapiens
VVMNYSEIESK

SEQ ID NO: 29805 - protein, 11 aa, Homo Sapiens
VVMTPVPLFSK

SEQ ID NO: 29806 - protein, 11 aa, Homo Sapiens
VVQDGITLITK

SEQ ID NO: 29807 - protein, 11 aa, Homo Sapiens
VVQWADLVICK

SEQ ID NO: 29808 - protein, 11 aa, Homo Sapiens
VVSPSSFENVK

SEQ ID NO: 29809 - protein, 11 aa, Homo Sapiens
VVVDEADTMLK

SEQ ID NO: 29810 - protein, 11 aa, Homo Sapiens
VVVGVYRPPPK

SEQ ID NO: 29811 - protein, 11 aa, Homo Sapiens
VVYSGLENIKK

SEQ ID NO: 29812 - protein, 11 aa, Homo Sapiens
YDGHAGSQVAK

SEQ ID NO: 29813 - protein, 8 aa, Homo Sapiens
APEEHPVL

SEQ ID NO: 29814 - protein, 8 aa, Homo Sapiens
FERELGVK

SEQ ID NO: 29815 - protein, 8 aa, Homo Sapiens
FPTISLEF

SEQ ID NO: 29816 - protein, 8 aa, Homo Sapiens
GLQFPVGR

SEQ ID NO: 29817 - protein, 8 aa, Homo Sapiens
GPPPPGKP

SEQ ID NO: 29818 - protein, 8 aa, Homo Sapiens
IYSKTTRF

SEQ ID NO: 29819 - protein, 8 aa, Homo Sapiens
KYGPIRQI

SEQ ID NO: 29820 - protein, 8 aa, Homo Sapiens
KYGPVFSF

SEQ ID NO: 29821 - protein, 8 aa, Homo Sapiens
KYLHQSIM

SEQ ID NO: 29822 - protein, 8 aa, Homo Sapiens
LLPGELAK

SEQ ID NO: 29823 - protein, 8 aa, Homo Sapiens
LLTTAKNL

SEQ ID NO: 29824 - protein, 8 aa, Homo Sapiens
LPKLYVKL

SEQ ID NO: 29825 - protein, 8 aa, Homo Sapiens
PPPPPGKP

SEQ ID NO: 29826 - protein, 8 aa, Homo Sapiens
QILVGVNK

SEQ ID NO: 29827 - protein, 8 aa, Homo Sapiens
RVDPVNFK

SEQ ID NO: 29828 - protein, 8 aa, Homo Sapiens
VANEVTLN

SEQ ID NO: 29829 - protein, 8 aa, Homo Sapiens
VFFKGFKW

SEQ ID NO: 29830 - protein, 8 aa, Homo Sapiens
VHLTPEEK

SEQ ID NO: 29831 - protein, 8 aa, Homo Sapiens
VSLTACKV

SEQ ID NO: 29832 - protein, 8 aa, Homo Sapiens
WISKQEYD

SEQ ID NO: 29833 - protein, 8 aa, Homo Sapiens
YVHMVTHF

SEQ ID NO: 29834 - protein, 8 aa, Homo Sapiens
YWSHPRKF

SEQ ID NO: 29835 - protein, 9 aa, Homo Sapiens
AAPTSAAAL

SEQ ID NO: 29836 - protein, 9 aa, Homo Sapiens
AAPVPTTTL

SEQ ID NO: 29837 - protein, 9 aa, Homo Sapiens
AFADVSVKF

SEQ ID NO: 29838 - protein, 9 aa, Homo Sapiens
AFIDRHPRL

SEQ ID NO: 29839 - protein, 9 aa, Homo Sapiens
AFIEKHWTF

SEQ ID NO: 29840 - protein, 9 aa, Homo Sapiens
AFIKIKMAF

SEQ ID NO: 29841 - protein, 9 aa, Homo Sapiens
AFIKRTPVI

SEQ ID NO: 29842 - protein, 9 aa, Homo Sapiens
AFINKFVQF

SEQ ID NO: 29843 - protein, 9 aa, Homo Sapiens
AFIPAIDSF

SEQ ID NO: 29844 - protein, 9 aa, Homo Sapiens
AFLDVVSKL

SEQ ID NO: 29845 - protein, 9 aa, Homo Sapiens
AFLTPSYTW

SEQ ID NO: 29846 - protein, 9 aa, Homo Sapiens
AFMKGVFTF

SEQ ID NO: 29847 - protein, 9 aa, Homo Sapiens
AGLDIFAKF

SEQ ID NO: 29848 - protein, 9 aa, Homo Sapiens
AHIGVMVEF

SEQ ID NO: 29849 - protein, 9 aa, Homo Sapiens
ALKKQSWRF

SEQ ID NO: 29850 - protein, 9 aa, Homo Sapiens
ALPDQSFLW

SEQ ID NO: 29851 - protein, 9 aa, Homo Sapiens
ALPKELPLI

SEQ ID NO: 29852 - protein, 9 aa, Homo Sapiens
ALPSKLPTF

SEQ ID NO: 29853 - protein, 9 aa, Homo Sapiens
ALPSKVPAF

SEQ ID NO: 29854 - protein, 9 aa, Homo Sapiens
ALSSVYLLL

SEQ ID NO: 29855 - protein, 9 aa, Homo Sapiens
AMLGVNPRF

SEQ ID NO: 29856 - protein, 9 aa, Homo Sapiens
AMLPLVLHW

SEQ ID NO: 29857 - protein, 9 aa, Homo Sapiens
AQLRQYHRL

SEQ ID NO: 29858 - protein, 9 aa, Homo Sapiens
AYADVQAVL

SEQ ID NO: 29859 - protein, 9 aa, Homo Sapiens
AYAIIKEEL

SEQ ID NO: 29860 - protein, 9 aa, Homo Sapiens
AYALLLQHL

SEQ ID NO: 29861 - protein, 9 aa, Homo Sapiens
AYATHPFKF

SEQ ID NO: 29862 - protein, 9 aa, Homo Sapiens
AYDTVRWEF

SEQ ID NO: 29863 - protein, 9 aa, Homo Sapiens
AYEHKFYEI

SEQ ID NO: 29864 - protein, 9 aa, Homo Sapiens
AYGHFSYEF

SEQ ID NO: 29865 - protein, 9 aa, Homo Sapiens
AYGKDFHLI

SEQ ID NO: 29866 - protein, 9 aa, Homo Sapiens
AYGLVSATF

SEQ ID NO: 29867 - protein, 9 aa, Homo Sapiens
AYGNVFSAF

SEQ ID NO: 29868 - protein, 9 aa, Homo Sapiens
AYGQVVFRL

SEQ ID NO: 29869 - protein, 9 aa, Homo Sapiens
AYGSLFNTI

SEQ ID NO: 29870 - protein, 9 aa, Homo Sapiens
AYGWVSATF

SEQ ID NO: 29871 - protein, 9 aa, Homo Sapiens
AYHNSPAYL

SEQ ID NO: 29872 - protein, 9 aa, Homo Sapiens
AYIADHLGF

SEQ ID NO: 29873 - protein, 9 aa, Homo Sapiens
AYIDYLSHL

SEQ ID NO: 29874 - protein, 9 aa, Homo Sapiens
AYIERMNSI

SEQ ID NO: 29875 - protein, 9 aa, Homo Sapiens
AYIERMNYI

SEQ ID NO: 29876 - protein, 9 aa, Homo Sapiens
AYIFIHRKW

SEQ ID NO: 29877 - protein, 9 aa, Homo Sapiens
AYIGFIQSL

SEQ ID NO: 29878 - protein, 9 aa, Homo Sapiens
AYIHCVSAF

SEQ ID NO: 29879 - protein, 9 aa, Homo Sapiens
AYIKGGWIL

SEQ ID NO: 29880 - protein, 9 aa, Homo Sapiens
AYINKVEEL

SEQ ID NO: 29881 - protein, 9 aa, Homo Sapiens
AYIPKLLQL

SEQ ID NO: 29882 - protein, 9 aa, Homo Sapiens
AYIPLNNYL

SEQ ID NO: 29883 - protein, 9 aa, Homo Sapiens
AYIPTPIYF

SEQ ID NO: 29884 - protein, 9 aa, Homo Sapiens
AYISGLDVF

SEQ ID NO: 29885 - protein, 9 aa, Homo Sapiens
AYITGLCFI

SEQ ID NO: 29886 - protein, 9 aa, Homo Sapiens
AYITQKVEF

SEQ ID NO: 29887 - protein, 9 aa, Homo Sapiens
AYKPGALTF

SEQ ID NO: 29888 - protein, 9 aa, Homo Sapiens
AYKYIQELW

SEQ ID NO: 29889 - protein, 9 aa, Homo Sapiens
AYLAQSPQL

SEQ ID NO: 29890 - protein, 9 aa, Homo Sapiens
AYLCYRFLF

SEQ ID NO: 29891 - protein, 9 aa, Homo Sapiens
AYLDALQTL

SEQ ID NO: 29892 - protein, 9 aa, Homo Sapiens
AYLDKISEL

SEQ ID NO: 29893 - protein, 9 aa, Homo Sapiens
AYLDKSPQF

SEQ ID NO: 29894 - protein, 9 aa, Homo Sapiens
AYLEAHETF

SEQ ID NO: 29895 - protein, 9 aa, Homo Sapiens
AYLEAIHNF

SEQ ID NO: 29896 - protein, 9 aa, Homo Sapiens
AYLEALSHL

SEQ ID NO: 29897 - protein, 9 aa, Homo Sapiens
AYLEAYKEF

SEQ ID NO: 29898 - protein, 9 aa, Homo Sapiens
AYLESFYKF

SEQ ID NO: 29899 - protein, 9 aa, Homo Sapiens
AYLGHGYGF

SEQ ID NO: 29900 - protein, 9 aa, Homo Sapiens
AYLHSHALI

SEQ ID NO: 29901 - protein, 9 aa, Homo Sapiens
AYLHSHNMI

SEQ ID NO: 29902 - protein, 9 aa, Homo Sapiens
AYLIQVHKW

SEQ ID NO: 29903 - protein, 9 aa, Homo Sapiens
AYLKAIVLF

SEQ ID NO: 29904 - protein, 9 aa, Homo Sapiens
AYLKDLQKL

SEQ ID NO: 29905 - protein, 9 aa, Homo Sapiens
AYLKWISQI

SEQ ID NO: 29906 - protein, 9 aa, Homo Sapiens
AYLLFYERI

SEQ ID NO: 29907 - protein, 9 aa, Homo Sapiens
AYLNITKHL

SEQ ID NO: 29908 - protein, 9 aa, Homo Sapiens
AYLPKMMTL

SEQ ID NO: 29909 - protein, 9 aa, Homo Sapiens
AYLPTGKQF

SEQ ID NO: 29910 - protein, 9 aa, Homo Sapiens
AYLPVNESF

SEQ ID NO: 29911 - protein, 9 aa, Homo Sapiens
AYLQLFTKL

SEQ ID NO: 29912 - protein, 9 aa, Homo Sapiens
AYLSKAMEI

SEQ ID NO: 29913 - protein, 9 aa, Homo Sapiens
AYLTEHEKI

SEQ ID NO: 29914 - protein, 9 aa, Homo Sapiens
AYLTHHQRI

SEQ ID NO: 29915 - protein, 9 aa, Homo Sapiens
AYLTLTSRM

SEQ ID NO: 29916 - protein, 9 aa, Homo Sapiens
AYLTVHQRI

SEQ ID NO: 29917 - protein, 9 aa, Homo Sapiens
AYLVNTYAL

SEQ ID NO: 29918 - protein, 9 aa, Homo Sapiens
AYMERMNYI

SEQ ID NO: 29919 - protein, 9 aa, Homo Sapiens
AYMPHTFFI

SEQ ID NO: 29920 - protein, 9 aa, Homo Sapiens
AYNAVVRYF

SEQ ID NO: 29921 - protein, 9 aa, Homo Sapiens
AYNPNTQTF

SEQ ID NO: 29922 - protein, 9 aa, Homo Sapiens
AYPAIRYLL

SEQ ID NO: 29923 - protein, 9 aa, Homo Sapiens
AYPDKNFTL

SEQ ID NO: 29924 - protein, 9 aa, Homo Sapiens
AYPEYLITF

SEQ ID NO: 29925 - protein, 9 aa, Homo Sapiens
AYPHNLMTF

SEQ ID NO: 29926 - protein, 9 aa, Homo Sapiens
AYPTAYPSF

SEQ ID NO: 29927 - protein, 9 aa, Homo Sapiens
AYQDRLAYL

SEQ ID NO: 29928 - protein, 9 aa, Homo Sapiens
AYQHLFYLL

SEQ ID NO: 29929 - protein, 9 aa, Homo Sapiens
AYQSIQNYL

SEQ ID NO: 29930 - protein, 9 aa, Homo Sapiens
AYSEAIFEL

SEQ ID NO: 29931 - protein, 9 aa, Homo Sapiens
AYSNCQHDF

SEQ ID NO: 29932 - protein, 9 aa, Homo Sapiens
AYSPRHYVI

SEQ ID NO: 29933 - protein, 9 aa, Homo Sapiens
AYTDCIPQL

SEQ ID NO: 29934 - protein, 9 aa, Homo Sapiens
AYTLLLHTW

SEQ ID NO: 29935 - protein, 9 aa, Homo Sapiens
AYTPFHAVL

SEQ ID NO: 29936 - protein, 9 aa, Homo Sapiens
AYTPVLNQF

SEQ ID NO: 29937 - protein, 9 aa, Homo Sapiens
AYVDIHTGL

SEQ ID NO: 29938 - protein, 9 aa, Homo Sapiens
AYVDKLEEL

SEQ ID NO: 29939 - protein, 9 aa, Homo Sapiens
AYVEKVEKL

SEQ ID NO: 29940 - protein, 9 aa, Homo Sapiens
AYVELVHHI

SEQ ID NO: 29941 - protein, 9 aa, Homo Sapiens
AYVGDLQTL

SEQ ID NO: 29942 - protein, 9 aa, Homo Sapiens
AYVGDVPIL

SEQ ID NO: 29943 - protein, 9 aa, Homo Sapiens
AYVHMVTHF

SEQ ID NO: 29944 - protein, 9 aa, Homo Sapiens
AYVPGFAHI

SEQ ID NO: 29945 - protein, 9 aa, Homo Sapiens
AYVQIKTIW

SEQ ID NO: 29946 - protein, 9 aa, Homo Sapiens
AYVTLAAHF

SEQ ID NO: 29947 - protein, 9 aa, Homo Sapiens
AYVTVLEGF

SEQ ID NO: 29948 - protein, 9 aa, Homo Sapiens
AYYEHRLQL

SEQ ID NO: 29949 - protein, 9 aa, Homo Sapiens
AYYEIRYQF

SEQ ID NO: 29950 - protein, 9 aa, Homo Sapiens
AYYGNINFF

SEQ ID NO: 29951 - protein, 9 aa, Homo Sapiens
AYYGNISHF

SEQ ID NO: 29952 - protein, 9 aa, Homo Sapiens
CFFTAKTTF

SEQ ID NO: 29953 - protein, 9 aa, Homo Sapiens
CMPVFHPRF

SEQ ID NO: 29954 - protein, 9 aa, Homo Sapiens
CWLPLRASF

SEQ ID NO: 29955 - protein, 9 aa, Homo Sapiens
CYATQSHQW

SEQ ID NO: 29956 - protein, 9 aa, Homo Sapiens
CYGDITIHF

SEQ ID NO: 29957 - protein, 9 aa, Homo Sapiens
CYIKILHQL

SEQ ID NO: 29958 - protein, 9 aa, Homo Sapiens
CYLDKPEEW

SEQ ID NO: 29959 - protein, 9 aa, Homo Sapiens
CYLERHTFL

SEQ ID NO: 29960 - protein, 9 aa, Homo Sapiens
CYLLQVDEF

SEQ ID NO: 29961 - protein, 9 aa, Homo Sapiens
CYLVIIRTL

SEQ ID NO: 29962 - protein, 9 aa, Homo Sapiens
CYNGSTNRF

SEQ ID NO: 29963 - protein, 9 aa, Homo Sapiens
CYNPEFEKL

SEQ ID NO: 29964 - protein, 9 aa, Homo Sapiens
CYNPHTDHW

SEQ ID NO: 29965 - protein, 9 aa, Homo Sapiens
CYNPMTNQW

SEQ ID NO: 29966 - protein, 9 aa, Homo Sapiens
CYQEVSQCF

SEQ ID NO: 29967 - protein, 9 aa, Homo Sapiens
CYTATILKL

SEQ ID NO: 29968 - protein, 9 aa, Homo Sapiens
CYTDFHVDF

SEQ ID NO: 29969 - protein, 9 aa, Homo Sapiens
CYVGVVHRL

SEQ ID NO: 29970 - protein, 9 aa, Homo Sapiens
CYVIYFTKL

SEQ ID NO: 29971 - protein, 9 aa, Homo Sapiens
CYVKDLSRL

SEQ ID NO: 29972 - protein, 9 aa, Homo Sapiens
CYVQPQWVF

SEQ ID NO: 29973 - protein, 9 aa, Homo Sapiens
CYYPFRTFF

SEQ ID NO: 29974 - protein, 9 aa, Homo Sapiens
DESGPSIVH

SEQ ID NO: 29975 - protein, 9 aa, Homo Sapiens
DFPTISLEF

SEQ ID NO: 29976 - protein, 9 aa, Homo Sapiens
DYAEVSNTF

SEQ ID NO: 29977 - protein, 9 aa, Homo Sapiens
DYFVPLHHF

SEQ ID NO: 29978 - protein, 9 aa, Homo Sapiens
DYIAVNPHL

SEQ ID NO: 29979 - protein, 9 aa, Homo Sapiens
DYIDSSWEL

SEQ ID NO: 29980 - protein, 9 aa, Homo Sapiens
DYIDTIWKI

SEQ ID NO: 29981 - protein, 9 aa, Homo Sapiens
DYIPQLAKF

SEQ ID NO: 29982 - protein, 9 aa, Homo Sapiens
DYIQKHPEL

SEQ ID NO: 29983 - protein, 9 aa, Homo Sapiens
DYLKFKEKF

SEQ ID NO: 29984 - protein, 9 aa, Homo Sapiens
DYLPSFCKW

SEQ ID NO: 29985 - protein, 9 aa, Homo Sapiens
DYLQCVLQI

SEQ ID NO: 29986 - protein, 9 aa, Homo Sapiens
DYLQEVPIL

SEQ ID NO: 29987 - protein, 9 aa, Homo Sapiens
DYNFVFTSF

SEQ ID NO: 29988 - protein, 9 aa, Homo Sapiens
DYSSILQKF

SEQ ID NO: 29989 - protein, 9 aa, Homo Sapiens
DYVEGLRVF

SEQ ID NO: 29990 - protein, 9 aa, Homo Sapiens
EFITVHSML

SEQ ID NO: 29991 - protein, 9 aa, Homo Sapiens
EFLKYFGTF

SEQ ID NO: 29992 - protein, 9 aa, Homo Sapiens
EFLPVTPIL

SEQ ID NO: 29993 - protein, 9 aa, Homo Sapiens
EFLRQLLTF

SEQ ID NO: 29994 - protein, 9 aa, Homo Sapiens
EFLTKTAKF

SEQ ID NO: 29995 - protein, 9 aa, Homo Sapiens
EFPSIKTEF

SEQ ID NO: 29996 - protein, 9 aa, Homo Sapiens
EFVAKGHLF

SEQ ID NO: 29997 - protein, 9 aa, Homo Sapiens
ELPKHYFSF

SEQ ID NO: 29998 - protein, 9 aa, Homo Sapiens
EPSVSIPFL

SEQ ID NO: 29999 - protein, 9 aa, Homo Sapiens
EQIKEYHHL

SEQ ID NO: 30000 - protein, 9 aa, Homo Sapiens
EQPETYYKW

SEQ ID NO: 30001 - protein, 9 aa, Homo Sapiens
EWIPLAWKW

SEQ ID NO: 30002 - protein, 9 aa, Homo Sapiens
EWISFGHRF

SEQ ID NO: 30003 - protein, 9 aa, Homo Sapiens
EYAHLFEVF

SEQ ID NO: 30004 - protein, 9 aa, Homo Sapiens
EYATKISRF

SEQ ID NO: 30005 - protein, 9 aa, Homo Sapiens
EYAVLTSTI

SEQ ID NO: 30006 - protein, 9 aa, Homo Sapiens
EYDLIVHQL

SEQ ID NO: 30007 - protein, 9 aa, Homo Sapiens
EYGENFPML

SEQ ID NO: 30008 - protein, 9 aa, Homo Sapiens
EYGQVNHAL

SEQ ID NO: 30009 - protein, 9 aa, Homo Sapiens
EYIAKQFGF

SEQ ID NO: 30010 - protein, 9 aa, Homo Sapiens
EYIAVVKKL

SEQ ID NO: 30011 - protein, 9 aa, Homo Sapiens
EYIDDLFKL

SEQ ID NO: 30012 - protein, 9 aa, Homo Sapiens
EYIDRMIKI

SEQ ID NO: 30013 - protein, 9 aa, Homo Sapiens
EYIHALTLL

SEQ ID NO: 30014 - protein, 9 aa, Homo Sapiens
EYIIEYPHF

SEQ ID NO: 30015 - protein, 9 aa, Homo Sapiens
EYIKFLRSI

SEQ ID NO: 30016 - protein, 9 aa, Homo Sapiens
EYIPKWEQF

SEQ ID NO: 30017 - protein, 9 aa, Homo Sapiens
EYIQFVPLL

SEQ ID NO: 30018 - protein, 9 aa, Homo Sapiens
EYIQKNVQL

SEQ ID NO: 30019 - protein, 9 aa, Homo Sapiens
EYIRSLNQF

SEQ ID NO: 30020 - protein, 9 aa, Homo Sapiens
EYISKTYKI

SEQ ID NO: 30021 - protein, 9 aa, Homo Sapiens
EYISTVKTL

SEQ ID NO: 30022 - protein, 9 aa, Homo Sapiens
EYLARIQGF

SEQ ID NO: 30023 - protein, 9 aa, Homo Sapiens
EYLDDRNTF

SEQ ID NO: 30024 - protein, 9 aa, Homo Sapiens
EYLDKYCSL

SEQ ID NO: 30025 - protein, 9 aa, Homo Sapiens
EYLEAHLKF

SEQ ID NO: 30026 - protein, 9 aa, Homo Sapiens
EYLENALKL

SEQ ID NO: 30027 - protein, 9 aa, Homo Sapiens
EYLERAPEL

SEQ ID NO: 30028 - protein, 9 aa, Homo Sapiens
EYLGKFRRL

SEQ ID NO: 30029 - protein, 9 aa, Homo Sapiens
EYLGSMAKI

SEQ ID NO: 30030 - protein, 9 aa, Homo Sapiens
EYLHFMRKI

SEQ ID NO: 30031 - protein, 9 aa, Homo Sapiens
EYLHQHWIL

SEQ ID NO: 30032 - protein, 9 aa, Homo Sapiens
EYLIKVNEI

SEQ ID NO: 30033 - protein, 9 aa, Homo Sapiens
EYLIVFPKL

SEQ ID NO: 30034 - protein, 9 aa, Homo Sapiens
EYLKIKQSF

SEQ ID NO: 30035 - protein, 9 aa, Homo Sapiens
EYLKLLHSF

SEQ ID NO: 30036 - protein, 9 aa, Homo Sapiens
EYLRQIFRL

SEQ ID NO: 30037 - protein, 9 aa, Homo Sapiens
EYLSTCSKL

SEQ ID NO: 30038 - protein, 9 aa, Homo Sapiens
EYLTKVDKL

SEQ ID NO: 30039 - protein, 9 aa, Homo Sapiens
EYLYFFRVL

SEQ ID NO: 30040 - protein, 9 aa, Homo Sapiens
EYMEHVYLI

SEQ ID NO: 30041 - protein, 9 aa, Homo Sapiens
EYMEVRERI

SEQ ID NO: 30042 - protein, 9 aa, Homo Sapiens
EYMPIKLKI

SEQ ID NO: 30043 - protein, 9 aa, Homo Sapiens
EYNGKIPRF

SEQ ID NO: 30044 - protein, 9 aa, Homo Sapiens
EYNSALPLL

SEQ ID NO: 30045 - protein, 9 aa, Homo Sapiens
EYNSDLHQF

SEQ ID NO: 30046 - protein, 9 aa, Homo Sapiens
EYNTIKDKF

SEQ ID NO: 30047 - protein, 9 aa, Homo Sapiens
EYPHEVPQI

SEQ ID NO: 30048 - protein, 9 aa, Homo Sapiens
EYSKQMQRF

SEQ ID NO: 30049 - protein, 9 aa, Homo Sapiens
EYTDVYPEI

SEQ ID NO: 30050 - protein, 9 aa, Homo Sapiens
EYTGYSFKF

SEQ ID NO: 30051 - protein, 9 aa, Homo Sapiens
EYVANLTNL

SEQ ID NO: 30052 - protein, 9 aa, Homo Sapiens
EYVEKFYRI

SEQ ID NO: 30053 - protein, 9 aa, Homo Sapiens
EYVPGAHQF

SEQ ID NO: 30054 - protein, 9 aa, Homo Sapiens
EYVRELPAF

SEQ ID NO: 30055 - protein, 9 aa, Homo Sapiens
EYVRNQQTI

SEQ ID NO: 30056 - protein, 9 aa, Homo Sapiens
EYVSQHLVF

SEQ ID NO: 30057 - protein, 9 aa, Homo Sapiens
FFIAGRYEF

SEQ ID NO: 30058 - protein, 9 aa, Homo Sapiens
FLPFPLPLF

SEQ ID NO: 30059 - protein, 9 aa, Homo Sapiens
FYAELYHII

SEQ ID NO: 30060 - protein, 9 aa, Homo Sapiens
FYAHIIPFL

SEQ ID NO: 30061 - protein, 9 aa, Homo Sapiens
FYFALRDTL

SEQ ID NO: 30062 - protein, 9 aa, Homo Sapiens
FYGDKMNLF

SEQ ID NO: 30063 - protein, 9 aa, Homo Sapiens
FYHEAVVLF

SEQ ID NO: 30064 - protein, 9 aa, Homo Sapiens
FYHKYFNYL

SEQ ID NO: 30065 - protein, 9 aa, Homo Sapiens
FYIESISYL

SEQ ID NO: 30066 - protein, 9 aa, Homo Sapiens
FYISPVNKL

SEQ ID NO: 30067 - protein, 9 aa, Homo Sapiens
FYITSRTQF

SEQ ID NO: 30068 - protein, 9 aa, Homo Sapiens
FYIWRPLRI

SEQ ID NO: 30069 - protein, 9 aa, Homo Sapiens
FYLLISKTF

SEQ ID NO: 30070 - protein, 9 aa, Homo Sapiens
FYMDTSHLF

SEQ ID NO: 30071 - protein, 9 aa, Homo Sapiens
FYNLLTRTF

SEQ ID NO: 30072 - protein, 9 aa, Homo Sapiens
FYPPKVELF

SEQ ID NO: 30073 - protein, 9 aa, Homo Sapiens
FYQPKIQQF

SEQ ID NO: 30074 - protein, 9 aa, Homo Sapiens
FYQRFPLSF

SEQ ID NO: 30075 - protein, 9 aa, Homo Sapiens
FYSNIQTVI

SEQ ID NO: 30076 - protein, 9 aa, Homo Sapiens
FYVDTVRAF

SEQ ID NO: 30077 - protein, 9 aa, Homo Sapiens
FYVGHIDAF

SEQ ID NO: 30078 - protein, 9 aa, Homo Sapiens
GAPVAAAAL

SEQ ID NO: 30079 - protein, 9 aa, Homo Sapiens
GEYKFQNAL

SEQ ID NO: 30080 - protein, 9 aa, Homo Sapiens
GFAGDDAPR

SEQ ID NO: 30081 - protein, 9 aa, Homo Sapiens
GFLDIDTKF

SEQ ID NO: 30082 - protein, 9 aa, Homo Sapiens
GGPGGVGGL

SEQ ID NO: 30083 - protein, 9 aa, Homo Sapiens
GILCSALQK

SEQ ID NO: 30084 - protein, 9 aa, Homo Sapiens
GPPPPGKPQ

SEQ ID NO: 30085 - protein, 9 aa, Homo Sapiens
GPPPPPGKP

SEQ ID NO: 30086 - protein, 9 aa, Homo Sapiens
GQPEIFYTF

SEQ ID NO: 30087 - protein, 9 aa, Homo Sapiens
GYIEDLKKF

SEQ ID NO: 30088 - protein, 9 aa, Homo Sapiens
GYIERPQLI

SEQ ID NO: 30089 - protein, 9 aa, Homo Sapiens
GYIESVQHI

SEQ ID NO: 30090 - protein, 9 aa, Homo Sapiens
GYIHVTQTF

SEQ ID NO: 30091 - protein, 9 aa, Homo Sapiens
GYIKNKLVF

SEQ ID NO: 30092 - protein, 9 aa, Homo Sapiens
GYIPIYTPF

SEQ ID NO: 30093 - protein, 9 aa, Homo Sapiens
GYLGYTSGF

SEQ ID NO: 30094 - protein, 9 aa, Homo Sapiens
GYLPLAHVL

SEQ ID NO: 30095 - protein, 9 aa, Homo Sapiens
GYLPVQTVL

SEQ ID NO: 30096 - protein, 9 aa, Homo Sapiens
GYLQVFPGL

SEQ ID NO: 30097 - protein, 9 aa, Homo Sapiens
GYPEVALHF

SEQ ID NO: 30098 - protein, 9 aa, Homo Sapiens
GYPLWKVTF

SEQ ID NO: 30099 - protein, 9 aa, Homo Sapiens
GYSEHFVEF

SEQ ID NO: 30100 - protein, 9 aa, Homo Sapiens
GYSPYQLTW

SEQ ID NO: 30101 - protein, 9 aa, Homo Sapiens
GYVKEQFAW

SEQ ID NO: 30102 - protein, 9 aa, Homo Sapiens
HFIAEHYMF

SEQ ID NO: 30103 - protein, 9 aa, Homo Sapiens
HFIECIFHF

SEQ ID NO: 30104 - protein, 9 aa, Homo Sapiens
HFIEIHHHL

SEQ ID NO: 30105 - protein, 9 aa, Homo Sapiens
HFIEKAHTL

SEQ ID NO: 30106 - protein, 9 aa, Homo Sapiens
HFLDRHLVF

SEQ ID NO: 30107 - protein, 9 aa, Homo Sapiens
HFLEQHPLL

SEQ ID NO: 30108 - protein, 9 aa, Homo Sapiens
HWKPGQFVF

SEQ ID NO: 30109 - protein, 9 aa, Homo Sapiens
HWVEFQNKF

SEQ ID NO: 30110 - protein, 9 aa, Homo Sapiens
HYAALAHYF

SEQ ID NO: 30111 - protein, 9 aa, Homo Sapiens
HYCEPYTTW

SEQ ID NO: 30112 - protein, 9 aa, Homo Sapiens
HYFNTPFQL

SEQ ID NO: 30113 - protein, 9 aa, Homo Sapiens
HYHPIVQRF

SEQ ID NO: 30114 - protein, 9 aa, Homo Sapiens
HYILHNSFF

SEQ ID NO: 30115 - protein, 9 aa, Homo Sapiens
HYINEVLFL

SEQ ID NO: 30116 - protein, 9 aa, Homo Sapiens
HYINMPVQF

SEQ ID NO: 30117 - protein, 9 aa, Homo Sapiens
HYIPRAVLL

SEQ ID NO: 30118 - protein, 9 aa, Homo Sapiens
HYIRKYNRF

SEQ ID NO: 30119 - protein, 9 aa, Homo Sapiens
HYITPMMEL

SEQ ID NO: 30120 - protein, 9 aa, Homo Sapiens
HYIYIENQF

SEQ ID NO: 30121 - protein, 9 aa, Homo Sapiens
HYKPTPLYF

SEQ ID NO: 30122 - protein, 9 aa, Homo Sapiens
HYLDVLYKM

SEQ ID NO: 30123 - protein, 9 aa, Homo Sapiens
HYLEHWLSM

SEQ ID NO: 30124 - protein, 9 aa, Homo Sapiens
HYLNVAFDL

SEQ ID NO: 30125 - protein, 9 aa, Homo Sapiens
HYLPVKIIL

SEQ ID NO: 30126 - protein, 9 aa, Homo Sapiens
HYLSYLNNL

SEQ ID NO: 30127 - protein, 9 aa, Homo Sapiens
HYLYQIAHL

SEQ ID NO: 30128 - protein, 9 aa, Homo Sapiens
HYMSINDSF

SEQ ID NO: 30129 - protein, 9 aa, Homo Sapiens
HYNSHYEKF

SEQ ID NO: 30130 - protein, 9 aa, Homo Sapiens
HYNWLIYHL

SEQ ID NO: 30131 - protein, 9 aa, Homo Sapiens
HYPPVQVLF

SEQ ID NO: 30132 - protein, 9 aa, Homo Sapiens
HYSKKWHRF

SEQ ID NO: 30133 - protein, 9 aa, Homo Sapiens
HYSPIYLSF

SEQ ID NO: 30134 - protein, 9 aa, Homo Sapiens
HYTIVFNTF

SEQ ID NO: 30135 - protein, 9 aa, Homo Sapiens
HYTYILEVF

SEQ ID NO: 30136 - protein, 9 aa, Homo Sapiens
HYVEKPSTF

SEQ ID NO: 30137 - protein, 9 aa, Homo Sapiens
HYVPATKVF

SEQ ID NO: 30138 - protein, 9 aa, Homo Sapiens
IEMPCHHLF

SEQ ID NO: 30139 - protein, 9 aa, Homo Sapiens
IFCETRAEW

SEQ ID NO: 30140 - protein, 9 aa, Homo Sapiens
IFFENHPYF

SEQ ID NO: 30141 - protein, 9 aa, Homo Sapiens
IFFPGVSEF

SEQ ID NO: 30142 - protein, 9 aa, Homo Sapiens
IFHDISLRF

SEQ ID NO: 30143 - protein, 9 aa, Homo Sapiens
IFHEVPLKF

SEQ ID NO: 30144 - protein, 9 aa, Homo Sapiens
IFHEVSQLI

SEQ ID NO: 30145 - protein, 9 aa, Homo Sapiens
IFIDEIDSF

SEQ ID NO: 30146 - protein, 9 aa, Homo Sapiens
IFIDKIYSI

SEQ ID NO: 30147 - protein, 9 aa, Homo Sapiens
IFITGTTRI

SEQ ID NO: 30148 - protein, 9 aa, Homo Sapiens
IFKDKPIKL

SEQ ID NO: 30149 - protein, 9 aa, Homo Sapiens
IFLLQALFG

SEQ ID NO: 30150 - protein, 9 aa, Homo Sapiens
IFLNLKTAL

SEQ ID NO: 30151 - protein, 9 aa, Homo Sapiens
IFLSQPILL

SEQ ID NO: 30152 - protein, 9 aa, Homo Sapiens
IFMENRNEF

SEQ ID NO: 30153 - protein, 9 aa, Homo Sapiens
IFMRVATML

SEQ ID NO: 30154 - protein, 9 aa, Homo Sapiens
IFPQSLPKL

SEQ ID NO: 30155 - protein, 9 aa, Homo Sapiens
IFQDVLLQF

SEQ ID NO: 30156 - protein, 9 aa, Homo Sapiens
IFSKIVSLF

SEQ ID NO: 30157 - protein, 9 aa, Homo Sapiens
IFTDLSSRF

SEQ ID NO: 30158 - protein, 9 aa, Homo Sapiens
IFTDVALKF

SEQ ID NO: 30159 - protein, 9 aa, Homo Sapiens
IFTNTVARF

SEQ ID NO: 30160 - protein, 9 aa, Homo Sapiens
IFTPKPTLF

SEQ ID NO: 30161 - protein, 9 aa, Homo Sapiens
IFVARLYYF

SEQ ID NO: 30162 - protein, 9 aa, Homo Sapiens
ILKKKSFTF

SEQ ID NO: 30163 - protein, 9 aa, Homo Sapiens
ILPCQVPVW

SEQ ID NO: 30164 - protein, 9 aa, Homo Sapiens
ILPEKQAEF

SEQ ID NO: 30165 - protein, 9 aa, Homo Sapiens
ILPGSLFRF

SEQ ID NO: 30166 - protein, 9 aa, Homo Sapiens
ILPKVIYRF

SEQ ID NO: 30167 - protein, 9 aa, Homo Sapiens
ILTERGYSF

SEQ ID NO: 30168 - protein, 9 aa, Homo Sapiens
IWIPYCIKL

SEQ ID NO: 30169 - protein, 9 aa, Homo Sapiens
IWISKLPHF

SEQ ID NO: 30170 - protein, 9 aa, Homo Sapiens
IWPEKSFCL

SEQ ID NO: 30171 - protein, 9 aa, Homo Sapiens
IYAAVTPEL

SEQ ID NO: 30172 - protein, 9 aa, Homo Sapiens
IYADVGEEF

SEQ ID NO: 30173 - protein, 9 aa, Homo Sapiens
IYAFVGEKF

SEQ ID NO: 30174 - protein, 9 aa, Homo Sapiens
IYAPKLQEF

SEQ ID NO: 30175 - protein, 9 aa, Homo Sapiens
IYAPPLPSL

SEQ ID NO: 30176 - protein, 9 aa, Homo Sapiens
IYAPQGLLL

SEQ ID NO: 30177 - protein, 9 aa, Homo Sapiens
IYATEAHVF

SEQ ID NO: 30178 - protein, 9 aa, Homo Sapiens
IYDSVKVYF

SEQ ID NO: 30179 - protein, 9 aa, Homo Sapiens
IYEEEPFNF

SEQ ID NO: 30180 - protein, 9 aa, Homo Sapiens
IYEPNFIFF

SEQ ID NO: 30181 - protein, 9 aa, Homo Sapiens
IYFKKPLNI

SEQ ID NO: 30182 - protein, 9 aa, Homo Sapiens
IYFPYVLKI

SEQ ID NO: 30183 - protein, 9 aa, Homo Sapiens
IYGEKTYAF

SEQ ID NO: 30184 - protein, 9 aa, Homo Sapiens
IYGSVPYLL

SEQ ID NO: 30185 - protein, 9 aa, Homo Sapiens
IYGYVAEQF

SEQ ID NO: 30186 - protein, 9 aa, Homo Sapiens
IYHPDIQLL

SEQ ID NO: 30187 - protein, 9 aa, Homo Sapiens
IYHQVAVQF

SEQ ID NO: 30188 - protein, 9 aa, Homo Sapiens
IYHSHHPTL

SEQ ID NO: 30189 - protein, 9 aa, Homo Sapiens
IYIAGHPAF

SEQ ID NO: 30190 - protein, 9 aa, Homo Sapiens
IYIDRFEDL

SEQ ID NO: 30191 - protein, 9 aa, Homo Sapiens
IYIDRGVVF

SEQ ID NO: 30192 - protein, 9 aa, Homo Sapiens
IYIKHPHLF

SEQ ID NO: 30193 - protein, 9 aa, Homo Sapiens
IYIKQIKTF

SEQ ID NO: 30194 - protein, 9 aa, Homo Sapiens
IYKAPSENW

SEQ ID NO: 30195 - protein, 9 aa, Homo Sapiens
IYKCVNTTL

SEQ ID NO: 30196 - protein, 9 aa, Homo Sapiens
IYKEIECSI

SEQ ID NO: 30197 - protein, 9 aa, Homo Sapiens
IYKPVTDFF

SEQ ID NO: 30198 - protein, 9 aa, Homo Sapiens
IYLDELQVI

SEQ ID NO: 30199 - protein, 9 aa, Homo Sapiens
IYLDGIITI

SEQ ID NO: 30200 - protein, 9 aa, Homo Sapiens
IYLDIIHTY

SEQ ID NO: 30201 - protein, 9 aa, Homo Sapiens
IYLDLPQNF

SEQ ID NO: 30202 - protein, 9 aa, Homo Sapiens
IYLDTHFRL

SEQ ID NO: 30203 - protein, 9 aa, Homo Sapiens
IYLEHTESI

SEQ ID NO: 30204 - protein, 9 aa, Homo Sapiens
IYLEKLKTI

SEQ ID NO: 30205 - protein, 9 aa, Homo Sapiens
IYLERFPIF

SEQ ID NO: 30206 - protein, 9 aa, Homo Sapiens
IYLEVIHNL

SEQ ID NO: 30207 - protein, 9 aa, Homo Sapiens
IYLIHHQRF

SEQ ID NO: 30208 - protein, 9 aa, Homo Sapiens
IYLLIHNNF

SEQ ID NO: 30209 - protein, 9 aa, Homo Sapiens
IYLLPRCTF

SEQ ID NO: 30210 - protein, 9 aa, Homo Sapiens
IYLNLLNDL

SEQ ID NO: 30211 - protein, 9 aa, Homo Sapiens
IYLPAAQTM

SEQ ID NO: 30212 - protein, 9 aa, Homo Sapiens
IYLPEVRKI

SEQ ID NO: 30213 - protein, 9 aa, Homo Sapiens
IYLPYLHEW

SEQ ID NO: 30214 - protein, 9 aa, Homo Sapiens
IYLPYLQNW

SEQ ID NO: 30215 - protein, 9 aa, Homo Sapiens
IYLRLLVKL

SEQ ID NO: 30216 - protein, 9 aa, Homo Sapiens
IYLTFPVAM

SEQ ID NO: 30217 - protein, 9 aa, Homo Sapiens
IYMDTLNIF

SEQ ID NO: 30218 - protein, 9 aa, Homo Sapiens
IYNFVESKL

SEQ ID NO: 30219 - protein, 9 aa, Homo Sapiens
IYNGDMEKI

SEQ ID NO: 30220 - protein, 9 aa, Homo Sapiens
IYNGKLFDL

SEQ ID NO: 30221 - protein, 9 aa, Homo Sapiens
IYNHITTRV

SEQ ID NO: 30222 - protein, 9 aa, Homo Sapiens
IYNQVNVVL

SEQ ID NO: 30223 - protein, 9 aa, Homo Sapiens
IYNSQREHF

SEQ ID NO: 30224 - protein, 9 aa, Homo Sapiens
IYNYPEQLF

SEQ ID NO: 30225 - protein, 9 aa, Homo Sapiens
IYPDSFTVL

SEQ ID NO: 30226 - protein, 9 aa, Homo Sapiens
IYPEAVTMF

SEQ ID NO: 30227 - protein, 9 aa, Homo Sapiens
IYPEVVHMF

SEQ ID NO: 30228 - protein, 9 aa, Homo Sapiens
IYPHGLVLL

SEQ ID NO: 30229 - protein, 9 aa, Homo Sapiens
IYPPEVAEF

SEQ ID NO: 30230 - protein, 9 aa, Homo Sapiens
IYPPKLHQF

SEQ ID NO: 30231 - protein, 9 aa, Homo Sapiens
IYPQVLHSL

SEQ ID NO: 30232 - protein, 9 aa, Homo Sapiens
IYPVNAISF

SEQ ID NO: 30233 - protein, 9 aa, Homo Sapiens
IYPWVHVVI

SEQ ID NO: 30234 - protein, 9 aa, Homo Sapiens
IYPYVIQEL

SEQ ID NO: 30235 - protein, 9 aa, Homo Sapiens
IYQDVTLKW

SEQ ID NO: 30236 - protein, 9 aa, Homo Sapiens
IYQKAFEHL

SEQ ID NO: 30237 - protein, 9 aa, Homo Sapiens
IYQKKYLLL

SEQ ID NO: 30238 - protein, 9 aa, Homo Sapiens
IYQKPFQTL

SEQ ID NO: 30239 - protein, 9 aa, Homo Sapiens
IYQRDPLKL

SEQ ID NO: 30240 - protein, 9 aa, Homo Sapiens
IYQRHVYNL

SEQ ID NO: 30241 - protein, 9 aa, Homo Sapiens
IYQWICDNF

SEQ ID NO: 30242 - protein, 9 aa, Homo Sapiens
IYQYIQSRF

SEQ ID NO: 30243 - protein, 9 aa, Homo Sapiens
IYSAERFLI

SEQ ID NO: 30244 - protein, 9 aa, Homo Sapiens
IYSEVATLI

SEQ ID NO: 30245 - protein, 9 aa, Homo Sapiens
IYSFHTLSF

SEQ ID NO: 30246 - protein, 9 aa, Homo Sapiens
IYSPQFSRL

SEQ ID NO: 30247 - protein, 9 aa, Homo Sapiens
IYSTAFDYF

SEQ ID NO: 30248 - protein, 9 aa, Homo Sapiens
IYSTKLYRF

SEQ ID NO: 30249 - protein, 9 aa, Homo Sapiens
IYTDITYSF

SEQ ID NO: 30250 - protein, 9 aa, Homo Sapiens
IYTMIYRNL

SEQ ID NO: 30251 - protein, 9 aa, Homo Sapiens
IYTSSVNRL

SEQ ID NO: 30252 - protein, 9 aa, Homo Sapiens
IYTVLFERL

SEQ ID NO: 30253 - protein, 9 aa, Homo Sapiens
IYVEQKQYI

SEQ ID NO: 30254 - protein, 9 aa, Homo Sapiens
IYVGAKVYF

SEQ ID NO: 30255 - protein, 9 aa, Homo Sapiens
IYVGRVKSF

SEQ ID NO: 30256 - protein, 9 aa, Homo Sapiens
IYVGSSPTL

SEQ ID NO: 30257 - protein, 9 aa, Homo Sapiens
IYVHDLLTF

SEQ ID NO: 30258 - protein, 9 aa, Homo Sapiens
IYVIPQPHF

SEQ ID NO: 30259 - protein, 9 aa, Homo Sapiens
IYVISAETF

SEQ ID NO: 30260 - protein, 9 aa, Homo Sapiens
IYVNMKTDF

SEQ ID NO: 30261 - protein, 9 aa, Homo Sapiens
IYVPSSYHL

SEQ ID NO: 30262 - protein, 9 aa, Homo Sapiens
IYVVGGYSW

SEQ ID NO: 30263 - protein, 9 aa, Homo Sapiens
IYWDGPLAL

SEQ ID NO: 30264 - protein, 9 aa, Homo Sapiens
IYYFKANVF

SEQ ID NO: 30265 - protein, 9 aa, Homo Sapiens
IYYGTQHKM

SEQ ID NO: 30266 - protein, 9 aa, Homo Sapiens
IYYVDVQKF

SEQ ID NO: 30267 - protein, 9 aa, Homo Sapiens
KFAEEFYSF

SEQ ID NO: 30268 - protein, 9 aa, Homo Sapiens
KFCMISATF

SEQ ID NO: 30269 - protein, 9 aa, Homo Sapiens
KFFEEVLLF

SEQ ID NO: 30270 - protein, 9 aa, Homo Sapiens
KFFYQKEHW

SEQ ID NO: 30271 - protein, 9 aa, Homo Sapiens
KFHAIITTF

SEQ ID NO: 30272 - protein, 9 aa, Homo Sapiens
KFIDKQLEL

SEQ ID NO: 30273 - protein, 9 aa, Homo Sapiens
KFIDTTSKF

SEQ ID NO: 30274 - protein, 9 aa, Homo Sapiens
KFIWTNHKF

SEQ ID NO: 30275 - protein, 9 aa, Homo Sapiens
KFLDALISL

SEQ ID NO: 30276 - protein, 9 aa, Homo Sapiens
KFLDEDFVF

SEQ ID NO: 30277 - protein, 9 aa, Homo Sapiens
KFLEQVHQL

SEQ ID NO: 30278 - protein, 9 aa, Homo Sapiens
KFLTKLPEI

SEQ ID NO: 30279 - protein, 9 aa, Homo Sapiens
KFNPVSFTW

SEQ ID NO: 30280 - protein, 9 aa, Homo Sapiens
KFPQFLPKF

SEQ ID NO: 30281 - protein, 9 aa, Homo Sapiens
KFSPRPLKF

SEQ ID NO: 30282 - protein, 9 aa, Homo Sapiens
KFVDILTNW

SEQ ID NO: 30283 - protein, 9 aa, Homo Sapiens
KFVDSTFYL

SEQ ID NO: 30284 - protein, 9 aa, Homo Sapiens
KFVETHPEF

SEQ ID NO: 30285 - protein, 9 aa, Homo Sapiens
KFVNKSYLL

SEQ ID NO: 30286 - protein, 9 aa, Homo Sapiens
KFYGNRHLI

SEQ ID NO: 30287 - protein, 9 aa, Homo Sapiens
KIIPLVVKF

SEQ ID NO: 30288 - protein, 9 aa, Homo Sapiens
KLPANHPLL

SEQ ID NO: 30289 - protein, 9 aa, Homo Sapiens
KLPDVYGVF

SEQ ID NO: 30290 - protein, 9 aa, Homo Sapiens
KLPEKTQTF

SEQ ID NO: 30291 - protein, 9 aa, Homo Sapiens
KLPSNLPQL

SEQ ID NO: 30292 - protein, 9 aa, Homo Sapiens
KLYPWIHQF

SEQ ID NO: 30293 - protein, 9 aa, Homo Sapiens
KMLDNFYNF

SEQ ID NO: 30294 - protein, 9 aa, Homo Sapiens
KMMDVTVTI

SEQ ID NO: 30295 - protein, 9 aa, Homo Sapiens
KMPLSTHRF

SEQ ID NO: 30296 - protein, 9 aa, Homo Sapiens
KQLAVYEEF

SEQ ID NO: 30297 - protein, 9 aa, Homo Sapiens
KQLTWFYTF

SEQ ID NO: 30298 - protein, 9 aa, Homo Sapiens
KQPKYWPVI

SEQ ID NO: 30299 - protein, 9 aa, Homo Sapiens
KTFPFHFMF

SEQ ID NO: 30300 - protein, 9 aa, Homo Sapiens
KWFDFKLFF

SEQ ID NO: 30301 - protein, 9 aa, Homo Sapiens
KWFFQKLRF

SEQ ID NO: 30302 - protein, 9 aa, Homo Sapiens
KWVPCSAKF

SEQ ID NO: 30303 - protein, 9 aa, Homo Sapiens
KYAHMINGF

SEQ ID NO: 30304 - protein, 9 aa, Homo Sapiens
KYAMMFAEL

SEQ ID NO: 30305 - protein, 9 aa, Homo Sapiens
KYAPRFNGF

SEQ ID NO: 30306 - protein, 9 aa, Homo Sapiens
KYCQVIRVI

SEQ ID NO: 30307 - protein, 9 aa, Homo Sapiens
KYEAIQLTF

SEQ ID NO: 30308 - protein, 9 aa, Homo Sapiens
KYEELFPAF

SEQ ID NO: 30309 - protein, 9 aa, Homo Sapiens
KYESIRLLF

SEQ ID NO: 30310 - protein, 9 aa, Homo Sapiens
KYFAKHPRL

SEQ ID NO: 30311 - protein, 9 aa, Homo Sapiens
KYFAQALKL

SEQ ID NO: 30312 - protein, 9 aa, Homo Sapiens
KYFEKQFEL

SEQ ID NO: 30313 - protein, 9 aa, Homo Sapiens
KYFHPPAHL

SEQ ID NO: 30314 - protein, 9 aa, Homo Sapiens
KYFLWEEKF

SEQ ID NO: 30315 - protein, 9 aa, Homo Sapiens
KYFLWVVKF

SEQ ID NO: 30316 - protein, 9 aa, Homo Sapiens
KYFQLDVTL

SEQ ID NO: 30317 - protein, 9 aa, Homo Sapiens
KYGIVLKEF

SEQ ID NO: 30318 - protein, 9 aa, Homo Sapiens
KYGSNVHRI

SEQ ID NO: 30319 - protein, 9 aa, Homo Sapiens
KYIATDFTL

SEQ ID NO: 30320 - protein, 9 aa, Homo Sapiens
KYIDKTIRV

SEQ ID NO: 30321 - protein, 9 aa, Homo Sapiens
KYIDQKFVL

SEQ ID NO: 30322 - protein, 9 aa, Homo Sapiens
KYIDRLIQL

SEQ ID NO: 30323 - protein, 9 aa, Homo Sapiens
KYIDYIFNV

SEQ ID NO: 30324 - protein, 9 aa, Homo Sapiens
KYIEGVSDF

SEQ ID NO: 30325 - protein, 9 aa, Homo Sapiens
KYIESPVLF

SEQ ID NO: 30326 - protein, 9 aa, Homo Sapiens
KYIGENLQL

SEQ ID NO: 30327 - protein, 9 aa, Homo Sapiens
KYIGFLVRL

SEQ ID NO: 30328 - protein, 9 aa, Homo Sapiens
KYIHSANVL

SEQ ID NO: 30329 - protein, 9 aa, Homo Sapiens
KYIKDDFRF

SEQ ID NO: 30330 - protein, 9 aa, Homo Sapiens
KYIMDLERL

SEQ ID NO: 30331 - protein, 9 aa, Homo Sapiens
KYINTDAKF

SEQ ID NO: 30332 - protein, 9 aa, Homo Sapiens
KYIPGTKMI

SEQ ID NO: 30333 - protein, 9 aa, Homo Sapiens
KYIPKQSFL

SEQ ID NO: 30334 - protein, 9 aa, Homo Sapiens
KYIPLPQRV

SEQ ID NO: 30335 - protein, 9 aa, Homo Sapiens
KYIQRQETI

SEQ ID NO: 30336 - protein, 9 aa, Homo Sapiens
KYIQRQQTI

SEQ ID NO: 30337 - protein, 9 aa, Homo Sapiens
KYISGPHEL

SEQ ID NO: 30338 - protein, 9 aa, Homo Sapiens
KYISKPENL

SEQ ID NO: 30339 - protein, 9 aa, Homo Sapiens
KYITDVVKL

SEQ ID NO: 30340 - protein, 9 aa, Homo Sapiens
KYITEVSRW

SEQ ID NO: 30341 - protein, 9 aa, Homo Sapiens
KYITKSFNF

SEQ ID NO: 30342 - protein, 9 aa, Homo Sapiens
KYITQGQLL

SEQ ID NO: 30343 - protein, 9 aa, Homo Sapiens
KYKGIFNGF

SEQ ID NO: 30344 - protein, 9 aa, Homo Sapiens
KYLADLPTL

SEQ ID NO: 30345 - protein, 9 aa, Homo Sapiens
KYLAHLEQL

SEQ ID NO: 30346 - protein, 9 aa, Homo Sapiens
KYLATLERL

SEQ ID NO: 30347 - protein, 9 aa, Homo Sapiens
KYLDIHERM

SEQ ID NO: 30348 - protein, 9 aa, Homo Sapiens
KYLDVKFEY

SEQ ID NO: 30349 - protein, 9 aa, Homo Sapiens
KYLEETNSL

SEQ ID NO: 30350 - protein, 9 aa, Homo Sapiens
KYLEHPLLL

SEQ ID NO: 30351 - protein, 9 aa, Homo Sapiens
KYLELCVDL

SEQ ID NO: 30352 - protein, 9 aa, Homo Sapiens
KYLGKTHNL

SEQ ID NO: 30353 - protein, 9 aa, Homo Sapiens
KYLGLLENL

SEQ ID NO: 30354 - protein, 9 aa, Homo Sapiens
KYLGQLHYL

SEQ ID NO: 30355 - protein, 9 aa, Homo Sapiens
KYLHPPPHL

SEQ ID NO: 30356 - protein, 9 aa, Homo Sapiens
KYLKEVLRI

SEQ ID NO: 30357 - protein, 9 aa, Homo Sapiens
KYLPALDEF

SEQ ID NO: 30358 - protein, 9 aa, Homo Sapiens
KYLPCFTFL

SEQ ID NO: 30359 - protein, 9 aa, Homo Sapiens
KYLPEWSAW

SEQ ID NO: 30360 - protein, 9 aa, Homo Sapiens
KYLPEWTAW

SEQ ID NO: 30361 - protein, 9 aa, Homo Sapiens
KYLQLRNVI

SEQ ID NO: 30362 - protein, 9 aa, Homo Sapiens
KYLQVVGMF

SEQ ID NO: 30363 - protein, 9 aa, Homo Sapiens
KYLSGIAHF

SEQ ID NO: 30364 - protein, 9 aa, Homo Sapiens
KYLSVQGQL

SEQ ID NO: 30365 - protein, 9 aa, Homo Sapiens
KYLTQHERI

SEQ ID NO: 30366 - protein, 9 aa, Homo Sapiens
KYLTVNKRL

SEQ ID NO: 30367 - protein, 9 aa, Homo Sapiens
KYLVIGDLL

SEQ ID NO: 30368 - protein, 9 aa, Homo Sapiens
KYLYQKIMF

SEQ ID NO: 30369 - protein, 9 aa, Homo Sapiens
KYLYVDKNF

SEQ ID NO: 30370 - protein, 9 aa, Homo Sapiens
KYMDINFDF

SEQ ID NO: 30371 - protein, 9 aa, Homo Sapiens
KYMDVQFDF

SEQ ID NO: 30372 - protein, 9 aa, Homo Sapiens
KYMLKANLI

SEQ ID NO: 30373 - protein, 9 aa, Homo Sapiens
KYMVYPQTF

SEQ ID NO: 30374 - protein, 9 aa, Homo Sapiens
KYNANFVTF

SEQ ID NO: 30375 - protein, 9 aa, Homo Sapiens
KYNDNFFGL

SEQ ID NO: 30376 - protein, 9 aa, Homo Sapiens
KYNETFQFI

SEQ ID NO: 30377 - protein, 9 aa, Homo Sapiens
KYNIMLVRL

SEQ ID NO: 30378 - protein, 9 aa, Homo Sapiens
KYNLVTHIL

SEQ ID NO: 30379 - protein, 9 aa, Homo Sapiens
KYNPTWHCI

SEQ ID NO: 30380 - protein, 9 aa, Homo Sapiens
KYPDIISRI

SEQ ID NO: 30381 - protein, 9 aa, Homo Sapiens
KYPDRVPVI

SEQ ID NO: 30382 - protein, 9 aa, Homo Sapiens
KYPENFFLL

SEQ ID NO: 30383 - protein, 9 aa, Homo Sapiens
KYPHYFPLL

SEQ ID NO: 30384 - protein, 9 aa, Homo Sapiens
KYPHYFPVM

SEQ ID NO: 30385 - protein, 9 aa, Homo Sapiens
KYPKVWEGF

SEQ ID NO: 30386 - protein, 9 aa, Homo Sapiens
KYPNVFKKI

SEQ ID NO: 30387 - protein, 9 aa, Homo Sapiens
KYPQLLPGI

SEQ ID NO: 30388 - protein, 9 aa, Homo Sapiens
KYPSPFFVF

SEQ ID NO: 30389 - protein, 9 aa, Homo Sapiens
KYPVHIYRL

SEQ ID NO: 30390 - protein, 9 aa, Homo Sapiens
KYQAVTATL

SEQ ID NO: 30391 - protein, 9 aa, Homo Sapiens
KYQDVYVEL

SEQ ID NO: 30392 - protein, 9 aa, Homo Sapiens
KYQEEFEHF

SEQ ID NO: 30393 - protein, 9 aa, Homo Sapiens
KYQEVTNNL

SEQ ID NO: 30394 - protein, 9 aa, Homo Sapiens
KYQHLKAEF

SEQ ID NO: 30395 - protein, 9 aa, Homo Sapiens
KYQIINEEF

SEQ ID NO: 30396 - protein, 9 aa, Homo Sapiens
KYQKGFSLW

SEQ ID NO: 30397 - protein, 9 aa, Homo Sapiens
KYQRILERL

SEQ ID NO: 30398 - protein, 9 aa, Homo Sapiens
KYSDITIMF

SEQ ID NO: 30399 - protein, 9 aa, Homo Sapiens
KYSEVFEAI

SEQ ID NO: 30400 - protein, 9 aa, Homo Sapiens
KYSPFVVSF

SEQ ID NO: 30401 - protein, 9 aa, Homo Sapiens
KYTGVLTEL

SEQ ID NO: 30402 - protein, 9 aa, Homo Sapiens
KYTKIFNDF

SEQ ID NO: 30403 - protein, 9 aa, Homo Sapiens
KYTPPPHHI

SEQ ID NO: 30404 - protein, 9 aa, Homo Sapiens
KYVDLTVSF

SEQ ID NO: 30405 - protein, 9 aa, Homo Sapiens
KYVHLFPKL

SEQ ID NO: 30406 - protein, 9 aa, Homo Sapiens
KYVKGLISI

SEQ ID NO: 30407 - protein, 9 aa, Homo Sapiens
KYVKIFDNF

SEQ ID NO: 30408 - protein, 9 aa, Homo Sapiens
KYVKVFDKF

SEQ ID NO: 30409 - protein, 9 aa, Homo Sapiens
KYVKVFHKF

SEQ ID NO: 30410 - protein, 9 aa, Homo Sapiens
KYVKVFHKY

SEQ ID NO: 30411 - protein, 9 aa, Homo Sapiens
KYVKVFNKF

SEQ ID NO: 30412 - protein, 9 aa, Homo Sapiens
KYVKVIHKF

SEQ ID NO: 30413 - protein, 9 aa, Homo Sapiens
KYVKVMHKF

SEQ ID NO: 30414 - protein, 9 aa, Homo Sapiens
KYVPLVTGL

SEQ ID NO: 30415 - protein, 9 aa, Homo Sapiens
KYVPYSESF

SEQ ID NO: 30416 - protein, 9 aa, Homo Sapiens
KYVSGEFRF

SEQ ID NO: 30417 - protein, 9 aa, Homo Sapiens
KYVYVVTEL

SEQ ID NO: 30418 - protein, 9 aa, Homo Sapiens
KYWDTFYKI

SEQ ID NO: 30419 - protein, 9 aa, Homo Sapiens
LFIATSQKF

SEQ ID NO: 30420 - protein, 9 aa, Homo Sapiens
LFIDNIFRF

SEQ ID NO: 30421 - protein, 9 aa, Homo Sapiens
LFKNDPLFF

SEQ ID NO: 30422 - protein, 9 aa, Homo Sapiens
LFLDTVSTF

SEQ ID NO: 30423 - protein, 9 aa, Homo Sapiens
LFLPLHELW

SEQ ID NO: 30424 - protein, 9 aa, Homo Sapiens
LFPLVPLHW

SEQ ID NO: 30425 - protein, 9 aa, Homo Sapiens
LFVKDLPQI

SEQ ID NO: 30426 - protein, 9 aa, Homo Sapiens
LLKLRYLIL

SEQ ID NO: 30427 - protein, 9 aa, Homo Sapiens
LLPGKTYSF

SEQ ID NO: 30428 - protein, 9 aa, Homo Sapiens
LLPSRQFGF

SEQ ID NO: 30429 - protein, 9 aa, Homo Sapiens
LMVPVTVVF

SEQ ID NO: 30430 - protein, 9 aa, Homo Sapiens
LVQQMEQLR

SEQ ID NO: 30431 - protein, 9 aa, Homo Sapiens
LWAPRPFNL

SEQ ID NO: 30432 - protein, 9 aa, Homo Sapiens
LWKGTHHAF

SEQ ID NO: 30433 - protein, 9 aa, Homo Sapiens
LWNEVTTSF

SEQ ID NO: 30434 - protein, 9 aa, Homo Sapiens
LWYYGEHLF

SEQ ID NO: 30435 - protein, 9 aa, Homo Sapiens
LYANMFERL

SEQ ID NO: 30436 - protein, 9 aa, Homo Sapiens
LYCEMGSTF

SEQ ID NO: 30437 - protein, 9 aa, Homo Sapiens
LYCGKTLLF

SEQ ID NO: 30438 - protein, 9 aa, Homo Sapiens
LYDIILKNF

SEQ ID NO: 30439 - protein, 9 aa, Homo Sapiens
LYENCFHIL

SEQ ID NO: 30440 - protein, 9 aa, Homo Sapiens
LYEPVWHVW

SEQ ID NO: 30441 - protein, 9 aa, Homo Sapiens
LYFHINQTL

SEQ ID NO: 30442 - protein, 9 aa, Homo Sapiens
LYGRHFNYL

SEQ ID NO: 30443 - protein, 9 aa, Homo Sapiens
LYHDIFSRL

SEQ ID NO: 30444 - protein, 9 aa, Homo Sapiens
LYIDEAHSI

SEQ ID NO: 30445 - protein, 9 aa, Homo Sapiens
LYIDFGGKF

SEQ ID NO: 30446 - protein, 9 aa, Homo Sapiens
LYIDSRQNL

SEQ ID NO: 30447 - protein, 9 aa, Homo Sapiens
LYIGDGYVI

SEQ ID NO: 30448 - protein, 9 aa, Homo Sapiens
LYIGHLTTL

SEQ ID NO: 30449 - protein, 9 aa, Homo Sapiens
LYIGSSKTF

SEQ ID NO: 30450 - protein, 9 aa, Homo Sapiens
LYIKNGQGF

SEQ ID NO: 30451 - protein, 9 aa, Homo Sapiens
LYIPPTHTF

SEQ ID NO: 30452 - protein, 9 aa, Homo Sapiens
LYITEPKTI

SEQ ID NO: 30453 - protein, 9 aa, Homo Sapiens
LYIVEPLKF

SEQ ID NO: 30454 - protein, 9 aa, Homo Sapiens
LYIVHPTMF

SEQ ID NO: 30455 - protein, 9 aa, Homo Sapiens
LYLECSAKF

SEQ ID NO: 30456 - protein, 9 aa, Homo Sapiens
LYLENIDEF

SEQ ID NO: 30457 - protein, 9 aa, Homo Sapiens
LYLGETVRF

SEQ ID NO: 30458 - protein, 9 aa, Homo Sapiens
LYLGLFNRL

SEQ ID NO: 30459 - protein, 9 aa, Homo Sapiens
LYLPSFFTY

SEQ ID NO: 30460 - protein, 9 aa, Homo Sapiens
LYLTIARQL

SEQ ID NO: 30461 - protein, 9 aa, Homo Sapiens
LYMDKFEEF

SEQ ID NO: 30462 - protein, 9 aa, Homo Sapiens
LYMNGMYAF

SEQ ID NO: 30463 - protein, 9 aa, Homo Sapiens
LYNDRMFRI

SEQ ID NO: 30464 - protein, 9 aa, Homo Sapiens
LYNKITSRL

SEQ ID NO: 30465 - protein, 9 aa, Homo Sapiens
LYNRTMVQL

SEQ ID NO: 30466 - protein, 9 aa, Homo Sapiens
LYPDHFHLL

SEQ ID NO: 30467 - protein, 9 aa, Homo Sapiens
LYPEGLAQL

SEQ ID NO: 30468 - protein, 9 aa, Homo Sapiens
LYPEVFEKF

SEQ ID NO: 30469 - protein, 9 aa, Homo Sapiens
LYPLTNYTF

SEQ ID NO: 30470 - protein, 9 aa, Homo Sapiens
LYPQFMFHL

SEQ ID NO: 30471 - protein, 9 aa, Homo Sapiens
LYPRLYPEL

SEQ ID NO: 30472 - protein, 9 aa, Homo Sapiens
LYPSIIQEF

SEQ ID NO: 30473 - protein, 9 aa, Homo Sapiens
LYQDGVFKF

SEQ ID NO: 30474 - protein, 9 aa, Homo Sapiens
LYQDKFPFF

SEQ ID NO: 30475 - protein, 9 aa, Homo Sapiens
LYQEHMAYI

SEQ ID NO: 30476 - protein, 9 aa, Homo Sapiens
LYQFNPAFF

SEQ ID NO: 30477 - protein, 9 aa, Homo Sapiens
LYQRAFQHL

SEQ ID NO: 30478 - protein, 9 aa, Homo Sapiens
LYQTFVVQL

SEQ ID NO: 30479 - protein, 9 aa, Homo Sapiens
LYSAVKTLL

SEQ ID NO: 30480 - protein, 9 aa, Homo Sapiens
LYSEVDVHF

SEQ ID NO: 30481 - protein, 9 aa, Homo Sapiens
LYSPLAEQF

SEQ ID NO: 30482 - protein, 9 aa, Homo Sapiens
LYSSEQLLI

SEQ ID NO: 30483 - protein, 9 aa, Homo Sapiens
LYSSKLYRF

SEQ ID NO: 30484 - protein, 9 aa, Homo Sapiens
LYSTIRPYL

SEQ ID NO: 30485 - protein, 9 aa, Homo Sapiens
LYTEAIKFF

SEQ ID NO: 30486 - protein, 9 aa, Homo Sapiens
LYTEKFEEF

SEQ ID NO: 30487 - protein, 9 aa, Homo Sapiens
LYTHIVTDI

SEQ ID NO: 30488 - protein, 9 aa, Homo Sapiens
LYTPEHHLI

SEQ ID NO: 30489 - protein, 9 aa, Homo Sapiens
LYTPHSWLL

SEQ ID NO: 30490 - protein, 9 aa, Homo Sapiens
LYTPKPQVI

SEQ ID NO: 30491 - protein, 9 aa, Homo Sapiens
LYTPVLIRF

SEQ ID NO: 30492 - protein, 9 aa, Homo Sapiens
LYVDFPQHL

SEQ ID NO: 30493 - protein, 9 aa, Homo Sapiens
LYVGKIPGF

SEQ ID NO: 30494 - protein, 9 aa, Homo Sapiens
LYVPVMITW

SEQ ID NO: 30495 - protein, 9 aa, Homo Sapiens
LYWSHPRKF

SEQ ID NO: 30496 - protein, 9 aa, Homo Sapiens
MFLDRPQQW

SEQ ID NO: 30497 - protein, 9 aa, Homo Sapiens
MWFPVKPKF

SEQ ID NO: 30498 - protein, 9 aa, Homo Sapiens
MYGFVNHAL

SEQ ID NO: 30499 - protein, 9 aa, Homo Sapiens
MYIARQLSF

SEQ ID NO: 30500 - protein, 9 aa, Homo Sapiens
MYIIGGYYW

SEQ ID NO: 30501 - protein, 9 aa, Homo Sapiens
MYLGITPSI

SEQ ID NO: 30502 - protein, 9 aa, Homo Sapiens
MYLKTVDKF

SEQ ID NO: 30503 - protein, 9 aa, Homo Sapiens
MYLVPAAMF

SEQ ID NO: 30504 - protein, 9 aa, Homo Sapiens
MYPYIFHVL

SEQ ID NO: 30505 - protein, 9 aa, Homo Sapiens
MYQEHINEI

SEQ ID NO: 30506 - protein, 9 aa, Homo Sapiens
MYTKLFVGF

SEQ ID NO: 30507 - protein, 9 aa, Homo Sapiens
NFHQSIPSF

SEQ ID NO: 30508 - protein, 9 aa, Homo Sapiens
NFICPALEF

SEQ ID NO: 30509 - protein, 9 aa, Homo Sapiens
NFIPTIVNF

SEQ ID NO: 30510 - protein, 9 aa, Homo Sapiens
NFLSRSFYW

SEQ ID NO: 30511 - protein, 9 aa, Homo Sapiens
NFPGIVTSF

SEQ ID NO: 30512 - protein, 9 aa, Homo Sapiens
NFTNVAATF

SEQ ID NO: 30513 - protein, 9 aa, Homo Sapiens
NFTSTHLLL

SEQ ID NO: 30514 - protein, 9 aa, Homo Sapiens
NHINVMVKF

SEQ ID NO: 30515 - protein, 9 aa, Homo Sapiens
NIHDIKLLF

SEQ ID NO: 30516 - protein, 9 aa, Homo Sapiens
NMTSVTNHF

SEQ ID NO: 30517 - protein, 9 aa, Homo Sapiens
NWVPTAYTW

SEQ ID NO: 30518 - protein, 9 aa, Homo Sapiens
NYAQVLDKF

SEQ ID NO: 30519 - protein, 9 aa, Homo Sapiens
NYASTFTWW

SEQ ID NO: 30520 - protein, 9 aa, Homo Sapiens
NYAWVYYHL

SEQ ID NO: 30521 - protein, 9 aa, Homo Sapiens
NYCNLFNYI

SEQ ID NO: 30522 - protein, 9 aa, Homo Sapiens
NYFHLAVAF

SEQ ID NO: 30523 - protein, 9 aa, Homo Sapiens
NYFIPSHYF

SEQ ID NO: 30524 - protein, 9 aa, Homo Sapiens
NYFLWTEKF

SEQ ID NO: 30525 - protein, 9 aa, Homo Sapiens
NYFPFQWKL

SEQ ID NO: 30526 - protein, 9 aa, Homo Sapiens
NYGHVYAVF

SEQ ID NO: 30527 - protein, 9 aa, Homo Sapiens
NYGQYFTLW

SEQ ID NO: 30528 - protein, 9 aa, Homo Sapiens
NYGRVFSEW

SEQ ID NO: 30529 - protein, 9 aa, Homo Sapiens
NYIDKVRFL

SEQ ID NO: 30530 - protein, 9 aa, Homo Sapiens
NYIEFTRIL

SEQ ID NO: 30531 - protein, 9 aa, Homo Sapiens
NYIEKVVAI

SEQ ID NO: 30532 - protein, 9 aa, Homo Sapiens
NYIGLINRI

SEQ ID NO: 30533 - protein, 9 aa, Homo Sapiens
NYIHVGAQL

SEQ ID NO: 30534 - protein, 9 aa, Homo Sapiens
NYIHWVEDL

SEQ ID NO: 30535 - protein, 9 aa, Homo Sapiens
NYIMKIHNF

SEQ ID NO: 30536 - protein, 9 aa, Homo Sapiens
NYIPYLTKL

SEQ ID NO: 30537 - protein, 9 aa, Homo Sapiens
NYISFYDHL

SEQ ID NO: 30538 - protein, 9 aa, Homo Sapiens
NYISGIQTI

SEQ ID NO: 30539 - protein, 9 aa, Homo Sapiens
NYITAALKL

SEQ ID NO: 30540 - protein, 9 aa, Homo Sapiens
NYKSHHLQL

SEQ ID NO: 30541 - protein, 9 aa, Homo Sapiens
NYLDIKGLL

SEQ ID NO: 30542 - protein, 9 aa, Homo Sapiens
NYLDQIAKF

SEQ ID NO: 30543 - protein, 9 aa, Homo Sapiens
NYLDVATFL

SEQ ID NO: 30544 - protein, 9 aa, Homo Sapiens
NYLHLDYNF

SEQ ID NO: 30545 - protein, 9 aa, Homo Sapiens
NYLKDGPYI

SEQ ID NO: 30546 - protein, 9 aa, Homo Sapiens
NYLPFIMEL

SEQ ID NO: 30547 - protein, 9 aa, Homo Sapiens
NYLPQISHL

SEQ ID NO: 30548 - protein, 9 aa, Homo Sapiens
NYLSHHLTI

SEQ ID NO: 30549 - protein, 9 aa, Homo Sapiens
NYLSIFRKF

SEQ ID NO: 30550 - protein, 9 aa, Homo Sapiens
NYMPGQLTI

SEQ ID NO: 30551 - protein, 9 aa, Homo Sapiens
NYNEKIYEL

SEQ ID NO: 30552 - protein, 9 aa, Homo Sapiens
NYPGIKLQI

SEQ ID NO: 30553 - protein, 9 aa, Homo Sapiens
NYPQSVPRL

SEQ ID NO: 30554 - protein, 9 aa, Homo Sapiens
NYPTKFQYL

SEQ ID NO: 30555 - protein, 9 aa, Homo Sapiens
NYQKRFQNL

SEQ ID NO: 30556 - protein, 9 aa, Homo Sapiens
NYQNVVHKL

SEQ ID NO: 30557 - protein, 9 aa, Homo Sapiens
NYSNIRFQF

SEQ ID NO: 30558 - protein, 9 aa, Homo Sapiens
NYSNVSIHL

SEQ ID NO: 30559 - protein, 9 aa, Homo Sapiens
NYTARFSRF

SEQ ID NO: 30560 - protein, 9 aa, Homo Sapiens
NYTGVQILL

SEQ ID NO: 30561 - protein, 9 aa, Homo Sapiens
NYTLVSHLI

SEQ ID NO: 30562 - protein, 9 aa, Homo Sapiens
NYVDCMKKF

SEQ ID NO: 30563 - protein, 9 aa, Homo Sapiens
NYVDVDPTF

SEQ ID NO: 30564 - protein, 9 aa, Homo Sapiens
NYVEVTRKW

SEQ ID NO: 30565 - protein, 9 aa, Homo Sapiens
NYVKKFQSF

SEQ ID NO: 30566 - protein, 9 aa, Homo Sapiens
NYVQAVEEF

SEQ ID NO: 30567 - protein, 9 aa, Homo Sapiens
NYYEHICHF

SEQ ID NO: 30568 - protein, 9 aa, Homo Sapiens
PAYHSSLMD

SEQ ID NO: 30569 - protein, 9 aa, Homo Sapiens
PFAKPLPTF

SEQ ID NO: 30570 - protein, 9 aa, Homo Sapiens
PFAPAIQTF

SEQ ID NO: 30571 - protein, 9 aa, Homo Sapiens
PFIDSQHVI

SEQ ID NO: 30572 - protein, 9 aa, Homo Sapiens
PFLDIQKRF

SEQ ID NO: 30573 - protein, 9 aa, Homo Sapiens
PFLELHTNF

SEQ ID NO: 30574 - protein, 9 aa, Homo Sapiens
PFLPKPLFF

SEQ ID NO: 30575 - protein, 9 aa, Homo Sapiens
PFLQVIPCF

SEQ ID NO: 30576 - protein, 9 aa, Homo Sapiens
PFTDQIFHF

SEQ ID NO: 30577 - protein, 9 aa, Homo Sapiens
PFVDHVFTF

SEQ ID NO: 30578 - protein, 9 aa, Homo Sapiens
PFYDKPMRI

SEQ ID NO: 30579 - protein, 9 aa, Homo Sapiens
PMNAVTTKF

SEQ ID NO: 30580 - protein, 9 aa, Homo Sapiens
PMYGAGHKF

SEQ ID NO: 30581 - protein, 9 aa, Homo Sapiens
PQPDVFPLF

SEQ ID NO: 30582 - protein, 9 aa, Homo Sapiens
PQYQTWEEF

SEQ ID NO: 30583 - protein, 9 aa, Homo Sapiens
PSIVHRKCF

SEQ ID NO: 30584 - protein, 9 aa, Homo Sapiens
PWLFDAPKF

SEQ ID NO: 30585 - protein, 9 aa, Homo Sapiens
PWYFWGETF

SEQ ID NO: 30586 - protein, 9 aa, Homo Sapiens
PYADQVFRI

SEQ ID NO: 30587 - protein, 9 aa, Homo Sapiens
PYAERVYFL

SEQ ID NO: 30588 - protein, 9 aa, Homo Sapiens
PYCSPPMTF

SEQ ID NO: 30589 - protein, 9 aa, Homo Sapiens
PYFNAPVYL

SEQ ID NO: 30590 - protein, 9 aa, Homo Sapiens
PYHPHPHVF

SEQ ID NO: 30591 - protein, 9 aa, Homo Sapiens
PYITEHTGF

SEQ ID NO: 30592 - protein, 9 aa, Homo Sapiens
PYLDKFFAL

SEQ ID NO: 30593 - protein, 9 aa, Homo Sapiens
PYLDSFYEY

SEQ ID NO: 30594 - protein, 9 aa, Homo Sapiens
PYLFHVVTF

SEQ ID NO: 30595 - protein, 9 aa, Homo Sapiens
PYLGQAPFL

SEQ ID NO: 30596 - protein, 9 aa, Homo Sapiens
PYLPSAHRV

SEQ ID NO: 30597 - protein, 9 aa, Homo Sapiens
PYLQGQVTL

SEQ ID NO: 30598 - protein, 9 aa, Homo Sapiens
PYLSEVLTF

SEQ ID NO: 30599 - protein, 9 aa, Homo Sapiens
PYLSPLVVW

SEQ ID NO: 30600 - protein, 9 aa, Homo Sapiens
PYMSSPCHI

SEQ ID NO: 30601 - protein, 9 aa, Homo Sapiens
PYNAPTVKF

SEQ ID NO: 30602 - protein, 9 aa, Homo Sapiens
PYNDYFEYF

SEQ ID NO: 30603 - protein, 9 aa, Homo Sapiens
PYNHQHEYF

SEQ ID NO: 30604 - protein, 9 aa, Homo Sapiens
PYNPLWAQL

SEQ ID NO: 30605 - protein, 9 aa, Homo Sapiens
PYPPPPPEF

SEQ ID NO: 30606 - protein, 9 aa, Homo Sapiens
PYRGWFPVI

SEQ ID NO: 30607 - protein, 9 aa, Homo Sapiens
PYRLIFEKF

SEQ ID NO: 30608 - protein, 9 aa, Homo Sapiens
PYSDSTAKL

SEQ ID NO: 30609 - protein, 9 aa, Homo Sapiens
PYVDHFLRL

SEQ ID NO: 30610 - protein, 9 aa, Homo Sapiens
PYVDNSYKW

SEQ ID NO: 30611 - protein, 9 aa, Homo Sapiens
PYVDRQNRI

SEQ ID NO: 30612 - protein, 9 aa, Homo Sapiens
PYVGGLEEF

SEQ ID NO: 30613 - protein, 9 aa, Homo Sapiens
PYVNNVPHL

SEQ ID NO: 30614 - protein, 9 aa, Homo Sapiens
PYVRNTPQF

SEQ ID NO: 30615 - protein, 9 aa, Homo Sapiens
PYYQPPYTL

SEQ ID NO: 30616 - protein, 9 aa, Homo Sapiens
PYYSKFILI

SEQ ID NO: 30617 - protein, 9 aa, Homo Sapiens
QFIDKPVCF

SEQ ID NO: 30618 - protein, 9 aa, Homo Sapiens
QFIGYPITL

SEQ ID NO: 30619 - protein, 9 aa, Homo Sapiens
QFVPKSHLF

SEQ ID NO: 30620 - protein, 9 aa, Homo Sapiens
QFVPPLPEW

SEQ ID NO: 30621 - protein, 9 aa, Homo Sapiens
QFYDLKELF

SEQ ID NO: 30622 - protein, 9 aa, Homo Sapiens
QGLDFFPFL

SEQ ID NO: 30623 - protein, 9 aa, Homo Sapiens
QIPEIKQTL

SEQ ID NO: 30624 - protein, 9 aa, Homo Sapiens
QMPTVHYEF

SEQ ID NO: 30625 - protein, 9 aa, Homo Sapiens
QQGGHPRPP

SEQ ID NO: 30626 - protein, 9 aa, Homo Sapiens
QVLDRYHRF

SEQ ID NO: 30627 - protein, 9 aa, Homo Sapiens
QWPELLLRF

SEQ ID NO: 30628 - protein, 9 aa, Homo Sapiens
QYAIISEAW

SEQ ID NO: 30629 - protein, 9 aa, Homo Sapiens
QYAPSTAQF

SEQ ID NO: 30630 - protein, 9 aa, Homo Sapiens
QYASAFHFL

SEQ ID NO: 30631 - protein, 9 aa, Homo Sapiens
QYASRFVQL

SEQ ID NO: 30632 - protein, 9 aa, Homo Sapiens
QYAVLLNRF

SEQ ID NO: 30633 - protein, 9 aa, Homo Sapiens
QYEEQFVTL

SEQ ID NO: 30634 - protein, 9 aa, Homo Sapiens
QYEIWRELF

SEQ ID NO: 30635 - protein, 9 aa, Homo Sapiens
QYEKLFHKW

SEQ ID NO: 30636 - protein, 9 aa, Homo Sapiens
QYEPLFHML

SEQ ID NO: 30637 - protein, 9 aa, Homo Sapiens
QYFPKAPEF

SEQ ID NO: 30638 - protein, 9 aa, Homo Sapiens
QYIDKLNEL

SEQ ID NO: 30639 - protein, 9 aa, Homo Sapiens
QYILFPLRF

SEQ ID NO: 30640 - protein, 9 aa, Homo Sapiens
QYISYIPQI

SEQ ID NO: 30641 - protein, 9 aa, Homo Sapiens
QYLARFDAL

SEQ ID NO: 30642 - protein, 9 aa, Homo Sapiens
QYLECPQYL

SEQ ID NO: 30643 - protein, 9 aa, Homo Sapiens
QYLEEAPKF

SEQ ID NO: 30644 - protein, 9 aa, Homo Sapiens
QYLELAHSL

SEQ ID NO: 30645 - protein, 9 aa, Homo Sapiens
QYLGQIQHI

SEQ ID NO: 30646 - protein, 9 aa, Homo Sapiens
QYLMDNPTF

SEQ ID NO: 30647 - protein, 9 aa, Homo Sapiens
QYLPHVARL

SEQ ID NO: 30648 - protein, 9 aa, Homo Sapiens
QYLQDAYSF

SEQ ID NO: 30649 - protein, 9 aa, Homo Sapiens
QYLTTKEQF

SEQ ID NO: 30650 - protein, 9 aa, Homo Sapiens
QYMERLQLL

SEQ ID NO: 30651 - protein, 9 aa, Homo Sapiens
QYNCLTQRI

SEQ ID NO: 30652 - protein, 9 aa, Homo Sapiens
QYNPKFQTL

SEQ ID NO: 30653 - protein, 9 aa, Homo Sapiens
QYPVIIHLI

SEQ ID NO: 30654 - protein, 9 aa, Homo Sapiens
QYQFLHHTL

SEQ ID NO: 30655 - protein, 9 aa, Homo Sapiens
QYSPLLAAF

SEQ ID NO: 30656 - protein, 9 aa, Homo Sapiens
QYTHKIYHL

SEQ ID NO: 30657 - protein, 9 aa, Homo Sapiens
QYVDFHNQL

SEQ ID NO: 30658 - protein, 9 aa, Homo Sapiens
QYVSAFSKL

SEQ ID NO: 30659 - protein, 9 aa, Homo Sapiens
QYVTQINRL

SEQ ID NO: 30660 - protein, 9 aa, Homo Sapiens
QYVYWLHML

SEQ ID NO: 30661 - protein, 9 aa, Homo Sapiens
RFCDNVWTF

SEQ ID NO: 30662 - protein, 9 aa, Homo Sapiens
RFEEAHFTF

SEQ ID NO: 30663 - protein, 9 aa, Homo Sapiens
RFFHLADLF

SEQ ID NO: 30664 - protein, 9 aa, Homo Sapiens
RFIDAVYKL

SEQ ID NO: 30665 - protein, 9 aa, Homo Sapiens
RFIGATANF

SEQ ID NO: 30666 - protein, 9 aa, Homo Sapiens
RFIGELTKF

SEQ ID NO: 30667 - protein, 9 aa, Homo Sapiens
RFILNLPTF

SEQ ID NO: 30668 - protein, 9 aa, Homo Sapiens
RFIPELINF

SEQ ID NO: 30669 - protein, 9 aa, Homo Sapiens
RFIPYTEEF

SEQ ID NO: 30670 - protein, 9 aa, Homo Sapiens
RFIQVCTQL

SEQ ID NO: 30671 - protein, 9 aa, Homo Sapiens
RFITEKAVF

SEQ ID NO: 30672 - protein, 9 aa, Homo Sapiens
RFLAATFLL

SEQ ID NO: 30673 - protein, 9 aa, Homo Sapiens
RFLEALNHF

SEQ ID NO: 30674 - protein, 9 aa, Homo Sapiens
RFLGLVVCL

SEQ ID NO: 30675 - protein, 9 aa, Homo Sapiens
RFLPEALFL

SEQ ID NO: 30676 - protein, 9 aa, Homo Sapiens
RFLPHGQLL

SEQ ID NO: 30677 - protein, 9 aa, Homo Sapiens
RFMDGHITF

SEQ ID NO: 30678 - protein, 9 aa, Homo Sapiens
RFQEKFFIF

SEQ ID NO: 30679 - protein, 9 aa, Homo Sapiens
RFSLNTVEL

SEQ ID NO: 30680 - protein, 9 aa, Homo Sapiens
RFVAPKTLF

SEQ ID NO: 30681 - protein, 9 aa, Homo Sapiens
RFVMKAHSF

SEQ ID NO: 30682 - protein, 9 aa, Homo Sapiens
RFVNVVPTF

SEQ ID NO: 30683 - protein, 9 aa, Homo Sapiens
RFYAFGRVF

SEQ ID NO: 30684 - protein, 9 aa, Homo Sapiens
RFYLLTEHF

SEQ ID NO: 30685 - protein, 9 aa, Homo Sapiens
RILHTYYKF

SEQ ID NO: 30686 - protein, 9 aa, Homo Sapiens
RILSVKTEF

SEQ ID NO: 30687 - protein, 9 aa, Homo Sapiens
RLIAQRYLL

SEQ ID NO: 30688 - protein, 9 aa, Homo Sapiens
RLLVKLYRF

SEQ ID NO: 30689 - protein, 9 aa, Homo Sapiens
RLPAWQPIL

SEQ ID NO: 30690 - protein, 9 aa, Homo Sapiens
RLPEPLPSW

SEQ ID NO: 30691 - protein, 9 aa, Homo Sapiens
RLPLRLFLI

SEQ ID NO: 30692 - protein, 9 aa, Homo Sapiens
RTINVYPNF

SEQ ID NO: 30693 - protein, 9 aa, Homo Sapiens
RTLLWTELF

SEQ ID NO: 30694 - protein, 9 aa, Homo Sapiens
RVLVVSAKF

SEQ ID NO: 30695 - protein, 9 aa, Homo Sapiens
RVVDIYSKF

SEQ ID NO: 30696 - protein, 9 aa, Homo Sapiens
RWLAQPYYL

SEQ ID NO: 30697 - protein, 9 aa, Homo Sapiens
RWPKKSAEF

SEQ ID NO: 30698 - protein, 9 aa, Homo Sapiens
RYALIMHKL

SEQ ID NO: 30699 - protein, 9 aa, Homo Sapiens
RYASINAHL

SEQ ID NO: 30700 - protein, 9 aa, Homo Sapiens
RYASINTHL

SEQ ID NO: 30701 - protein, 9 aa, Homo Sapiens
RYDEIRRHW

SEQ ID NO: 30702 - protein, 9 aa, Homo Sapiens
RYDKTQLRF

SEQ ID NO: 30703 - protein, 9 aa, Homo Sapiens
RYDNVTILF

SEQ ID NO: 30704 - protein, 9 aa, Homo Sapiens
RYEGKMETL

SEQ ID NO: 30705 - protein, 9 aa, Homo Sapiens
RYEKWIFEF

SEQ ID NO: 30706 - protein, 9 aa, Homo Sapiens
RYFENPQVI

SEQ ID NO: 30707 - protein, 9 aa, Homo Sapiens
RYFIPVSCF

SEQ ID NO: 30708 - protein, 9 aa, Homo Sapiens
RYFKGPELL

SEQ ID NO: 30709 - protein, 9 aa, Homo Sapiens
RYFKTPRKF

SEQ ID NO: 30710 - protein, 9 aa, Homo Sapiens
RYFLPPYTF

SEQ ID NO: 30711 - protein, 9 aa, Homo Sapiens
RYFQPPGTW

SEQ ID NO: 30712 - protein, 9 aa, Homo Sapiens
RYGDCHPVF

SEQ ID NO: 30713 - protein, 9 aa, Homo Sapiens
RYGLVTNEI

SEQ ID NO: 30714 - protein, 9 aa, Homo Sapiens
RYGTVEDLL

SEQ ID NO: 30715 - protein, 9 aa, Homo Sapiens
RYIANTVEL

SEQ ID NO: 30716 - protein, 9 aa, Homo Sapiens
RYIDRIHIF

SEQ ID NO: 30717 - protein, 9 aa, Homo Sapiens
RYIDTHNRV

SEQ ID NO: 30718 - protein, 9 aa, Homo Sapiens
RYIFAKNLF

SEQ ID NO: 30719 - protein, 9 aa, Homo Sapiens
RYIHLENLL

SEQ ID NO: 30720 - protein, 9 aa, Homo Sapiens
RYIKALETL

SEQ ID NO: 30721 - protein, 9 aa, Homo Sapiens
RYILEPFFI

SEQ ID NO: 30722 - protein, 9 aa, Homo Sapiens
RYINNPLLI

SEQ ID NO: 30723 - protein, 9 aa, Homo Sapiens
RYIPDAMNL

SEQ ID NO: 30724 - protein, 9 aa, Homo Sapiens
RYIPHPFLV

SEQ ID NO: 30725 - protein, 9 aa, Homo Sapiens
RYIPTAAAF

SEQ ID NO: 30726 - protein, 9 aa, Homo Sapiens
RYITKGNLF

SEQ ID NO: 30727 - protein, 9 aa, Homo Sapiens
RYIYNREEF

SEQ ID NO: 30728 - protein, 9 aa, Homo Sapiens
RYKLYQEMF

SEQ ID NO: 30729 - protein, 9 aa, Homo Sapiens
RYKQDVERF

SEQ ID NO: 30730 - protein, 9 aa, Homo Sapiens
RYKYQFFNL

SEQ ID NO: 30731 - protein, 9 aa, Homo Sapiens
RYLAEKYEW

SEQ ID NO: 30732 - protein, 9 aa, Homo Sapiens
RYLDEINLL

SEQ ID NO: 30733 - protein, 9 aa, Homo Sapiens
RYLDELMKL

SEQ ID NO: 30734 - protein, 9 aa, Homo Sapiens
RYLDLFTNY

SEQ ID NO: 30735 - protein, 9 aa, Homo Sapiens
RYLDLFTSF

SEQ ID NO: 30736 - protein, 9 aa, Homo Sapiens
RYLDSLKAI

SEQ ID NO: 30737 - protein, 9 aa, Homo Sapiens
RYLEKNVKL

SEQ ID NO: 30738 - protein, 9 aa, Homo Sapiens
RYLEKPMEI

SEQ ID NO: 30739 - protein, 9 aa, Homo Sapiens
RYLEQLHQL

SEQ ID NO: 30740 - protein, 9 aa, Homo Sapiens
RYLERLIKL

SEQ ID NO: 30741 - protein, 9 aa, Homo Sapiens
RYLEVMRKL

SEQ ID NO: 30742 - protein, 9 aa, Homo Sapiens
RYLEYFEKI

SEQ ID NO: 30743 - protein, 9 aa, Homo Sapiens
RYLFVVDRL

SEQ ID NO: 30744 - protein, 9 aa, Homo Sapiens
RYLGKKVQF

SEQ ID NO: 30745 - protein, 9 aa, Homo Sapiens
RYLGKVLEL

SEQ ID NO: 30746 - protein, 9 aa, Homo Sapiens
RYLHKPYLI

SEQ ID NO: 30747 - protein, 9 aa, Homo Sapiens
RYLLKFEQI

SEQ ID NO: 30748 - protein, 9 aa, Homo Sapiens
RYLNEFEEL

SEQ ID NO: 30749 - protein, 9 aa, Homo Sapiens
RYLNFFTKA

SEQ ID NO: 30750 - protein, 9 aa, Homo Sapiens
RYLNKAFHI

SEQ ID NO: 30751 - protein, 9 aa, Homo Sapiens
RYLPDTLLL

SEQ ID NO: 30752 - protein, 9 aa, Homo Sapiens
RYLPHEELF

SEQ ID NO: 30753 - protein, 9 aa, Homo Sapiens
RYLPLNTAL

SEQ ID NO: 30754 - protein, 9 aa, Homo Sapiens
RYLPQCSYF

SEQ ID NO: 30755 - protein, 9 aa, Homo Sapiens
RYLQTLTTI

SEQ ID NO: 30756 - protein, 9 aa, Homo Sapiens
RYLSHFRCV

SEQ ID NO: 30757 - protein, 9 aa, Homo Sapiens
RYLSKATTL

SEQ ID NO: 30758 - protein, 9 aa, Homo Sapiens
RYLSKVLEL

SEQ ID NO: 30759 - protein, 9 aa, Homo Sapiens
RYLTGAWRL

SEQ ID NO: 30760 - protein, 9 aa, Homo Sapiens
RYLTVAAVF

SEQ ID NO: 30761 - protein, 9 aa, Homo Sapiens
RYLVISEKL

SEQ ID NO: 30762 - protein, 9 aa, Homo Sapiens
RYLWATVTI

SEQ ID NO: 30763 - protein, 9 aa, Homo Sapiens
RYMDAWNTV

SEQ ID NO: 30764 - protein, 9 aa, Homo Sapiens
RYMNHMQSL

SEQ ID NO: 30765 - protein, 9 aa, Homo Sapiens
RYMPDICVI

SEQ ID NO: 30766 - protein, 9 aa, Homo Sapiens
RYMPQNPCI

SEQ ID NO: 30767 - protein, 9 aa, Homo Sapiens
RYMPQNPHI

SEQ ID NO: 30768 - protein, 9 aa, Homo Sapiens
RYMVHLLEL

SEQ ID NO: 30769 - protein, 9 aa, Homo Sapiens
RYNEKCFKL

SEQ ID NO: 30770 - protein, 9 aa, Homo Sapiens
RYNHITATY

SEQ ID NO: 30771 - protein, 9 aa, Homo Sapiens
RYNPENNTW

SEQ ID NO: 30772 - protein, 9 aa, Homo Sapiens
RYNPNLNTW

SEQ ID NO: 30773 - protein, 9 aa, Homo Sapiens
RYNSQLLSF

SEQ ID NO: 30774 - protein, 9 aa, Homo Sapiens
RYPAIIYNI

SEQ ID NO: 30775 - protein, 9 aa, Homo Sapiens
RYPCFFNTL

SEQ ID NO: 30776 - protein, 9 aa, Homo Sapiens
RYPDNLKHL

SEQ ID NO: 30777 - protein, 9 aa, Homo Sapiens
RYPDRITLI

SEQ ID NO: 30778 - protein, 9 aa, Homo Sapiens
RYPDSHQLF

SEQ ID NO: 30779 - protein, 9 aa, Homo Sapiens
RYPNKLDTI

SEQ ID NO: 30780 - protein, 9 aa, Homo Sapiens
RYPSLWRRL

SEQ ID NO: 30781 - protein, 9 aa, Homo Sapiens
RYPSNLQLF

SEQ ID NO: 30782 - protein, 9 aa, Homo Sapiens
RYQDAIRVF

SEQ ID NO: 30783 - protein, 9 aa, Homo Sapiens
RYQDIIHSI

SEQ ID NO: 30784 - protein, 9 aa, Homo Sapiens
RYQFIEEAF

SEQ ID NO: 30785 - protein, 9 aa, Homo Sapiens
RYQGVNLYI

SEQ ID NO: 30786 - protein, 9 aa, Homo Sapiens
RYQQWMERF

SEQ ID NO: 30787 - protein, 9 aa, Homo Sapiens
RYQTKFRHL

SEQ ID NO: 30788 - protein, 9 aa, Homo Sapiens
RYQTLYARF

SEQ ID NO: 30789 - protein, 9 aa, Homo Sapiens
RYRPDMPCF

SEQ ID NO: 30790 - protein, 9 aa, Homo Sapiens
RYRPRAPII

SEQ ID NO: 30791 - protein, 9 aa, Homo Sapiens
RYSDSTFTF

SEQ ID NO: 30792 - protein, 9 aa, Homo Sapiens
RYSGNQVLF

SEQ ID NO: 30793 - protein, 9 aa, Homo Sapiens
RYSPVLSRF

SEQ ID NO: 30794 - protein, 9 aa, Homo Sapiens
RYTDVSTRY

SEQ ID NO: 30795 - protein, 9 aa, Homo Sapiens
RYTTEFHEL

SEQ ID NO: 30796 - protein, 9 aa, Homo Sapiens
RYVDKVSNL

SEQ ID NO: 30797 - protein, 9 aa, Homo Sapiens
RYVDQVLQL

SEQ ID NO: 30798 - protein, 9 aa, Homo Sapiens
RYVDRVTEF

SEQ ID NO: 30799 - protein, 9 aa, Homo Sapiens
RYVEIVSQF

SEQ ID NO: 30800 - protein, 9 aa, Homo Sapiens
RYVGFCMKF

SEQ ID NO: 30801 - protein, 9 aa, Homo Sapiens
RYVKKLGDF

SEQ ID NO: 30802 - protein, 9 aa, Homo Sapiens
RYVMTTTTL

SEQ ID NO: 30803 - protein, 9 aa, Homo Sapiens
RYVPRASYF

SEQ ID NO: 30804 - protein, 9 aa, Homo Sapiens
RYVQPMASF

SEQ ID NO: 30805 - protein, 9 aa, Homo Sapiens
RYVWWKKSL

SEQ ID NO: 30806 - protein, 9 aa, Homo Sapiens
RYYGAISKL

SEQ ID NO: 30807 - protein, 9 aa, Homo Sapiens
RYYGNISRF

SEQ ID NO: 30808 - protein, 9 aa, Homo Sapiens
RYYHCAVTL

SEQ ID NO: 30809 - protein, 9 aa, Homo Sapiens
SALEKFFYF

SEQ ID NO: 30810 - protein, 9 aa, Homo Sapiens
SFCDKVMRW

SEQ ID NO: 30811 - protein, 9 aa, Homo Sapiens
SFFLGKVCF

SEQ ID NO: 30812 - protein, 9 aa, Homo Sapiens
SFFRVVPQF

SEQ ID NO: 30813 - protein, 9 aa, Homo Sapiens
SFHNIHNTF

SEQ ID NO: 30814 - protein, 9 aa, Homo Sapiens
SFHQVDFTF

SEQ ID NO: 30815 - protein, 9 aa, Homo Sapiens
SFINSNLKF

SEQ ID NO: 30816 - protein, 9 aa, Homo Sapiens
SFIRTRLLL

SEQ ID NO: 30817 - protein, 9 aa, Homo Sapiens
SFISVGNKF

SEQ ID NO: 30818 - protein, 9 aa, Homo Sapiens
SFITSSWTF

SEQ ID NO: 30819 - protein, 9 aa, Homo Sapiens
SFLATITSF

SEQ ID NO: 30820 - protein, 9 aa, Homo Sapiens
SFLKFHPEL

SEQ ID NO: 30821 - protein, 9 aa, Homo Sapiens
SFLPGNFHF

SEQ ID NO: 30822 - protein, 9 aa, Homo Sapiens
SFLPLAHMF

SEQ ID NO: 30823 - protein, 9 aa, Homo Sapiens
SFLPVHLGF

SEQ ID NO: 30824 - protein, 9 aa, Homo Sapiens
SFLPVVSTF

SEQ ID NO: 30825 - protein, 9 aa, Homo Sapiens
SFLQRFFKF

SEQ ID NO: 30826 - protein, 9 aa, Homo Sapiens
SFMPNSPRF

SEQ ID NO: 30827 - protein, 9 aa, Homo Sapiens
SFSTVHEKF

SEQ ID NO: 30828 - protein, 9 aa, Homo Sapiens
SFSTVTNTF

SEQ ID NO: 30829 - protein, 9 aa, Homo Sapiens
SGPGPAAAL

SEQ ID NO: 30830 - protein, 9 aa, Homo Sapiens
SLPDFCHKF

SEQ ID NO: 30831 - protein, 9 aa, Homo Sapiens
SLPEDFYHF

SEQ ID NO: 30832 - protein, 9 aa, Homo Sapiens
SLPESVPLF

SEQ ID NO: 30833 - protein, 9 aa, Homo Sapiens
SMFHNRHLF

SEQ ID NO: 30834 - protein, 9 aa, Homo Sapiens
SQMKSYQSF

SEQ ID NO: 30835 - protein, 9 aa, Homo Sapiens
SSPAPRTAL

SEQ ID NO: 30836 - protein, 9 aa, Homo Sapiens
SWLPLFPRI

SEQ ID NO: 30837 - protein, 9 aa, Homo Sapiens
SYADQMFLL

SEQ ID NO: 30838 - protein, 9 aa, Homo Sapiens
SYALLTYMI

SEQ ID NO: 30839 - protein, 9 aa, Homo Sapiens
SYANYFIRL

SEQ ID NO: 30840 - protein, 9 aa, Homo Sapiens
SYAQYVHNL

SEQ ID NO: 30841 - protein, 9 aa, Homo Sapiens
SYEYRFLEF

SEQ ID NO: 30842 - protein, 9 aa, Homo Sapiens
SYFPKILTF

SEQ ID NO: 30843 - protein, 9 aa, Homo Sapiens
SYGAWYPLL

SEQ ID NO: 30844 - protein, 9 aa, Homo Sapiens
SYGDILHVI

SEQ ID NO: 30845 - protein, 9 aa, Homo Sapiens
SYGIVLYEL

SEQ ID NO: 30846 - protein, 9 aa, Homo Sapiens
SYGKINILL

SEQ ID NO: 30847 - protein, 9 aa, Homo Sapiens
SYGKVTAEF

SEQ ID NO: 30848 - protein, 9 aa, Homo Sapiens
SYIAHLRQI

SEQ ID NO: 30849 - protein, 9 aa, Homo Sapiens
SYIALPLTL

SEQ ID NO: 30850 - protein, 9 aa, Homo Sapiens
SYIDVAVKL

SEQ ID NO: 30851 - protein, 9 aa, Homo Sapiens
SYIEHIFEI

SEQ ID NO: 30852 - protein, 9 aa, Homo Sapiens
SYIELPAYL

SEQ ID NO: 30853 - protein, 9 aa, Homo Sapiens
SYIGANVRL

SEQ ID NO: 30854 - protein, 9 aa, Homo Sapiens
SYIGVHQQI

SEQ ID NO: 30855 - protein, 9 aa, Homo Sapiens
SYIHYFHCL

SEQ ID NO: 30856 - protein, 9 aa, Homo Sapiens
SYINLNPRL

SEQ ID NO: 30857 - protein, 9 aa, Homo Sapiens
SYIPCSERI

SEQ ID NO: 30858 - protein, 9 aa, Homo Sapiens
SYIPIFPQL

SEQ ID NO: 30859 - protein, 9 aa, Homo Sapiens
SYIPSTVFF

SEQ ID NO: 30860 - protein, 9 aa, Homo Sapiens
SYISRTNQL

SEQ ID NO: 30861 - protein, 9 aa, Homo Sapiens
SYITKPEKW

SEQ ID NO: 30862 - protein, 9 aa, Homo Sapiens
SYLANHTRI

SEQ ID NO: 30863 - protein, 9 aa, Homo Sapiens
SYLAQHIRI

SEQ ID NO: 30864 - protein, 9 aa, Homo Sapiens
SYLAVHKRI

SEQ ID NO: 30865 - protein, 9 aa, Homo Sapiens
SYLDEGFLL

SEQ ID NO: 30866 - protein, 9 aa, Homo Sapiens
SYLDRTEQL

SEQ ID NO: 30867 - protein, 9 aa, Homo Sapiens
SYLDSVHFF

SEQ ID NO: 30868 - protein, 9 aa, Homo Sapiens
SYLDVKQRL

SEQ ID NO: 30869 - protein, 9 aa, Homo Sapiens
SYLEGAVYI

SEQ ID NO: 30870 - protein, 9 aa, Homo Sapiens
SYLEKVVTL

SEQ ID NO: 30871 - protein, 9 aa, Homo Sapiens
SYLENVDHF

SEQ ID NO: 30872 - protein, 9 aa, Homo Sapiens
SYLKEFIHI

SEQ ID NO: 30873 - protein, 9 aa, Homo Sapiens
SYLKQLPHF

SEQ ID NO: 30874 - protein, 9 aa, Homo Sapiens
SYLLFFRAL

SEQ ID NO: 30875 - protein, 9 aa, Homo Sapiens
SYLNQHQRI

SEQ ID NO: 30876 - protein, 9 aa, Homo Sapiens
SYLNSVQRL

SEQ ID NO: 30877 - protein, 9 aa, Homo Sapiens
SYLPHAPPF

SEQ ID NO: 30878 - protein, 9 aa, Homo Sapiens
SYLPISPTF

SEQ ID NO: 30879 - protein, 9 aa, Homo Sapiens
SYLPLAHMF

SEQ ID NO: 30880 - protein, 9 aa, Homo Sapiens
SYLPRIVLL

SEQ ID NO: 30881 - protein, 9 aa, Homo Sapiens
SYLSHQLDF

SEQ ID NO: 30882 - protein, 9 aa, Homo Sapiens
SYLSQHQRI

SEQ ID NO: 30883 - protein, 9 aa, Homo Sapiens
SYLSSILRF

SEQ ID NO: 30884 - protein, 9 aa, Homo Sapiens
SYLSSLSHL

SEQ ID NO: 30885 - protein, 9 aa, Homo Sapiens
SYLSVHTRM

SEQ ID NO: 30886 - protein, 9 aa, Homo Sapiens
SYLTKHKRI

SEQ ID NO: 30887 - protein, 9 aa, Homo Sapiens
SYLTKHQRI

SEQ ID NO: 30888 - protein, 9 aa, Homo Sapiens
SYLTQHQRI

SEQ ID NO: 30889 - protein, 9 aa, Homo Sapiens
SYLTVHKRI

SEQ ID NO: 30890 - protein, 9 aa, Homo Sapiens
SYLTWHQQI

SEQ ID NO: 30891 - protein, 9 aa, Homo Sapiens
SYLVIHERI

SEQ ID NO: 30892 - protein, 9 aa, Homo Sapiens
SYMEVPTYL

SEQ ID NO: 30893 - protein, 9 aa, Homo Sapiens
SYMGHFDLL

SEQ ID NO: 30894 - protein, 9 aa, Homo Sapiens
SYMPTVSHL

SEQ ID NO: 30895 - protein, 9 aa, Homo Sapiens
SYMWTINNF

SEQ ID NO: 30896 - protein, 9 aa, Homo Sapiens
SYNDIYCRF

SEQ ID NO: 30897 - protein, 9 aa, Homo Sapiens
SYNGKLYVF

SEQ ID NO: 30898 - protein, 9 aa, Homo Sapiens
SYNNFFRMF

SEQ ID NO: 30899 - protein, 9 aa, Homo Sapiens
SYNPITHQL

SEQ ID NO: 30900 - protein, 9 aa, Homo Sapiens
SYNPLWLRI

SEQ ID NO: 30901 - protein, 9 aa, Homo Sapiens
SYPDLLPTF

SEQ ID NO: 30902 - protein, 9 aa, Homo Sapiens
SYPDNFLHI

SEQ ID NO: 30903 - protein, 9 aa, Homo Sapiens
SYPGSSYIF

SEQ ID NO: 30904 - protein, 9 aa, Homo Sapiens
SYPTFFPRF

SEQ ID NO: 30905 - protein, 9 aa, Homo Sapiens
SYQDVHLLL

SEQ ID NO: 30906 - protein, 9 aa, Homo Sapiens
SYQKVIELF

SEQ ID NO: 30907 - protein, 9 aa, Homo Sapiens
SYQRAFNEF

SEQ ID NO: 30908 - protein, 9 aa, Homo Sapiens
SYRNIFPIW

SEQ ID NO: 30909 - protein, 9 aa, Homo Sapiens
SYSDPPLKF

SEQ ID NO: 30910 - protein, 9 aa, Homo Sapiens
SYSHIMALI

SEQ ID NO: 30911 - protein, 9 aa, Homo Sapiens
SYSPQAFKF

SEQ ID NO: 30912 - protein, 9 aa, Homo Sapiens
SYTHIQYLF

SEQ ID NO: 30913 - protein, 9 aa, Homo Sapiens
SYTRLFSNF

SEQ ID NO: 30914 - protein, 9 aa, Homo Sapiens
SYTSVKENF

SEQ ID NO: 30915 - protein, 9 aa, Homo Sapiens
SYVETELIF

SEQ ID NO: 30916 - protein, 9 aa, Homo Sapiens
SYVHYVFRL

SEQ ID NO: 30917 - protein, 9 aa, Homo Sapiens
SYVQVTSNF

SEQ ID NO: 30918 - protein, 9 aa, Homo Sapiens
SYVVAMETF

SEQ ID NO: 30919 - protein, 9 aa, Homo Sapiens
SYVWRTYHL

SEQ ID NO: 30920 - protein, 9 aa, Homo Sapiens
SYYKDALRF

SEQ ID NO: 30921 - protein, 9 aa, Homo Sapiens
SYYTVAHAI

SEQ ID NO: 30922 - protein, 9 aa, Homo Sapiens
TDVTFLLIF

SEQ ID NO: 30923 - protein, 9 aa, Homo Sapiens
TEAPLNPKA

SEQ ID NO: 30924 - protein, 9 aa, Homo Sapiens
TFIDAGSNF

SEQ ID NO: 30925 - protein, 9 aa, Homo Sapiens
TFINLMTHI

SEQ ID NO: 30926 - protein, 9 aa, Homo Sapiens
TFISYSVTF

SEQ ID NO: 30927 - protein, 9 aa, Homo Sapiens
TFKDVEVTF

SEQ ID NO: 30928 - protein, 9 aa, Homo Sapiens
TFLHVNPYI

SEQ ID NO: 30929 - protein, 9 aa, Homo Sapiens
TFLNIAEHF

SEQ ID NO: 30930 - protein, 9 aa, Homo Sapiens
TFLPFIHTI

SEQ ID NO: 30931 - protein, 9 aa, Homo Sapiens
TFLPTAIKF

SEQ ID NO: 30932 - protein, 9 aa, Homo Sapiens
TFSDVEAHF

SEQ ID NO: 30933 - protein, 9 aa, Homo Sapiens
TFTDHVMLF

SEQ ID NO: 30934 - protein, 9 aa, Homo Sapiens
TFTFSHATF

SEQ ID NO: 30935 - protein, 9 aa, Homo Sapiens
TLIDIMTRF

SEQ ID NO: 30936 - protein, 9 aa, Homo Sapiens
TLSDIFLLF

SEQ ID NO: 30937 - protein, 9 aa, Homo Sapiens
TMLGKFYHF

SEQ ID NO: 30938 - protein, 9 aa, Homo Sapiens
TPPPPGKPE

SEQ ID NO: 30939 - protein, 9 aa, Homo Sapiens
TQNPNYYNL

SEQ ID NO: 30940 - protein, 9 aa, Homo Sapiens
TWIHKLHKF

SEQ ID NO: 30941 - protein, 9 aa, Homo Sapiens
TWWHGVLAW

SEQ ID NO: 30942 - protein, 9 aa, Homo Sapiens
TYAEKLHRL

SEQ ID NO: 30943 - protein, 9 aa, Homo Sapiens
TYAPVKSFL

SEQ ID NO: 30944 - protein, 9 aa, Homo Sapiens
TYATHVTEI

SEQ ID NO: 30945 - protein, 9 aa, Homo Sapiens
TYFDKNYNL

SEQ ID NO: 30946 - protein, 9 aa, Homo Sapiens
TYFRFQEEI

SEQ ID NO: 30947 - protein, 9 aa, Homo Sapiens
TYFSTPLLL

SEQ ID NO: 30948 - protein, 9 aa, Homo Sapiens
TYGEIFEKF

SEQ ID NO: 30949 - protein, 9 aa, Homo Sapiens
TYGKIDLGF

SEQ ID NO: 30950 - protein, 9 aa, Homo Sapiens
TYGNPNYHW

SEQ ID NO: 30951 - protein, 9 aa, Homo Sapiens
TYGPSFPAF

SEQ ID NO: 30952 - protein, 9 aa, Homo Sapiens
TYGVSFFLV

SEQ ID NO: 30953 - protein, 9 aa, Homo Sapiens
TYHGVFVNI

SEQ ID NO: 30954 - protein, 9 aa, Homo Sapiens
TYHPGVPVF

SEQ ID NO: 30955 - protein, 9 aa, Homo Sapiens
TYIDKKCPF

SEQ ID NO: 30956 - protein, 9 aa, Homo Sapiens
TYIDKSTQL

SEQ ID NO: 30957 - protein, 9 aa, Homo Sapiens
TYIGPSTVF

SEQ ID NO: 30958 - protein, 9 aa, Homo Sapiens
TYIKFINLF

SEQ ID NO: 30959 - protein, 9 aa, Homo Sapiens
TYIKPISKL

SEQ ID NO: 30960 - protein, 9 aa, Homo Sapiens
TYIKSPPFF

SEQ ID NO: 30961 - protein, 9 aa, Homo Sapiens
TYINHVVSV

SEQ ID NO: 30962 - protein, 9 aa, Homo Sapiens
TYINPFVSF

SEQ ID NO: 30963 - protein, 9 aa, Homo Sapiens
TYIQILESF

SEQ ID NO: 30964 - protein, 9 aa, Homo Sapiens
TYIQKIFRM

SEQ ID NO: 30965 - protein, 9 aa, Homo Sapiens
TYIRDFQKI

SEQ ID NO: 30966 - protein, 9 aa, Homo Sapiens
TYISWKEEL

SEQ ID NO: 30967 - protein, 9 aa, Homo Sapiens
TYITSVSRL

SEQ ID NO: 30968 - protein, 9 aa, Homo Sapiens
TYKAFNTFI

SEQ ID NO: 30969 - protein, 9 aa, Homo Sapiens
TYLDIFRDF

SEQ ID NO: 30970 - protein, 9 aa, Homo Sapiens
TYLDKVENI

SEQ ID NO: 30971 - protein, 9 aa, Homo Sapiens
TYLDLLGTW

SEQ ID NO: 30972 - protein, 9 aa, Homo Sapiens
TYLEKAIKI

SEQ ID NO: 30973 - protein, 9 aa, Homo Sapiens
TYLEKFQNL

SEQ ID NO: 30974 - protein, 9 aa, Homo Sapiens
TYLGKYWAI

SEQ ID NO: 30975 - protein, 9 aa, Homo Sapiens
TYLIQHQKI

SEQ ID NO: 30976 - protein, 9 aa, Homo Sapiens
TYLKAVKLF

SEQ ID NO: 30977 - protein, 9 aa, Homo Sapiens
TYLLSVYRL

SEQ ID NO: 30978 - protein, 9 aa, Homo Sapiens
TYLNDFFSY

SEQ ID NO: 30979 - protein, 9 aa, Homo Sapiens
TYLNISRNL

SEQ ID NO: 30980 - protein, 9 aa, Homo Sapiens
TYLNWLVRM

SEQ ID NO: 30981 - protein, 9 aa, Homo Sapiens
TYLPTSPLL

SEQ ID NO: 30982 - protein, 9 aa, Homo Sapiens
TYLRDQHFL

SEQ ID NO: 30983 - protein, 9 aa, Homo Sapiens
TYLRKIPRF

SEQ ID NO: 30984 - protein, 9 aa, Homo Sapiens
TYLSHQEKL

SEQ ID NO: 30985 - protein, 9 aa, Homo Sapiens
TYMPHVHIL

SEQ ID NO: 30986 - protein, 9 aa, Homo Sapiens
TYNMVLNLL

SEQ ID NO: 30987 - protein, 9 aa, Homo Sapiens
TYNQKHSLF

SEQ ID NO: 30988 - protein, 9 aa, Homo Sapiens
TYNYPVHYF

SEQ ID NO: 30989 - protein, 9 aa, Homo Sapiens
TYPDVNNSI

SEQ ID NO: 30990 - protein, 9 aa, Homo Sapiens
TYPENWRAF

SEQ ID NO: 30991 - protein, 9 aa, Homo Sapiens
TYPNYLPLY

SEQ ID NO: 30992 - protein, 9 aa, Homo Sapiens
TYQDIFRDF

SEQ ID NO: 30993 - protein, 9 aa, Homo Sapiens
TYQDIQNTI

SEQ ID NO: 30994 - protein, 9 aa, Homo Sapiens
TYQEVAQKF

SEQ ID NO: 30995 - protein, 9 aa, Homo Sapiens
TYQRWQFTL

SEQ ID NO: 30996 - protein, 9 aa, Homo Sapiens
TYQVLAVTF

SEQ ID NO: 30997 - protein, 9 aa, Homo Sapiens
TYRNVMEQF

SEQ ID NO: 30998 - protein, 9 aa, Homo Sapiens
TYSKKHFRI

SEQ ID NO: 30999 - protein, 9 aa, Homo Sapiens
TYSNFHPLL

SEQ ID NO: 31000 - protein, 9 aa, Homo Sapiens
TYSYSFFHF

SEQ ID NO: 31001 - protein, 9 aa, Homo Sapiens
TYTDRVFFL

SEQ ID NO: 31002 - protein, 9 aa, Homo Sapiens
TYTEFVPQI

SEQ ID NO: 31003 - protein, 9 aa, Homo Sapiens
TYTSYLDKF

SEQ ID NO: 31004 - protein, 9 aa, Homo Sapiens
TYTYEKLLW

SEQ ID NO: 31005 - protein, 9 aa, Homo Sapiens
TYVHSSATI

SEQ ID NO: 31006 - protein, 9 aa, Homo Sapiens
TYVPCLKTL

SEQ ID NO: 31007 - protein, 9 aa, Homo Sapiens
TYVPWPLML

SEQ ID NO: 31008 - protein, 9 aa, Homo Sapiens
TYVRWYTQL

SEQ ID NO: 31009 - protein, 9 aa, Homo Sapiens
TYVSFPLEL

SEQ ID NO: 31010 - protein, 9 aa, Homo Sapiens
TYVSGTLRF

SEQ ID NO: 31011 - protein, 9 aa, Homo Sapiens
TYVTILPEL

SEQ ID NO: 31012 - protein, 9 aa, Homo Sapiens
TYVYFTNEL

SEQ ID NO: 31013 - protein, 9 aa, Homo Sapiens
VANAIIHLF

SEQ ID NO: 31014 - protein, 9 aa, Homo Sapiens
VAPPVSGDL

SEQ ID NO: 31015 - protein, 9 aa, Homo Sapiens
VFADVETHF

SEQ ID NO: 31016 - protein, 9 aa, Homo Sapiens
VFGYHGYTF

SEQ ID NO: 31017 - protein, 9 aa, Homo Sapiens
VFIDGPLAL

SEQ ID NO: 31018 - protein, 9 aa, Homo Sapiens
VFIDHPVHL

SEQ ID NO: 31019 - protein, 9 aa, Homo Sapiens
VFIDKQTNL

SEQ ID NO: 31020 - protein, 9 aa, Homo Sapiens
VFIGNLNTL

SEQ ID NO: 31021 - protein, 9 aa, Homo Sapiens
VFIGTGHLL

SEQ ID NO: 31022 - protein, 9 aa, Homo Sapiens
VFIKYLPEW

SEQ ID NO: 31023 - protein, 9 aa, Homo Sapiens
VFKEKHHSW

SEQ ID NO: 31024 - protein, 9 aa, Homo Sapiens
VFKGAPHEI

SEQ ID NO: 31025 - protein, 9 aa, Homo Sapiens
VFKPIVEKF

SEQ ID NO: 31026 - protein, 9 aa, Homo Sapiens
VFLGQAFTI

SEQ ID NO: 31027 - protein, 9 aa, Homo Sapiens
VFLPGFYHL

SEQ ID NO: 31028 - protein, 9 aa, Homo Sapiens
VFLPIHITY

SEQ ID NO: 31029 - protein, 9 aa, Homo Sapiens
VFLRAINKF

SEQ ID NO: 31030 - protein, 9 aa, Homo Sapiens
VFLTTRQTL

SEQ ID NO: 31031 - protein, 9 aa, Homo Sapiens
VFNDVRLLL

SEQ ID NO: 31032 - protein, 9 aa, Homo Sapiens
VFNGCPLRI

SEQ ID NO: 31033 - protein, 9 aa, Homo Sapiens
VFPDDMPTL

SEQ ID NO: 31034 - protein, 9 aa, Homo Sapiens
VFPDFYLHL

SEQ ID NO: 31035 - protein, 9 aa, Homo Sapiens
VFPDKGYSF

SEQ ID NO: 31036 - protein, 9 aa, Homo Sapiens
VFPEKGYSF

SEQ ID NO: 31037 - protein, 9 aa, Homo Sapiens
VFSTVVIHF

SEQ ID NO: 31038 - protein, 9 aa, Homo Sapiens
VFTAETHNF

SEQ ID NO: 31039 - protein, 9 aa, Homo Sapiens
VFTEVANLF

SEQ ID NO: 31040 - protein, 9 aa, Homo Sapiens
VFTGVVTKL

SEQ ID NO: 31041 - protein, 9 aa, Homo Sapiens
VFTLKPLEF

SEQ ID NO: 31042 - protein, 9 aa, Homo Sapiens
VFTPVTTEI

SEQ ID NO: 31043 - protein, 9 aa, Homo Sapiens
VFTRSELKF

SEQ ID NO: 31044 - protein, 9 aa, Homo Sapiens
VFTSVRQKI

SEQ ID NO: 31045 - protein, 9 aa, Homo Sapiens
VFTYVGALF

SEQ ID NO: 31046 - protein, 9 aa, Homo Sapiens
VFVDRAACF

SEQ ID NO: 31047 - protein, 9 aa, Homo Sapiens
VFVDSVPEF

SEQ ID NO: 31048 - protein, 9 aa, Homo Sapiens
VFVKPLVLF

SEQ ID NO: 31049 - protein, 9 aa, Homo Sapiens
VFVNIQYTL

SEQ ID NO: 31050 - protein, 9 aa, Homo Sapiens
VFYELAHQL

SEQ ID NO: 31051 - protein, 9 aa, Homo Sapiens
VFYPYPQYF

SEQ ID NO: 31052 - protein, 9 aa, Homo Sapiens
VGLGLHPLF

SEQ ID NO: 31053 - protein, 9 aa, Homo Sapiens
VHIDLPLFF

SEQ ID NO: 31054 - protein, 9 aa, Homo Sapiens
VHIPEVYLI

SEQ ID NO: 31055 - protein, 9 aa, Homo Sapiens
VHVGHVVRF

SEQ ID NO: 31056 - protein, 9 aa, Homo Sapiens
VICGVKAEF

SEQ ID NO: 31057 - protein, 9 aa, Homo Sapiens
VIIEKTYSL

SEQ ID NO: 31058 - protein, 9 aa, Homo Sapiens
VITPVLLHF

SEQ ID NO: 31059 - protein, 9 aa, Homo Sapiens
VLHQIFSKF

SEQ ID NO: 31060 - protein, 9 aa, Homo Sapiens
VLIGRKELF

SEQ ID NO: 31061 - protein, 9 aa, Homo Sapiens
VLIPKLPQL

SEQ ID NO: 31062 - protein, 9 aa, Homo Sapiens
VLKSVVAKF

SEQ ID NO: 31063 - protein, 9 aa, Homo Sapiens
VLLPKLPQF

SEQ ID NO: 31064 - protein, 9 aa, Homo Sapiens
VLNNVAHTF

SEQ ID NO: 31065 - protein, 9 aa, Homo Sapiens
VLPESLPVL

SEQ ID NO: 31066 - protein, 9 aa, Homo Sapiens
VLPGHFNTF

SEQ ID NO: 31067 - protein, 9 aa, Homo Sapiens
VLPHFNVLF

SEQ ID NO: 31068 - protein, 9 aa, Homo Sapiens
VLPHLLLCF

SEQ ID NO: 31069 - protein, 9 aa, Homo Sapiens
VLPKCKHEF

SEQ ID NO: 31070 - protein, 9 aa, Homo Sapiens
VLPKLYVKL

SEQ ID NO: 31071 - protein, 9 aa, Homo Sapiens
VLPKQGPLF

SEQ ID NO: 31072 - protein, 9 aa, Homo Sapiens
VLPNIHPEL

SEQ ID NO: 31073 - protein, 9 aa, Homo Sapiens
VLPSAQPVL

SEQ ID NO: 31074 - protein, 9 aa, Homo Sapiens
VLPSVLNKF

SEQ ID NO: 31075 - protein, 9 aa, Homo Sapiens
VLPTEQFHL

SEQ ID NO: 31076 - protein, 9 aa, Homo Sapiens
VMAPRTLVL

SEQ ID NO: 31077 - protein, 9 aa, Homo Sapiens
VMKNQVARF

SEQ ID NO: 31078 - protein, 9 aa, Homo Sapiens
VMKSLTQTF

SEQ ID NO: 31079 - protein, 9 aa, Homo Sapiens
VMTDVHRRF

SEQ ID NO: 31080 - protein, 9 aa, Homo Sapiens
VMYGKVYRI

SEQ ID NO: 31081 - protein, 9 aa, Homo Sapiens
VQAGVTYLF

SEQ ID NO: 31082 - protein, 9 aa, Homo Sapiens
VQPRNWLLF

SEQ ID NO: 31083 - protein, 9 aa, Homo Sapiens
VQPSKYHFL

SEQ ID NO: 31084 - protein, 9 aa, Homo Sapiens
VSEPRYFQL

SEQ ID NO: 31085 - protein, 9 aa, Homo Sapiens
VTYVPVTTF

SEQ ID NO: 31086 - protein, 9 aa, Homo Sapiens
VVYPWTQRF

SEQ ID NO: 31087 - protein, 9 aa, Homo Sapiens
VWIDVGSRF

SEQ ID NO: 31088 - protein, 9 aa, Homo Sapiens
VWIINIGHF

SEQ ID NO: 31089 - protein, 9 aa, Homo Sapiens
VWIYDPVHF

SEQ ID NO: 31090 - protein, 9 aa, Homo Sapiens
VWVINIGHF

SEQ ID NO: 31091 - protein, 9 aa, Homo Sapiens
VYADQPHIF

SEQ ID NO: 31092 - protein, 9 aa, Homo Sapiens
VYAILTHGI

SEQ ID NO: 31093 - protein, 9 aa, Homo Sapiens
VYANGIRNI

SEQ ID NO: 31094 - protein, 9 aa, Homo Sapiens
VYAPFIEKL

SEQ ID NO: 31095 - protein, 9 aa, Homo Sapiens
VYAPPVGGF

SEQ ID NO: 31096 - protein, 9 aa, Homo Sapiens
VYAQVARLF

SEQ ID NO: 31097 - protein, 9 aa, Homo Sapiens
VYCARFVEL

SEQ ID NO: 31098 - protein, 9 aa, Homo Sapiens
VYDSVAFPE

SEQ ID NO: 31099 - protein, 9 aa, Homo Sapiens
VYEAMVPLF

SEQ ID NO: 31100 - protein, 9 aa, Homo Sapiens
VYEDLRYKL

SEQ ID NO: 31101 - protein, 9 aa, Homo Sapiens
VYEDQVGKF

SEQ ID NO: 31102 - protein, 9 aa, Homo Sapiens
VYEEILHQI

SEQ ID NO: 31103 - protein, 9 aa, Homo Sapiens
VYENVSHFL

SEQ ID NO: 31104 - protein, 9 aa, Homo Sapiens
VYEPVSYHV

SEQ ID NO: 31105 - protein, 9 aa, Homo Sapiens
VYERELQTF

SEQ ID NO: 31106 - protein, 9 aa, Homo Sapiens
VYEYVVERF

SEQ ID NO: 31107 - protein, 9 aa, Homo Sapiens
VYFGDPVSL

SEQ ID NO: 31108 - protein, 9 aa, Homo Sapiens
VYFGHWVVM

SEQ ID NO: 31109 - protein, 9 aa, Homo Sapiens
VYGFQWRHF

SEQ ID NO: 31110 - protein, 9 aa, Homo Sapiens
VYGPLPQSF

SEQ ID NO: 31111 - protein, 9 aa, Homo Sapiens
VYGSFASKL

SEQ ID NO: 31112 - protein, 9 aa, Homo Sapiens
VYHKPPNAF

SEQ ID NO: 31113 - protein, 9 aa, Homo Sapiens
VYHKPPSAF

SEQ ID NO: 31114 - protein, 9 aa, Homo Sapiens
VYHNLKNVI

SEQ ID NO: 31115 - protein, 9 aa, Homo Sapiens
VYHSDIPKW

SEQ ID NO: 31116 - protein, 9 aa, Homo Sapiens
VYIAPLKAL

SEQ ID NO: 31117 - protein, 9 aa, Homo Sapiens
VYIDKVRSL

SEQ ID NO: 31118 - protein, 9 aa, Homo Sapiens
VYIDQTMVL

SEQ ID NO: 31119 - protein, 9 aa, Homo Sapiens
VYIDRVRSL

SEQ ID NO: 31120 - protein, 9 aa, Homo Sapiens
VYIEHRLMM

SEQ ID NO: 31121 - protein, 9 aa, Homo Sapiens
VYIHHFDRI

SEQ ID NO: 31122 - protein, 9 aa, Homo Sapiens
VYIKHPVSL

SEQ ID NO: 31123 - protein, 9 aa, Homo Sapiens
VYINEVRVI

SEQ ID NO: 31124 - protein, 9 aa, Homo Sapiens
VYINTAQEF

SEQ ID NO: 31125 - protein, 9 aa, Homo Sapiens
VYIPAHGRL

SEQ ID NO: 31126 - protein, 9 aa, Homo Sapiens
VYIPCIYVL

SEQ ID NO: 31127 - protein, 9 aa, Homo Sapiens
VYIPNKVLI

SEQ ID NO: 31128 - protein, 9 aa, Homo Sapiens
VYISEHEHF

SEQ ID NO: 31129 - protein, 9 aa, Homo Sapiens
VYISNGQVL

SEQ ID NO: 31130 - protein, 9 aa, Homo Sapiens
VYITDKTVL

SEQ ID NO: 31131 - protein, 9 aa, Homo Sapiens
VYITRAQLM

SEQ ID NO: 31132 - protein, 9 aa, Homo Sapiens
VYIVPVIVL

SEQ ID NO: 31133 - protein, 9 aa, Homo Sapiens
VYKDLLVLF

SEQ ID NO: 31134 - protein, 9 aa, Homo Sapiens
VYKDLVLLL

SEQ ID NO: 31135 - protein, 9 aa, Homo Sapiens
VYKDSIYYI

SEQ ID NO: 31136 - protein, 9 aa, Homo Sapiens
VYKKSIFVF

SEQ ID NO: 31137 - protein, 9 aa, Homo Sapiens
VYKKYPNVF

SEQ ID NO: 31138 - protein, 9 aa, Homo Sapiens
VYLDEPIKI

SEQ ID NO: 31139 - protein, 9 aa, Homo Sapiens
VYLDGIVRI

SEQ ID NO: 31140 - protein, 9 aa, Homo Sapiens
VYLDKFIRL

SEQ ID NO: 31141 - protein, 9 aa, Homo Sapiens
VYLEKFMTF

SEQ ID NO: 31142 - protein, 9 aa, Homo Sapiens
VYLHDFQRF

SEQ ID NO: 31143 - protein, 9 aa, Homo Sapiens
VYLHYLPSY

SEQ ID NO: 31144 - protein, 9 aa, Homo Sapiens
VYLIEHPSL

SEQ ID NO: 31145 - protein, 9 aa, Homo Sapiens
VYLKTALGL

SEQ ID NO: 31146 - protein, 9 aa, Homo Sapiens
VYLPLTSHI

SEQ ID NO: 31147 - protein, 9 aa, Homo Sapiens
VYLPMSYCY

SEQ ID NO: 31148 - protein, 9 aa, Homo Sapiens
VYLPRVLDI

SEQ ID NO: 31149 - protein, 9 aa, Homo Sapiens
VYLPTHTSL

SEQ ID NO: 31150 - protein, 9 aa, Homo Sapiens
VYLSNVVLF

SEQ ID NO: 31151 - protein, 9 aa, Homo Sapiens
VYMDWYEKF

SEQ ID NO: 31152 - protein, 9 aa, Homo Sapiens
VYMELSQKL

SEQ ID NO: 31153 - protein, 9 aa, Homo Sapiens
VYMNRVKEI

SEQ ID NO: 31154 - protein, 9 aa, Homo Sapiens
VYNHRFHKI

SEQ ID NO: 31155 - protein, 9 aa, Homo Sapiens
VYNKVHITL

SEQ ID NO: 31156 - protein, 9 aa, Homo Sapiens
VYNPHSDTW

SEQ ID NO: 31157 - protein, 9 aa, Homo Sapiens
VYNPVRAEW

SEQ ID NO: 31158 - protein, 9 aa, Homo Sapiens
VYNYAEQTL

SEQ ID NO: 31159 - protein, 9 aa, Homo Sapiens
VYPADVVLF

SEQ ID NO: 31160 - protein, 9 aa, Homo Sapiens
VYPDGIRHI

SEQ ID NO: 31161 - protein, 9 aa, Homo Sapiens
VYPEESLVI

SEQ ID NO: 31162 - protein, 9 aa, Homo Sapiens
VYPERTPLL

SEQ ID NO: 31163 - protein, 9 aa, Homo Sapiens
VYPGIAVFF

SEQ ID NO: 31164 - protein, 9 aa, Homo Sapiens
VYPGYYLTF

SEQ ID NO: 31165 - protein, 9 aa, Homo Sapiens
VYPLMKEYF

SEQ ID NO: 31166 - protein, 9 aa, Homo Sapiens
VYPNWAIGL

SEQ ID NO: 31167 - protein, 9 aa, Homo Sapiens
VYPPHSHSI

SEQ ID NO: 31168 - protein, 9 aa, Homo Sapiens
VYPPIRHHL

SEQ ID NO: 31169 - protein, 9 aa, Homo Sapiens
VYPPPHQVF

SEQ ID NO: 31170 - protein, 9 aa, Homo Sapiens
VYPSSLSKI

SEQ ID NO: 31171 - protein, 9 aa, Homo Sapiens
VYQEIWIGM

SEQ ID NO: 31172 - protein, 9 aa, Homo Sapiens
VYQHLFTRI

SEQ ID NO: 31173 - protein, 9 aa, Homo Sapiens
VYQLRFQFL

SEQ ID NO: 31174 - protein, 9 aa, Homo Sapiens
VYQSKPATL

SEQ ID NO: 31175 - protein, 9 aa, Homo Sapiens
VYQYMHETI

SEQ ID NO: 31176 - protein, 9 aa, Homo Sapiens
VYSEVHFTL

SEQ ID NO: 31177 - protein, 9 aa, Homo Sapiens
VYSFVTPTF

SEQ ID NO: 31178 - protein, 9 aa, Homo Sapiens
VYSGGVYLF

SEQ ID NO: 31179 - protein, 9 aa, Homo Sapiens
VYSIVPQSW

SEQ ID NO: 31180 - protein, 9 aa, Homo Sapiens
VYSPHVLNL

SEQ ID NO: 31181 - protein, 9 aa, Homo Sapiens
VYSPIRSGL

SEQ ID NO: 31182 - protein, 9 aa, Homo Sapiens
VYSPKSPSL

SEQ ID NO: 31183 - protein, 9 aa, Homo Sapiens
VYSQFITQL

SEQ ID NO: 31184 - protein, 9 aa, Homo Sapiens
VYSTPTPFF

SEQ ID NO: 31185 - protein, 9 aa, Homo Sapiens
VYTATITEI

SEQ ID NO: 31186 - protein, 9 aa, Homo Sapiens
VYTDFAFRI

SEQ ID NO: 31187 - protein, 9 aa, Homo Sapiens
VYTHEVVTL

SEQ ID NO: 31188 - protein, 9 aa, Homo Sapiens
VYTKANPTF

SEQ ID NO: 31189 - protein, 9 aa, Homo Sapiens
VYTKVKCKI

SEQ ID NO: 31190 - protein, 9 aa, Homo Sapiens
VYTSVVEEL

SEQ ID NO: 31191 - protein, 9 aa, Homo Sapiens
VYTTNIQEL

SEQ ID NO: 31192 - protein, 9 aa, Homo Sapiens
VYTTTVHWL

SEQ ID NO: 31193 - protein, 9 aa, Homo Sapiens
VYTVVDEMF

SEQ ID NO: 31194 - protein, 9 aa, Homo Sapiens
VYTWVKQCW

SEQ ID NO: 31195 - protein, 9 aa, Homo Sapiens
VYTYIQSRF

SEQ ID NO: 31196 - protein, 9 aa, Homo Sapiens
VYVAAVREF

SEQ ID NO: 31197 - protein, 9 aa, Homo Sapiens
VYVAIQAVL

SEQ ID NO: 31198 - protein, 9 aa, Homo Sapiens
VYVATRPTI

SEQ ID NO: 31199 - protein, 9 aa, Homo Sapiens
VYVDAVGQF

SEQ ID NO: 31200 - protein, 9 aa, Homo Sapiens
VYVDDIYVI

SEQ ID NO: 31201 - protein, 9 aa, Homo Sapiens
VYVERAEVL

SEQ ID NO: 31202 - protein, 9 aa, Homo Sapiens
VYVERILLL

SEQ ID NO: 31203 - protein, 9 aa, Homo Sapiens
VYVGICRQL

SEQ ID NO: 31204 - protein, 9 aa, Homo Sapiens
VYVKDLSSF

SEQ ID NO: 31205 - protein, 9 aa, Homo Sapiens
VYVKHNISF

SEQ ID NO: 31206 - protein, 9 aa, Homo Sapiens
VYVKHSISF

SEQ ID NO: 31207 - protein, 9 aa, Homo Sapiens
VYVLTVTEI

SEQ ID NO: 31208 - protein, 9 aa, Homo Sapiens
VYVPHIHVW

SEQ ID NO: 31209 - protein, 9 aa, Homo Sapiens
VYVPLKELL

SEQ ID NO: 31210 - protein, 9 aa, Homo Sapiens
VYVQHPITF

SEQ ID NO: 31211 - protein, 9 aa, Homo Sapiens
VYVQNVVKL

SEQ ID NO: 31212 - protein, 9 aa, Homo Sapiens
VYVQPIVSL

SEQ ID NO: 31213 - protein, 9 aa, Homo Sapiens
VYVQPPLEL

SEQ ID NO: 31214 - protein, 9 aa, Homo Sapiens
VYVSDIQEL

SEQ ID NO: 31215 - protein, 9 aa, Homo Sapiens
VYVVGTAHF

SEQ ID NO: 31216 - protein, 9 aa, Homo Sapiens
VYWKIYNSI

SEQ ID NO: 31217 - protein, 9 aa, Homo Sapiens
VYYPELFVW

SEQ ID NO: 31218 - protein, 9 aa, Homo Sapiens
VYYPVRHHL

SEQ ID NO: 31219 - protein, 9 aa, Homo Sapiens
WVQKTIAEN

SEQ ID NO: 31220 - protein, 9 aa, Homo Sapiens
YFIADLPHL

SEQ ID NO: 31221 - protein, 9 aa, Homo Sapiens
YFISHVLAF

SEQ ID NO: 31222 - protein, 9 aa, Homo Sapiens
YFKDTHPKF

SEQ ID NO: 31223 - protein, 9 aa, Homo Sapiens
YFKRYQVKF

SEQ ID NO: 31224 - protein, 9 aa, Homo Sapiens
YFLDKIDVI

SEQ ID NO: 31225 - protein, 9 aa, Homo Sapiens
YFLKGVLVF

SEQ ID NO: 31226 - protein, 9 aa, Homo Sapiens
YFLPDHPEL

SEQ ID NO: 31227 - protein, 9 aa, Homo Sapiens
YFLTTRQTL

SEQ ID NO: 31228 - protein, 9 aa, Homo Sapiens
YFYHGVHKI

SEQ ID NO: 31229 - protein, 9 aa, Homo Sapiens
YGLEKFWAF

SEQ ID NO: 31230 - protein, 9 aa, Homo Sapiens
YQTPRLWLF

SEQ ID NO: 31231 - protein, 9 aa, Homo Sapiens
YVIQKFFEF

SEQ ID NO: 31232 - protein, 9 aa, Homo Sapiens
YWMHVQNTF

SEQ ID NO: 31233 - protein, 9 aa, Homo Sapiens
YYAEVETRI

SEQ ID NO: 31234 - protein, 9 aa, Homo Sapiens
YYAGEFHKM

SEQ ID NO: 31235 - protein, 9 aa, Homo Sapiens
YYCHPPTSW

SEQ ID NO: 31236 - protein, 9 aa, Homo Sapiens
YYDKHFTEF

SEQ ID NO: 31237 - protein, 9 aa, Homo Sapiens
YYEDNKQFF

SEQ ID NO: 31238 - protein, 9 aa, Homo Sapiens
YYEEQHPEL

SEQ ID NO: 31239 - protein, 9 aa, Homo Sapiens
YYEKQFPEI

SEQ ID NO: 31240 - protein, 9 aa, Homo Sapiens
YYFDSYAHF

SEQ ID NO: 31241 - protein, 9 aa, Homo Sapiens
YYFPVKNVI

SEQ ID NO: 31242 - protein, 9 aa, Homo Sapiens
YYGDVIWVI

SEQ ID NO: 31243 - protein, 9 aa, Homo Sapiens
YYGNISHFV

SEQ ID NO: 31244 - protein, 9 aa, Homo Sapiens
YYGQGFPSF

SEQ ID NO: 31245 - protein, 9 aa, Homo Sapiens
YYHARVYEF

SEQ ID NO: 31246 - protein, 9 aa, Homo Sapiens
YYHKVVIRL

SEQ ID NO: 31247 - protein, 9 aa, Homo Sapiens
YYIDCIRQV

SEQ ID NO: 31248 - protein, 9 aa, Homo Sapiens
YYIDKLEYL

SEQ ID NO: 31249 - protein, 9 aa, Homo Sapiens
YYIEGINQL

SEQ ID NO: 31250 - protein, 9 aa, Homo Sapiens
YYIFIPSKF

SEQ ID NO: 31251 - protein, 9 aa, Homo Sapiens
YYIRFFITY

SEQ ID NO: 31252 - protein, 9 aa, Homo Sapiens
YYISPRITF

SEQ ID NO: 31253 - protein, 9 aa, Homo Sapiens
YYITTRAQF

SEQ ID NO: 31254 - protein, 9 aa, Homo Sapiens
YYITTRVQF

SEQ ID NO: 31255 - protein, 9 aa, Homo Sapiens
YYLAEKHLF

SEQ ID NO: 31256 - protein, 9 aa, Homo Sapiens
YYLNDLDRI

SEQ ID NO: 31257 - protein, 9 aa, Homo Sapiens
YYLNDLERI

SEQ ID NO: 31258 - protein, 9 aa, Homo Sapiens
YYLNEIQSF

SEQ ID NO: 31259 - protein, 9 aa, Homo Sapiens
YYLSDSPLL

SEQ ID NO: 31260 - protein, 9 aa, Homo Sapiens
YYLSKIEEL

SEQ ID NO: 31261 - protein, 9 aa, Homo Sapiens
YYLTHGLYL

SEQ ID NO: 31262 - protein, 9 aa, Homo Sapiens
YYPEYKLLF

SEQ ID NO: 31263 - protein, 9 aa, Homo Sapiens
YYQDTPKQI

SEQ ID NO: 31264 - protein, 9 aa, Homo Sapiens
YYQGGKFQF

SEQ ID NO: 31265 - protein, 9 aa, Homo Sapiens
YYQHIVTTL

SEQ ID NO: 31266 - protein, 9 aa, Homo Sapiens
YYQNYFEKL

SEQ ID NO: 31267 - protein, 9 aa, Homo Sapiens
YYRPRFFLL

SEQ ID NO: 31268 - protein, 9 aa, Homo Sapiens
YYSAVDPTK

SEQ ID NO: 31269 - protein, 9 aa, Homo Sapiens
YYSAVTPHL

SEQ ID NO: 31270 - protein, 9 aa, Homo Sapiens
YYSPHGHIL

SEQ ID NO: 31271 - protein, 9 aa, Homo Sapiens
YYTDIMHTL

SEQ ID NO: 31272 - protein, 9 aa, Homo Sapiens
YYTPITPHL

SEQ ID NO: 31273 - protein, 9 aa, Homo Sapiens
YYTSVTPVL

SEQ ID NO: 31274 - protein, 9 aa, Homo Sapiens
YYTTPIYRF

SEQ ID NO: 31275 - protein, 9 aa, Homo Sapiens
YYVRAVLHL

SEQ ID NO: 31276 - protein, 9 aa, Homo Sapiens
YYVRILSTI

SEQ ID NO: 31277 - protein, 9 aa, Homo Sapiens
YYVWLQHTL

SEQ ID NO: 31278 - protein, 9 aa, Homo Sapiens
YYYVGFAYL

SEQ ID NO: 31279 - protein, 10 aa, Homo Sapiens
AFFEGPPFKF

SEQ ID NO: 31280 - protein, 10 aa, Homo Sapiens
AFFGDVVLRF

SEQ ID NO: 31281 - protein, 10 aa, Homo Sapiens
AFFRMKELFF

SEQ ID NO: 31282 - protein, 10 aa, Homo Sapiens
AFIPVLPFIL

SEQ ID NO: 31283 - protein, 10 aa, Homo Sapiens
AFIRVVGSEF

SEQ ID NO: 31284 - protein, 10 aa, Homo Sapiens
AFLDSQTATF

SEQ ID NO: 31285 - protein, 10 aa, Homo Sapiens
AFLTFPGLRL

SEQ ID NO: 31286 - protein, 10 aa, Homo Sapiens
AFNNLENLVF

SEQ ID NO: 31287 - protein, 10 aa, Homo Sapiens
AFVPVIKLCF

SEQ ID NO: 31288 - protein, 10 aa, Homo Sapiens
AICRPLPVTF

SEQ ID NO: 31289 - protein, 10 aa, Homo Sapiens
AIIRGGLTRF

SEQ ID NO: 31290 - protein, 10 aa, Homo Sapiens
ALLAYTLGVK

SEQ ID NO: 31291 - protein, 10 aa, Homo Sapiens
AWAPKPYHKF

SEQ ID NO: 31292 - protein, 10 aa, Homo Sapiens
AWARPLSVSF

SEQ ID NO: 31293 - protein, 10 aa, Homo Sapiens
AYFKRYQVKF

SEQ ID NO: 31294 - protein, 10 aa, Homo Sapiens
AYIAVGSISF

SEQ ID NO: 31295 - protein, 10 aa, Homo Sapiens
AYIQGLKEKF

SEQ ID NO: 31296 - protein, 10 aa, Homo Sapiens
AYLDKKHTIF

SEQ ID NO: 31297 - protein, 10 aa, Homo Sapiens
AYLESFYKFC

SEQ ID NO: 31298 - protein, 10 aa, Homo Sapiens
AYLKLRNWQW

SEQ ID NO: 31299 - protein, 10 aa, Homo Sapiens
AYLPEWKENI

SEQ ID NO: 31300 - protein, 10 aa, Homo Sapiens
AYLPKNTHPF

SEQ ID NO: 31301 - protein, 10 aa, Homo Sapiens
AYLPPLQQVF

SEQ ID NO: 31302 - protein, 10 aa, Homo Sapiens
AYLVHLIQRF

SEQ ID NO: 31303 - protein, 10 aa, Homo Sapiens
AYNDNWFITF

SEQ ID NO: 31304 - protein, 10 aa, Homo Sapiens
AYPPAPFMHI

SEQ ID NO: 31305 - protein, 10 aa, Homo Sapiens
AYSAAKSWVF

SEQ ID NO: 31306 - protein, 10 aa, Homo Sapiens
CFIPGEGHTL

SEQ ID NO: 31307 - protein, 10 aa, Homo Sapiens
CFLTSQNHGF

SEQ ID NO: 31308 - protein, 10 aa, Homo Sapiens
CWLRGVTATF

SEQ ID NO: 31309 - protein, 10 aa, Homo Sapiens
CYKLPDNVTF

SEQ ID NO: 31310 - protein, 10 aa, Homo Sapiens
CYQTLTGIKF

SEQ ID NO: 31311 - protein, 10 aa, Homo Sapiens
DFLNVKNVYF

SEQ ID NO: 31312 - protein, 10 aa, Homo Sapiens
DYIAVNPHLF

SEQ ID NO: 31313 - protein, 10 aa, Homo Sapiens
DYLNEWGNRF

SEQ ID NO: 31314 - protein, 10 aa, Homo Sapiens
DYYPEYKLLF

SEQ ID NO: 31315 - protein, 10 aa, Homo Sapiens
EFLKYFGTFF

SEQ ID NO: 31316 - protein, 10 aa, Homo Sapiens
EFLTDMKQVF

SEQ ID NO: 31317 - protein, 10 aa, Homo Sapiens
EWPKHWPTFI

SEQ ID NO: 31318 - protein, 10 aa, Homo Sapiens
EYIAAFLSHF

SEQ ID NO: 31319 - protein, 10 aa, Homo Sapiens
EYIPDLYNHF

SEQ ID NO: 31320 - protein, 10 aa, Homo Sapiens
EYLFNFDNTF

SEQ ID NO: 31321 - protein, 10 aa, Homo Sapiens
EYLKNVLLQF

SEQ ID NO: 31322 - protein, 10 aa, Homo Sapiens
EYLTAEILEL

SEQ ID NO: 31323 - protein, 10 aa, Homo Sapiens
EYLYPDQTHF

SEQ ID NO: 31324 - protein, 10 aa, Homo Sapiens
EYPDRIMNTF

SEQ ID NO: 31325 - protein, 10 aa, Homo Sapiens
EYSGCWAHGF

SEQ ID NO: 31326 - protein, 10 aa, Homo Sapiens
EYYDKAFDRI

SEQ ID NO: 31327 - protein, 10 aa, Homo Sapiens
EYYDKHFTEF

SEQ ID NO: 31328 - protein, 10 aa, Homo Sapiens
FFIDRDGFLF

SEQ ID NO: 31329 - protein, 10 aa, Homo Sapiens
FFLIGPPLLI

SEQ ID NO: 31330 - protein, 10 aa, Homo Sapiens
FYLAGKLHCF

SEQ ID NO: 31331 - protein, 10 aa, Homo Sapiens
FYLFPNRLEW

SEQ ID NO: 31332 - protein, 10 aa, Homo Sapiens
FYYDGKVMKL

SEQ ID NO: 31333 - protein, 10 aa, Homo Sapiens
GFIMPIEVHF

SEQ ID NO: 31334 - protein, 10 aa, Homo Sapiens
GFVRGICTRF

SEQ ID NO: 31335 - protein, 10 aa, Homo Sapiens
GLIIVGKDPF

SEQ ID NO: 31336 - protein, 10 aa, Homo Sapiens
GPPPHPGKPE

SEQ ID NO: 31337 - protein, 10 aa, Homo Sapiens
GPPPPPGKPQ

SEQ ID NO: 31338 - protein, 10 aa, Homo Sapiens
GPPPPQGKPQ

SEQ ID NO: 31339 - protein, 10 aa, Homo Sapiens
GPSIVHRKCF

SEQ ID NO: 31340 - protein, 10 aa, Homo Sapiens
GWLAEKLPTL

SEQ ID NO: 31341 - protein, 10 aa, Homo Sapiens
GYIDLELPCF

SEQ ID NO: 31342 - protein, 10 aa, Homo Sapiens
GYLRNLTWTL

SEQ ID NO: 31343 - protein, 10 aa, Homo Sapiens
GYTPYGWLQL

SEQ ID NO: 31344 - protein, 10 aa, Homo Sapiens
GYVHPVNLTW

SEQ ID NO: 31345 - protein, 10 aa, Homo Sapiens
GYVPTENLRF

SEQ ID NO: 31346 - protein, 10 aa, Homo Sapiens
GYYNGKWEFL

SEQ ID NO: 31347 - protein, 10 aa, Homo Sapiens
HFIVALKVLF

SEQ ID NO: 31348 - protein, 10 aa, Homo Sapiens
HFLGNFKTKF

SEQ ID NO: 31349 - protein, 10 aa, Homo Sapiens
HFPSPIRLEF

SEQ ID NO: 31350 - protein, 10 aa, Homo Sapiens
HYADVLGLLL

SEQ ID NO: 31351 - protein, 10 aa, Homo Sapiens
HYFDPQYFEF

SEQ ID NO: 31352 - protein, 10 aa, Homo Sapiens
HYIDAGYLGF

SEQ ID NO: 31353 - protein, 10 aa, Homo Sapiens
HYIYIENQFF

SEQ ID NO: 31354 - protein, 10 aa, Homo Sapiens
HYLDKTFYNL

SEQ ID NO: 31355 - protein, 10 aa, Homo Sapiens
HYLPSAILQL

SEQ ID NO: 31356 - protein, 10 aa, Homo Sapiens
HYMPPPYASL

SEQ ID NO: 31357 - protein, 10 aa, Homo Sapiens
HYNNVSCAVF

SEQ ID NO: 31358 - protein, 10 aa, Homo Sapiens
HYQDVSCLQF

SEQ ID NO: 31359 - protein, 10 aa, Homo Sapiens
HYVPATKVFL

SEQ ID NO: 31360 - protein, 10 aa, Homo Sapiens
HYVYSHFLQF

SEQ ID NO: 31361 - protein, 10 aa, Homo Sapiens
IFASIPGLEF

SEQ ID NO: 31362 - protein, 10 aa, Homo Sapiens
IFFGGLVFKF

SEQ ID NO: 31363 - protein, 10 aa, Homo Sapiens
IFIDPGYQTF

SEQ ID NO: 31364 - protein, 10 aa, Homo Sapiens
IFIDRDPTVF

SEQ ID NO: 31365 - protein, 10 aa, Homo Sapiens
IFIRFPKTLF

SEQ ID NO: 31366 - protein, 10 aa, Homo Sapiens
IFIRTPRTLF

SEQ ID NO: 31367 - protein, 10 aa, Homo Sapiens
IFLPILRTGF

SEQ ID NO: 31368 - protein, 10 aa, Homo Sapiens
IFLPPLQGDF

SEQ ID NO: 31369 - protein, 10 aa, Homo Sapiens
IFLPQVLDVF

SEQ ID NO: 31370 - protein, 10 aa, Homo Sapiens
IFPKPPLYTF

SEQ ID NO: 31371 - protein, 10 aa, Homo Sapiens
IFVFGFRTHF

SEQ ID NO: 31372 - protein, 10 aa, Homo Sapiens
IIFNSTNKLF

SEQ ID NO: 31373 - protein, 10 aa, Homo Sapiens
IKYPENFFLL

SEQ ID NO: 31374 - protein, 10 aa, Homo Sapiens
ILPQDVILKF

SEQ ID NO: 31375 - protein, 10 aa, Homo Sapiens
IVLVYITYHW

SEQ ID NO: 31376 - protein, 10 aa, Homo Sapiens
IWPGGVLPKF

SEQ ID NO: 31377 - protein, 10 aa, Homo Sapiens
IYADNQVMHF

SEQ ID NO: 31378 - protein, 10 aa, Homo Sapiens
IYCDAVPYLF

SEQ ID NO: 31379 - protein, 10 aa, Homo Sapiens
IYDSNTGKLI

SEQ ID NO: 31380 - protein, 10 aa, Homo Sapiens
IYFDGDFGHF

SEQ ID NO: 31381 - protein, 10 aa, Homo Sapiens
IYFDGDFGQI

SEQ ID NO: 31382 - protein, 10 aa, Homo Sapiens
IYFDQVLVNI

SEQ ID NO: 31383 - protein, 10 aa, Homo Sapiens
IYGESISSHF

SEQ ID NO: 31384 - protein, 10 aa, Homo Sapiens
IYGHWSIMKW

SEQ ID NO: 31385 - protein, 10 aa, Homo Sapiens
IYHHALHSRW

SEQ ID NO: 31386 - protein, 10 aa, Homo Sapiens
IYHKLKHFKF

SEQ ID NO: 31387 - protein, 10 aa, Homo Sapiens
IYHTGTFAQI

SEQ ID NO: 31388 - protein, 10 aa, Homo Sapiens
IYIDASCLTW

SEQ ID NO: 31389 - protein, 10 aa, Homo Sapiens
IYIDRGVVFV

SEQ ID NO: 31390 - protein, 10 aa, Homo Sapiens
IYISKIVVEF

SEQ ID NO: 31391 - protein, 10 aa, Homo Sapiens
IYISTLKTEF

SEQ ID NO: 31392 - protein, 10 aa, Homo Sapiens
IYKPVTDFFL

SEQ ID NO: 31393 - protein, 10 aa, Homo Sapiens
IYLNNIIPRF

SEQ ID NO: 31394 - protein, 10 aa, Homo Sapiens
IYLQLDCARF

SEQ ID NO: 31395 - protein, 10 aa, Homo Sapiens
IYLTADNLVL

SEQ ID NO: 31396 - protein, 10 aa, Homo Sapiens
IYMVHIQVTL

SEQ ID NO: 31397 - protein, 10 aa, Homo Sapiens
IYNGKLFDLL

SEQ ID NO: 31398 - protein, 10 aa, Homo Sapiens
IYPELQIERF

SEQ ID NO: 31399 - protein, 10 aa, Homo Sapiens
IYPSINPPTL

SEQ ID NO: 31400 - protein, 10 aa, Homo Sapiens
IYPSPTGVLI

SEQ ID NO: 31401 - protein, 10 aa, Homo Sapiens
IYPVDLGDKF

SEQ ID NO: 31402 - protein, 10 aa, Homo Sapiens
IYQDSFEQRF

SEQ ID NO: 31403 - protein, 10 aa, Homo Sapiens
IYSDDLGVTW

SEQ ID NO: 31404 - protein, 10 aa, Homo Sapiens
IYTDMGRFTI

SEQ ID NO: 31405 - protein, 10 aa, Homo Sapiens
IYVPELGMSF

SEQ ID NO: 31406 - protein, 10 aa, Homo Sapiens
IYVQALIFRL

SEQ ID NO: 31407 - protein, 10 aa, Homo Sapiens
IYYTGKYQSL

SEQ ID NO: 31408 - protein, 10 aa, Homo Sapiens
KFIDPIYQVW

SEQ ID NO: 31409 - protein, 10 aa, Homo Sapiens
KFIEGVVLQL

SEQ ID NO: 31410 - protein, 10 aa, Homo Sapiens
KFILALKVLF

SEQ ID NO: 31411 - protein, 10 aa, Homo Sapiens
KFINYVKNCF

SEQ ID NO: 31412 - protein, 10 aa, Homo Sapiens
KFISQALLTF

SEQ ID NO: 31413 - protein, 10 aa, Homo Sapiens
KFLDPITGTF

SEQ ID NO: 31414 - protein, 10 aa, Homo Sapiens
KFLEISRLHF

SEQ ID NO: 31415 - protein, 10 aa, Homo Sapiens
KFLETVELQI

SEQ ID NO: 31416 - protein, 10 aa, Homo Sapiens
KFLPPVLLKL

SEQ ID NO: 31417 - protein, 10 aa, Homo Sapiens
KFLSQLEITF

SEQ ID NO: 31418 - protein, 10 aa, Homo Sapiens
KFLTITPIVL

SEQ ID NO: 31419 - protein, 10 aa, Homo Sapiens
KFMGVQMETF

SEQ ID NO: 31420 - protein, 10 aa, Homo Sapiens
KFMPVEGMVF

SEQ ID NO: 31421 - protein, 10 aa, Homo Sapiens
KFMTHVASQF

SEQ ID NO: 31422 - protein, 10 aa, Homo Sapiens
KLPNFGFVVF

SEQ ID NO: 31423 - protein, 10 aa, Homo Sapiens
KMPKFSMPGF

SEQ ID NO: 31424 - protein, 10 aa, Homo Sapiens
KMPKMKMPKF

SEQ ID NO: 31425 - protein, 10 aa, Homo Sapiens
KMPKMKMPTF

SEQ ID NO: 31426 - protein, 10 aa, Homo Sapiens
KMPKVKMPKF

SEQ ID NO: 31427 - protein, 10 aa, Homo Sapiens
KWIDIKQFVW

SEQ ID NO: 31428 - protein, 10 aa, Homo Sapiens
KWLEKNLPTL

SEQ ID NO: 31429 - protein, 10 aa, Homo Sapiens
KWLPLYGCYF

SEQ ID NO: 31430 - protein, 10 aa, Homo Sapiens
KWNPTAGVAF

SEQ ID NO: 31431 - protein, 10 aa, Homo Sapiens
KYADLSHNRL

SEQ ID NO: 31432 - protein, 10 aa, Homo Sapiens
KYETVIMPVF

SEQ ID NO: 31433 - protein, 10 aa, Homo Sapiens
KYFEVPSVLL

SEQ ID NO: 31434 - protein, 10 aa, Homo Sapiens
KYFSLIPTGF

SEQ ID NO: 31435 - protein, 10 aa, Homo Sapiens
KYFTQFCVKF

SEQ ID NO: 31436 - protein, 10 aa, Homo Sapiens
KYIDQGIAEL

SEQ ID NO: 31437 - protein, 10 aa, Homo Sapiens
KYIERIITRF

SEQ ID NO: 31438 - protein, 10 aa, Homo Sapiens
KYIESPVLFL

SEQ ID NO: 31439 - protein, 10 aa, Homo Sapiens
KYIETTPLTI

SEQ ID NO: 31440 - protein, 10 aa, Homo Sapiens
KYIFKERESF

SEQ ID NO: 31441 - protein, 10 aa, Homo Sapiens
KYIHKVHHEF

SEQ ID NO: 31442 - protein, 10 aa, Homo Sapiens
KYITDWQNVF

SEQ ID NO: 31443 - protein, 10 aa, Homo Sapiens
KYLAIAPPII

SEQ ID NO: 31444 - protein, 10 aa, Homo Sapiens
KYLDIHERMG

SEQ ID NO: 31445 - protein, 10 aa, Homo Sapiens
KYLDTGGDVF

SEQ ID NO: 31446 - protein, 10 aa, Homo Sapiens
KYLDVKFEYL

SEQ ID NO: 31447 - protein, 10 aa, Homo Sapiens
KYLEDFITNI

SEQ ID NO: 31448 - protein, 10 aa, Homo Sapiens
KYLEDMKTYF

SEQ ID NO: 31449 - protein, 10 aa, Homo Sapiens
KYLIKICQEF

SEQ ID NO: 31450 - protein, 10 aa, Homo Sapiens
KYLKPSGNMF

SEQ ID NO: 31451 - protein, 10 aa, Homo Sapiens
KYLKTGFLKW

SEQ ID NO: 31452 - protein, 10 aa, Homo Sapiens
KYLLKLKFNF

SEQ ID NO: 31453 - protein, 10 aa, Homo Sapiens
KYLNQTSRSF

SEQ ID NO: 31454 - protein, 10 aa, Homo Sapiens
KYLPEWTAWL

SEQ ID NO: 31455 - protein, 10 aa, Homo Sapiens
KYLPISHPRF

SEQ ID NO: 31456 - protein, 10 aa, Homo Sapiens
KYLSGIAHFL

SEQ ID NO: 31457 - protein, 10 aa, Homo Sapiens
KYLSVQGQLF

SEQ ID NO: 31458 - protein, 10 aa, Homo Sapiens
KYLTAEAFGF

SEQ ID NO: 31459 - protein, 10 aa, Homo Sapiens
KYLTEGLLQF

SEQ ID NO: 31460 - protein, 10 aa, Homo Sapiens
KYLTQVDILL

SEQ ID NO: 31461 - protein, 10 aa, Homo Sapiens
KYLVIGDLLF

SEQ ID NO: 31462 - protein, 10 aa, Homo Sapiens
KYMDVVKERI

SEQ ID NO: 31463 - protein, 10 aa, Homo Sapiens
KYMSTCRLIL

SEQ ID NO: 31464 - protein, 10 aa, Homo Sapiens
KYMTAVVKLF

SEQ ID NO: 31465 - protein, 10 aa, Homo Sapiens
KYMTPMQQKL

SEQ ID NO: 31466 - protein, 10 aa, Homo Sapiens
KYPHYFPLLK

SEQ ID NO: 31467 - protein, 10 aa, Homo Sapiens
KYPNRGFPKI

SEQ ID NO: 31468 - protein, 10 aa, Homo Sapiens
KYSPNCKLLI

SEQ ID NO: 31469 - protein, 10 aa, Homo Sapiens
KYTEITATYF

SEQ ID NO: 31470 - protein, 10 aa, Homo Sapiens
KYWPVIPLKF

SEQ ID NO: 31471 - protein, 10 aa, Homo Sapiens
KYYDDYRVQL

SEQ ID NO: 31472 - protein, 10 aa, Homo Sapiens
KYYEDNKQFF

SEQ ID NO: 31473 - protein, 10 aa, Homo Sapiens
LFIPSSKLLF

SEQ ID NO: 31474 - protein, 10 aa, Homo Sapiens
LFLKGIGLTL

SEQ ID NO: 31475 - protein, 10 aa, Homo Sapiens
LFLPPNRYIF

SEQ ID NO: 31476 - protein, 10 aa, Homo Sapiens
LFLPRTDYSF

SEQ ID NO: 31477 - protein, 10 aa, Homo Sapiens
LTAFLAEMLL

SEQ ID NO: 31478 - protein, 10 aa, Homo Sapiens
LVAASQAALG

SEQ ID NO: 31479 - protein, 10 aa, Homo Sapiens
LYADVGGKQF

SEQ ID NO: 31480 - protein, 10 aa, Homo Sapiens
LYESRQEVPK

SEQ ID NO: 31481 - protein, 10 aa, Homo Sapiens
LYETPTGWKF

SEQ ID NO: 31482 - protein, 10 aa, Homo Sapiens
LYIDRPLPYL

SEQ ID NO: 31483 - protein, 10 aa, Homo Sapiens
LYIPPTHTFL

SEQ ID NO: 31484 - protein, 10 aa, Homo Sapiens
LYIQRTKSMF

SEQ ID NO: 31485 - protein, 10 aa, Homo Sapiens
LYIYPQSLNF

SEQ ID NO: 31486 - protein, 10 aa, Homo Sapiens
LYKPPPQHMF

SEQ ID NO: 31487 - protein, 10 aa, Homo Sapiens
LYLDKATLIW

SEQ ID NO: 31488 - protein, 10 aa, Homo Sapiens
LYLEPQGTLF

SEQ ID NO: 31489 - protein, 10 aa, Homo Sapiens
LYLKVKGNVF

SEQ ID NO: 31490 - protein, 10 aa, Homo Sapiens
LYNPKITSEL

SEQ ID NO: 31491 - protein, 10 aa, Homo Sapiens
LYPDGVFYDL

SEQ ID NO: 31492 - protein, 10 aa, Homo Sapiens
LYQDQILEKF

SEQ ID NO: 31493 - protein, 10 aa, Homo Sapiens
LYQILQGIVF

SEQ ID NO: 31494 - protein, 10 aa, Homo Sapiens
LYRDVMQETF

SEQ ID NO: 31495 - protein, 10 aa, Homo Sapiens
LYVYPQRLNF

SEQ ID NO: 31496 - protein, 10 aa, Homo Sapiens
MWKEGNRIHF

SEQ ID NO: 31497 - protein, 10 aa, Homo Sapiens
MYIISGLTGF

SEQ ID NO: 31498 - protein, 10 aa, Homo Sapiens
MYINDKLPYF

SEQ ID NO: 31499 - protein, 10 aa, Homo Sapiens
MYIVGQYPRF

SEQ ID NO: 31500 - protein, 10 aa, Homo Sapiens
MYLPEAKESF

SEQ ID NO: 31501 - protein, 10 aa, Homo Sapiens
MYPLKPTWWF

SEQ ID NO: 31502 - protein, 10 aa, Homo Sapiens
NFIDIQFPKW

SEQ ID NO: 31503 - protein, 10 aa, Homo Sapiens
NFLHPINTIF

SEQ ID NO: 31504 - protein, 10 aa, Homo Sapiens
NFLPPIIARF

SEQ ID NO: 31505 - protein, 10 aa, Homo Sapiens
NFPKGMLLRF

SEQ ID NO: 31506 - protein, 10 aa, Homo Sapiens
NFVKKLVSTF

SEQ ID NO: 31507 - protein, 10 aa, Homo Sapiens
NWTTAAPLLL

SEQ ID NO: 31508 - protein, 10 aa, Homo Sapiens
NYIDIVKYVF

SEQ ID NO: 31509 - protein, 10 aa, Homo Sapiens
NYITPNPIFF

SEQ ID NO: 31510 - protein, 10 aa, Homo Sapiens
NYIVPDKQIF

SEQ ID NO: 31511 - protein, 10 aa, Homo Sapiens
NYKDLNGNVF

SEQ ID NO: 31512 - protein, 10 aa, Homo Sapiens
NYLIDFKHHF

SEQ ID NO: 31513 - protein, 10 aa, Homo Sapiens
NYMMDWKNQF

SEQ ID NO: 31514 - protein, 10 aa, Homo Sapiens
NYVNKIKNRF

SEQ ID NO: 31515 - protein, 10 aa, Homo Sapiens
NYVVIGTCTF

SEQ ID NO: 31516 - protein, 10 aa, Homo Sapiens
NYYEVHKELF

SEQ ID NO: 31517 - protein, 10 aa, Homo Sapiens
PFAHLPKSTF

SEQ ID NO: 31518 - protein, 10 aa, Homo Sapiens
PFLPQLQTTF

SEQ ID NO: 31519 - protein, 10 aa, Homo Sapiens
PFLTHLICTF

SEQ ID NO: 31520 - protein, 10 aa, Homo Sapiens
PWVTGKAANF

SEQ ID NO: 31521 - protein, 10 aa, Homo Sapiens
PYAKPIPAQF

SEQ ID NO: 31522 - protein, 10 aa, Homo Sapiens
PYIPLCPLSL

SEQ ID NO: 31523 - protein, 10 aa, Homo Sapiens
PYTDVNIVTI

SEQ ID NO: 31524 - protein, 10 aa, Homo Sapiens
PYYKDILPCL

SEQ ID NO: 31525 - protein, 10 aa, Homo Sapiens
PYYNGPHLNL

SEQ ID NO: 31526 - protein, 10 aa, Homo Sapiens
QFIEPFEEKF

SEQ ID NO: 31527 - protein, 10 aa, Homo Sapiens
QFIPPYVPRF

SEQ ID NO: 31528 - protein, 10 aa, Homo Sapiens
QYLDNLLVRF

SEQ ID NO: 31529 - protein, 10 aa, Homo Sapiens
QYLPAIRALW

SEQ ID NO: 31530 - protein, 10 aa, Homo Sapiens
QYLTFKPQTF

SEQ ID NO: 31531 - protein, 10 aa, Homo Sapiens
QYMEEIYHRI

SEQ ID NO: 31532 - protein, 10 aa, Homo Sapiens
RFCDSSGNSF

SEQ ID NO: 31533 - protein, 10 aa, Homo Sapiens
RFIDHLMVMF

SEQ ID NO: 31534 - protein, 10 aa, Homo Sapiens
RFIFDVGTRL

SEQ ID NO: 31535 - protein, 10 aa, Homo Sapiens
RFIKKLEHTW

SEQ ID NO: 31536 - protein, 10 aa, Homo Sapiens
RFIPKYSTFW

SEQ ID NO: 31537 - protein, 10 aa, Homo Sapiens
RFIRPMGLRF

SEQ ID NO: 31538 - protein, 10 aa, Homo Sapiens
RFKDLGEEHF

SEQ ID NO: 31539 - protein, 10 aa, Homo Sapiens
RFLDDLGLKF

SEQ ID NO: 31540 - protein, 10 aa, Homo Sapiens
RFLDVNSHKI

SEQ ID NO: 31541 - protein, 10 aa, Homo Sapiens
RFLESHWFVW

SEQ ID NO: 31542 - protein, 10 aa, Homo Sapiens
RFLIDIGVKF

SEQ ID NO: 31543 - protein, 10 aa, Homo Sapiens
RFLPHGQLLF

SEQ ID NO: 31544 - protein, 10 aa, Homo Sapiens
RFLSHEDLRF

SEQ ID NO: 31545 - protein, 10 aa, Homo Sapiens
RFLVDQGYSF

SEQ ID NO: 31546 - protein, 10 aa, Homo Sapiens
RFPEELTQTF

SEQ ID NO: 31547 - protein, 10 aa, Homo Sapiens
RMPNSPAPHF

SEQ ID NO: 31548 - protein, 10 aa, Homo Sapiens
RQVADAREKI

SEQ ID NO: 31549 - protein, 10 aa, Homo Sapiens
RVAPEEHPVL

SEQ ID NO: 31550 - protein, 10 aa, Homo Sapiens
RWAGLPRQGF

SEQ ID NO: 31551 - protein, 10 aa, Homo Sapiens
RWFQPAIPSW

SEQ ID NO: 31552 - protein, 10 aa, Homo Sapiens
RWFTHASPTL

SEQ ID NO: 31553 - protein, 10 aa, Homo Sapiens
RWKPASQPTI

SEQ ID NO: 31554 - protein, 10 aa, Homo Sapiens
RWLDGSPVTL

SEQ ID NO: 31555 - protein, 10 aa, Homo Sapiens
RWLDRQLIRL

SEQ ID NO: 31556 - protein, 10 aa, Homo Sapiens
RWSPVRPLVF

SEQ ID NO: 31557 - protein, 10 aa, Homo Sapiens
RYADGPQLYI

SEQ ID NO: 31558 - protein, 10 aa, Homo Sapiens
RYAKIVEIPF

SEQ ID NO: 31559 - protein, 10 aa, Homo Sapiens
RYAVVLNATW

SEQ ID NO: 31560 - protein, 10 aa, Homo Sapiens
RYFDGNLEKL

SEQ ID NO: 31561 - protein, 10 aa, Homo Sapiens
RYFDPANGKF

SEQ ID NO: 31562 - protein, 10 aa, Homo Sapiens
RYFDVGLHNF

SEQ ID NO: 31563 - protein, 10 aa, Homo Sapiens
RYFISHVLAF

SEQ ID NO: 31564 - protein, 10 aa, Homo Sapiens
RYFPTQALNF

SEQ ID NO: 31565 - protein, 10 aa, Homo Sapiens
RYIDRIHIFF

SEQ ID NO: 31566 - protein, 10 aa, Homo Sapiens
RYIHPQQEAF

SEQ ID NO: 31567 - protein, 10 aa, Homo Sapiens
RYIKNPRIVL

SEQ ID NO: 31568 - protein, 10 aa, Homo Sapiens
RYINKALECF

SEQ ID NO: 31569 - protein, 10 aa, Homo Sapiens
RYIPSLPDRI

SEQ ID NO: 31570 - protein, 10 aa, Homo Sapiens
RYIQPWESEF

SEQ ID NO: 31571 - protein, 10 aa, Homo Sapiens
RYKGPGFEYF

SEQ ID NO: 31572 - protein, 10 aa, Homo Sapiens
RYLDLFTNYI

SEQ ID NO: 31573 - protein, 10 aa, Homo Sapiens
RYLDLILNDF

SEQ ID NO: 31574 - protein, 10 aa, Homo Sapiens
RYLDLSNNRL

SEQ ID NO: 31575 - protein, 10 aa, Homo Sapiens
RYLENGKETL

SEQ ID NO: 31576 - protein, 10 aa, Homo Sapiens
RYLHVEGGNF

SEQ ID NO: 31577 - protein, 10 aa, Homo Sapiens
RYLNKAFHIW

SEQ ID NO: 31578 - protein, 10 aa, Homo Sapiens
RYLNSQQQYF

SEQ ID NO: 31579 - protein, 10 aa, Homo Sapiens
RYLPTGSFPF

SEQ ID NO: 31580 - protein, 10 aa, Homo Sapiens
RYLRELPLLF

SEQ ID NO: 31581 - protein, 10 aa, Homo Sapiens
RYLWHIPLTY

SEQ ID NO: 31582 - protein, 10 aa, Homo Sapiens
RYMDQWVPVI

SEQ ID NO: 31583 - protein, 10 aa, Homo Sapiens
RYMPQNPCII

SEQ ID NO: 31584 - protein, 10 aa, Homo Sapiens
RYMPQNPHII

SEQ ID NO: 31585 - protein, 10 aa, Homo Sapiens
RYNHITATYF

SEQ ID NO: 31586 - protein, 10 aa, Homo Sapiens
RYNHIVGCTF

SEQ ID NO: 31587 - protein, 10 aa, Homo Sapiens
RYPDTIALTF

SEQ ID NO: 31588 - protein, 10 aa, Homo Sapiens
RYPNSHTHYF

SEQ ID NO: 31589 - protein, 10 aa, Homo Sapiens
RYPPDIRATF

SEQ ID NO: 31590 - protein, 10 aa, Homo Sapiens
RYPPKSGNYF

SEQ ID NO: 31591 - protein, 10 aa, Homo Sapiens
RYPVCKFPSL

SEQ ID NO: 31592 - protein, 10 aa, Homo Sapiens
RYPVGRFPSL

SEQ ID NO: 31593 - protein, 10 aa, Homo Sapiens
RYQNIWNINL

SEQ ID NO: 31594 - protein, 10 aa, Homo Sapiens
RYSTPHAFTF

SEQ ID NO: 31595 - protein, 10 aa, Homo Sapiens
RYTVGGLETF

SEQ ID NO: 31596 - protein, 10 aa, Homo Sapiens
RYVFQSENTF

SEQ ID NO: 31597 - protein, 10 aa, Homo Sapiens
RYYKNIGLGF

SEQ ID NO: 31598 - protein, 10 aa, Homo Sapiens
SFFKISYLTF

SEQ ID NO: 31599 - protein, 10 aa, Homo Sapiens
SFFKKIGVHF

SEQ ID NO: 31600 - protein, 10 aa, Homo Sapiens
SFHKFHYLTF

SEQ ID NO: 31601 - protein, 10 aa, Homo Sapiens
SFIPDQHMVF

SEQ ID NO: 31602 - protein, 10 aa, Homo Sapiens
SFLDQQAILF

SEQ ID NO: 31603 - protein, 10 aa, Homo Sapiens
SFLDVRNIIL

SEQ ID NO: 31604 - protein, 10 aa, Homo Sapiens
SFLGGIRWGF

SEQ ID NO: 31605 - protein, 10 aa, Homo Sapiens
SFLGVKELSF

SEQ ID NO: 31606 - protein, 10 aa, Homo Sapiens
SFLTHQRFQF

SEQ ID NO: 31607 - protein, 10 aa, Homo Sapiens
SFLYQPDWRF

SEQ ID NO: 31608 - protein, 10 aa, Homo Sapiens
SQEGMVFTRF

SEQ ID NO: 31609 - protein, 10 aa, Homo Sapiens
SWLDGSGLGF

SEQ ID NO: 31610 - protein, 10 aa, Homo Sapiens
SWMELPGLKF

SEQ ID NO: 31611 - protein, 10 aa, Homo Sapiens
SYDPLRIYLF

SEQ ID NO: 31612 - protein, 10 aa, Homo Sapiens
SYFEKGPLTF

SEQ ID NO: 31613 - protein, 10 aa, Homo Sapiens
SYGIIRGLQF

SEQ ID NO: 31614 - protein, 10 aa, Homo Sapiens
SYIAAISARF

SEQ ID NO: 31615 - protein, 10 aa, Homo Sapiens
SYIDRLISVF

SEQ ID NO: 31616 - protein, 10 aa, Homo Sapiens
SYIPYNPQQF

SEQ ID NO: 31617 - protein, 10 aa, Homo Sapiens
SYISTIGVDF

SEQ ID NO: 31618 - protein, 10 aa, Homo Sapiens
SYLDCELTKF

SEQ ID NO: 31619 - protein, 10 aa, Homo Sapiens
SYLDQELTTF

SEQ ID NO: 31620 - protein, 10 aa, Homo Sapiens
SYLDQVKLQF

SEQ ID NO: 31621 - protein, 10 aa, Homo Sapiens
SYLDRCLHKF

SEQ ID NO: 31622 - protein, 10 aa, Homo Sapiens
SYLDVKGNHF

SEQ ID NO: 31623 - protein, 10 aa, Homo Sapiens
SYLEKQVVTF

SEQ ID NO: 31624 - protein, 10 aa, Homo Sapiens
SYLFLGGILM

SEQ ID NO: 31625 - protein, 10 aa, Homo Sapiens
SYLLPGMASF

SEQ ID NO: 31626 - protein, 10 aa, Homo Sapiens
SYLMYNKEHI

SEQ ID NO: 31627 - protein, 10 aa, Homo Sapiens
SYLPHAPPFA

SEQ ID NO: 31628 - protein, 10 aa, Homo Sapiens
SYLPVGSHNL

SEQ ID NO: 31629 - protein, 10 aa, Homo Sapiens
SYLPVGSVSF

SEQ ID NO: 31630 - protein, 10 aa, Homo Sapiens
SYMFVDENTF

SEQ ID NO: 31631 - protein, 10 aa, Homo Sapiens
SYVEPLKLYL

SEQ ID NO: 31632 - protein, 10 aa, Homo Sapiens
SYVKLPPEKF

SEQ ID NO: 31633 - protein, 10 aa, Homo Sapiens
SYVNKIKTRF

SEQ ID NO: 31634 - protein, 10 aa, Homo Sapiens
SYVQRVALEF

SEQ ID NO: 31635 - protein, 10 aa, Homo Sapiens
TFAVTDELVF

SEQ ID NO: 31636 - protein, 10 aa, Homo Sapiens
TFLDTIATRF

SEQ ID NO: 31637 - protein, 10 aa, Homo Sapiens
TFLEHIIPRF

SEQ ID NO: 31638 - protein, 10 aa, Homo Sapiens
TFLEQSKTRF

SEQ ID NO: 31639 - protein, 10 aa, Homo Sapiens
TFVDNIQTAF

SEQ ID NO: 31640 - protein, 10 aa, Homo Sapiens
TFYLIKDIRF

SEQ ID NO: 31641 - protein, 10 aa, Homo Sapiens
TWAEAARLVL

SEQ ID NO: 31642 - protein, 10 aa, Homo Sapiens
TYFNGDLKNF

SEQ ID NO: 31643 - protein, 10 aa, Homo Sapiens
TYIPGTQITF

SEQ ID NO: 31644 - protein, 10 aa, Homo Sapiens
TYIPVVPESL

SEQ ID NO: 31645 - protein, 10 aa, Homo Sapiens
TYIRLYGRKF

SEQ ID NO: 31646 - protein, 10 aa, Homo Sapiens
TYISAIRERF

SEQ ID NO: 31647 - protein, 10 aa, Homo Sapiens
TYKPDVYTYL

SEQ ID NO: 31648 - protein, 10 aa, Homo Sapiens
TYLDDLRSKF

SEQ ID NO: 31649 - protein, 10 aa, Homo Sapiens
TYLDQVKIRF

SEQ ID NO: 31650 - protein, 10 aa, Homo Sapiens
TYLTITDTQL

SEQ ID NO: 31651 - protein, 10 aa, Homo Sapiens
TYMDRVFKQF

SEQ ID NO: 31652 - protein, 10 aa, Homo Sapiens
TYMGHTGAVW

SEQ ID NO: 31653 - protein, 10 aa, Homo Sapiens
TYNKHINISF

SEQ ID NO: 31654 - protein, 10 aa, Homo Sapiens
TYNPNMPFKW

SEQ ID NO: 31655 - protein, 10 aa, Homo Sapiens
TYPQLEGFKF

SEQ ID NO: 31656 - protein, 10 aa, Homo Sapiens
TYQHVPVESF

SEQ ID NO: 31657 - protein, 10 aa, Homo Sapiens
TYQPIQSPTF

SEQ ID NO: 31658 - protein, 10 aa, Homo Sapiens
TYSPALNKMF

SEQ ID NO: 31659 - protein, 10 aa, Homo Sapiens
TYTDVTPRQF

SEQ ID NO: 31660 - protein, 10 aa, Homo Sapiens
TYVSQYYNHF

SEQ ID NO: 31661 - protein, 10 aa, Homo Sapiens
VDVLKDSGRD

SEQ ID NO: 31662 - protein, 10 aa, Homo Sapiens
VFEDPVISKF

SEQ ID NO: 31663 - protein, 10 aa, Homo Sapiens
VFEGIPTYRF

SEQ ID NO: 31664 - protein, 10 aa, Homo Sapiens
VFEKTKRLLF

SEQ ID NO: 31665 - protein, 10 aa, Homo Sapiens
VFEPNNPVCF

SEQ ID NO: 31666 - protein, 10 aa, Homo Sapiens
VFFEVSPVSF

SEQ ID NO: 31667 - protein, 10 aa, Homo Sapiens
VFFKELIQEF

SEQ ID NO: 31668 - protein, 10 aa, Homo Sapiens
VFFKGFKWGF

SEQ ID NO: 31669 - protein, 10 aa, Homo Sapiens
VFHPSQDLVF

SEQ ID NO: 31670 - protein, 10 aa, Homo Sapiens
VFIGKIITNL

SEQ ID NO: 31671 - protein, 10 aa, Homo Sapiens
VFIGNLNTAI

SEQ ID NO: 31672 - protein, 10 aa, Homo Sapiens
VFIKAPESLF

SEQ ID NO: 31673 - protein, 10 aa, Homo Sapiens
VFITDKISSF

SEQ ID NO: 31674 - protein, 10 aa, Homo Sapiens
VFLAVSHSEF

SEQ ID NO: 31675 - protein, 10 aa, Homo Sapiens
VFLPDQGAFF

SEQ ID NO: 31676 - protein, 10 aa, Homo Sapiens
VFLPREDHLF

SEQ ID NO: 31677 - protein, 10 aa, Homo Sapiens
VFPRLHNVLF

SEQ ID NO: 31678 - protein, 10 aa, Homo Sapiens
VFPSIVGRPR

SEQ ID NO: 31679 - protein, 10 aa, Homo Sapiens
VFRTPPYHKM

SEQ ID NO: 31680 - protein, 10 aa, Homo Sapiens
VFVHVYIHHF

SEQ ID NO: 31681 - protein, 10 aa, Homo Sapiens
VHAPPMQLGF

SEQ ID NO: 31682 - protein, 10 aa, Homo Sapiens
VHHGVNQLKF

SEQ ID NO: 31683 - protein, 10 aa, Homo Sapiens
VHMPCLGHTF

SEQ ID NO: 31684 - protein, 10 aa, Homo Sapiens
VINDVRDIFL

SEQ ID NO: 31685 - protein, 10 aa, Homo Sapiens
VLSAADKGNV

SEQ ID NO: 31686 - protein, 10 aa, Homo Sapiens
VQPRNWLLFA

SEQ ID NO: 31687 - protein, 10 aa, Homo Sapiens
VWIKYGAFLL

SEQ ID NO: 31688 - protein, 10 aa, Homo Sapiens
VWIRNIQLGF

SEQ ID NO: 31689 - protein, 10 aa, Homo Sapiens
VWLEEELKTF

SEQ ID NO: 31690 - protein, 10 aa, Homo Sapiens
VWNPRSHEKL

SEQ ID NO: 31691 - protein, 10 aa, Homo Sapiens
VWPTKYGLLF

SEQ ID NO: 31692 - protein, 10 aa, Homo Sapiens
VYADTCFSTI

SEQ ID NO: 31693 - protein, 10 aa, Homo Sapiens
VYAEVSRLLL

SEQ ID NO: 31694 - protein, 10 aa, Homo Sapiens
VYAHIYHQHF

SEQ ID NO: 31695 - protein, 10 aa, Homo Sapiens
VYAVIPAEKF

SEQ ID NO: 31696 - protein, 10 aa, Homo Sapiens
VYFEGSDFKF

SEQ ID NO: 31697 - protein, 10 aa, Homo Sapiens
VYFEGSIYEI

SEQ ID NO: 31698 - protein, 10 aa, Homo Sapiens
VYIHGGGWAL

SEQ ID NO: 31699 - protein, 10 aa, Homo Sapiens
VYIHPSSALF

SEQ ID NO: 31700 - protein, 10 aa, Homo Sapiens
VYIPVLPPHL

SEQ ID NO: 31701 - protein, 10 aa, Homo Sapiens
VYIRGSKIRF

SEQ ID NO: 31702 - protein, 10 aa, Homo Sapiens
VYITNFHVRM

SEQ ID NO: 31703 - protein, 10 aa, Homo Sapiens
VYITNYRLYL

SEQ ID NO: 31704 - protein, 10 aa, Homo Sapiens
VYKAFVMETF

SEQ ID NO: 31705 - protein, 10 aa, Homo Sapiens
VYKDHQTITI

SEQ ID NO: 31706 - protein, 10 aa, Homo Sapiens
VYKDMPETSF

SEQ ID NO: 31707 - protein, 10 aa, Homo Sapiens
VYLAKLGNFF

SEQ ID NO: 31708 - protein, 10 aa, Homo Sapiens
VYLEDSGHTL

SEQ ID NO: 31709 - protein, 10 aa, Homo Sapiens
VYLPDGTASL

SEQ ID NO: 31710 - protein, 10 aa, Homo Sapiens
VYLPGSRQTL

SEQ ID NO: 31711 - protein, 10 aa, Homo Sapiens
VYLPPEAFTF

SEQ ID NO: 31712 - protein, 10 aa, Homo Sapiens
VYLPTHTSLL

SEQ ID NO: 31713 - protein, 10 aa, Homo Sapiens
VYLQNWSHVL

SEQ ID NO: 31714 - protein, 10 aa, Homo Sapiens
VYLRETANAI

SEQ ID NO: 31715 - protein, 10 aa, Homo Sapiens
VYLTIKPLNL

SEQ ID NO: 31716 - protein, 10 aa, Homo Sapiens
VYLWDLDHGF

SEQ ID NO: 31717 - protein, 10 aa, Homo Sapiens
VYNENLVHMI

SEQ ID NO: 31718 - protein, 10 aa, Homo Sapiens
VYNNIMRHYL

SEQ ID NO: 31719 - protein, 10 aa, Homo Sapiens
VYPEKLATKF

SEQ ID NO: 31720 - protein, 10 aa, Homo Sapiens
VYPESIPRKF

SEQ ID NO: 31721 - protein, 10 aa, Homo Sapiens
VYPPGGQPLL

SEQ ID NO: 31722 - protein, 10 aa, Homo Sapiens
VYPSKQFDVL

SEQ ID NO: 31723 - protein, 10 aa, Homo Sapiens
VYQKIHNEKF

SEQ ID NO: 31724 - protein, 10 aa, Homo Sapiens
VYQPMEKLYM

SEQ ID NO: 31725 - protein, 10 aa, Homo Sapiens
VYQPVTTECF

SEQ ID NO: 31726 - protein, 10 aa, Homo Sapiens
VYQTEGIRGF

SEQ ID NO: 31727 - protein, 10 aa, Homo Sapiens
VYRKPKWNHL

SEQ ID NO: 31728 - protein, 10 aa, Homo Sapiens
VYSEVAAYEF

SEQ ID NO: 31729 - protein, 10 aa, Homo Sapiens
VYTPTDTLVF

SEQ ID NO: 31730 - protein, 10 aa, Homo Sapiens
VYTPVDSLVF

SEQ ID NO: 31731 - protein, 10 aa, Homo Sapiens
VYTVVDEMFL

SEQ ID NO: 31732 - protein, 10 aa, Homo Sapiens
VYVDFEGINF

SEQ ID NO: 31733 - protein, 10 aa, Homo Sapiens
VYVEVSKMKI

SEQ ID NO: 31734 - protein, 10 aa, Homo Sapiens
VYVPKEEQLF

SEQ ID NO: 31735 - protein, 10 aa, Homo Sapiens
YFIAPTGHSL

SEQ ID NO: 31736 - protein, 10 aa, Homo Sapiens
YFIPATGHSL

SEQ ID NO: 31737 - protein, 10 aa, Homo Sapiens
YFISPTGHSL

SEQ ID NO: 31738 - protein, 10 aa, Homo Sapiens
YFITPTGHSL

SEQ ID NO: 31739 - protein, 10 aa, Homo Sapiens
YFITVVPTKL

SEQ ID NO: 31740 - protein, 10 aa, Homo Sapiens
YFLSHIPITL

SEQ ID NO: 31741 - protein, 10 aa, Homo Sapiens
YGSKEDPQTF

SEQ ID NO: 31742 - protein, 10 aa, Homo Sapiens
YLQYTDETFR

SEQ ID NO: 31743 - protein, 10 aa, Homo Sapiens
YYDDLKYRYF

SEQ ID NO: 31744 - protein, 10 aa, Homo Sapiens
YYINKISSTL

SEQ ID NO: 31745 - protein, 10 aa, Homo Sapiens
YYIQNGIQSF

SEQ ID NO: 31746 - protein, 10 aa, Homo Sapiens
YYLGSGRETF

SEQ ID NO: 31747 - protein, 10 aa, Homo Sapiens
YYLQGGFNKF

SEQ ID NO: 31748 - protein, 10 aa, Homo Sapiens
YYLQHPPISF

SEQ ID NO: 31749 - protein, 10 aa, Homo Sapiens
YYLQIHPQEL

SEQ ID NO: 31750 - protein, 10 aa, Homo Sapiens
YYPRKYDAKF

SEQ ID NO: 31751 - protein, 10 aa, Homo Sapiens
YYVHKGIWLF

SEQ ID NO: 31752 - protein, 11 aa, Homo Sapiens
AAYPSLHIYTY

SEQ ID NO: 31753 - protein, 11 aa, Homo Sapiens
AFFPKHQDLQF

SEQ ID NO: 31754 - protein, 11 aa, Homo Sapiens
AFIEPPERMEF

SEQ ID NO: 31755 - protein, 11 aa, Homo Sapiens
AFIQAGIFQEF

SEQ ID NO: 31756 - protein, 11 aa, Homo Sapiens
AFLDKQNQVKF

SEQ ID NO: 31757 - protein, 11 aa, Homo Sapiens
AFLEINRQLLF

SEQ ID NO: 31758 - protein, 11 aa, Homo Sapiens
AFLPREAVTRF

SEQ ID NO: 31759 - protein, 11 aa, Homo Sapiens
AFLSEGARVLF

SEQ ID NO: 31760 - protein, 11 aa, Homo Sapiens
AFVPQLRSGKF

SEQ ID NO: 31761 - protein, 11 aa, Homo Sapiens
AWLPAYATPHF

SEQ ID NO: 31762 - protein, 11 aa, Homo Sapiens
AWLPHVADFRW

SEQ ID NO: 31763 - protein, 11 aa, Homo Sapiens
AWNEITGQIKF

SEQ ID NO: 31764 - protein, 11 aa, Homo Sapiens
AYCPNDYHQLF

SEQ ID NO: 31765 - protein, 11 aa, Homo Sapiens
AYDIGNHFNEF

SEQ ID NO: 31766 - protein, 11 aa, Homo Sapiens
AYLECIERITF

SEQ ID NO: 31767 - protein, 11 aa, Homo Sapiens
AYLPKKNGLYL

SEQ ID NO: 31768 - protein, 11 aa, Homo Sapiens
AYLPKNTHPFL

SEQ ID NO: 31769 - protein, 11 aa, Homo Sapiens
AYLPLRLLERL

SEQ ID NO: 31770 - protein, 11 aa, Homo Sapiens
AYLPSGSSAHL

SEQ ID NO: 31771 - protein, 11 aa, Homo Sapiens
AYLPTGKQFLV

SEQ ID NO: 31772 - protein, 11 aa, Homo Sapiens
AYLPVNESFGF

SEQ ID NO: 31773 - protein, 11 aa, Homo Sapiens
AYMELQQKAEF

SEQ ID NO: 31774 - protein, 11 aa, Homo Sapiens
AYMGCDQEYKF

SEQ ID NO: 31775 - protein, 11 aa, Homo Sapiens
AYMQEPLFVEF

SEQ ID NO: 31776 - protein, 11 aa, Homo Sapiens
AYSTVPGYYSW

SEQ ID NO: 31777 - protein, 11 aa, Homo Sapiens
AYYPAQGVQQF

SEQ ID NO: 31778 - protein, 11 aa, Homo Sapiens
CFINQEVKYLF

SEQ ID NO: 31779 - protein, 11 aa, Homo Sapiens
CFLPAGIVAVL

SEQ ID NO: 31780 - protein, 11 aa, Homo Sapiens
CLLYRGDVVPK

SEQ ID NO: 31781 - protein, 11 aa, Homo Sapiens
CWLPRDQKLLL

SEQ ID NO: 31782 - protein, 11 aa, Homo Sapiens
CYNPHTDHWSF

SEQ ID NO: 31783 - protein, 11 aa, Homo Sapiens
DFLPADIQAQF

SEQ ID NO: 31784 - protein, 11 aa, Homo Sapiens
DYIDGILIKTF

SEQ ID NO: 31785 - protein, 11 aa, Homo Sapiens
DYIDPAIMKKL

SEQ ID NO: 31786 - protein, 11 aa, Homo Sapiens
DYVEINIDHKF

SEQ ID NO: 31787 - protein, 11 aa, Homo Sapiens
EALPGPHYYTW

SEQ ID NO: 31788 - protein, 11 aa, Homo Sapiens
EFPNFKYRMIL

SEQ ID NO: 31789 - protein, 11 aa, Homo Sapiens
EWDDRKVRHTF

SEQ ID NO: 31790 - protein, 11 aa, Homo Sapiens
EWSPYTKIFQF

SEQ ID NO: 31791 - protein, 11 aa, Homo Sapiens
EYFGPDFKLHI

SEQ ID NO: 31792 - protein, 11 aa, Homo Sapiens
EYIPEDILKNL

SEQ ID NO: 31793 - protein, 11 aa, Homo Sapiens
EYIPEGEILVI

SEQ ID NO: 31794 - protein, 11 aa, Homo Sapiens
EYLDEEFHQSL

SEQ ID NO: 31795 - protein, 11 aa, Homo Sapiens
EYLDRIGQLFF

SEQ ID NO: 31796 - protein, 11 aa, Homo Sapiens
EYLGANSVVYL

SEQ ID NO: 31797 - protein, 11 aa, Homo Sapiens
EYLHIDQRLVF

SEQ ID NO: 31798 - protein, 11 aa, Homo Sapiens
EYLIRIKGQEF

SEQ ID NO: 31799 - protein, 11 aa, Homo Sapiens
EYLPIGGLAEF

SEQ ID NO: 31800 - protein, 11 aa, Homo Sapiens
EYLTPEEMVTF

SEQ ID NO: 31801 - protein, 11 aa, Homo Sapiens
EYQLIDCAQYF

SEQ ID NO: 31802 - protein, 11 aa, Homo Sapiens
EYVDDTQFLRF

SEQ ID NO: 31803 - protein, 11 aa, Homo Sapiens
EYVEAVSFQHF

SEQ ID NO: 31804 - protein, 11 aa, Homo Sapiens
FHNKFLCFYGF

SEQ ID NO: 31805 - protein, 11 aa, Homo Sapiens
FQTVTDYGKDL

SEQ ID NO: 31806 - protein, 11 aa, Homo Sapiens
FYIPDGSFTNI

SEQ ID NO: 31807 - protein, 11 aa, Homo Sapiens
FYIPPLATHTI

SEQ ID NO: 31808 - protein, 11 aa, Homo Sapiens
FYLNQSTAYHF

SEQ ID NO: 31809 - protein, 11 aa, Homo Sapiens
FYLPKDAVKHL

SEQ ID NO: 31810 - protein, 11 aa, Homo Sapiens
FYLPLDAIKQL

SEQ ID NO: 31811 - protein, 11 aa, Homo Sapiens
FYPEEVSSMVL

SEQ ID NO: 31812 - protein, 11 aa, Homo Sapiens
FYQRFPLSFGF

SEQ ID NO: 31813 - protein, 11 aa, Homo Sapiens
FYVPAEPKLAF

SEQ ID NO: 31814 - protein, 11 aa, Homo Sapiens
GFYPAEITLTW

SEQ ID NO: 31815 - protein, 11 aa, Homo Sapiens
GPPPPPPGKPQ

SEQ ID NO: 31816 - protein, 11 aa, Homo Sapiens
GYLERIDGLDF

SEQ ID NO: 31817 - protein, 11 aa, Homo Sapiens
GYLPLAHVLEL

SEQ ID NO: 31818 - protein, 11 aa, Homo Sapiens
GYLPNQLFRTF

SEQ ID NO: 31819 - protein, 11 aa, Homo Sapiens
GYLSDNIFTHF

SEQ ID NO: 31820 - protein, 11 aa, Homo Sapiens
HRPPPPPGKPE

SEQ ID NO: 31821 - protein, 11 aa, Homo Sapiens
HYFQNTQGLIF

SEQ ID NO: 31822 - protein, 11 aa, Homo Sapiens
HYIEDDCLLRL

SEQ ID NO: 31823 - protein, 11 aa, Homo Sapiens
HYLPARVMEKL

SEQ ID NO: 31824 - protein, 11 aa, Homo Sapiens
HYLTRVEVTEF

SEQ ID NO: 31825 - protein, 11 aa, Homo Sapiens
HYNSDLNNLLF

SEQ ID NO: 31826 - protein, 11 aa, Homo Sapiens
HYVDLKDRPFF

SEQ ID NO: 31827 - protein, 11 aa, Homo Sapiens
IFINLPRSMDF

SEQ ID NO: 31828 - protein, 11 aa, Homo Sapiens
IFINQPQLTKF

SEQ ID NO: 31829 - protein, 11 aa, Homo Sapiens
IFITEKHGNYF

SEQ ID NO: 31830 - protein, 11 aa, Homo Sapiens
IFKPPDPDNTF

SEQ ID NO: 31831 - protein, 11 aa, Homo Sapiens
IFLDPHTTQTF

SEQ ID NO: 31832 - protein, 11 aa, Homo Sapiens
IFLDQKCQNIL

SEQ ID NO: 31833 - protein, 11 aa, Homo Sapiens
IFLYPEDGLQF

SEQ ID NO: 31834 - protein, 11 aa, Homo Sapiens
IFYAGTGNLLL

SEQ ID NO: 31835 - protein, 11 aa, Homo Sapiens
IQLPAALLSRF

SEQ ID NO: 31836 - protein, 11 aa, Homo Sapiens
IYCPPKLQATL

SEQ ID NO: 31837 - protein, 11 aa, Homo Sapiens
IYDHINEGKLW

SEQ ID NO: 31838 - protein, 11 aa, Homo Sapiens
IYDPNLAFLRF

SEQ ID NO: 31839 - protein, 11 aa, Homo Sapiens
IYDTSTDRLLW

SEQ ID NO: 31840 - protein, 11 aa, Homo Sapiens
IYEDPQHHPLL

SEQ ID NO: 31841 - protein, 11 aa, Homo Sapiens
IYEGDESFREL

SEQ ID NO: 31842 - protein, 11 aa, Homo Sapiens
IYEIIDNSQGF

SEQ ID NO: 31843 - protein, 11 aa, Homo Sapiens
IYFGKDIPNMF

SEQ ID NO: 31844 - protein, 11 aa, Homo Sapiens
IYFPEGSGVKI

SEQ ID NO: 31845 - protein, 11 aa, Homo Sapiens
IYFPKKEAVTF

SEQ ID NO: 31846 - protein, 11 aa, Homo Sapiens
IYIKHPHLFKY

SEQ ID NO: 31847 - protein, 11 aa, Homo Sapiens
IYLAPGDYHCF

SEQ ID NO: 31848 - protein, 11 aa, Homo Sapiens
IYLDKMITRNL

SEQ ID NO: 31849 - protein, 11 aa, Homo Sapiens
IYLESKDNQKL

SEQ ID NO: 31850 - protein, 11 aa, Homo Sapiens
IYLNHIEPLKI

SEQ ID NO: 31851 - protein, 11 aa, Homo Sapiens
IYMDPHYCQSF

SEQ ID NO: 31852 - protein, 11 aa, Homo Sapiens
IYNGDMEKILL

SEQ ID NO: 31853 - protein, 11 aa, Homo Sapiens
IYNNIKNFVRF

SEQ ID NO: 31854 - protein, 11 aa, Homo Sapiens
IYNPSMGVSVL

SEQ ID NO: 31855 - protein, 11 aa, Homo Sapiens
IYQDRDQFAKL

SEQ ID NO: 31856 - protein, 11 aa, Homo Sapiens
IYREFREEESL

SEQ ID NO: 31857 - protein, 11 aa, Homo Sapiens
IYSPDHTNNSF

SEQ ID NO: 31858 - protein, 11 aa, Homo Sapiens
IYTVKVEDLTF

SEQ ID NO: 31859 - protein, 11 aa, Homo Sapiens
IYVFDLHGNRF

SEQ ID NO: 31860 - protein, 11 aa, Homo Sapiens
IYVNPANTHQF

SEQ ID NO: 31861 - protein, 11 aa, Homo Sapiens
KFFGKDISTTL

SEQ ID NO: 31862 - protein, 11 aa, Homo Sapiens
KFFGKELSTTL

SEQ ID NO: 31863 - protein, 11 aa, Homo Sapiens
KFIDEQQILHW

SEQ ID NO: 31864 - protein, 11 aa, Homo Sapiens
KFIDPKKIKVF

SEQ ID NO: 31865 - protein, 11 aa, Homo Sapiens
KFIGPDQHRNF

SEQ ID NO: 31866 - protein, 11 aa, Homo Sapiens
KFLDKAKAKKF

SEQ ID NO: 31867 - protein, 11 aa, Homo Sapiens
KFLVTESPAKF

SEQ ID NO: 31868 - protein, 11 aa, Homo Sapiens
KFMDKKLSLKL

SEQ ID NO: 31869 - protein, 11 aa, Homo Sapiens
KFYPPKVELFF

SEQ ID NO: 31870 - protein, 11 aa, Homo Sapiens
KLPEILGKMSF

SEQ ID NO: 31871 - protein, 11 aa, Homo Sapiens
KLVAASQAALG

SEQ ID NO: 31872 - protein, 11 aa, Homo Sapiens
KWCELIPGAEF

SEQ ID NO: 31873 - protein, 11 aa, Homo Sapiens
KWLEPLKNLRF

SEQ ID NO: 31874 - protein, 11 aa, Homo Sapiens
KWLPESESLFL

SEQ ID NO: 31875 - protein, 11 aa, Homo Sapiens
KYAPLHLVPLI

SEQ ID NO: 31876 - protein, 11 aa, Homo Sapiens
KYARVVQKLGF

SEQ ID NO: 31877 - protein, 11 aa, Homo Sapiens
KYEPTNVRYLW

SEQ ID NO: 31878 - protein, 11 aa, Homo Sapiens
KYFAQEALTVL

SEQ ID NO: 31879 - protein, 11 aa, Homo Sapiens
KYGDLLGHLKI

SEQ ID NO: 31880 - protein, 11 aa, Homo Sapiens
KYIDKTIRVKF

SEQ ID NO: 31881 - protein, 11 aa, Homo Sapiens
KYIEEQLLQRI

SEQ ID NO: 31882 - protein, 11 aa, Homo Sapiens
KYIQQTKPLTL

SEQ ID NO: 31883 - protein, 11 aa, Homo Sapiens
KYISKPENLKL

SEQ ID NO: 31884 - protein, 11 aa, Homo Sapiens
KYISPETMVAL

SEQ ID NO: 31885 - protein, 11 aa, Homo Sapiens
KYITQGQLLQF

SEQ ID NO: 31886 - protein, 11 aa, Homo Sapiens
KYKKTTPEYVF

SEQ ID NO: 31887 - protein, 11 aa, Homo Sapiens
KYKNSEINFSF

SEQ ID NO: 31888 - protein, 11 aa, Homo Sapiens
KYLAILGSVTF

SEQ ID NO: 31889 - protein, 11 aa, Homo Sapiens
KYLAKNSATLF

SEQ ID NO: 31890 - protein, 11 aa, Homo Sapiens
KYLDEDTIYHL

SEQ ID NO: 31891 - protein, 11 aa, Homo Sapiens
KYLDEFLLNKI

SEQ ID NO: 31892 - protein, 11 aa, Homo Sapiens
KYLDVHSMHQL

SEQ ID NO: 31893 - protein, 11 aa, Homo Sapiens
KYLEDRGEVTF

SEQ ID NO: 31894 - protein, 11 aa, Homo Sapiens
KYLEESTIRHF

SEQ ID NO: 31895 - protein, 11 aa, Homo Sapiens
KYLIVDEGHRI

SEQ ID NO: 31896 - protein, 11 aa, Homo Sapiens
KYLLADCNEAF

SEQ ID NO: 31897 - protein, 11 aa, Homo Sapiens
KYLNENQLSQL

SEQ ID NO: 31898 - protein, 11 aa, Homo Sapiens
KYLNWDAVFRF

SEQ ID NO: 31899 - protein, 11 aa, Homo Sapiens
KYLPENDLKRL

SEQ ID NO: 31900 - protein, 11 aa, Homo Sapiens
KYLPYNHQHEY

SEQ ID NO: 31901 - protein, 11 aa, Homo Sapiens
KYLYEEYLQAF

SEQ ID NO: 31902 - protein, 11 aa, Homo Sapiens
KYMGIPQIRQL

SEQ ID NO: 31903 - protein, 11 aa, Homo Sapiens
KYMKYEKSYRF

SEQ ID NO: 31904 - protein, 11 aa, Homo Sapiens
KYMPNVKVAVF

SEQ ID NO: 31905 - protein, 11 aa, Homo Sapiens
KYMPSVKVSVF

SEQ ID NO: 31906 - protein, 11 aa, Homo Sapiens
KYPENDLFRKL

SEQ ID NO: 31907 - protein, 11 aa, Homo Sapiens
KYPGHLAAITL

SEQ ID NO: 31908 - protein, 11 aa, Homo Sapiens
KYQEVTNNLEF

SEQ ID NO: 31909 - protein, 11 aa, Homo Sapiens
KYSTKPGSYIF

SEQ ID NO: 31910 - protein, 11 aa, Homo Sapiens
LFIPEHTNLSL

SEQ ID NO: 31911 - protein, 11 aa, Homo Sapiens
LFIPSSKLLFL

SEQ ID NO: 31912 - protein, 11 aa, Homo Sapiens
LFTEATRILFF

SEQ ID NO: 31913 - protein, 11 aa, Homo Sapiens
LYEEGSNKRLF

SEQ ID NO: 31914 - protein, 11 aa, Homo Sapiens
LYIDRPLPYLI

SEQ ID NO: 31915 - protein, 11 aa, Homo Sapiens
LYIGWDKHYGF

SEQ ID NO: 31916 - protein, 11 aa, Homo Sapiens
LYISEAEGLKF

SEQ ID NO: 31917 - protein, 11 aa, Homo Sapiens
LYLEHKGWYSW

SEQ ID NO: 31918 - protein, 11 aa, Homo Sapiens
LYLEHQVRVGF

SEQ ID NO: 31919 - protein, 11 aa, Homo Sapiens
LYPDRELQSQW

SEQ ID NO: 31920 - protein, 11 aa, Homo Sapiens
LYPNIDKDHAF

SEQ ID NO: 31921 - protein, 11 aa, Homo Sapiens
LYYDEKKMANF

SEQ ID NO: 31922 - protein, 11 aa, Homo Sapiens
LYYTWTDGYRF

SEQ ID NO: 31923 - protein, 11 aa, Homo Sapiens
MYIKQVIIQGF

SEQ ID NO: 31924 - protein, 11 aa, Homo Sapiens
NFIPKNLFEQF

SEQ ID NO: 31925 - protein, 11 aa, Homo Sapiens
NFISGAGILRL

SEQ ID NO: 31926 - protein, 11 aa, Homo Sapiens
NFLGYKESVHL

SEQ ID NO: 31927 - protein, 11 aa, Homo Sapiens
NFLHPINTIFF

SEQ ID NO: 31928 - protein, 11 aa, Homo Sapiens
NFVPKNLFEQF

SEQ ID NO: 31929 - protein, 11 aa, Homo Sapiens
NYCEITGMNTL

SEQ ID NO: 31930 - protein, 11 aa, Homo Sapiens
NYFESTDGLIW

SEQ ID NO: 31931 - protein, 11 aa, Homo Sapiens
NYFFDAAKLMF

SEQ ID NO: 31932 - protein, 11 aa, Homo Sapiens
NYIHGSSQAQF

SEQ ID NO: 31933 - protein, 11 aa, Homo Sapiens
NYLAYDIGNHF

SEQ ID NO: 31934 - protein, 11 aa, Homo Sapiens
NYLCPAIINQI

SEQ ID NO: 31935 - protein, 11 aa, Homo Sapiens
NYLDPRITVAW

SEQ ID NO: 31936 - protein, 11 aa, Homo Sapiens
NYLGGEYFARM

SEQ ID NO: 31937 - protein, 11 aa, Homo Sapiens
NYLPAINGIVF

SEQ ID NO: 31938 - protein, 11 aa, Homo Sapiens
NYLPPEMKSFF

SEQ ID NO: 31939 - protein, 11 aa, Homo Sapiens
NYPETLGRLLI

SEQ ID NO: 31940 - protein, 11 aa, Homo Sapiens
NYPPQYLILKL

SEQ ID NO: 31941 - protein, 11 aa, Homo Sapiens
NYSDVMSKLGF

SEQ ID NO: 31942 - protein, 11 aa, Homo Sapiens
NYSGAAEYLYF

SEQ ID NO: 31943 - protein, 11 aa, Homo Sapiens
NYSTVPQKQTL

SEQ ID NO: 31944 - protein, 11 aa, Homo Sapiens
PFIKSQHELLF

SEQ ID NO: 31945 - protein, 11 aa, Homo Sapiens
PFLDIQKRFGL

SEQ ID NO: 31946 - protein, 11 aa, Homo Sapiens
PFLKPDDIQYF

SEQ ID NO: 31947 - protein, 11 aa, Homo Sapiens
PFYGILGALLF

SEQ ID NO: 31948 - protein, 11 aa, Homo Sapiens
PGSYLPSSYSF

SEQ ID NO: 31949 - protein, 11 aa, Homo Sapiens
PLSSLFSLPTF

SEQ ID NO: 31950 - protein, 11 aa, Homo Sapiens
PMFIVNTNVPR

SEQ ID NO: 31951 - protein, 11 aa, Homo Sapiens
PWIPPSSPTTF

SEQ ID NO: 31952 - protein, 11 aa, Homo Sapiens
PYAPSGEIPKF

SEQ ID NO: 31953 - protein, 11 aa, Homo Sapiens
PYMDSPQSIGF

SEQ ID NO: 31954 - protein, 11 aa, Homo Sapiens
PYQATIDGVRF

SEQ ID NO: 31955 - protein, 11 aa, Homo Sapiens
QFLPDHINIVL

SEQ ID NO: 31956 - protein, 11 aa, Homo Sapiens
QGPPPPQGKPQ

SEQ ID NO: 31957 - protein, 11 aa, Homo Sapiens
QWINLKKAYSF

SEQ ID NO: 31958 - protein, 11 aa, Homo Sapiens
QYKLLEPVLLL

SEQ ID NO: 31959 - protein, 11 aa, Homo Sapiens
QYLARFDALVL

SEQ ID NO: 31960 - protein, 11 aa, Homo Sapiens
QYLSIAERAEF

SEQ ID NO: 31961 - protein, 11 aa, Homo Sapiens
QYPDGEVWKKL

SEQ ID NO: 31962 - protein, 11 aa, Homo Sapiens
QYPVYWDHLEF

SEQ ID NO: 31963 - protein, 11 aa, Homo Sapiens
RFAHGTAGLVF

SEQ ID NO: 31964 - protein, 11 aa, Homo Sapiens
RFHVLSKLLSF

SEQ ID NO: 31965 - protein, 11 aa, Homo Sapiens
RFIAPAASLGF

SEQ ID NO: 31966 - protein, 11 aa, Homo Sapiens
RFLAEEGFYKF

SEQ ID NO: 31967 - protein, 11 aa, Homo Sapiens
RFLDGQAVLRL

SEQ ID NO: 31968 - protein, 11 aa, Homo Sapiens
RFLDPRNKISF

SEQ ID NO: 31969 - protein, 11 aa, Homo Sapiens
RFLEQQNKILL

SEQ ID NO: 31970 - protein, 11 aa, Homo Sapiens
RFLKSDIYLNL

SEQ ID NO: 31971 - protein, 11 aa, Homo Sapiens
RFLNDPGHLLW

SEQ ID NO: 31972 - protein, 11 aa, Homo Sapiens
RFLNSSNDHRF

SEQ ID NO: 31973 - protein, 11 aa, Homo Sapiens
RFVPLPASAKW

SEQ ID NO: 31974 - protein, 11 aa, Homo Sapiens
RFVTGNKILRI

SEQ ID NO: 31975 - protein, 11 aa, Homo Sapiens
RILPQDVILKF

SEQ ID NO: 31976 - protein, 11 aa, Homo Sapiens
RWKPPAVNQQF

SEQ ID NO: 31977 - protein, 11 aa, Homo Sapiens
RWLCHPLGQKF

SEQ ID NO: 31978 - protein, 11 aa, Homo Sapiens
RWLPQKNAAQF

SEQ ID NO: 31979 - protein, 11 aa, Homo Sapiens
RYFSEGDKVKI

SEQ ID NO: 31980 - protein, 11 aa, Homo Sapiens
RYIDQKFVQQL

SEQ ID NO: 31981 - protein, 11 aa, Homo Sapiens
RYIEFHSQSGF

SEQ ID NO: 31982 - protein, 11 aa, Homo Sapiens
RYIKNPRIVLL

SEQ ID NO: 31983 - protein, 11 aa, Homo Sapiens
RYISDQLFTNF

SEQ ID NO: 31984 - protein, 11 aa, Homo Sapiens
RYISPDQLADL

SEQ ID NO: 31985 - protein, 11 aa, Homo Sapiens
RYITEALIKKL

SEQ ID NO: 31986 - protein, 11 aa, Homo Sapiens
RYLDSLKAIVF

SEQ ID NO: 31987 - protein, 11 aa, Homo Sapiens
RYLDVSILGKF

SEQ ID NO: 31988 - protein, 11 aa, Homo Sapiens
RYLHNFQGKEI

SEQ ID NO: 31989 - protein, 11 aa, Homo Sapiens
RYLPEDFMESL

SEQ ID NO: 31990 - protein, 11 aa, Homo Sapiens
RYLPKGFLNQF

SEQ ID NO: 31991 - protein, 11 aa, Homo Sapiens
RYLPPATQVVL

SEQ ID NO: 31992 - protein, 11 aa, Homo Sapiens
RYLPTEQEVRF

SEQ ID NO: 31993 - protein, 11 aa, Homo Sapiens
RYLPTGSFPFL

SEQ ID NO: 31994 - protein, 11 aa, Homo Sapiens
RYLRPPNTSLF

SEQ ID NO: 31995 - protein, 11 aa, Homo Sapiens
RYLSPKWIKMF

SEQ ID NO: 31996 - protein, 11 aa, Homo Sapiens
RYLSPKYIKMF

SEQ ID NO: 31997 - protein, 11 aa, Homo Sapiens
RYLYLRGLVYL

SEQ ID NO: 31998 - protein, 11 aa, Homo Sapiens
RYMNHMQSLRF

SEQ ID NO: 31999 - protein, 11 aa, Homo Sapiens
RYMSPMEAQEF

SEQ ID NO: 32000 - protein, 11 aa, Homo Sapiens
RYPDNLKHLYL

SEQ ID NO: 32001 - protein, 11 aa, Homo Sapiens
RYPNGVVVHYF

SEQ ID NO: 32002 - protein, 11 aa, Homo Sapiens
RYPNKLDTITW

SEQ ID NO: 32003 - protein, 11 aa, Homo Sapiens
RYPTSIASLAF

SEQ ID NO: 32004 - protein, 11 aa, Homo Sapiens
RYQEKWDKLLL

SEQ ID NO: 32005 - protein, 11 aa, Homo Sapiens
RYQESLGNTVF

SEQ ID NO: 32006 - protein, 11 aa, Homo Sapiens
RYSGVNQSMLF

SEQ ID NO: 32007 - protein, 11 aa, Homo Sapiens
RYSSDVQEMIL

SEQ ID NO: 32008 - protein, 11 aa, Homo Sapiens
RYTPEQDTMTF

SEQ ID NO: 32009 - protein, 11 aa, Homo Sapiens
RYVASYLLAAL

SEQ ID NO: 32010 - protein, 11 aa, Homo Sapiens
RYVEQKAGITF

SEQ ID NO: 32011 - protein, 11 aa, Homo Sapiens
RYVLYPNNFQF

SEQ ID NO: 32012 - protein, 11 aa, Homo Sapiens
RYVPGLLLSYL

SEQ ID NO: 32013 - protein, 11 aa, Homo Sapiens
RYVQQLQRLSF

SEQ ID NO: 32014 - protein, 11 aa, Homo Sapiens
SFHAASESLKF

SEQ ID NO: 32015 - protein, 11 aa, Homo Sapiens
SFIPSSVPATF

SEQ ID NO: 32016 - protein, 11 aa, Homo Sapiens
SFLHGNASLLF

SEQ ID NO: 32017 - protein, 11 aa, Homo Sapiens
SGPSIVHRKCF

SEQ ID NO: 32018 - protein, 11 aa, Homo Sapiens
SYIDMDKELEF

SEQ ID NO: 32019 - protein, 11 aa, Homo Sapiens
SYIELPAYLKL

SEQ ID NO: 32020 - protein, 11 aa, Homo Sapiens
SYIRPEDIVNF

SEQ ID NO: 32021 - protein, 11 aa, Homo Sapiens
SYISDGKEYLF

SEQ ID NO: 32022 - protein, 11 aa, Homo Sapiens
SYISKEHFGTF

SEQ ID NO: 32023 - protein, 11 aa, Homo Sapiens
SYKPMLNNNSF

SEQ ID NO: 32024 - protein, 11 aa, Homo Sapiens
SYLAVIEGAKF

SEQ ID NO: 32025 - protein, 11 aa, Homo Sapiens
SYLDMSKVIIF

SEQ ID NO: 32026 - protein, 11 aa, Homo Sapiens
SYLENPTSYHL

SEQ ID NO: 32027 - protein, 11 aa, Homo Sapiens
SYLEPGSIRHI

SEQ ID NO: 32028 - protein, 11 aa, Homo Sapiens
SYLEPTSVTNF

SEQ ID NO: 32029 - protein, 11 aa, Homo Sapiens
SYLEREDFFFY

SEQ ID NO: 32030 - protein, 11 aa, Homo Sapiens
SYLERHGLINF

SEQ ID NO: 32031 - protein, 11 aa, Homo Sapiens
SYLPSQVTEMF

SEQ ID NO: 32032 - protein, 11 aa, Homo Sapiens
SYLSGMPECKF

SEQ ID NO: 32033 - protein, 11 aa, Homo Sapiens
SYLSHSEQLVF

SEQ ID NO: 32034 - protein, 11 aa, Homo Sapiens
SYMEVPTYLNF

SEQ ID NO: 32035 - protein, 11 aa, Homo Sapiens
SYPTFFPRFEF

SEQ ID NO: 32036 - protein, 11 aa, Homo Sapiens
SYTPVGLIQNL

SEQ ID NO: 32037 - protein, 11 aa, Homo Sapiens
SYVCPDLVKEF

SEQ ID NO: 32038 - protein, 11 aa, Homo Sapiens
SYVSIASNSTF

SEQ ID NO: 32039 - protein, 11 aa, Homo Sapiens
TFCDSQLRLLF

SEQ ID NO: 32040 - protein, 11 aa, Homo Sapiens
TFEDTGPLLQF

SEQ ID NO: 32041 - protein, 11 aa, Homo Sapiens
TFIRHIALLGF

SEQ ID NO: 32042 - protein, 11 aa, Homo Sapiens
TFLFPIQAKTF

SEQ ID NO: 32043 - protein, 11 aa, Homo Sapiens
TFLPKFLERQF

SEQ ID NO: 32044 - protein, 11 aa, Homo Sapiens
TFPNIASATKF

SEQ ID NO: 32045 - protein, 11 aa, Homo Sapiens
TWFTAGAKLLF

SEQ ID NO: 32046 - protein, 11 aa, Homo Sapiens
TWLVNSAAHLF

SEQ ID NO: 32047 - protein, 11 aa, Homo Sapiens
TWSADSKVLLF

SEQ ID NO: 32048 - protein, 11 aa, Homo Sapiens
TYAELMQTLRF

SEQ ID NO: 32049 - protein, 11 aa, Homo Sapiens
TYECIKEANLF

SEQ ID NO: 32050 - protein, 11 aa, Homo Sapiens
TYEPGFVGIRF

SEQ ID NO: 32051 - protein, 11 aa, Homo Sapiens
TYGDAGLTYTF

SEQ ID NO: 32052 - protein, 11 aa, Homo Sapiens
TYIHALDNGLF

SEQ ID NO: 32053 - protein, 11 aa, Homo Sapiens
TYIPSTQNPAF

SEQ ID NO: 32054 - protein, 11 aa, Homo Sapiens
TYLDLLGTWVF

SEQ ID NO: 32055 - protein, 11 aa, Homo Sapiens
TYLEAHRIVKM

SEQ ID NO: 32056 - protein, 11 aa, Homo Sapiens
TYLEKFQNLTY

SEQ ID NO: 32057 - protein, 11 aa, Homo Sapiens
TYLFPIQVKTF

SEQ ID NO: 32058 - protein, 11 aa, Homo Sapiens
TYLNQEDAVHF

SEQ ID NO: 32059 - protein, 11 aa, Homo Sapiens
TYLPAGQSVLL

SEQ ID NO: 32060 - protein, 11 aa, Homo Sapiens
TYLPREILNLI

SEQ ID NO: 32061 - protein, 11 aa, Homo Sapiens
TYMDAQLFKKV

SEQ ID NO: 32062 - protein, 11 aa, Homo Sapiens
TYPEGLEVLHF

SEQ ID NO: 32063 - protein, 11 aa, Homo Sapiens
TYSDEFGNLDF

SEQ ID NO: 32064 - protein, 11 aa, Homo Sapiens
TYTDVTPRQFF

SEQ ID NO: 32065 - protein, 11 aa, Homo Sapiens
TYVPVTTFKNL

SEQ ID NO: 32066 - protein, 11 aa, Homo Sapiens
VFEDLKKYLKF

SEQ ID NO: 32067 - protein, 11 aa, Homo Sapiens
VFHAHSSVLNF

SEQ ID NO: 32068 - protein, 11 aa, Homo Sapiens
VFIEGADAETF

SEQ ID NO: 32069 - protein, 11 aa, Homo Sapiens
VFIHKDKGFGF

SEQ ID NO: 32070 - protein, 11 aa, Homo Sapiens
VFINKGKGFGF

SEQ ID NO: 32071 - protein, 11 aa, Homo Sapiens
VFLDGNEVYVW

SEQ ID NO: 32072 - protein, 11 aa, Homo Sapiens
VFLTGTDRLQM

SEQ ID NO: 32073 - protein, 11 aa, Homo Sapiens
VFMDSNGIRQF

SEQ ID NO: 32074 - protein, 11 aa, Homo Sapiens
VFMKPGLPTTF

SEQ ID NO: 32075 - protein, 11 aa, Homo Sapiens
VFMPQHIMAIL

SEQ ID NO: 32076 - protein, 11 aa, Homo Sapiens
VFVQKEILDKF

SEQ ID NO: 32077 - protein, 11 aa, Homo Sapiens
VLPDADTLLHF

SEQ ID NO: 32078 - protein, 11 aa, Homo Sapiens
VMIGEDKLIHF

SEQ ID NO: 32079 - protein, 11 aa, Homo Sapiens
VMLGTQLLYKF

SEQ ID NO: 32080 - protein, 11 aa, Homo Sapiens
VVLDDKDYFLF

SEQ ID NO: 32081 - protein, 11 aa, Homo Sapiens
VWIKPGAEQSF

SEQ ID NO: 32082 - protein, 11 aa, Homo Sapiens
VYAHFPINVVI

SEQ ID NO: 32083 - protein, 11 aa, Homo Sapiens
VYAPPVGGFSF

SEQ ID NO: 32084 - protein, 11 aa, Homo Sapiens
VYCGKKAQLNI

SEQ ID NO: 32085 - protein, 11 aa, Homo Sapiens
VYCIPVGTHEF

SEQ ID NO: 32086 - protein, 11 aa, Homo Sapiens
VYEDQVGKFDW

SEQ ID NO: 32087 - protein, 11 aa, Homo Sapiens
VYEEILHQILL

SEQ ID NO: 32088 - protein, 11 aa, Homo Sapiens
VYELERILNRF

SEQ ID NO: 32089 - protein, 11 aa, Homo Sapiens
VYFQARLYHTL

SEQ ID NO: 32090 - protein, 11 aa, Homo Sapiens
VYIKEDKLEKL

SEQ ID NO: 32091 - protein, 11 aa, Homo Sapiens
VYILKGGYERF

SEQ ID NO: 32092 - protein, 11 aa, Homo Sapiens
VYILKGMIDQI

SEQ ID NO: 32093 - protein, 11 aa, Homo Sapiens
VYIPSRVALIL

SEQ ID NO: 32094 - protein, 11 aa, Homo Sapiens
VYISEENFRVM

SEQ ID NO: 32095 - protein, 11 aa, Homo Sapiens
VYISSSAGARW

SEQ ID NO: 32096 - protein, 11 aa, Homo Sapiens
VYITGKEVFSF

SEQ ID NO: 32097 - protein, 11 aa, Homo Sapiens
VYLDGHLITTV

SEQ ID NO: 32098 - protein, 11 aa, Homo Sapiens
VYLDPLVFREF

SEQ ID NO: 32099 - protein, 11 aa, Homo Sapiens
VYLPASSPCTL

SEQ ID NO: 32100 - protein, 11 aa, Homo Sapiens
VYLPEAMPASF

SEQ ID NO: 32101 - protein, 11 aa, Homo Sapiens
VYLTPESKSSF

SEQ ID NO: 32102 - protein, 11 aa, Homo Sapiens
VYMPASSYQSL

SEQ ID NO: 32103 - protein, 11 aa, Homo Sapiens
VYNDIGKEMLL

SEQ ID NO: 32104 - protein, 11 aa, Homo Sapiens
VYNTVSEGTHF

SEQ ID NO: 32105 - protein, 11 aa, Homo Sapiens
VYPANERFWYF

SEQ ID NO: 32106 - protein, 11 aa, Homo Sapiens
VYPASKMFPFI

SEQ ID NO: 32107 - protein, 11 aa, Homo Sapiens
VYPPPHQVFTW

SEQ ID NO: 32108 - protein, 11 aa, Homo Sapiens
VYPSRAVITTM

SEQ ID NO: 32109 - protein, 11 aa, Homo Sapiens
VYQEPIPTAQL

SEQ ID NO: 32110 - protein, 11 aa, Homo Sapiens
VYQVGGVTAYF

SEQ ID NO: 32111 - protein, 11 aa, Homo Sapiens
VYQYGSALAHF

SEQ ID NO: 32112 - protein, 11 aa, Homo Sapiens
VYRRFTEIYEF

SEQ ID NO: 32113 - protein, 11 aa, Homo Sapiens
VYSEAARVLQF

SEQ ID NO: 32114 - protein, 11 aa, Homo Sapiens
VYSPAIKDSTM

SEQ ID NO: 32115 - protein, 11 aa, Homo Sapiens
VYSPLGSAYKL

SEQ ID NO: 32116 - protein, 11 aa, Homo Sapiens
VYSQIPAAVKL

SEQ ID NO: 32117 - protein, 11 aa, Homo Sapiens
VYTPVASRQSL

SEQ ID NO: 32118 - protein, 11 aa, Homo Sapiens
VYVDLGGSHVF

SEQ ID NO: 32119 - protein, 11 aa, Homo Sapiens
VYVIEPHSMEF

SEQ ID NO: 32120 - protein, 11 aa, Homo Sapiens
VYVTSPLVNNF

SEQ ID NO: 32121 - protein, 11 aa, Homo Sapiens
VYVWIYDPVHF

SEQ ID NO: 32122 - protein, 11 aa, Homo Sapiens
WYVHPQVLQSF

SEQ ID NO: 32123 - protein, 11 aa, Homo Sapiens
YFVGKEHANYF

SEQ ID NO: 32124 - protein, 11 aa, Homo Sapiens
YHPSKGYWWHF

SEQ ID NO: 32125 - protein, 11 aa, Homo Sapiens
YWVGEDSTYKF

SEQ ID NO: 32126 - protein, 11 aa, Homo Sapiens
YYEEESCMRYL

SEQ ID NO: 32127 - protein, 11 aa, Homo Sapiens
YYESDTLLHSF

SEQ ID NO: 32128 - protein, 11 aa, Homo Sapiens
YYIEGIENSVF

SEQ ID NO: 32129 - protein, 11 aa, Homo Sapiens
YYLHQNNIVHL

SEQ ID NO: 32130 - protein, 11 aa, Homo Sapiens
YYLPDGSTIEI

SEQ ID NO: 32131 - protein, 11 aa, Homo Sapiens
YYPSTPGRYSI

SEQ ID NO: 32132 - protein, 11 aa, Homo Sapiens
YYSPHGHILVL

SEQ ID NO: 32133 - protein, 11 aa, Homo Sapiens
YYVPRGFWKQF

SEQ ID NO: 32134 - protein, 8 aa, Homo Sapiens
FSPVGSVL

SEQ ID NO: 32135 - protein, 8 aa, Homo Sapiens
FYGHFFRF

SEQ ID NO: 32136 - protein, 8 aa, Homo Sapiens
FYGNVSRF

SEQ ID NO: 32137 - protein, 8 aa, Homo Sapiens
IYTIINSI

SEQ ID NO: 32138 - protein, 8 aa, Homo Sapiens
KYGPIRQI

SEQ ID NO: 32139 - protein, 8 aa, Homo Sapiens
KYGPVFSF

SEQ ID NO: 32140 - protein, 8 aa, Homo Sapiens
LPKLYVKL

SEQ ID NO: 32141 - protein, 8 aa, Homo Sapiens
LYGQVQVF

SEQ ID NO: 32142 - protein, 8 aa, Homo Sapiens
PNLAFLRF

SEQ ID NO: 32143 - protein, 8 aa, Homo Sapiens
RYFKGYFL

SEQ ID NO: 32144 - protein, 8 aa, Homo Sapiens
TYGGSWKF

SEQ ID NO: 32145 - protein, 8 aa, Homo Sapiens
TYGSIALI

SEQ ID NO: 32146 - protein, 8 aa, Homo Sapiens
TYPNTYIF

SEQ ID NO: 32147 - protein, 8 aa, Homo Sapiens
VFFKGFKW

SEQ ID NO: 32148 - protein, 8 aa, Homo Sapiens
VYTTTVHW

SEQ ID NO: 32149 - protein, 8 aa, Homo Sapiens
YVHMVTHF

SEQ ID NO: 32150 - protein, 8 aa, Homo Sapiens
YYNTAVKL

SEQ ID NO: 32151 - protein, 9 aa, Homo Sapiens
AFHPTAQLL

SEQ ID NO: 32152 - protein, 9 aa, Homo Sapiens
AFIEKHWTF

SEQ ID NO: 32153 - protein, 9 aa, Homo Sapiens
AFIQKSNLI

SEQ ID NO: 32154 - protein, 9 aa, Homo Sapiens
AFLKVSSVF

SEQ ID NO: 32155 - protein, 9 aa, Homo Sapiens
AFMVNGQKF

SEQ ID NO: 32156 - protein, 9 aa, Homo Sapiens
AFNPEPLVL

SEQ ID NO: 32157 - protein, 9 aa, Homo Sapiens
ALPAAFHTW

SEQ ID NO: 32158 - protein, 9 aa, Homo Sapiens
ALPKELPLI

SEQ ID NO: 32159 - protein, 9 aa, Homo Sapiens
ALPSKLPTF

SEQ ID NO: 32160 - protein, 9 aa, Homo Sapiens
ALPSKVPAF

SEQ ID NO: 32161 - protein, 9 aa, Homo Sapiens
ALPYFWEHF

SEQ ID NO: 32162 - protein, 9 aa, Homo Sapiens
ALSSVYLLL

SEQ ID NO: 32163 - protein, 9 aa, Homo Sapiens
AWYDRFWLF

SEQ ID NO: 32164 - protein, 9 aa, Homo Sapiens
AYADVQAVL

SEQ ID NO: 32165 - protein, 9 aa, Homo Sapiens
AYAENIALL

SEQ ID NO: 32166 - protein, 9 aa, Homo Sapiens
AYAIIKEEL

SEQ ID NO: 32167 - protein, 9 aa, Homo Sapiens
AYAKFYTLL

SEQ ID NO: 32168 - protein, 9 aa, Homo Sapiens
AYALLLQHL

SEQ ID NO: 32169 - protein, 9 aa, Homo Sapiens
AYDDKIYYF

SEQ ID NO: 32170 - protein, 9 aa, Homo Sapiens
AYDTVRWEF

SEQ ID NO: 32171 - protein, 9 aa, Homo Sapiens
AYDVLFHQW

SEQ ID NO: 32172 - protein, 9 aa, Homo Sapiens
AYFLKPKEL

SEQ ID NO: 32173 - protein, 9 aa, Homo Sapiens
AYFTETEKF

SEQ ID NO: 32174 - protein, 9 aa, Homo Sapiens
AYFYGPIFI

SEQ ID NO: 32175 - protein, 9 aa, Homo Sapiens
AYGASFLSF

SEQ ID NO: 32176 - protein, 9 aa, Homo Sapiens
AYGDIILTF

SEQ ID NO: 32177 - protein, 9 aa, Homo Sapiens
AYGEFLSRL

SEQ ID NO: 32178 - protein, 9 aa, Homo Sapiens
AYGGAFYAF

SEQ ID NO: 32179 - protein, 9 aa, Homo Sapiens
AYGHFSYEF

SEQ ID NO: 32180 - protein, 9 aa, Homo Sapiens
AYGKDFHLI

SEQ ID NO: 32181 - protein, 9 aa, Homo Sapiens
AYGLDFYIL

SEQ ID NO: 32182 - protein, 9 aa, Homo Sapiens
AYGLVSATF

SEQ ID NO: 32183 - protein, 9 aa, Homo Sapiens
AYGNVFSAF

SEQ ID NO: 32184 - protein, 9 aa, Homo Sapiens
AYGQVVFRL

SEQ ID NO: 32185 - protein, 9 aa, Homo Sapiens
AYGSLFNTI

SEQ ID NO: 32186 - protein, 9 aa, Homo Sapiens
AYGWVSATF

SEQ ID NO: 32187 - protein, 9 aa, Homo Sapiens
AYHNSPAYL

SEQ ID NO: 32188 - protein, 9 aa, Homo Sapiens
AYIADHLGF

SEQ ID NO: 32189 - protein, 9 aa, Homo Sapiens
AYIDYLSHL

SEQ ID NO: 32190 - protein, 9 aa, Homo Sapiens
AYIERMNSI

SEQ ID NO: 32191 - protein, 9 aa, Homo Sapiens
AYIERMNYI

SEQ ID NO: 32192 - protein, 9 aa, Homo Sapiens
AYIGFIQSL

SEQ ID NO: 32193 - protein, 9 aa, Homo Sapiens
AYILDTLVF

SEQ ID NO: 32194 - protein, 9 aa, Homo Sapiens
AYINRASLL

SEQ ID NO: 32195 - protein, 9 aa, Homo Sapiens
AYIPKLLQL

SEQ ID NO: 32196 - protein, 9 aa, Homo Sapiens
AYIPTPIYF

SEQ ID NO: 32197 - protein, 9 aa, Homo Sapiens
AYIQESATF

SEQ ID NO: 32198 - protein, 9 aa, Homo Sapiens
AYISGLDVF

SEQ ID NO: 32199 - protein, 9 aa, Homo Sapiens
AYITGLCFI

SEQ ID NO: 32200 - protein, 9 aa, Homo Sapiens
AYKDFLWFF

SEQ ID NO: 32201 - protein, 9 aa, Homo Sapiens
AYKPGALTF

SEQ ID NO: 32202 - protein, 9 aa, Homo Sapiens
AYKPPGFSL

SEQ ID NO: 32203 - protein, 9 aa, Homo Sapiens
AYKYIQELW

SEQ ID NO: 32204 - protein, 9 aa, Homo Sapiens
AYLALFLKL

SEQ ID NO: 32205 - protein, 9 aa, Homo Sapiens
AYLDALQTL

SEQ ID NO: 32206 - protein, 9 aa, Homo Sapiens
AYLDKISEL

SEQ ID NO: 32207 - protein, 9 aa, Homo Sapiens
AYLEAHETF

SEQ ID NO: 32208 - protein, 9 aa, Homo Sapiens
AYLEAIHNF

SEQ ID NO: 32209 - protein, 9 aa, Homo Sapiens
AYLEALSHL

SEQ ID NO: 32210 - protein, 9 aa, Homo Sapiens
AYLEAYKEF

SEQ ID NO: 32211 - protein, 9 aa, Homo Sapiens
AYLECIERI

SEQ ID NO: 32212 - protein, 9 aa, Homo Sapiens
AYLESFYKF

SEQ ID NO: 32213 - protein, 9 aa, Homo Sapiens
AYLIDIKTI

SEQ ID NO: 32214 - protein, 9 aa, Homo Sapiens
AYLITLGKF

SEQ ID NO: 32215 - protein, 9 aa, Homo Sapiens
AYLKAIVLF

SEQ ID NO: 32216 - protein, 9 aa, Homo Sapiens
AYLKEVEQL

SEQ ID NO: 32217 - protein, 9 aa, Homo Sapiens
AYLKFLDQF

SEQ ID NO: 32218 - protein, 9 aa, Homo Sapiens
AYLKWISQI

SEQ ID NO: 32219 - protein, 9 aa, Homo Sapiens
AYLPTGKQF

SEQ ID NO: 32220 - protein, 9 aa, Homo Sapiens
AYLPVNESF

SEQ ID NO: 32221 - protein, 9 aa, Homo Sapiens
AYLQLFTKL

SEQ ID NO: 32222 - protein, 9 aa, Homo Sapiens
AYLQLLNLF

SEQ ID NO: 32223 - protein, 9 aa, Homo Sapiens
AYLSEAMKL

SEQ ID NO: 32224 - protein, 9 aa, Homo Sapiens
AYLSGMLRF

SEQ ID NO: 32225 - protein, 9 aa, Homo Sapiens
AYLSKAMEI

SEQ ID NO: 32226 - protein, 9 aa, Homo Sapiens
AYLVNTYAL

SEQ ID NO: 32227 - protein, 9 aa, Homo Sapiens
AYMAAFNSI

SEQ ID NO: 32228 - protein, 9 aa, Homo Sapiens
AYMEDAPLL

SEQ ID NO: 32229 - protein, 9 aa, Homo Sapiens
AYMKSLLSL

SEQ ID NO: 32230 - protein, 9 aa, Homo Sapiens
AYMPHTFFI

SEQ ID NO: 32231 - protein, 9 aa, Homo Sapiens
AYNDKIVAF

SEQ ID NO: 32232 - protein, 9 aa, Homo Sapiens
AYNPVTHQL

SEQ ID NO: 32233 - protein, 9 aa, Homo Sapiens
AYNRIVDAL

SEQ ID NO: 32234 - protein, 9 aa, Homo Sapiens
AYPEYLITF

SEQ ID NO: 32235 - protein, 9 aa, Homo Sapiens
AYPHNLMTF

SEQ ID NO: 32236 - protein, 9 aa, Homo Sapiens
AYPIIFTAW

SEQ ID NO: 32237 - protein, 9 aa, Homo Sapiens
AYPTAYPSF

SEQ ID NO: 32238 - protein, 9 aa, Homo Sapiens
AYPTVKFYF

SEQ ID NO: 32239 - protein, 9 aa, Homo Sapiens
AYPYNFSNL

SEQ ID NO: 32240 - protein, 9 aa, Homo Sapiens
AYQHAFLYI

SEQ ID NO: 32241 - protein, 9 aa, Homo Sapiens
AYQKQPTIF

SEQ ID NO: 32242 - protein, 9 aa, Homo Sapiens
AYQLMTDVF

SEQ ID NO: 32243 - protein, 9 aa, Homo Sapiens
AYSAKIALF

SEQ ID NO: 32244 - protein, 9 aa, Homo Sapiens
AYSIVAGVF

SEQ ID NO: 32245 - protein, 9 aa, Homo Sapiens
AYSLNFPLL

SEQ ID NO: 32246 - protein, 9 aa, Homo Sapiens
AYSPAIQMF

SEQ ID NO: 32247 - protein, 9 aa, Homo Sapiens
AYSPRFLYI

SEQ ID NO: 32248 - protein, 9 aa, Homo Sapiens
AYSVEHNQL

SEQ ID NO: 32249 - protein, 9 aa, Homo Sapiens
AYSYPIATL

SEQ ID NO: 32250 - protein, 9 aa, Homo Sapiens
AYTDCIPQL

SEQ ID NO: 32251 - protein, 9 aa, Homo Sapiens
AYTLIAPNI

SEQ ID NO: 32252 - protein, 9 aa, Homo Sapiens
AYTLLGHEF

SEQ ID NO: 32253 - protein, 9 aa, Homo Sapiens
AYTLLLHTW

SEQ ID NO: 32254 - protein, 9 aa, Homo Sapiens
AYTPFHAVL

SEQ ID NO: 32255 - protein, 9 aa, Homo Sapiens
AYTPVLNQF

SEQ ID NO: 32256 - protein, 9 aa, Homo Sapiens
AYTPVVVTL

SEQ ID NO: 32257 - protein, 9 aa, Homo Sapiens
AYTSQFVSL

SEQ ID NO: 32258 - protein, 9 aa, Homo Sapiens
AYVGDLQTL

SEQ ID NO: 32259 - protein, 9 aa, Homo Sapiens
AYVGDVPIL

SEQ ID NO: 32260 - protein, 9 aa, Homo Sapiens
AYVGNLPRI

SEQ ID NO: 32261 - protein, 9 aa, Homo Sapiens
AYVHMVTHF

SEQ ID NO: 32262 - protein, 9 aa, Homo Sapiens
AYVPGFAHI

SEQ ID NO: 32263 - protein, 9 aa, Homo Sapiens
AYVTVLEGF

SEQ ID NO: 32264 - protein, 9 aa, Homo Sapiens
AYVVFVSTL

SEQ ID NO: 32265 - protein, 9 aa, Homo Sapiens
AYVVFVTTL

SEQ ID NO: 32266 - protein, 9 aa, Homo Sapiens
CYAELGTTI

SEQ ID NO: 32267 - protein, 9 aa, Homo Sapiens
CYIKILHQL

SEQ ID NO: 32268 - protein, 9 aa, Homo Sapiens
CYLLQVDEF

SEQ ID NO: 32269 - protein, 9 aa, Homo Sapiens
CYNPMTNQW

SEQ ID NO: 32270 - protein, 9 aa, Homo Sapiens
CYVLFSYSF

SEQ ID NO: 32271 - protein, 9 aa, Homo Sapiens
CYVQPQWVF

SEQ ID NO: 32272 - protein, 9 aa, Homo Sapiens
DGAGKYFLW

SEQ ID NO: 32273 - protein, 9 aa, Homo Sapiens
DYAELLQHF

SEQ ID NO: 32274 - protein, 9 aa, Homo Sapiens
DYAVVLNQL

SEQ ID NO: 32275 - protein, 9 aa, Homo Sapiens
DYAYLREHF

SEQ ID NO: 32276 - protein, 9 aa, Homo Sapiens
DYFVPLHHF

SEQ ID NO: 32277 - protein, 9 aa, Homo Sapiens
DYGIVADLF

SEQ ID NO: 32278 - protein, 9 aa, Homo Sapiens
DYIDTIWKI

SEQ ID NO: 32279 - protein, 9 aa, Homo Sapiens
DYILNVMKF

SEQ ID NO: 32280 - protein, 9 aa, Homo Sapiens
DYIPQLAKF

SEQ ID NO: 32281 - protein, 9 aa, Homo Sapiens
DYKNTFPKW

SEQ ID NO: 32282 - protein, 9 aa, Homo Sapiens
DYKPSFPKW

SEQ ID NO: 32283 - protein, 9 aa, Homo Sapiens
DYLEHITSI

SEQ ID NO: 32284 - protein, 9 aa, Homo Sapiens
DYLEWPEYF

SEQ ID NO: 32285 - protein, 9 aa, Homo Sapiens
DYLPSFCKW

SEQ ID NO: 32286 - protein, 9 aa, Homo Sapiens
DYLQEVPIL

SEQ ID NO: 32287 - protein, 9 aa, Homo Sapiens
DYLRDPVTI

SEQ ID NO: 32288 - protein, 9 aa, Homo Sapiens
DYNFVFTSF

SEQ ID NO: 32289 - protein, 9 aa, Homo Sapiens
DYPRYLFEI

SEQ ID NO: 32290 - protein, 9 aa, Homo Sapiens
DYPSKMEYF

SEQ ID NO: 32291 - protein, 9 aa, Homo Sapiens
DYSDIVTTL

SEQ ID NO: 32292 - protein, 9 aa, Homo Sapiens
DYSRIIQSW

SEQ ID NO: 32293 - protein, 9 aa, Homo Sapiens
DYSSILQKF

SEQ ID NO: 32294 - protein, 9 aa, Homo Sapiens
DYVEGLRVF

SEQ ID NO: 32295 - protein, 9 aa, Homo Sapiens
EFLPFHFLL

SEQ ID NO: 32296 - protein, 9 aa, Homo Sapiens
EFLTKTAKF

SEQ ID NO: 32297 - protein, 9 aa, Homo Sapiens
EFMPQGAVF

SEQ ID NO: 32298 - protein, 9 aa, Homo Sapiens
ELPDYYLTI

SEQ ID NO: 32299 - protein, 9 aa, Homo Sapiens
ELPKHYFSF

SEQ ID NO: 32300 - protein, 9 aa, Homo Sapiens
EPSVSIPFL

SEQ ID NO: 32301 - protein, 9 aa, Homo Sapiens
EQPETYYKW

SEQ ID NO: 32302 - protein, 9 aa, Homo Sapiens
EWASRFWLW

SEQ ID NO: 32303 - protein, 9 aa, Homo Sapiens
EWIPLAWKW

SEQ ID NO: 32304 - protein, 9 aa, Homo Sapiens
EWLNKFNTF

SEQ ID NO: 32305 - protein, 9 aa, Homo Sapiens
EYALWNYLF

SEQ ID NO: 32306 - protein, 9 aa, Homo Sapiens
EYAVLTSTI

SEQ ID NO: 32307 - protein, 9 aa, Homo Sapiens
EYAVMLYTW

SEQ ID NO: 32308 - protein, 9 aa, Homo Sapiens
EYDLIVHQL

SEQ ID NO: 32309 - protein, 9 aa, Homo Sapiens
EYDNFFQHL

SEQ ID NO: 32310 - protein, 9 aa, Homo Sapiens
EYGFYHDFF

SEQ ID NO: 32311 - protein, 9 aa, Homo Sapiens
EYGRILTRL

SEQ ID NO: 32312 - protein, 9 aa, Homo Sapiens
EYHTPWYLF

SEQ ID NO: 32313 - protein, 9 aa, Homo Sapiens
EYIIEYPHF

SEQ ID NO: 32314 - protein, 9 aa, Homo Sapiens
EYIKFLRSI

SEQ ID NO: 32315 - protein, 9 aa, Homo Sapiens
EYIPKWEQF

SEQ ID NO: 32316 - protein, 9 aa, Homo Sapiens
EYIQFVPLL

SEQ ID NO: 32317 - protein, 9 aa, Homo Sapiens
EYIQKNVQL

SEQ ID NO: 32318 - protein, 9 aa, Homo Sapiens
EYIRSLNQF

SEQ ID NO: 32319 - protein, 9 aa, Homo Sapiens
EYISTVKTL

SEQ ID NO: 32320 - protein, 9 aa, Homo Sapiens
EYLENALKL

SEQ ID NO: 32321 - protein, 9 aa, Homo Sapiens
EYLERAPEL

SEQ ID NO: 32322 - protein, 9 aa, Homo Sapiens
EYLGSMAKI

SEQ ID NO: 32323 - protein, 9 aa, Homo Sapiens
EYLIKVNEI

SEQ ID NO: 32324 - protein, 9 aa, Homo Sapiens
EYLIVFPKL

SEQ ID NO: 32325 - protein, 9 aa, Homo Sapiens
EYLKLLHSF

SEQ ID NO: 32326 - protein, 9 aa, Homo Sapiens
EYLMQLNTI

SEQ ID NO: 32327 - protein, 9 aa, Homo Sapiens
EYLQEVARI

SEQ ID NO: 32328 - protein, 9 aa, Homo Sapiens
EYLQLLNLL

SEQ ID NO: 32329 - protein, 9 aa, Homo Sapiens
EYLRFLQTI

SEQ ID NO: 32330 - protein, 9 aa, Homo Sapiens
EYLRQIFRL

SEQ ID NO: 32331 - protein, 9 aa, Homo Sapiens
EYLTKVDKL

SEQ ID NO: 32332 - protein, 9 aa, Homo Sapiens
EYLYFFRVL

SEQ ID NO: 32333 - protein, 9 aa, Homo Sapiens
EYMKHTRLF

SEQ ID NO: 32334 - protein, 9 aa, Homo Sapiens
EYMPIKLKI

SEQ ID NO: 32335 - protein, 9 aa, Homo Sapiens
EYNNNFHVL

SEQ ID NO: 32336 - protein, 9 aa, Homo Sapiens
EYNQWFTKL

SEQ ID NO: 32337 - protein, 9 aa, Homo Sapiens
EYNSALPLL

SEQ ID NO: 32338 - protein, 9 aa, Homo Sapiens
EYNSDLHQF

SEQ ID NO: 32339 - protein, 9 aa, Homo Sapiens
EYQIKTNQL

SEQ ID NO: 32340 - protein, 9 aa, Homo Sapiens
EYRPEFSNF

SEQ ID NO: 32341 - protein, 9 aa, Homo Sapiens
EYSIVIQQL

SEQ ID NO: 32342 - protein, 9 aa, Homo Sapiens
EYSKQMQRF

SEQ ID NO: 32343 - protein, 9 aa, Homo Sapiens
EYTAKIALL

SEQ ID NO: 32344 - protein, 9 aa, Homo Sapiens
EYTDVYPEI

SEQ ID NO: 32345 - protein, 9 aa, Homo Sapiens
EYTGYSFKF

SEQ ID NO: 32346 - protein, 9 aa, Homo Sapiens
EYTRALFLL

SEQ ID NO: 32347 - protein, 9 aa, Homo Sapiens
EYTRYLFAL

SEQ ID NO: 32348 - protein, 9 aa, Homo Sapiens
EYTSILHLF

SEQ ID NO: 32349 - protein, 9 aa, Homo Sapiens
EYVANLTNL

SEQ ID NO: 32350 - protein, 9 aa, Homo Sapiens
EYVEKFYRI

SEQ ID NO: 32351 - protein, 9 aa, Homo Sapiens
EYVKFLHKF

SEQ ID NO: 32352 - protein, 9 aa, Homo Sapiens
EYVSQHLVF

SEQ ID NO: 32353 - protein, 9 aa, Homo Sapiens
FFIAGRYEF

SEQ ID NO: 32354 - protein, 9 aa, Homo Sapiens
FFIDQANYF

SEQ ID NO: 32355 - protein, 9 aa, Homo Sapiens
FFKDRHWLF

SEQ ID NO: 32356 - protein, 9 aa, Homo Sapiens
FHISRLFYF

SEQ ID NO: 32357 - protein, 9 aa, Homo Sapiens
FLPFPLPLF

SEQ ID NO: 32358 - protein, 9 aa, Homo Sapiens
FLYAPTILL

SEQ ID NO: 32359 - protein, 9 aa, Homo Sapiens
FSPFHASVL

SEQ ID NO: 32360 - protein, 9 aa, Homo Sapiens
FVITPILLI

SEQ ID NO: 32361 - protein, 9 aa, Homo Sapiens
FWIPYIHNL

SEQ ID NO: 32362 - protein, 9 aa, Homo Sapiens
FYAELYHII

SEQ ID NO: 32363 - protein, 9 aa, Homo Sapiens
FYAHIIPFL

SEQ ID NO: 32364 - protein, 9 aa, Homo Sapiens
FYGDKMNLF

SEQ ID NO: 32365 - protein, 9 aa, Homo Sapiens
FYGKYTAEI

SEQ ID NO: 32366 - protein, 9 aa, Homo Sapiens
FYHDFFTNI

SEQ ID NO: 32367 - protein, 9 aa, Homo Sapiens
FYHEAVVLF

SEQ ID NO: 32368 - protein, 9 aa, Homo Sapiens
FYIESISYL

SEQ ID NO: 32369 - protein, 9 aa, Homo Sapiens
FYINGQYQF

SEQ ID NO: 32370 - protein, 9 aa, Homo Sapiens
FYIPKIQDL

SEQ ID NO: 32371 - protein, 9 aa, Homo Sapiens
FYISPVNKL

SEQ ID NO: 32372 - protein, 9 aa, Homo Sapiens
FYITSRTQF

SEQ ID NO: 32373 - protein, 9 aa, Homo Sapiens
FYLFDLKAF

SEQ ID NO: 32374 - protein, 9 aa, Homo Sapiens
FYLLISKTF

SEQ ID NO: 32375 - protein, 9 aa, Homo Sapiens
FYLPSSPNL

SEQ ID NO: 32376 - protein, 9 aa, Homo Sapiens
FYLRDPIDL

SEQ ID NO: 32377 - protein, 9 aa, Homo Sapiens
FYMDTSHLF

SEQ ID NO: 32378 - protein, 9 aa, Homo Sapiens
FYNLLTRTF

SEQ ID NO: 32379 - protein, 9 aa, Homo Sapiens
FYNPFQFEI

SEQ ID NO: 32380 - protein, 9 aa, Homo Sapiens
FYPIYFRPL

SEQ ID NO: 32381 - protein, 9 aa, Homo Sapiens
FYPPKVELF

SEQ ID NO: 32382 - protein, 9 aa, Homo Sapiens
FYPYGLQTF

SEQ ID NO: 32383 - protein, 9 aa, Homo Sapiens
FYQILIYDF

SEQ ID NO: 32384 - protein, 9 aa, Homo Sapiens
FYQPKIQQF

SEQ ID NO: 32385 - protein, 9 aa, Homo Sapiens
FYQRFPLSF

SEQ ID NO: 32386 - protein, 9 aa, Homo Sapiens
FYSISQERF

SEQ ID NO: 32387 - protein, 9 aa, Homo Sapiens
FYSQPDHLF

SEQ ID NO: 32388 - protein, 9 aa, Homo Sapiens
FYSRLLQKF

SEQ ID NO: 32389 - protein, 9 aa, Homo Sapiens
FYTAIAQAF

SEQ ID NO: 32390 - protein, 9 aa, Homo Sapiens
FYTFPFQQL

SEQ ID NO: 32391 - protein, 9 aa, Homo Sapiens
FYTKDLIVM

SEQ ID NO: 32392 - protein, 9 aa, Homo Sapiens
FYTKRFQEL

SEQ ID NO: 32393 - protein, 9 aa, Homo Sapiens
FYTPAPPGF

SEQ ID NO: 32394 - protein, 9 aa, Homo Sapiens
FYTVIPHNF

SEQ ID NO: 32395 - protein, 9 aa, Homo Sapiens
FYVDTVRAF

SEQ ID NO: 32396 - protein, 9 aa, Homo Sapiens
FYVRGLFSF

SEQ ID NO: 32397 - protein, 9 aa, Homo Sapiens
GFQVKAYTF

SEQ ID NO: 32398 - protein, 9 aa, Homo Sapiens
GHNGWVTQI

SEQ ID NO: 32399 - protein, 9 aa, Homo Sapiens
GYADIVQLL

SEQ ID NO: 32400 - protein, 9 aa, Homo Sapiens
GYASRFIVI

SEQ ID NO: 32401 - protein, 9 aa, Homo Sapiens
GYIERPQLI

SEQ ID NO: 32402 - protein, 9 aa, Homo Sapiens
GYIESVQHI

SEQ ID NO: 32403 - protein, 9 aa, Homo Sapiens
GYIKGIFGF

SEQ ID NO: 32404 - protein, 9 aa, Homo Sapiens
GYLADPAKF

SEQ ID NO: 32405 - protein, 9 aa, Homo Sapiens
GYLPLAHVL

SEQ ID NO: 32406 - protein, 9 aa, Homo Sapiens
GYLRSVFAL

SEQ ID NO: 32407 - protein, 9 aa, Homo Sapiens
GYLTLVPLL

SEQ ID NO: 32408 - protein, 9 aa, Homo Sapiens
GYNVKFDMF

SEQ ID NO: 32409 - protein, 9 aa, Homo Sapiens
GYPEVALHF

SEQ ID NO: 32410 - protein, 9 aa, Homo Sapiens
GYVVWQEVF

SEQ ID NO: 32411 - protein, 9 aa, Homo Sapiens
HAPFTATSL

SEQ ID NO: 32412 - protein, 9 aa, Homo Sapiens
HAPLTNIPL

SEQ ID NO: 32413 - protein, 9 aa, Homo Sapiens
HFHPSVALF

SEQ ID NO: 32414 - protein, 9 aa, Homo Sapiens
HFIEIHHHL

SEQ ID NO: 32415 - protein, 9 aa, Homo Sapiens
HFLDRHLVF

SEQ ID NO: 32416 - protein, 9 aa, Homo Sapiens
HWAEICETF

SEQ ID NO: 32417 - protein, 9 aa, Homo Sapiens
HYAALAHYF

SEQ ID NO: 32418 - protein, 9 aa, Homo Sapiens
HYALNTWLF

SEQ ID NO: 32419 - protein, 9 aa, Homo Sapiens
HYATLYFVF

SEQ ID NO: 32420 - protein, 9 aa, Homo Sapiens
HYFNTPFQL

SEQ ID NO: 32421 - protein, 9 aa, Homo Sapiens
HYHPIVQRF

SEQ ID NO: 32422 - protein, 9 aa, Homo Sapiens
HYIDDLVVI

SEQ ID NO: 32423 - protein, 9 aa, Homo Sapiens
HYILHNSFF

SEQ ID NO: 32424 - protein, 9 aa, Homo Sapiens
HYINMPVQF

SEQ ID NO: 32425 - protein, 9 aa, Homo Sapiens
HYIPRAVLL

SEQ ID NO: 32426 - protein, 9 aa, Homo Sapiens
HYIRKYNRF

SEQ ID NO: 32427 - protein, 9 aa, Homo Sapiens
HYIYIENQF

SEQ ID NO: 32428 - protein, 9 aa, Homo Sapiens
HYKPTPLYF

SEQ ID NO: 32429 - protein, 9 aa, Homo Sapiens
HYLNHWNHF

SEQ ID NO: 32430 - protein, 9 aa, Homo Sapiens
HYLNVAFDL

SEQ ID NO: 32431 - protein, 9 aa, Homo Sapiens
HYLPYYYSI

SEQ ID NO: 32432 - protein, 9 aa, Homo Sapiens
HYNWLIYHL

SEQ ID NO: 32433 - protein, 9 aa, Homo Sapiens
HYPPVQVLF

SEQ ID NO: 32434 - protein, 9 aa, Homo Sapiens
HYSENMFSF

SEQ ID NO: 32435 - protein, 9 aa, Homo Sapiens
HYSFYIETF

SEQ ID NO: 32436 - protein, 9 aa, Homo Sapiens
HYSLFPLLF

SEQ ID NO: 32437 - protein, 9 aa, Homo Sapiens
HYSPIYLSF

SEQ ID NO: 32438 - protein, 9 aa, Homo Sapiens
HYTIVFNTF

SEQ ID NO: 32439 - protein, 9 aa, Homo Sapiens
HYTYILEVF

SEQ ID NO: 32440 - protein, 9 aa, Homo Sapiens
HYVAGLVGI

SEQ ID NO: 32441 - protein, 9 aa, Homo Sapiens
IFFENHPYF

SEQ ID NO: 32442 - protein, 9 aa, Homo Sapiens
IFFPGVSEF

SEQ ID NO: 32443 - protein, 9 aa, Homo Sapiens
IFGVIIDTF

SEQ ID NO: 32444 - protein, 9 aa, Homo Sapiens
IFHDISLRF

SEQ ID NO: 32445 - protein, 9 aa, Homo Sapiens
IFHEVPLKF

SEQ ID NO: 32446 - protein, 9 aa, Homo Sapiens
IFIKDSNSL

SEQ ID NO: 32447 - protein, 9 aa, Homo Sapiens
IFIRNVLLF

SEQ ID NO: 32448 - protein, 9 aa, Homo Sapiens
IFKDKPIKL

SEQ ID NO: 32449 - protein, 9 aa, Homo Sapiens
IFLNKTFQW

SEQ ID NO: 32450 - protein, 9 aa, Homo Sapiens
IFLSQPILL

SEQ ID NO: 32451 - protein, 9 aa, Homo Sapiens
IFLTKANLI

SEQ ID NO: 32452 - protein, 9 aa, Homo Sapiens
IFNGFSVTL

SEQ ID NO: 32453 - protein, 9 aa, Homo Sapiens
IFPLETPAF

SEQ ID NO: 32454 - protein, 9 aa, Homo Sapiens
IFPPSMHFF

SEQ ID NO: 32455 - protein, 9 aa, Homo Sapiens
IFQDVLLQF

SEQ ID NO: 32456 - protein, 9 aa, Homo Sapiens
IFSIKPLQF

SEQ ID NO: 32457 - protein, 9 aa, Homo Sapiens
IFSKIVSLF

SEQ ID NO: 32458 - protein, 9 aa, Homo Sapiens
IFTDIFHYL

SEQ ID NO: 32459 - protein, 9 aa, Homo Sapiens
IFTDLSSRF

SEQ ID NO: 32460 - protein, 9 aa, Homo Sapiens
IFTDVALKF

SEQ ID NO: 32461 - protein, 9 aa, Homo Sapiens
IFTPKPTLF

SEQ ID NO: 32462 - protein, 9 aa, Homo Sapiens
IGVIAYILL

SEQ ID NO: 32463 - protein, 9 aa, Homo Sapiens
IHPSLLPSF

SEQ ID NO: 32464 - protein, 9 aa, Homo Sapiens
IISSVIQKF

SEQ ID NO: 32465 - protein, 9 aa, Homo Sapiens
IITPIHEQW

SEQ ID NO: 32466 - protein, 9 aa, Homo Sapiens
ILGPPPPSF

SEQ ID NO: 32467 - protein, 9 aa, Homo Sapiens
ILPCQVPVW

SEQ ID NO: 32468 - protein, 9 aa, Homo Sapiens
ILPEIIPIL

SEQ ID NO: 32469 - protein, 9 aa, Homo Sapiens
ILPGSLFRF

SEQ ID NO: 32470 - protein, 9 aa, Homo Sapiens
ILPKELQTW

SEQ ID NO: 32471 - protein, 9 aa, Homo Sapiens
ILPPQLALF

SEQ ID NO: 32472 - protein, 9 aa, Homo Sapiens
ILPQFLYQF

SEQ ID NO: 32473 - protein, 9 aa, Homo Sapiens
ILSPLLLLF

SEQ ID NO: 32474 - protein, 9 aa, Homo Sapiens
ILTERGYSF

SEQ ID NO: 32475 - protein, 9 aa, Homo Sapiens
IMPEKFEFW

SEQ ID NO: 32476 - protein, 9 aa, Homo Sapiens
IMPSSSHLF

SEQ ID NO: 32477 - protein, 9 aa, Homo Sapiens
IMPTIFNLI

SEQ ID NO: 32478 - protein, 9 aa, Homo Sapiens
IPPSLNPII

SEQ ID NO: 32479 - protein, 9 aa, Homo Sapiens
IQERAFFLF

SEQ ID NO: 32480 - protein, 9 aa, Homo Sapiens
IQVRYLKII

SEQ ID NO: 32481 - protein, 9 aa, Homo Sapiens
ITPYGYFLI

SEQ ID NO: 32482 - protein, 9 aa, Homo Sapiens
ITSPYLITL

SEQ ID NO: 32483 - protein, 9 aa, Homo Sapiens
IWISKLPHF

SEQ ID NO: 32484 - protein, 9 aa, Homo Sapiens
IWLPFPVLL

SEQ ID NO: 32485 - protein, 9 aa, Homo Sapiens
IWPEKSFCL

SEQ ID NO: 32486 - protein, 9 aa, Homo Sapiens
IWPSSIPNL

SEQ ID NO: 32487 - protein, 9 aa, Homo Sapiens
IYAAFKEVL

SEQ ID NO: 32488 - protein, 9 aa, Homo Sapiens
IYAAVTPEL

SEQ ID NO: 32489 - protein, 9 aa, Homo Sapiens
IYAGQMAVL

SEQ ID NO: 32490 - protein, 9 aa, Homo Sapiens
IYAIHVEGL

SEQ ID NO: 32491 - protein, 9 aa, Homo Sapiens
IYAPPLPSL

SEQ ID NO: 32492 - protein, 9 aa, Homo Sapiens
IYAPQGLLL

SEQ ID NO: 32493 - protein, 9 aa, Homo Sapiens
IYAPTLLVF

SEQ ID NO: 32494 - protein, 9 aa, Homo Sapiens
IYATEAHVF

SEQ ID NO: 32495 - protein, 9 aa, Homo Sapiens
IYATIMDFF

SEQ ID NO: 32496 - protein, 9 aa, Homo Sapiens
IYDIVRNSW

SEQ ID NO: 32497 - protein, 9 aa, Homo Sapiens
IYDSVKVYF

SEQ ID NO: 32498 - protein, 9 aa, Homo Sapiens
IYELAVASF

SEQ ID NO: 32499 - protein, 9 aa, Homo Sapiens
IYELMQTEF

SEQ ID NO: 32500 - protein, 9 aa, Homo Sapiens
IYELRTYKL

SEQ ID NO: 32501 - protein, 9 aa, Homo Sapiens
IYEPNFIFF

SEQ ID NO: 32502 - protein, 9 aa, Homo Sapiens
IYFEYSHAF

SEQ ID NO: 32503 - protein, 9 aa, Homo Sapiens
IYFKNSENL

SEQ ID NO: 32504 - protein, 9 aa, Homo Sapiens
IYFSNTHFF

SEQ ID NO: 32505 - protein, 9 aa, Homo Sapiens
IYGEKTYAF

SEQ ID NO: 32506 - protein, 9 aa, Homo Sapiens
IYGLIVALL

SEQ ID NO: 32507 - protein, 9 aa, Homo Sapiens
IYGYVAEQF

SEQ ID NO: 32508 - protein, 9 aa, Homo Sapiens
IYHDLEQSI

SEQ ID NO: 32509 - protein, 9 aa, Homo Sapiens
IYHGLATLL

SEQ ID NO: 32510 - protein, 9 aa, Homo Sapiens
IYHNGVLEF

SEQ ID NO: 32511 - protein, 9 aa, Homo Sapiens
IYHPNVDKL

SEQ ID NO: 32512 - protein, 9 aa, Homo Sapiens
IYIAGHPAF

SEQ ID NO: 32513 - protein, 9 aa, Homo Sapiens
IYIDRFEDL

SEQ ID NO: 32514 - protein, 9 aa, Homo Sapiens
IYIDRGVVF

SEQ ID NO: 32515 - protein, 9 aa, Homo Sapiens
IYIINVHSM

SEQ ID NO: 32516 - protein, 9 aa, Homo Sapiens
IYIKHPHLF

SEQ ID NO: 32517 - protein, 9 aa, Homo Sapiens
IYIKQIKTF

SEQ ID NO: 32518 - protein, 9 aa, Homo Sapiens
IYILDPELL

SEQ ID NO: 32519 - protein, 9 aa, Homo Sapiens
IYIPSYFDF

SEQ ID NO: 32520 - protein, 9 aa, Homo Sapiens
IYIPTLAVL

SEQ ID NO: 32521 - protein, 9 aa, Homo Sapiens
IYITGSSII

SEQ ID NO: 32522 - protein, 9 aa, Homo Sapiens
IYKEDFNEL

SEQ ID NO: 32523 - protein, 9 aa, Homo Sapiens
IYKIDFVRF

SEQ ID NO: 32524 - protein, 9 aa, Homo Sapiens
IYKPVTDFF

SEQ ID NO: 32525 - protein, 9 aa, Homo Sapiens
IYLDGIITI

SEQ ID NO: 32526 - protein, 9 aa, Homo Sapiens
IYLDLPQNF

SEQ ID NO: 32527 - protein, 9 aa, Homo Sapiens
IYLDSVMCL

SEQ ID NO: 32528 - protein, 9 aa, Homo Sapiens
IYLDTHFRL

SEQ ID NO: 32529 - protein, 9 aa, Homo Sapiens
IYLEKLKTI

SEQ ID NO: 32530 - protein, 9 aa, Homo Sapiens
IYLERFPIF

SEQ ID NO: 32531 - protein, 9 aa, Homo Sapiens
IYLGQLECF

SEQ ID NO: 32532 - protein, 9 aa, Homo Sapiens
IYLLIHNNF

SEQ ID NO: 32533 - protein, 9 aa, Homo Sapiens
IYLPAAQTM

SEQ ID NO: 32534 - protein, 9 aa, Homo Sapiens
IYLPEVRKI

SEQ ID NO: 32535 - protein, 9 aa, Homo Sapiens
IYLPYLHEW

SEQ ID NO: 32536 - protein, 9 aa, Homo Sapiens
IYLPYLQNW

SEQ ID NO: 32537 - protein, 9 aa, Homo Sapiens
IYLRDPVQV

SEQ ID NO: 32538 - protein, 9 aa, Homo Sapiens
IYLRLLVKL

SEQ ID NO: 32539 - protein, 9 aa, Homo Sapiens
IYLTFPVAM

SEQ ID NO: 32540 - protein, 9 aa, Homo Sapiens
IYMDTLNIF

SEQ ID NO: 32541 - protein, 9 aa, Homo Sapiens
IYMFNMTGL

SEQ ID NO: 32542 - protein, 9 aa, Homo Sapiens
IYMNLASHI

SEQ ID NO: 32543 - protein, 9 aa, Homo Sapiens
IYNFPIHAF

SEQ ID NO: 32544 - protein, 9 aa, Homo Sapiens
IYNGDMEKI

SEQ ID NO: 32545 - protein, 9 aa, Homo Sapiens
IYNPAFFKY

SEQ ID NO: 32546 - protein, 9 aa, Homo Sapiens
IYNQVNVVL

SEQ ID NO: 32547 - protein, 9 aa, Homo Sapiens
IYNYPEQLF

SEQ ID NO: 32548 - protein, 9 aa, Homo Sapiens
IYPDSFTVL

SEQ ID NO: 32549 - protein, 9 aa, Homo Sapiens
IYPEVVHMF

SEQ ID NO: 32550 - protein, 9 aa, Homo Sapiens
IYPHGLVLL

SEQ ID NO: 32551 - protein, 9 aa, Homo Sapiens
IYPKLLDNF

SEQ ID NO: 32552 - protein, 9 aa, Homo Sapiens
IYPPKLHQF

SEQ ID NO: 32553 - protein, 9 aa, Homo Sapiens
IYPRAPDLF

SEQ ID NO: 32554 - protein, 9 aa, Homo Sapiens
IYPSIFHVL

SEQ ID NO: 32555 - protein, 9 aa, Homo Sapiens
IYPSLIYII

SEQ ID NO: 32556 - protein, 9 aa, Homo Sapiens
IYPTAPPRF

SEQ ID NO: 32557 - protein, 9 aa, Homo Sapiens
IYPVNAISF

SEQ ID NO: 32558 - protein, 9 aa, Homo Sapiens
IYPWVHVVI

SEQ ID NO: 32559 - protein, 9 aa, Homo Sapiens
IYPYVIQEL

SEQ ID NO: 32560 - protein, 9 aa, Homo Sapiens
IYQDVTLKW

SEQ ID NO: 32561 - protein, 9 aa, Homo Sapiens
IYQDWHSFL

SEQ ID NO: 32562 - protein, 9 aa, Homo Sapiens
IYQEVWNLF

SEQ ID NO: 32563 - protein, 9 aa, Homo Sapiens
IYQKAFEHL

SEQ ID NO: 32564 - protein, 9 aa, Homo Sapiens
IYQKPFQTL

SEQ ID NO: 32565 - protein, 9 aa, Homo Sapiens
IYQQIIQTY

SEQ ID NO: 32566 - protein, 9 aa, Homo Sapiens
IYQQNHMVL

SEQ ID NO: 32567 - protein, 9 aa, Homo Sapiens
IYQRDPLKL

SEQ ID NO: 32568 - protein, 9 aa, Homo Sapiens
IYQRHVYNL

SEQ ID NO: 32569 - protein, 9 aa, Homo Sapiens
IYQRWKDLL

SEQ ID NO: 32570 - protein, 9 aa, Homo Sapiens
IYQWICDNF

SEQ ID NO: 32571 - protein, 9 aa, Homo Sapiens
IYQYIQSRF

SEQ ID NO: 32572 - protein, 9 aa, Homo Sapiens
IYRWFNISF

SEQ ID NO: 32573 - protein, 9 aa, Homo Sapiens
IYSEMIHNL

SEQ ID NO: 32574 - protein, 9 aa, Homo Sapiens
IYSEVATLI

SEQ ID NO: 32575 - protein, 9 aa, Homo Sapiens
IYSIDFTRF

SEQ ID NO: 32576 - protein, 9 aa, Homo Sapiens
IYSTAFDYF

SEQ ID NO: 32577 - protein, 9 aa, Homo Sapiens
IYSTKLYRF

SEQ ID NO: 32578 - protein, 9 aa, Homo Sapiens
IYSWFTRTF

SEQ ID NO: 32579 - protein, 9 aa, Homo Sapiens
IYSYGFATI

SEQ ID NO: 32580 - protein, 9 aa, Homo Sapiens
IYTDIIYIF

SEQ ID NO: 32581 - protein, 9 aa, Homo Sapiens
IYTDITYSF

SEQ ID NO: 32582 - protein, 9 aa, Homo Sapiens
IYTEVRELV

SEQ ID NO: 32583 - protein, 9 aa, Homo Sapiens
IYTFPHASF

SEQ ID NO: 32584 - protein, 9 aa, Homo Sapiens
IYTMIYRNL

SEQ ID NO: 32585 - protein, 9 aa, Homo Sapiens
IYTNQNVVW

SEQ ID NO: 32586 - protein, 9 aa, Homo Sapiens
IYTPIFNEY

SEQ ID NO: 32587 - protein, 9 aa, Homo Sapiens
IYTRLLPAL

SEQ ID NO: 32588 - protein, 9 aa, Homo Sapiens
IYTSSVNRL

SEQ ID NO: 32589 - protein, 9 aa, Homo Sapiens
IYTSWIDCW

SEQ ID NO: 32590 - protein, 9 aa, Homo Sapiens
IYTWIEDHF

SEQ ID NO: 32591 - protein, 9 aa, Homo Sapiens
IYVGRVKSF

SEQ ID NO: 32592 - protein, 9 aa, Homo Sapiens
IYVHDLLTF

SEQ ID NO: 32593 - protein, 9 aa, Homo Sapiens
IYVISAETF

SEQ ID NO: 32594 - protein, 9 aa, Homo Sapiens
IYWDGPLAL

SEQ ID NO: 32595 - protein, 9 aa, Homo Sapiens
IYWTKYYDF

SEQ ID NO: 32596 - protein, 9 aa, Homo Sapiens
IYYFKANVF

SEQ ID NO: 32597 - protein, 9 aa, Homo Sapiens
IYYIDMQKF

SEQ ID NO: 32598 - protein, 9 aa, Homo Sapiens
IYYVDVQKF

SEQ ID NO: 32599 - protein, 9 aa, Homo Sapiens
KAPEPLSSL

SEQ ID NO: 32600 - protein, 9 aa, Homo Sapiens
KFAEEFYSF

SEQ ID NO: 32601 - protein, 9 aa, Homo Sapiens
KFFEEVLLF

SEQ ID NO: 32602 - protein, 9 aa, Homo Sapiens
KFIDTTSKF

SEQ ID NO: 32603 - protein, 9 aa, Homo Sapiens
KFIWTNHKF

SEQ ID NO: 32604 - protein, 9 aa, Homo Sapiens
KFMPVSSLI

SEQ ID NO: 32605 - protein, 9 aa, Homo Sapiens
KFSNVTMLF

SEQ ID NO: 32606 - protein, 9 aa, Homo Sapiens
KFSPNTSQF

SEQ ID NO: 32607 - protein, 9 aa, Homo Sapiens
KFSPRPLKF

SEQ ID NO: 32608 - protein, 9 aa, Homo Sapiens
KFVETHPEF

SEQ ID NO: 32609 - protein, 9 aa, Homo Sapiens
KLPDVYGVF

SEQ ID NO: 32610 - protein, 9 aa, Homo Sapiens
KLPSNLPQL

SEQ ID NO: 32611 - protein, 9 aa, Homo Sapiens
KMLDNFYNF

SEQ ID NO: 32612 - protein, 9 aa, Homo Sapiens
KQALKYFNL

SEQ ID NO: 32613 - protein, 9 aa, Homo Sapiens
KQLTWFYTF

SEQ ID NO: 32614 - protein, 9 aa, Homo Sapiens
KQPEDYFYL

SEQ ID NO: 32615 - protein, 9 aa, Homo Sapiens
KTNHVFFLL

SEQ ID NO: 32616 - protein, 9 aa, Homo Sapiens
KWFDFKLFF

SEQ ID NO: 32617 - protein, 9 aa, Homo Sapiens
KWFFQKLRF

SEQ ID NO: 32618 - protein, 9 aa, Homo Sapiens
KWFTGPQLI

SEQ ID NO: 32619 - protein, 9 aa, Homo Sapiens
KWLTKSFHF

SEQ ID NO: 32620 - protein, 9 aa, Homo Sapiens
KYAMMFAEL

SEQ ID NO: 32621 - protein, 9 aa, Homo Sapiens
KYEELFPAF

SEQ ID NO: 32622 - protein, 9 aa, Homo Sapiens
KYFEKQFEL

SEQ ID NO: 32623 - protein, 9 aa, Homo Sapiens
KYFHPPAHL

SEQ ID NO: 32624 - protein, 9 aa, Homo Sapiens
KYFLWEEKF

SEQ ID NO: 32625 - protein, 9 aa, Homo Sapiens
KYFLWVVKF

SEQ ID NO: 32626 - protein, 9 aa, Homo Sapiens
KYFQLDVTL

SEQ ID NO: 32627 - protein, 9 aa, Homo Sapiens
KYGALVNNF

SEQ ID NO: 32628 - protein, 9 aa, Homo Sapiens
KYGDIIFDF

SEQ ID NO: 32629 - protein, 9 aa, Homo Sapiens
KYGIQMPAF

SEQ ID NO: 32630 - protein, 9 aa, Homo Sapiens
KYGIVLKEF

SEQ ID NO: 32631 - protein, 9 aa, Homo Sapiens
KYGIVQEFF

SEQ ID NO: 32632 - protein, 9 aa, Homo Sapiens
KYGMVTYLL

SEQ ID NO: 32633 - protein, 9 aa, Homo Sapiens
KYIDFDHVF

SEQ ID NO: 32634 - protein, 9 aa, Homo Sapiens
KYIDKTIRV

SEQ ID NO: 32635 - protein, 9 aa, Homo Sapiens
KYIDQKFVL

SEQ ID NO: 32636 - protein, 9 aa, Homo Sapiens
KYIDYIFNV

SEQ ID NO: 32637 - protein, 9 aa, Homo Sapiens
KYIDYLMTW

SEQ ID NO: 32638 - protein, 9 aa, Homo Sapiens
KYIEGVSDF

SEQ ID NO: 32639 - protein, 9 aa, Homo Sapiens
KYIESPVLF

SEQ ID NO: 32640 - protein, 9 aa, Homo Sapiens
KYIHSANVL

SEQ ID NO: 32641 - protein, 9 aa, Homo Sapiens
KYIKDDFRF

SEQ ID NO: 32642 - protein, 9 aa, Homo Sapiens
KYILVVPLI

SEQ ID NO: 32643 - protein, 9 aa, Homo Sapiens
KYIMDLERL

SEQ ID NO: 32644 - protein, 9 aa, Homo Sapiens
KYINTDAKF

SEQ ID NO: 32645 - protein, 9 aa, Homo Sapiens
KYIQEAEML

SEQ ID NO: 32646 - protein, 9 aa, Homo Sapiens
KYIQRQETI

SEQ ID NO: 32647 - protein, 9 aa, Homo Sapiens
KYISGPHEL

SEQ ID NO: 32648 - protein, 9 aa, Homo Sapiens
KYISKPENL

SEQ ID NO: 32649 - protein, 9 aa, Homo Sapiens
KYLADLPTL

SEQ ID NO: 32650 - protein, 9 aa, Homo Sapiens
KYLATLETL

SEQ ID NO: 32651 - protein, 9 aa, Homo Sapiens
KYLEESNFV

SEQ ID NO: 32652 - protein, 9 aa, Homo Sapiens
KYLEHPLLL

SEQ ID NO: 32653 - protein, 9 aa, Homo Sapiens
KYLGQLHYL

SEQ ID NO: 32654 - protein, 9 aa, Homo Sapiens
KYLGQLTSI

SEQ ID NO: 32655 - protein, 9 aa, Homo Sapiens
KYLHPPPHL

SEQ ID NO: 32656 - protein, 9 aa, Homo Sapiens
KYLLHSLVF

SEQ ID NO: 32657 - protein, 9 aa, Homo Sapiens
KYLLSSIQW

SEQ ID NO: 32658 - protein, 9 aa, Homo Sapiens
KYLMALKNL

SEQ ID NO: 32659 - protein, 9 aa, Homo Sapiens
KYLMELTLI

SEQ ID NO: 32660 - protein, 9 aa, Homo Sapiens
KYLPALDEF

SEQ ID NO: 32661 - protein, 9 aa, Homo Sapiens
KYLPEWSAW

SEQ ID NO: 32662 - protein, 9 aa, Homo Sapiens
KYLQSTISF

SEQ ID NO: 32663 - protein, 9 aa, Homo Sapiens
KYLSGIAHF

SEQ ID NO: 32664 - protein, 9 aa, Homo Sapiens
KYLSVQGQL

SEQ ID NO: 32665 - protein, 9 aa, Homo Sapiens
KYLTVKDYL

SEQ ID NO: 32666 - protein, 9 aa, Homo Sapiens
KYLVIGDLL

SEQ ID NO: 32667 - protein, 9 aa, Homo Sapiens
KYMAEALLL

SEQ ID NO: 32668 - protein, 9 aa, Homo Sapiens
KYMDINFDF

SEQ ID NO: 32669 - protein, 9 aa, Homo Sapiens
KYMDVQFDF

SEQ ID NO: 32670 - protein, 9 aa, Homo Sapiens
KYMEDVTQI

SEQ ID NO: 32671 - protein, 9 aa, Homo Sapiens
KYMLKANLI

SEQ ID NO: 32672 - protein, 9 aa, Homo Sapiens
KYMSVIAEL

SEQ ID NO: 32673 - protein, 9 aa, Homo Sapiens
KYMVYPQTF

SEQ ID NO: 32674 - protein, 9 aa, Homo Sapiens
KYNDNFFGL

SEQ ID NO: 32675 - protein, 9 aa, Homo Sapiens
KYNETFQFI

SEQ ID NO: 32676 - protein, 9 aa, Homo Sapiens
KYNFPLVTL

SEQ ID NO: 32677 - protein, 9 aa, Homo Sapiens
KYNKILNKY

SEQ ID NO: 32678 - protein, 9 aa, Homo Sapiens
KYNLINEYF

SEQ ID NO: 32679 - protein, 9 aa, Homo Sapiens
KYNPTWHCI

SEQ ID NO: 32680 - protein, 9 aa, Homo Sapiens
KYPASTVQI

SEQ ID NO: 32681 - protein, 9 aa, Homo Sapiens
KYPDIISRI

SEQ ID NO: 32682 - protein, 9 aa, Homo Sapiens
KYPDRVPVI

SEQ ID NO: 32683 - protein, 9 aa, Homo Sapiens
KYPDYEVTW

SEQ ID NO: 32684 - protein, 9 aa, Homo Sapiens
KYPENFFLL

SEQ ID NO: 32685 - protein, 9 aa, Homo Sapiens
KYPHYFPLL

SEQ ID NO: 32686 - protein, 9 aa, Homo Sapiens
KYPHYFPVM

SEQ ID NO: 32687 - protein, 9 aa, Homo Sapiens
KYPLLLREI

SEQ ID NO: 32688 - protein, 9 aa, Homo Sapiens
KYPNVFKKI

SEQ ID NO: 32689 - protein, 9 aa, Homo Sapiens
KYPQLLPGI

SEQ ID NO: 32690 - protein, 9 aa, Homo Sapiens
KYPSPFFVF

SEQ ID NO: 32691 - protein, 9 aa, Homo Sapiens
KYPYVAVML

SEQ ID NO: 32692 - protein, 9 aa, Homo Sapiens
KYQAVTATL

SEQ ID NO: 32693 - protein, 9 aa, Homo Sapiens
KYQDILNEI

SEQ ID NO: 32694 - protein, 9 aa, Homo Sapiens
KYQELQVLF

SEQ ID NO: 32695 - protein, 9 aa, Homo Sapiens
KYQEVTNNL

SEQ ID NO: 32696 - protein, 9 aa, Homo Sapiens
KYQIINEEF

SEQ ID NO: 32697 - protein, 9 aa, Homo Sapiens
KYQYWAVVF

SEQ ID NO: 32698 - protein, 9 aa, Homo Sapiens
KYSDITIMF

SEQ ID NO: 32699 - protein, 9 aa, Homo Sapiens
KYSEIQQLL

SEQ ID NO: 32700 - protein, 9 aa, Homo Sapiens
KYSEVFEAI

SEQ ID NO: 32701 - protein, 9 aa, Homo Sapiens
KYTDWTEFL

SEQ ID NO: 32702 - protein, 9 aa, Homo Sapiens
KYTGVLTEL

SEQ ID NO: 32703 - protein, 9 aa, Homo Sapiens
KYTKIFNDF

SEQ ID NO: 32704 - protein, 9 aa, Homo Sapiens
KYTPPPHHI

SEQ ID NO: 32705 - protein, 9 aa, Homo Sapiens
KYVENFGLI

SEQ ID NO: 32706 - protein, 9 aa, Homo Sapiens
KYVGAVQML

SEQ ID NO: 32707 - protein, 9 aa, Homo Sapiens
KYVHLFPKL

SEQ ID NO: 32708 - protein, 9 aa, Homo Sapiens
KYVKGLISI

SEQ ID NO: 32709 - protein, 9 aa, Homo Sapiens
KYVKIFDNF

SEQ ID NO: 32710 - protein, 9 aa, Homo Sapiens
KYVKVFDKF

SEQ ID NO: 32711 - protein, 9 aa, Homo Sapiens
KYVKVFHKF

SEQ ID NO: 32712 - protein, 9 aa, Homo Sapiens
KYVSSVLSF

SEQ ID NO: 32713 - protein, 9 aa, Homo Sapiens
KYWDTFYKI

SEQ ID NO: 32714 - protein, 9 aa, Homo Sapiens
LFIATSQKF

SEQ ID NO: 32715 - protein, 9 aa, Homo Sapiens
LFIDNIFRF

SEQ ID NO: 32716 - protein, 9 aa, Homo Sapiens
LFKNDPLFF

SEQ ID NO: 32717 - protein, 9 aa, Homo Sapiens
LFLPYSHFL

SEQ ID NO: 32718 - protein, 9 aa, Homo Sapiens
LFPGKAFSW

SEQ ID NO: 32719 - protein, 9 aa, Homo Sapiens
LIPEEFFQF

SEQ ID NO: 32720 - protein, 9 aa, Homo Sapiens
LIPIIVLLL

SEQ ID NO: 32721 - protein, 9 aa, Homo Sapiens
LLPGKTYSF

SEQ ID NO: 32722 - protein, 9 aa, Homo Sapiens
LLPHILPLL

SEQ ID NO: 32723 - protein, 9 aa, Homo Sapiens
LLPLIYHHL

SEQ ID NO: 32724 - protein, 9 aa, Homo Sapiens
LLPPVVWLL

SEQ ID NO: 32725 - protein, 9 aa, Homo Sapiens
LLPSRQFGF

SEQ ID NO: 32726 - protein, 9 aa, Homo Sapiens
LMSLIINTF

SEQ ID NO: 32727 - protein, 9 aa, Homo Sapiens
LQPERYELW

SEQ ID NO: 32728 - protein, 9 aa, Homo Sapiens
LQPFIYYRF

SEQ ID NO: 32729 - protein, 9 aa, Homo Sapiens
LQPKQFPFL

SEQ ID NO: 32730 - protein, 9 aa, Homo Sapiens
LSTYLVTII

SEQ ID NO: 32731 - protein, 9 aa, Homo Sapiens
LWYYGEHLF

SEQ ID NO: 32732 - protein, 9 aa, Homo Sapiens
LYAFIGVKF

SEQ ID NO: 32733 - protein, 9 aa, Homo Sapiens
LYANMFERL

SEQ ID NO: 32734 - protein, 9 aa, Homo Sapiens
LYDIILKNF

SEQ ID NO: 32735 - protein, 9 aa, Homo Sapiens
LYDIVFKHF

SEQ ID NO: 32736 - protein, 9 aa, Homo Sapiens
LYDPCTVMF

SEQ ID NO: 32737 - protein, 9 aa, Homo Sapiens
LYDPVISKL

SEQ ID NO: 32738 - protein, 9 aa, Homo Sapiens
LYELHVFTF

SEQ ID NO: 32739 - protein, 9 aa, Homo Sapiens
LYEPVWHVW

SEQ ID NO: 32740 - protein, 9 aa, Homo Sapiens
LYEQAFQLL

SEQ ID NO: 32741 - protein, 9 aa, Homo Sapiens
LYFHINQTL

SEQ ID NO: 32742 - protein, 9 aa, Homo Sapiens
LYFLKPSYW

SEQ ID NO: 32743 - protein, 9 aa, Homo Sapiens
LYGKIAEAF

SEQ ID NO: 32744 - protein, 9 aa, Homo Sapiens
LYGMQVLLF

SEQ ID NO: 32745 - protein, 9 aa, Homo Sapiens
LYGNIIDNL

SEQ ID NO: 32746 - protein, 9 aa, Homo Sapiens
LYGPKYTFF

SEQ ID NO: 32747 - protein, 9 aa, Homo Sapiens
LYGRHFNYL

SEQ ID NO: 32748 - protein, 9 aa, Homo Sapiens
LYGRLLVTF

SEQ ID NO: 32749 - protein, 9 aa, Homo Sapiens
LYGRNFNYL

SEQ ID NO: 32750 - protein, 9 aa, Homo Sapiens
LYGTIPQIF

SEQ ID NO: 32751 - protein, 9 aa, Homo Sapiens
LYHDIFSRL

SEQ ID NO: 32752 - protein, 9 aa, Homo Sapiens
LYIDFGGKF

SEQ ID NO: 32753 - protein, 9 aa, Homo Sapiens
LYIGHLTTL

SEQ ID NO: 32754 - protein, 9 aa, Homo Sapiens
LYIGSSKTF

SEQ ID NO: 32755 - protein, 9 aa, Homo Sapiens
LYIISVKGI

SEQ ID NO: 32756 - protein, 9 aa, Homo Sapiens
LYINKANIW

SEQ ID NO: 32757 - protein, 9 aa, Homo Sapiens
LYIPIFSTF

SEQ ID NO: 32758 - protein, 9 aa, Homo Sapiens
LYIPPTHTF

SEQ ID NO: 32759 - protein, 9 aa, Homo Sapiens
LYIPSVDLL

SEQ ID NO: 32760 - protein, 9 aa, Homo Sapiens
LYIQSHYQL

SEQ ID NO: 32761 - protein, 9 aa, Homo Sapiens
LYIVEPLKF

SEQ ID NO: 32762 - protein, 9 aa, Homo Sapiens
LYIVHPTMF

SEQ ID NO: 32763 - protein, 9 aa, Homo Sapiens
LYKDVRDLL

SEQ ID NO: 32764 - protein, 9 aa, Homo Sapiens
LYKELGEYF

SEQ ID NO: 32765 - protein, 9 aa, Homo Sapiens
LYKFSADEF

SEQ ID NO: 32766 - protein, 9 aa, Homo Sapiens
LYLECSAKF

SEQ ID NO: 32767 - protein, 9 aa, Homo Sapiens
LYLKLWNLI

SEQ ID NO: 32768 - protein, 9 aa, Homo Sapiens
LYLLNTTKL

SEQ ID NO: 32769 - protein, 9 aa, Homo Sapiens
LYLPSFFTY

SEQ ID NO: 32770 - protein, 9 aa, Homo Sapiens
LYLTIARQL

SEQ ID NO: 32771 - protein, 9 aa, Homo Sapiens
LYMDKFEEF

SEQ ID NO: 32772 - protein, 9 aa, Homo Sapiens
LYMKNGQGF

SEQ ID NO: 32773 - protein, 9 aa, Homo Sapiens
LYMNGMYAF

SEQ ID NO: 32774 - protein, 9 aa, Homo Sapiens
LYNDRMFRI

SEQ ID NO: 32775 - protein, 9 aa, Homo Sapiens
LYNKIREDF

SEQ ID NO: 32776 - protein, 9 aa, Homo Sapiens
LYNPENIYL

SEQ ID NO: 32777 - protein, 9 aa, Homo Sapiens
LYNPVSFAF

SEQ ID NO: 32778 - protein, 9 aa, Homo Sapiens
LYNRTMVQL

SEQ ID NO: 32779 - protein, 9 aa, Homo Sapiens
LYPAAIVTI

SEQ ID NO: 32780 - protein, 9 aa, Homo Sapiens
LYPCIDSHL

SEQ ID NO: 32781 - protein, 9 aa, Homo Sapiens
LYPDHFHLL

SEQ ID NO: 32782 - protein, 9 aa, Homo Sapiens
LYPEGLAQL

SEQ ID NO: 32783 - protein, 9 aa, Homo Sapiens
LYPEIFEKF

SEQ ID NO: 32784 - protein, 9 aa, Homo Sapiens
LYPEVFEKF

SEQ ID NO: 32785 - protein, 9 aa, Homo Sapiens
LYPFLGIRF

SEQ ID NO: 32786 - protein, 9 aa, Homo Sapiens
LYPGQLVQL

SEQ ID NO: 32787 - protein, 9 aa, Homo Sapiens
LYPGSVYLL

SEQ ID NO: 32788 - protein, 9 aa, Homo Sapiens
LYPHLSTYW

SEQ ID NO: 32789 - protein, 9 aa, Homo Sapiens
LYPLTNYTF

SEQ ID NO: 32790 - protein, 9 aa, Homo Sapiens
LYPPGIELI

SEQ ID NO: 32791 - protein, 9 aa, Homo Sapiens
LYPQFMFHL

SEQ ID NO: 32792 - protein, 9 aa, Homo Sapiens
LYPSKSIIL

SEQ ID NO: 32793 - protein, 9 aa, Homo Sapiens
LYQDGVFKF

SEQ ID NO: 32794 - protein, 9 aa, Homo Sapiens
LYQDHMQYI

SEQ ID NO: 32795 - protein, 9 aa, Homo Sapiens
LYQDKFPFF

SEQ ID NO: 32796 - protein, 9 aa, Homo Sapiens
LYQEHMAYI

SEQ ID NO: 32797 - protein, 9 aa, Homo Sapiens
LYQEILAQL

SEQ ID NO: 32798 - protein, 9 aa, Homo Sapiens
LYQEVFGRL

SEQ ID NO: 32799 - protein, 9 aa, Homo Sapiens
LYQFNPAFF

SEQ ID NO: 32800 - protein, 9 aa, Homo Sapiens
LYQHAVEYF

SEQ ID NO: 32801 - protein, 9 aa, Homo Sapiens
LYQHEINLF

SEQ ID NO: 32802 - protein, 9 aa, Homo Sapiens
LYQLQVNTL

SEQ ID NO: 32803 - protein, 9 aa, Homo Sapiens
LYQRAFQHL

SEQ ID NO: 32804 - protein, 9 aa, Homo Sapiens
LYQVVSQRF

SEQ ID NO: 32805 - protein, 9 aa, Homo Sapiens
LYRQYFEEI

SEQ ID NO: 32806 - protein, 9 aa, Homo Sapiens
LYSAVKTLL

SEQ ID NO: 32807 - protein, 9 aa, Homo Sapiens
LYSEVSHLL

SEQ ID NO: 32808 - protein, 9 aa, Homo Sapiens
LYSGVFVAF

SEQ ID NO: 32809 - protein, 9 aa, Homo Sapiens
LYSHINQTL

SEQ ID NO: 32810 - protein, 9 aa, Homo Sapiens
LYSLKQYFL

SEQ ID NO: 32811 - protein, 9 aa, Homo Sapiens
LYSSKLYRF

SEQ ID NO: 32812 - protein, 9 aa, Homo Sapiens
LYSTIRPYL

SEQ ID NO: 32813 - protein, 9 aa, Homo Sapiens
LYTEAIKFF

SEQ ID NO: 32814 - protein, 9 aa, Homo Sapiens
LYTEKFEEF

SEQ ID NO: 32815 - protein, 9 aa, Homo Sapiens
LYTELFTGF

SEQ ID NO: 32816 - protein, 9 aa, Homo Sapiens
LYTPEHHLI

SEQ ID NO: 32817 - protein, 9 aa, Homo Sapiens
LYTPHSWLL

SEQ ID NO: 32818 - protein, 9 aa, Homo Sapiens
LYTPKPQVI

SEQ ID NO: 32819 - protein, 9 aa, Homo Sapiens
LYTPVLIRF

SEQ ID NO: 32820 - protein, 9 aa, Homo Sapiens
LYTVVVYDF

SEQ ID NO: 32821 - protein, 9 aa, Homo Sapiens
LYVDFPQHL

SEQ ID NO: 32822 - protein, 9 aa, Homo Sapiens
LYVGKIPGF

SEQ ID NO: 32823 - protein, 9 aa, Homo Sapiens
LYVIGGNHF

SEQ ID NO: 32824 - protein, 9 aa, Homo Sapiens
LYVLQVLTF

SEQ ID NO: 32825 - protein, 9 aa, Homo Sapiens
LYVMVNAKF

SEQ ID NO: 32826 - protein, 9 aa, Homo Sapiens
LYVPVMITW

SEQ ID NO: 32827 - protein, 9 aa, Homo Sapiens
LYVVDLKKF

SEQ ID NO: 32828 - protein, 9 aa, Homo Sapiens
LYWSHPRKF

SEQ ID NO: 32829 - protein, 9 aa, Homo Sapiens
MWLPWALLL

SEQ ID NO: 32830 - protein, 9 aa, Homo Sapiens
MYGFVNHAL

SEQ ID NO: 32831 - protein, 9 aa, Homo Sapiens
MYIARQLSF

SEQ ID NO: 32832 - protein, 9 aa, Homo Sapiens
MYIIPVVLF

SEQ ID NO: 32833 - protein, 9 aa, Homo Sapiens
MYLGITPSI

SEQ ID NO: 32834 - protein, 9 aa, Homo Sapiens
MYLGWTPYM

SEQ ID NO: 32835 - protein, 9 aa, Homo Sapiens
MYLKQILYL

SEQ ID NO: 32836 - protein, 9 aa, Homo Sapiens
MYLLDQPVL

SEQ ID NO: 32837 - protein, 9 aa, Homo Sapiens
MYNLFWRHF

SEQ ID NO: 32838 - protein, 9 aa, Homo Sapiens
MYPCNFVSF

SEQ ID NO: 32839 - protein, 9 aa, Homo Sapiens
MYPFQIHSI

SEQ ID NO: 32840 - protein, 9 aa, Homo Sapiens
MYPYIFHVL

SEQ ID NO: 32841 - protein, 9 aa, Homo Sapiens
MYQEHINEI

SEQ ID NO: 32842 - protein, 9 aa, Homo Sapiens
MYSDVWKQL

SEQ ID NO: 32843 - protein, 9 aa, Homo Sapiens
MYTLGITNF

SEQ ID NO: 32844 - protein, 9 aa, Homo Sapiens
MYTPKAEVW

SEQ ID NO: 32845 - protein, 9 aa, Homo Sapiens
MYTVFEHTF

SEQ ID NO: 32846 - protein, 9 aa, Homo Sapiens
NFLSRSFYW

SEQ ID NO: 32847 - protein, 9 aa, Homo Sapiens
NFQIEHHLF

SEQ ID NO: 32848 - protein, 9 aa, Homo Sapiens
NFTNVAATF

SEQ ID NO: 32849 - protein, 9 aa, Homo Sapiens
NMTSVTNHF

SEQ ID NO: 32850 - protein, 9 aa, Homo Sapiens
NYAAALETF

SEQ ID NO: 32851 - protein, 9 aa, Homo Sapiens
NYAENILTL

SEQ ID NO: 32852 - protein, 9 aa, Homo Sapiens
NYALKMFLY

SEQ ID NO: 32853 - protein, 9 aa, Homo Sapiens
NYAPAFTML

SEQ ID NO: 32854 - protein, 9 aa, Homo Sapiens
NYASTFTWW

SEQ ID NO: 32855 - protein, 9 aa, Homo Sapiens
NYATRIVTL

SEQ ID NO: 32856 - protein, 9 aa, Homo Sapiens
NYAWVYYHL

SEQ ID NO: 32857 - protein, 9 aa, Homo Sapiens
NYDKVEKLF

SEQ ID NO: 32858 - protein, 9 aa, Homo Sapiens
NYFAYVQMF

SEQ ID NO: 32859 - protein, 9 aa, Homo Sapiens
NYFIPSHYF

SEQ ID NO: 32860 - protein, 9 aa, Homo Sapiens
NYFLWTEKF

SEQ ID NO: 32861 - protein, 9 aa, Homo Sapiens
NYGQYFTLW

SEQ ID NO: 32862 - protein, 9 aa, Homo Sapiens
NYGRVFSEW

SEQ ID NO: 32863 - protein, 9 aa, Homo Sapiens
NYGTIKWFF

SEQ ID NO: 32864 - protein, 9 aa, Homo Sapiens
NYGVLHVTF

SEQ ID NO: 32865 - protein, 9 aa, Homo Sapiens
NYIDKVRFL

SEQ ID NO: 32866 - protein, 9 aa, Homo Sapiens
NYIEFTRIL

SEQ ID NO: 32867 - protein, 9 aa, Homo Sapiens
NYIEKVVAI

SEQ ID NO: 32868 - protein, 9 aa, Homo Sapiens
NYIFRLSQF

SEQ ID NO: 32869 - protein, 9 aa, Homo Sapiens
NYIHVGAQL

SEQ ID NO: 32870 - protein, 9 aa, Homo Sapiens
NYIHWVEDL

SEQ ID NO: 32871 - protein, 9 aa, Homo Sapiens
NYIKDLNIL

SEQ ID NO: 32872 - protein, 9 aa, Homo Sapiens
NYIKSLSSF

SEQ ID NO: 32873 - protein, 9 aa, Homo Sapiens
NYIMKIHNF

SEQ ID NO: 32874 - protein, 9 aa, Homo Sapiens
NYIMQSHSL

SEQ ID NO: 32875 - protein, 9 aa, Homo Sapiens
NYIPRFWTF

SEQ ID NO: 32876 - protein, 9 aa, Homo Sapiens
NYIPYLTKL

SEQ ID NO: 32877 - protein, 9 aa, Homo Sapiens
NYISFYDHL

SEQ ID NO: 32878 - protein, 9 aa, Homo Sapiens
NYISGIQTI

SEQ ID NO: 32879 - protein, 9 aa, Homo Sapiens
NYITAALKL

SEQ ID NO: 32880 - protein, 9 aa, Homo Sapiens
NYITIKDFL

SEQ ID NO: 32881 - protein, 9 aa, Homo Sapiens
NYKKFYEQF

SEQ ID NO: 32882 - protein, 9 aa, Homo Sapiens
NYKLTSITF

SEQ ID NO: 32883 - protein, 9 aa, Homo Sapiens
NYLDVATFL

SEQ ID NO: 32884 - protein, 9 aa, Homo Sapiens
NYLDWLTSI

SEQ ID NO: 32885 - protein, 9 aa, Homo Sapiens
NYLGAIESW

SEQ ID NO: 32886 - protein, 9 aa, Homo Sapiens
NYLGLTNEL

SEQ ID NO: 32887 - protein, 9 aa, Homo Sapiens
NYLHLDYNF

SEQ ID NO: 32888 - protein, 9 aa, Homo Sapiens
NYLLDMPLW

SEQ ID NO: 32889 - protein, 9 aa, Homo Sapiens
NYLPFIMEL

SEQ ID NO: 32890 - protein, 9 aa, Homo Sapiens
NYLPQISHL

SEQ ID NO: 32891 - protein, 9 aa, Homo Sapiens
NYLSHHLTI

SEQ ID NO: 32892 - protein, 9 aa, Homo Sapiens
NYLSIFRKF

SEQ ID NO: 32893 - protein, 9 aa, Homo Sapiens
NYLVRINEI

SEQ ID NO: 32894 - protein, 9 aa, Homo Sapiens
NYMPGQLTI

SEQ ID NO: 32895 - protein, 9 aa, Homo Sapiens
NYNDRYDEI

SEQ ID NO: 32896 - protein, 9 aa, Homo Sapiens
NYNEKIYEL

SEQ ID NO: 32897 - protein, 9 aa, Homo Sapiens
NYNFDFRSW

SEQ ID NO: 32898 - protein, 9 aa, Homo Sapiens
NYNPAQQAF

SEQ ID NO: 32899 - protein, 9 aa, Homo Sapiens
NYPDEFTKL

SEQ ID NO: 32900 - protein, 9 aa, Homo Sapiens
NYPLLLLTL

SEQ ID NO: 32901 - protein, 9 aa, Homo Sapiens
NYPSAFHSV

SEQ ID NO: 32902 - protein, 9 aa, Homo Sapiens
NYPTKFQYL

SEQ ID NO: 32903 - protein, 9 aa, Homo Sapiens
NYPVWDTQF

SEQ ID NO: 32904 - protein, 9 aa, Homo Sapiens
NYQKRFQNL

SEQ ID NO: 32905 - protein, 9 aa, Homo Sapiens
NYQRLFDFF

SEQ ID NO: 32906 - protein, 9 aa, Homo Sapiens
NYSNIRFQF

SEQ ID NO: 32907 - protein, 9 aa, Homo Sapiens
NYSPYVNYF

SEQ ID NO: 32908 - protein, 9 aa, Homo Sapiens
NYTARFSRF

SEQ ID NO: 32909 - protein, 9 aa, Homo Sapiens
NYTDQWERW

SEQ ID NO: 32910 - protein, 9 aa, Homo Sapiens
NYTDRIQVL

SEQ ID NO: 32911 - protein, 9 aa, Homo Sapiens
NYTEWLQDL

SEQ ID NO: 32912 - protein, 9 aa, Homo Sapiens
NYTKAMRLF

SEQ ID NO: 32913 - protein, 9 aa, Homo Sapiens
NYTLVSHLI

SEQ ID NO: 32914 - protein, 9 aa, Homo Sapiens
NYVDLVSSL

SEQ ID NO: 32915 - protein, 9 aa, Homo Sapiens
NYVEVTRKW

SEQ ID NO: 32916 - protein, 9 aa, Homo Sapiens
NYVKKFQSF

SEQ ID NO: 32917 - protein, 9 aa, Homo Sapiens
NYVQAVEEF

SEQ ID NO: 32918 - protein, 9 aa, Homo Sapiens
NYYAFFKLL

SEQ ID NO: 32919 - protein, 9 aa, Homo Sapiens
PFAKPLPTF

SEQ ID NO: 32920 - protein, 9 aa, Homo Sapiens
PFAPAIQTF

SEQ ID NO: 32921 - protein, 9 aa, Homo Sapiens
PFIDSQHVI

SEQ ID NO: 32922 - protein, 9 aa, Homo Sapiens
PIRLLAAAA

SEQ ID NO: 32923 - protein, 9 aa, Homo Sapiens
PIRVHTIVI

SEQ ID NO: 32924 - protein, 9 aa, Homo Sapiens
PLPESVPVF

SEQ ID NO: 32925 - protein, 9 aa, Homo Sapiens
PQPDVFPLF

SEQ ID NO: 32926 - protein, 9 aa, Homo Sapiens
PTLFNPFLL

SEQ ID NO: 32927 - protein, 9 aa, Homo Sapiens
PVTVRSIIS

SEQ ID NO: 32928 - protein, 9 aa, Homo Sapiens
PWGIKQAGF

SEQ ID NO: 32929 - protein, 9 aa, Homo Sapiens
PWLFDAPKF

SEQ ID NO: 32930 - protein, 9 aa, Homo Sapiens
PYAVLLEAL

SEQ ID NO: 32931 - protein, 9 aa, Homo Sapiens
PYFLPEHIF

SEQ ID NO: 32932 - protein, 9 aa, Homo Sapiens
PYFNAPVYL

SEQ ID NO: 32933 - protein, 9 aa, Homo Sapiens
PYGPPLPSL

SEQ ID NO: 32934 - protein, 9 aa, Homo Sapiens
PYISNIYLI

SEQ ID NO: 32935 - protein, 9 aa, Homo Sapiens
PYKADILYF

SEQ ID NO: 32936 - protein, 9 aa, Homo Sapiens
PYKVTQDEL

SEQ ID NO: 32937 - protein, 9 aa, Homo Sapiens
PYLDNLPNF

SEQ ID NO: 32938 - protein, 9 aa, Homo Sapiens
PYLFHVVTF

SEQ ID NO: 32939 - protein, 9 aa, Homo Sapiens
PYLGQAPFL

SEQ ID NO: 32940 - protein, 9 aa, Homo Sapiens
PYLISGSKF

SEQ ID NO: 32941 - protein, 9 aa, Homo Sapiens
PYLLYSVHM

SEQ ID NO: 32942 - protein, 9 aa, Homo Sapiens
PYLWWKKYI

SEQ ID NO: 32943 - protein, 9 aa, Homo Sapiens
PYMDAVVSL

SEQ ID NO: 32944 - protein, 9 aa, Homo Sapiens
PYNAPTVKF

SEQ ID NO: 32945 - protein, 9 aa, Homo Sapiens
PYNDYFEYF

SEQ ID NO: 32946 - protein, 9 aa, Homo Sapiens
PYQSQIAVF

SEQ ID NO: 32947 - protein, 9 aa, Homo Sapiens
PYSEYFEYF

SEQ ID NO: 32948 - protein, 9 aa, Homo Sapiens
PYSSIDQLL

SEQ ID NO: 32949 - protein, 9 aa, Homo Sapiens
PYSVYLFSF

SEQ ID NO: 32950 - protein, 9 aa, Homo Sapiens
PYTGPFNLL

SEQ ID NO: 32951 - protein, 9 aa, Homo Sapiens
PYVDNSYKW

SEQ ID NO: 32952 - protein, 9 aa, Homo Sapiens
PYVGGLEEF

SEQ ID NO: 32953 - protein, 9 aa, Homo Sapiens
PYVNNVPHL

SEQ ID NO: 32954 - protein, 9 aa, Homo Sapiens
PYYQPPYTL

SEQ ID NO: 32955 - protein, 9 aa, Homo Sapiens
PYYSKFILI

SEQ ID NO: 32956 - protein, 9 aa, Homo Sapiens
QFIDKPVCF

SEQ ID NO: 32957 - protein, 9 aa, Homo Sapiens
QFVPKSHLF

SEQ ID NO: 32958 - protein, 9 aa, Homo Sapiens
QLPELFHKI

SEQ ID NO: 32959 - protein, 9 aa, Homo Sapiens
QLPVVVFTF

SEQ ID NO: 32960 - protein, 9 aa, Homo Sapiens
QWPELLLRF

SEQ ID NO: 32961 - protein, 9 aa, Homo Sapiens
QYASAFHFL

SEQ ID NO: 32962 - protein, 9 aa, Homo Sapiens
QYAVLLNRF

SEQ ID NO: 32963 - protein, 9 aa, Homo Sapiens
QYDGIFYEF

SEQ ID NO: 32964 - protein, 9 aa, Homo Sapiens
QYEPLFHML

SEQ ID NO: 32965 - protein, 9 aa, Homo Sapiens
QYEQVKQLF

SEQ ID NO: 32966 - protein, 9 aa, Homo Sapiens
QYFPKAPEF

SEQ ID NO: 32967 - protein, 9 aa, Homo Sapiens
QYGTFCEKF

SEQ ID NO: 32968 - protein, 9 aa, Homo Sapiens
QYIDKLNEL

SEQ ID NO: 32969 - protein, 9 aa, Homo Sapiens
QYILFPLRF

SEQ ID NO: 32970 - protein, 9 aa, Homo Sapiens
QYLEEAPKF

SEQ ID NO: 32971 - protein, 9 aa, Homo Sapiens
QYLEQSSKL

SEQ ID NO: 32972 - protein, 9 aa, Homo Sapiens
QYLGQIQHI

SEQ ID NO: 32973 - protein, 9 aa, Homo Sapiens
QYLMDNPTF

SEQ ID NO: 32974 - protein, 9 aa, Homo Sapiens
QYLQDAYSF

SEQ ID NO: 32975 - protein, 9 aa, Homo Sapiens
QYMERLQLL

SEQ ID NO: 32976 - protein, 9 aa, Homo Sapiens
QYNPKFQTL

SEQ ID NO: 32977 - protein, 9 aa, Homo Sapiens
QYNTYPIKL

SEQ ID NO: 32978 - protein, 9 aa, Homo Sapiens
QYPFPLPVF

SEQ ID NO: 32979 - protein, 9 aa, Homo Sapiens
QYPGRSLVF

SEQ ID NO: 32980 - protein, 9 aa, Homo Sapiens
QYPNPLPVL

SEQ ID NO: 32981 - protein, 9 aa, Homo Sapiens
QYPVIIHLI

SEQ ID NO: 32982 - protein, 9 aa, Homo Sapiens
QYQFLHHTL

SEQ ID NO: 32983 - protein, 9 aa, Homo Sapiens
QYQIIMTMI

SEQ ID NO: 32984 - protein, 9 aa, Homo Sapiens
QYQNVLTLW

SEQ ID NO: 32985 - protein, 9 aa, Homo Sapiens
QYQPPAPAL

SEQ ID NO: 32986 - protein, 9 aa, Homo Sapiens
QYQVQFWKM

SEQ ID NO: 32987 - protein, 9 aa, Homo Sapiens
QYSNAFDVF

SEQ ID NO: 32988 - protein, 9 aa, Homo Sapiens
QYSPLLAAF

SEQ ID NO: 32989 - protein, 9 aa, Homo Sapiens
QYSYIDFKF

SEQ ID NO: 32990 - protein, 9 aa, Homo Sapiens
QYTDLLRLF

SEQ ID NO: 32991 - protein, 9 aa, Homo Sapiens
QYVDFHNQL

SEQ ID NO: 32992 - protein, 9 aa, Homo Sapiens
QYVHCLFLW

SEQ ID NO: 32993 - protein, 9 aa, Homo Sapiens
QYVSAFSKL

SEQ ID NO: 32994 - protein, 9 aa, Homo Sapiens
QYVTQINRL

SEQ ID NO: 32995 - protein, 9 aa, Homo Sapiens
RFEEAHFTF

SEQ ID NO: 32996 - protein, 9 aa, Homo Sapiens
RFEEKHAYF

SEQ ID NO: 32997 - protein, 9 aa, Homo Sapiens
RFHPTPLLL

SEQ ID NO: 32998 - protein, 9 aa, Homo Sapiens
RFIDAVYKL

SEQ ID NO: 32999 - protein, 9 aa, Homo Sapiens
RFIGATANF

SEQ ID NO: 33000 - protein, 9 aa, Homo Sapiens
RFILNLPTF

SEQ ID NO: 33001 - protein, 9 aa, Homo Sapiens
RFIPYTEEF

SEQ ID NO: 33002 - protein, 9 aa, Homo Sapiens
RFLAATFLL

SEQ ID NO: 33003 - protein, 9 aa, Homo Sapiens
RFLDKALEL

SEQ ID NO: 33004 - protein, 9 aa, Homo Sapiens
RFLPSPVVI

SEQ ID NO: 33005 - protein, 9 aa, Homo Sapiens
RFMDGHITF

SEQ ID NO: 33006 - protein, 9 aa, Homo Sapiens
RFQEKFFIF

SEQ ID NO: 33007 - protein, 9 aa, Homo Sapiens
RFSLNTVEL

SEQ ID NO: 33008 - protein, 9 aa, Homo Sapiens
RISLPLPNF

SEQ ID NO: 33009 - protein, 9 aa, Homo Sapiens
RLPAWQPIL

SEQ ID NO: 33010 - protein, 9 aa, Homo Sapiens
RLPEEWSQW

SEQ ID NO: 33011 - protein, 9 aa, Homo Sapiens
RLPLRLFLI

SEQ ID NO: 33012 - protein, 9 aa, Homo Sapiens
RLPPTPLLL

SEQ ID NO: 33013 - protein, 9 aa, Homo Sapiens
RLPVSIPLF

SEQ ID NO: 33014 - protein, 9 aa, Homo Sapiens
RMPRWYFLL

SEQ ID NO: 33015 - protein, 9 aa, Homo Sapiens
RQPSLFYHL

SEQ ID NO: 33016 - protein, 9 aa, Homo Sapiens
RWLAQPYYL

SEQ ID NO: 33017 - protein, 9 aa, Homo Sapiens
RWPKKSAEF

SEQ ID NO: 33018 - protein, 9 aa, Homo Sapiens
RYAALRELI

SEQ ID NO: 33019 - protein, 9 aa, Homo Sapiens
RYAAQLPAL

SEQ ID NO: 33020 - protein, 9 aa, Homo Sapiens
RYAEAVQLL

SEQ ID NO: 33021 - protein, 9 aa, Homo Sapiens
RYALIMHKL

SEQ ID NO: 33022 - protein, 9 aa, Homo Sapiens
RYASINAHL

SEQ ID NO: 33023 - protein, 9 aa, Homo Sapiens
RYASINTHL

SEQ ID NO: 33024 - protein, 9 aa, Homo Sapiens
RYAVEILTW

SEQ ID NO: 33025 - protein, 9 aa, Homo Sapiens
RYDGQVAVF

SEQ ID NO: 33026 - protein, 9 aa, Homo Sapiens
RYDNVTILF

SEQ ID NO: 33027 - protein, 9 aa, Homo Sapiens
RYEGFFSLW

SEQ ID NO: 33028 - protein, 9 aa, Homo Sapiens
RYEGILYTI

SEQ ID NO: 33029 - protein, 9 aa, Homo Sapiens
RYFENPQVI

SEQ ID NO: 33030 - protein, 9 aa, Homo Sapiens
RYFIDSTNL

SEQ ID NO: 33031 - protein, 9 aa, Homo Sapiens
RYFILPYVI

SEQ ID NO: 33032 - protein, 9 aa, Homo Sapiens
RYFIPVSCF

SEQ ID NO: 33033 - protein, 9 aa, Homo Sapiens
RYFKGPELL

SEQ ID NO: 33034 - protein, 9 aa, Homo Sapiens
RYFKTPRKF

SEQ ID NO: 33035 - protein, 9 aa, Homo Sapiens
RYFLPPYTF

SEQ ID NO: 33036 - protein, 9 aa, Homo Sapiens
RYFQPPGTW

SEQ ID NO: 33037 - protein, 9 aa, Homo Sapiens
RYGLITSLL

SEQ ID NO: 33038 - protein, 9 aa, Homo Sapiens
RYGLVTNEI

SEQ ID NO: 33039 - protein, 9 aa, Homo Sapiens
RYIANTVEL

SEQ ID NO: 33040 - protein, 9 aa, Homo Sapiens
RYIDRIHIF

SEQ ID NO: 33041 - protein, 9 aa, Homo Sapiens
RYIFAKNLF

SEQ ID NO: 33042 - protein, 9 aa, Homo Sapiens
RYIIKKDFF

SEQ ID NO: 33043 - protein, 9 aa, Homo Sapiens
RYILEPFFI

SEQ ID NO: 33044 - protein, 9 aa, Homo Sapiens
RYINNPLLI

SEQ ID NO: 33045 - protein, 9 aa, Homo Sapiens
RYIPDAMNL

SEQ ID NO: 33046 - protein, 9 aa, Homo Sapiens
RYIPHPFLV

SEQ ID NO: 33047 - protein, 9 aa, Homo Sapiens
RYIPTAAAF

SEQ ID NO: 33048 - protein, 9 aa, Homo Sapiens
RYIYNREEF

SEQ ID NO: 33049 - protein, 9 aa, Homo Sapiens
RYKLYQEMF

SEQ ID NO: 33050 - protein, 9 aa, Homo Sapiens
RYKQDVERF

SEQ ID NO: 33051 - protein, 9 aa, Homo Sapiens
RYLDEINLL

SEQ ID NO: 33052 - protein, 9 aa, Homo Sapiens
RYLDELMKL

SEQ ID NO: 33053 - protein, 9 aa, Homo Sapiens
RYLDLFTNY

SEQ ID NO: 33054 - protein, 9 aa, Homo Sapiens
RYLDLFTSF

SEQ ID NO: 33055 - protein, 9 aa, Homo Sapiens
RYLDLLTTW

SEQ ID NO: 33056 - protein, 9 aa, Homo Sapiens
RYLDWRALM

SEQ ID NO: 33057 - protein, 9 aa, Homo Sapiens
RYLEKNVKL

SEQ ID NO: 33058 - protein, 9 aa, Homo Sapiens
RYLEKPMEI

SEQ ID NO: 33059 - protein, 9 aa, Homo Sapiens
RYLELISSI

SEQ ID NO: 33060 - protein, 9 aa, Homo Sapiens
RYLEQLHQL

SEQ ID NO: 33061 - protein, 9 aa, Homo Sapiens
RYLERLIKL

SEQ ID NO: 33062 - protein, 9 aa, Homo Sapiens
RYLEVMRKL

SEQ ID NO: 33063 - protein, 9 aa, Homo Sapiens
RYLEYFEKI

SEQ ID NO: 33064 - protein, 9 aa, Homo Sapiens
RYLGKVLEL

SEQ ID NO: 33065 - protein, 9 aa, Homo Sapiens
RYLIKLLLL

SEQ ID NO: 33066 - protein, 9 aa, Homo Sapiens
RYLLKFEQI

SEQ ID NO: 33067 - protein, 9 aa, Homo Sapiens
RYLLTQELL

SEQ ID NO: 33068 - protein, 9 aa, Homo Sapiens
RYLMENTFF

SEQ ID NO: 33069 - protein, 9 aa, Homo Sapiens
RYLNEFEEL

SEQ ID NO: 33070 - protein, 9 aa, Homo Sapiens
RYLPDTLLL

SEQ ID NO: 33071 - protein, 9 aa, Homo Sapiens
RYLPQCSYF

SEQ ID NO: 33072 - protein, 9 aa, Homo Sapiens
RYLPQTYVV

SEQ ID NO: 33073 - protein, 9 aa, Homo Sapiens
RYLSKVLEL

SEQ ID NO: 33074 - protein, 9 aa, Homo Sapiens
RYLTGAWRL

SEQ ID NO: 33075 - protein, 9 aa, Homo Sapiens
RYLTVAAVF

SEQ ID NO: 33076 - protein, 9 aa, Homo Sapiens
RYLVEVEEL

SEQ ID NO: 33077 - protein, 9 aa, Homo Sapiens
RYLVISEKL

SEQ ID NO: 33078 - protein, 9 aa, Homo Sapiens
RYLWATVTI

SEQ ID NO: 33079 - protein, 9 aa, Homo Sapiens
RYMDAWNTV

SEQ ID NO: 33080 - protein, 9 aa, Homo Sapiens
RYMEVSGNL

SEQ ID NO: 33081 - protein, 9 aa, Homo Sapiens
RYMNHMQSL

SEQ ID NO: 33082 - protein, 9 aa, Homo Sapiens
RYMPQNPCI

SEQ ID NO: 33083 - protein, 9 aa, Homo Sapiens
RYMSINTHL

SEQ ID NO: 33084 - protein, 9 aa, Homo Sapiens
RYMVHLLEL

SEQ ID NO: 33085 - protein, 9 aa, Homo Sapiens
RYNPNLNTW

SEQ ID NO: 33086 - protein, 9 aa, Homo Sapiens
RYNSQLLSF

SEQ ID NO: 33087 - protein, 9 aa, Homo Sapiens
RYPAIIYNI

SEQ ID NO: 33088 - protein, 9 aa, Homo Sapiens
RYPCFFNTL

SEQ ID NO: 33089 - protein, 9 aa, Homo Sapiens
RYPDNLKHL

SEQ ID NO: 33090 - protein, 9 aa, Homo Sapiens
RYPDRITLI

SEQ ID NO: 33091 - protein, 9 aa, Homo Sapiens
RYPDSHQLF

SEQ ID NO: 33092 - protein, 9 aa, Homo Sapiens
RYPNKLDTI

SEQ ID NO: 33093 - protein, 9 aa, Homo Sapiens
RYPNSLPAL

SEQ ID NO: 33094 - protein, 9 aa, Homo Sapiens
RYPSLWRRL

SEQ ID NO: 33095 - protein, 9 aa, Homo Sapiens
RYPSNLQLF

SEQ ID NO: 33096 - protein, 9 aa, Homo Sapiens
RYPTSIASL

SEQ ID NO: 33097 - protein, 9 aa, Homo Sapiens
RYQDAIRVF

SEQ ID NO: 33098 - protein, 9 aa, Homo Sapiens
RYQDIIHSI

SEQ ID NO: 33099 - protein, 9 aa, Homo Sapiens
RYQEMIQKL

SEQ ID NO: 33100 - protein, 9 aa, Homo Sapiens
RYQEVIQEL

SEQ ID NO: 33101 - protein, 9 aa, Homo Sapiens
RYQFIEEAF

SEQ ID NO: 33102 - protein, 9 aa, Homo Sapiens
RYQGVNLYI

SEQ ID NO: 33103 - protein, 9 aa, Homo Sapiens
RYQKSTELL

SEQ ID NO: 33104 - protein, 9 aa, Homo Sapiens
RYQQWMERF

SEQ ID NO: 33105 - protein, 9 aa, Homo Sapiens
RYQTFLQLL

SEQ ID NO: 33106 - protein, 9 aa, Homo Sapiens
RYQTLYARF

SEQ ID NO: 33107 - protein, 9 aa, Homo Sapiens
RYRPDMPCF

SEQ ID NO: 33108 - protein, 9 aa, Homo Sapiens
RYSDSTFTF

SEQ ID NO: 33109 - protein, 9 aa, Homo Sapiens
RYSGNQVLF

SEQ ID NO: 33110 - protein, 9 aa, Homo Sapiens
RYSPVLSRF

SEQ ID NO: 33111 - protein, 9 aa, Homo Sapiens
RYSVFFQSL

SEQ ID NO: 33112 - protein, 9 aa, Homo Sapiens
RYSVFVNEL

SEQ ID NO: 33113 - protein, 9 aa, Homo Sapiens
RYTERVDYL

SEQ ID NO: 33114 - protein, 9 aa, Homo Sapiens
RYTFYVLEF

SEQ ID NO: 33115 - protein, 9 aa, Homo Sapiens
RYTIVQQQI

SEQ ID NO: 33116 - protein, 9 aa, Homo Sapiens
RYTLQASTF

SEQ ID NO: 33117 - protein, 9 aa, Homo Sapiens
RYTPAIDVW

SEQ ID NO: 33118 - protein, 9 aa, Homo Sapiens
RYTQTVDIW

SEQ ID NO: 33119 - protein, 9 aa, Homo Sapiens
RYTRWINQL

SEQ ID NO: 33120 - protein, 9 aa, Homo Sapiens
RYTTEFHEL

SEQ ID NO: 33121 - protein, 9 aa, Homo Sapiens
RYVDQVLQL

SEQ ID NO: 33122 - protein, 9 aa, Homo Sapiens
RYVEIVSQF

SEQ ID NO: 33123 - protein, 9 aa, Homo Sapiens
RYVKKLGDF

SEQ ID NO: 33124 - protein, 9 aa, Homo Sapiens
RYVLYPNNF

SEQ ID NO: 33125 - protein, 9 aa, Homo Sapiens
RYVMTTTTL

SEQ ID NO: 33126 - protein, 9 aa, Homo Sapiens
RYVPRASYF

SEQ ID NO: 33127 - protein, 9 aa, Homo Sapiens
RYVQQLQRL

SEQ ID NO: 33128 - protein, 9 aa, Homo Sapiens
RYVRKFVLM

SEQ ID NO: 33129 - protein, 9 aa, Homo Sapiens
RYVWWKKSL

SEQ ID NO: 33130 - protein, 9 aa, Homo Sapiens
RYYGNISRF

SEQ ID NO: 33131 - protein, 9 aa, Homo Sapiens
SFHNIHNTF

SEQ ID NO: 33132 - protein, 9 aa, Homo Sapiens
SFISGLFNF

SEQ ID NO: 33133 - protein, 9 aa, Homo Sapiens
SFLFVHPEW

SEQ ID NO: 33134 - protein, 9 aa, Homo Sapiens
SFMPNSPRF

SEQ ID NO: 33135 - protein, 9 aa, Homo Sapiens
SFPHPLPSL

SEQ ID NO: 33136 - protein, 9 aa, Homo Sapiens
SFSTVTNTF

SEQ ID NO: 33137 - protein, 9 aa, Homo Sapiens
SFYFFFSSF

SEQ ID NO: 33138 - protein, 9 aa, Homo Sapiens
SIPAFLSSL

SEQ ID NO: 33139 - protein, 9 aa, Homo Sapiens
SLPEDIPVF

SEQ ID NO: 33140 - protein, 9 aa, Homo Sapiens
SLPESVPLF

SEQ ID NO: 33141 - protein, 9 aa, Homo Sapiens
SLPGNFFYL

SEQ ID NO: 33142 - protein, 9 aa, Homo Sapiens
SLPKFYLLF

SEQ ID NO: 33143 - protein, 9 aa, Homo Sapiens
SLTYTLVII

SEQ ID NO: 33144 - protein, 9 aa, Homo Sapiens
SMTRYFYLF

SEQ ID NO: 33145 - protein, 9 aa, Homo Sapiens
SVPVSLQTL

SEQ ID NO: 33146 - protein, 9 aa, Homo Sapiens
SYADNILSF

SEQ ID NO: 33147 - protein, 9 aa, Homo Sapiens
SYADQMFLL

SEQ ID NO: 33148 - protein, 9 aa, Homo Sapiens
SYALLTYMI

SEQ ID NO: 33149 - protein, 9 aa, Homo Sapiens
SYANYFIRL

SEQ ID NO: 33150 - protein, 9 aa, Homo Sapiens
SYAQGFMLL

SEQ ID NO: 33151 - protein, 9 aa, Homo Sapiens
SYAQYVHNL

SEQ ID NO: 33152 - protein, 9 aa, Homo Sapiens
SYELRYFQI

SEQ ID NO: 33153 - protein, 9 aa, Homo Sapiens
SYEYRFLEF

SEQ ID NO: 33154 - protein, 9 aa, Homo Sapiens
SYFGSFSSL

SEQ ID NO: 33155 - protein, 9 aa, Homo Sapiens
SYFIEPVQW

SEQ ID NO: 33156 - protein, 9 aa, Homo Sapiens
SYFPKILTF

SEQ ID NO: 33157 - protein, 9 aa, Homo Sapiens
SYGDILHVI

SEQ ID NO: 33158 - protein, 9 aa, Homo Sapiens
SYGIVLYEL

SEQ ID NO: 33159 - protein, 9 aa, Homo Sapiens
SYGKINILL

SEQ ID NO: 33160 - protein, 9 aa, Homo Sapiens
SYGSVFKAI

SEQ ID NO: 33161 - protein, 9 aa, Homo Sapiens
SYHSEWNLF

SEQ ID NO: 33162 - protein, 9 aa, Homo Sapiens
SYIAHLRQI

SEQ ID NO: 33163 - protein, 9 aa, Homo Sapiens
SYIALPLTL

SEQ ID NO: 33164 - protein, 9 aa, Homo Sapiens
SYIDVAVKL

SEQ ID NO: 33165 - protein, 9 aa, Homo Sapiens
SYIEHIFEI

SEQ ID NO: 33166 - protein, 9 aa, Homo Sapiens
SYIELPAYL

SEQ ID NO: 33167 - protein, 9 aa, Homo Sapiens
SYIGFPVEL

SEQ ID NO: 33168 - protein, 9 aa, Homo Sapiens
SYIHYFHCL

SEQ ID NO: 33169 - protein, 9 aa, Homo Sapiens
SYIHYVFRL

SEQ ID NO: 33170 - protein, 9 aa, Homo Sapiens
SYIISGCLF

SEQ ID NO: 33171 - protein, 9 aa, Homo Sapiens
SYILRLEEI

SEQ ID NO: 33172 - protein, 9 aa, Homo Sapiens
SYIPSTVFF

SEQ ID NO: 33173 - protein, 9 aa, Homo Sapiens
SYIQQINNL

SEQ ID NO: 33174 - protein, 9 aa, Homo Sapiens
SYIQRLVQI

SEQ ID NO: 33175 - protein, 9 aa, Homo Sapiens
SYIQSIPVV

SEQ ID NO: 33176 - protein, 9 aa, Homo Sapiens
SYISKVDVL

SEQ ID NO: 33177 - protein, 9 aa, Homo Sapiens
SYISRTNQL

SEQ ID NO: 33178 - protein, 9 aa, Homo Sapiens
SYITKPEKW

SEQ ID NO: 33179 - protein, 9 aa, Homo Sapiens
SYKPIFSTL

SEQ ID NO: 33180 - protein, 9 aa, Homo Sapiens
SYLCNVTLF

SEQ ID NO: 33181 - protein, 9 aa, Homo Sapiens
SYLDEGFLL

SEQ ID NO: 33182 - protein, 9 aa, Homo Sapiens
SYLDRTEQL

SEQ ID NO: 33183 - protein, 9 aa, Homo Sapiens
SYLDSIHFF

SEQ ID NO: 33184 - protein, 9 aa, Homo Sapiens
SYLEKVVAI

SEQ ID NO: 33185 - protein, 9 aa, Homo Sapiens
SYLEKVVTL

SEQ ID NO: 33186 - protein, 9 aa, Homo Sapiens
SYLELVKSL

SEQ ID NO: 33187 - protein, 9 aa, Homo Sapiens
SYLENVDHF

SEQ ID NO: 33188 - protein, 9 aa, Homo Sapiens
SYLESFYHM

SEQ ID NO: 33189 - protein, 9 aa, Homo Sapiens
SYLGAFFSF

SEQ ID NO: 33190 - protein, 9 aa, Homo Sapiens
SYLHEPAVL

SEQ ID NO: 33191 - protein, 9 aa, Homo Sapiens
SYLIIHQRI

SEQ ID NO: 33192 - protein, 9 aa, Homo Sapiens
SYLITSVEL

SEQ ID NO: 33193 - protein, 9 aa, Homo Sapiens
SYLKEFIHI

SEQ ID NO: 33194 - protein, 9 aa, Homo Sapiens
SYLKQLPHF

SEQ ID NO: 33195 - protein, 9 aa, Homo Sapiens
SYLPHAPPF

SEQ ID NO: 33196 - protein, 9 aa, Homo Sapiens
SYLPISPTF

SEQ ID NO: 33197 - protein, 9 aa, Homo Sapiens
SYLPLAHMF

SEQ ID NO: 33198 - protein, 9 aa, Homo Sapiens
SYLPWFEVF

SEQ ID NO: 33199 - protein, 9 aa, Homo Sapiens
SYLQRLEVL

SEQ ID NO: 33200 - protein, 9 aa, Homo Sapiens
SYLQSLLLF

SEQ ID NO: 33201 - protein, 9 aa, Homo Sapiens
SYLSRLQYF

SEQ ID NO: 33202 - protein, 9 aa, Homo Sapiens
SYLSSILRF

SEQ ID NO: 33203 - protein, 9 aa, Homo Sapiens
SYLSSLSHL

SEQ ID NO: 33204 - protein, 9 aa, Homo Sapiens
SYLTIHHRI

SEQ ID NO: 33205 - protein, 9 aa, Homo Sapiens
SYLTSASSL

SEQ ID NO: 33206 - protein, 9 aa, Homo Sapiens
SYLVQYMQF

SEQ ID NO: 33207 - protein, 9 aa, Homo Sapiens
SYMEVPTYL

SEQ ID NO: 33208 - protein, 9 aa, Homo Sapiens
SYMGHFDLL

SEQ ID NO: 33209 - protein, 9 aa, Homo Sapiens
SYMPTVSHL

SEQ ID NO: 33210 - protein, 9 aa, Homo Sapiens
SYMWTINNF

SEQ ID NO: 33211 - protein, 9 aa, Homo Sapiens
SYNNFFRMF

SEQ ID NO: 33212 - protein, 9 aa, Homo Sapiens
SYNNHAWSF

SEQ ID NO: 33213 - protein, 9 aa, Homo Sapiens
SYNPLWLRI

SEQ ID NO: 33214 - protein, 9 aa, Homo Sapiens
SYPDLLPTF

SEQ ID NO: 33215 - protein, 9 aa, Homo Sapiens
SYPDNFLHI

SEQ ID NO: 33216 - protein, 9 aa, Homo Sapiens
SYPGSSYIF

SEQ ID NO: 33217 - protein, 9 aa, Homo Sapiens
SYPKIIEEF

SEQ ID NO: 33218 - protein, 9 aa, Homo Sapiens
SYPLNSYEL

SEQ ID NO: 33219 - protein, 9 aa, Homo Sapiens
SYPNVFLVF

SEQ ID NO: 33220 - protein, 9 aa, Homo Sapiens
SYPSAFSKL

SEQ ID NO: 33221 - protein, 9 aa, Homo Sapiens
SYPTFFPRF

SEQ ID NO: 33222 - protein, 9 aa, Homo Sapiens
SYQDFFEAI

SEQ ID NO: 33223 - protein, 9 aa, Homo Sapiens
SYQFILNLF

SEQ ID NO: 33224 - protein, 9 aa, Homo Sapiens
SYQKVIELF

SEQ ID NO: 33225 - protein, 9 aa, Homo Sapiens
SYQKVMALW

SEQ ID NO: 33226 - protein, 9 aa, Homo Sapiens
SYQRAFNEF

SEQ ID NO: 33227 - protein, 9 aa, Homo Sapiens
SYRIIYNLF

SEQ ID NO: 33228 - protein, 9 aa, Homo Sapiens
SYSDLVLFF

SEQ ID NO: 33229 - protein, 9 aa, Homo Sapiens
SYSDPPLKF

SEQ ID NO: 33230 - protein, 9 aa, Homo Sapiens
SYSEWLQRL

SEQ ID NO: 33231 - protein, 9 aa, Homo Sapiens
SYSHIMALI

SEQ ID NO: 33232 - protein, 9 aa, Homo Sapiens
SYSMIVNNL

SEQ ID NO: 33233 - protein, 9 aa, Homo Sapiens
SYSSTFHSL

SEQ ID NO: 33234 - protein, 9 aa, Homo Sapiens
SYTALFPQL

SEQ ID NO: 33235 - protein, 9 aa, Homo Sapiens
SYTDVWEKW

SEQ ID NO: 33236 - protein, 9 aa, Homo Sapiens
SYTEYLFLL

SEQ ID NO: 33237 - protein, 9 aa, Homo Sapiens
SYTHIQYLF

SEQ ID NO: 33238 - protein, 9 aa, Homo Sapiens
SYTRLFSNF

SEQ ID NO: 33239 - protein, 9 aa, Homo Sapiens
SYTSVLSRL

SEQ ID NO: 33240 - protein, 9 aa, Homo Sapiens
SYTYLSLGF

SEQ ID NO: 33241 - protein, 9 aa, Homo Sapiens
SYVHYVFRL

SEQ ID NO: 33242 - protein, 9 aa, Homo Sapiens
SYVMWKAGF

SEQ ID NO: 33243 - protein, 9 aa, Homo Sapiens
SYVRSLPFF

SEQ ID NO: 33244 - protein, 9 aa, Homo Sapiens
SYVWRTYHL

SEQ ID NO: 33245 - protein, 9 aa, Homo Sapiens
TFLPFIHTI

SEQ ID NO: 33246 - protein, 9 aa, Homo Sapiens
TFPSLLLVF

SEQ ID NO: 33247 - protein, 9 aa, Homo Sapiens
TFQMKFFYI

SEQ ID NO: 33248 - protein, 9 aa, Homo Sapiens
TFSDVEAHF

SEQ ID NO: 33249 - protein, 9 aa, Homo Sapiens
TFTDHVMLF

SEQ ID NO: 33250 - protein, 9 aa, Homo Sapiens
TFTFSHATF

SEQ ID NO: 33251 - protein, 9 aa, Homo Sapiens
THVGKVNIF

SEQ ID NO: 33252 - protein, 9 aa, Homo Sapiens
TIAEIKNLF

SEQ ID NO: 33253 - protein, 9 aa, Homo Sapiens
TLPFQQFEI

SEQ ID NO: 33254 - protein, 9 aa, Homo Sapiens
TLSDIFLLF

SEQ ID NO: 33255 - protein, 9 aa, Homo Sapiens
TMLGKFYHF

SEQ ID NO: 33256 - protein, 9 aa, Homo Sapiens
TTYPNTYIF

SEQ ID NO: 33257 - protein, 9 aa, Homo Sapiens
TVLICLLSF

SEQ ID NO: 33258 - protein, 9 aa, Homo Sapiens
TVPVRLSSL

SEQ ID NO: 33259 - protein, 9 aa, Homo Sapiens
TYAEKLHRL

SEQ ID NO: 33260 - protein, 9 aa, Homo Sapiens
TYAPAIHQI

SEQ ID NO: 33261 - protein, 9 aa, Homo Sapiens
TYAPVKSFL

SEQ ID NO: 33262 - protein, 9 aa, Homo Sapiens
TYARNLPAF

SEQ ID NO: 33263 - protein, 9 aa, Homo Sapiens
TYDPFHNCW

SEQ ID NO: 33264 - protein, 9 aa, Homo Sapiens
TYELRYFQI

SEQ ID NO: 33265 - protein, 9 aa, Homo Sapiens
TYENLIHVW

SEQ ID NO: 33266 - protein, 9 aa, Homo Sapiens
TYESIFSHF

SEQ ID NO: 33267 - protein, 9 aa, Homo Sapiens
TYFDKNYNL

SEQ ID NO: 33268 - protein, 9 aa, Homo Sapiens
TYFEKNFNL

SEQ ID NO: 33269 - protein, 9 aa, Homo Sapiens
TYFSTPLLL

SEQ ID NO: 33270 - protein, 9 aa, Homo Sapiens
TYGEIFEKF

SEQ ID NO: 33271 - protein, 9 aa, Homo Sapiens
TYGKIDLGF

SEQ ID NO: 33272 - protein, 9 aa, Homo Sapiens
TYGPSFPAF

SEQ ID NO: 33273 - protein, 9 aa, Homo Sapiens
TYGVSFFLV

SEQ ID NO: 33274 - protein, 9 aa, Homo Sapiens
TYHGVFVNI

SEQ ID NO: 33275 - protein, 9 aa, Homo Sapiens
TYHPGVPVF

SEQ ID NO: 33276 - protein, 9 aa, Homo Sapiens
TYIKFINLF

SEQ ID NO: 33277 - protein, 9 aa, Homo Sapiens
TYIKPISKL

SEQ ID NO: 33278 - protein, 9 aa, Homo Sapiens
TYINHVVSV

SEQ ID NO: 33279 - protein, 9 aa, Homo Sapiens
TYINPFVSF

SEQ ID NO: 33280 - protein, 9 aa, Homo Sapiens
TYIQKIFRM

SEQ ID NO: 33281 - protein, 9 aa, Homo Sapiens
TYIQNFRFF

SEQ ID NO: 33282 - protein, 9 aa, Homo Sapiens
TYIRDFQKI

SEQ ID NO: 33283 - protein, 9 aa, Homo Sapiens
TYISWKEEL

SEQ ID NO: 33284 - protein, 9 aa, Homo Sapiens
TYITSVSRL

SEQ ID NO: 33285 - protein, 9 aa, Homo Sapiens
TYKDYVDLF

SEQ ID NO: 33286 - protein, 9 aa, Homo Sapiens
TYKNFFYLI

SEQ ID NO: 33287 - protein, 9 aa, Homo Sapiens
TYKQVVDLI

SEQ ID NO: 33288 - protein, 9 aa, Homo Sapiens
TYLDIFRDF

SEQ ID NO: 33289 - protein, 9 aa, Homo Sapiens
TYLDLLGTW

SEQ ID NO: 33290 - protein, 9 aa, Homo Sapiens
TYLDNGVVF

SEQ ID NO: 33291 - protein, 9 aa, Homo Sapiens
TYLEKAIKI

SEQ ID NO: 33292 - protein, 9 aa, Homo Sapiens
TYLEKAVEV

SEQ ID NO: 33293 - protein, 9 aa, Homo Sapiens
TYLEKFQNL

SEQ ID NO: 33294 - protein, 9 aa, Homo Sapiens
TYLGKYWAI

SEQ ID NO: 33295 - protein, 9 aa, Homo Sapiens
TYLIQHQRI

SEQ ID NO: 33296 - protein, 9 aa, Homo Sapiens
TYLIVTSLL

SEQ ID NO: 33297 - protein, 9 aa, Homo Sapiens
TYLLSVYRL

SEQ ID NO: 33298 - protein, 9 aa, Homo Sapiens
TYLNDFFSY

SEQ ID NO: 33299 - protein, 9 aa, Homo Sapiens
TYLNYVVHL

SEQ ID NO: 33300 - protein, 9 aa, Homo Sapiens
TYLPGIVGL

SEQ ID NO: 33301 - protein, 9 aa, Homo Sapiens
TYLPTSPLL

SEQ ID NO: 33302 - protein, 9 aa, Homo Sapiens
TYLRDQHFL

SEQ ID NO: 33303 - protein, 9 aa, Homo Sapiens
TYLTIFDLF

SEQ ID NO: 33304 - protein, 9 aa, Homo Sapiens
TYLVDMQRF

SEQ ID NO: 33305 - protein, 9 aa, Homo Sapiens
TYMKDLYQL

SEQ ID NO: 33306 - protein, 9 aa, Homo Sapiens
TYMPHVHIL

SEQ ID NO: 33307 - protein, 9 aa, Homo Sapiens
TYNIFAITF

SEQ ID NO: 33308 - protein, 9 aa, Homo Sapiens
TYNLLSERW

SEQ ID NO: 33309 - protein, 9 aa, Homo Sapiens
TYNMVLNLL

SEQ ID NO: 33310 - protein, 9 aa, Homo Sapiens
TYNQKHSLF

SEQ ID NO: 33311 - protein, 9 aa, Homo Sapiens
TYNYPVHYF

SEQ ID NO: 33312 - protein, 9 aa, Homo Sapiens
TYPAELNNI

SEQ ID NO: 33313 - protein, 9 aa, Homo Sapiens
TYPDVNNSI

SEQ ID NO: 33314 - protein, 9 aa, Homo Sapiens
TYPELNSSI

SEQ ID NO: 33315 - protein, 9 aa, Homo Sapiens
TYPENWRAF

SEQ ID NO: 33316 - protein, 9 aa, Homo Sapiens
TYPLIFASI

SEQ ID NO: 33317 - protein, 9 aa, Homo Sapiens
TYQDIFRDF

SEQ ID NO: 33318 - protein, 9 aa, Homo Sapiens
TYQDIQNTI

SEQ ID NO: 33319 - protein, 9 aa, Homo Sapiens
TYQEVAQKF

SEQ ID NO: 33320 - protein, 9 aa, Homo Sapiens
TYQRWQFTL

SEQ ID NO: 33321 - protein, 9 aa, Homo Sapiens
TYQTIIELF

SEQ ID NO: 33322 - protein, 9 aa, Homo Sapiens
TYQVLAVTF

SEQ ID NO: 33323 - protein, 9 aa, Homo Sapiens
TYRNVMEQF

SEQ ID NO: 33324 - protein, 9 aa, Homo Sapiens
TYSYSFFHF

SEQ ID NO: 33325 - protein, 9 aa, Homo Sapiens
TYTDLLSVI

SEQ ID NO: 33326 - protein, 9 aa, Homo Sapiens
TYTDRVFFL

SEQ ID NO: 33327 - protein, 9 aa, Homo Sapiens
TYTEFVPQI

SEQ ID NO: 33328 - protein, 9 aa, Homo Sapiens
TYTMILNLL

SEQ ID NO: 33329 - protein, 9 aa, Homo Sapiens
TYTSYLDKF

SEQ ID NO: 33330 - protein, 9 aa, Homo Sapiens
TYTYEKLLW

SEQ ID NO: 33331 - protein, 9 aa, Homo Sapiens
TYVENLRLL

SEQ ID NO: 33332 - protein, 9 aa, Homo Sapiens
TYVKEIEVW

SEQ ID NO: 33333 - protein, 9 aa, Homo Sapiens
TYVPWPLML

SEQ ID NO: 33334 - protein, 9 aa, Homo Sapiens
TYVRWYTQL

SEQ ID NO: 33335 - protein, 9 aa, Homo Sapiens
TYVSGTLRF

SEQ ID NO: 33336 - protein, 9 aa, Homo Sapiens
TYVTILPEL

SEQ ID NO: 33337 - protein, 9 aa, Homo Sapiens
TYVWVQYVW

SEQ ID NO: 33338 - protein, 9 aa, Homo Sapiens
TYYWGFAAW

SEQ ID NO: 33339 - protein, 9 aa, Homo Sapiens
VANAIIHLF

SEQ ID NO: 33340 - protein, 9 aa, Homo Sapiens
VFAGVFNTF

SEQ ID NO: 33341 - protein, 9 aa, Homo Sapiens
VFGYHGYTF

SEQ ID NO: 33342 - protein, 9 aa, Homo Sapiens
VFIDKQTNL

SEQ ID NO: 33343 - protein, 9 aa, Homo Sapiens
VFIIVPAIF

SEQ ID NO: 33344 - protein, 9 aa, Homo Sapiens
VFIRGGEEF

SEQ ID NO: 33345 - protein, 9 aa, Homo Sapiens
VFKPISSTW

SEQ ID NO: 33346 - protein, 9 aa, Homo Sapiens
VFLPIVVLI

SEQ ID NO: 33347 - protein, 9 aa, Homo Sapiens
VFLRAINKF

SEQ ID NO: 33348 - protein, 9 aa, Homo Sapiens
VFNDVRLLL

SEQ ID NO: 33349 - protein, 9 aa, Homo Sapiens
VFPDDMPTL

SEQ ID NO: 33350 - protein, 9 aa, Homo Sapiens
VFPDKGYSF

SEQ ID NO: 33351 - protein, 9 aa, Homo Sapiens
VFPFRTFYL

SEQ ID NO: 33352 - protein, 9 aa, Homo Sapiens
VFRLQFDEF

SEQ ID NO: 33353 - protein, 9 aa, Homo Sapiens
VFSPDGHLF

SEQ ID NO: 33354 - protein, 9 aa, Homo Sapiens
VFSTVVIHF

SEQ ID NO: 33355 - protein, 9 aa, Homo Sapiens
VFTAFTEEF

SEQ ID NO: 33356 - protein, 9 aa, Homo Sapiens
VFTEVANLF

SEQ ID NO: 33357 - protein, 9 aa, Homo Sapiens
VFTLKPLEF

SEQ ID NO: 33358 - protein, 9 aa, Homo Sapiens
VFTPVTTEI

SEQ ID NO: 33359 - protein, 9 aa, Homo Sapiens
VFTPVVQRI

SEQ ID NO: 33360 - protein, 9 aa, Homo Sapiens
VFTYVGALF

SEQ ID NO: 33361 - protein, 9 aa, Homo Sapiens
VFVDSVPEF

SEQ ID NO: 33362 - protein, 9 aa, Homo Sapiens
VFVEATHVL

SEQ ID NO: 33363 - protein, 9 aa, Homo Sapiens
VFYPYPQYF

SEQ ID NO: 33364 - protein, 9 aa, Homo Sapiens
VGAYILYFF

SEQ ID NO: 33365 - protein, 9 aa, Homo Sapiens
VHILQVPVW

SEQ ID NO: 33366 - protein, 9 aa, Homo Sapiens
VHIPEVYLI

SEQ ID NO: 33367 - protein, 9 aa, Homo Sapiens
VITPVLLHF

SEQ ID NO: 33368 - protein, 9 aa, Homo Sapiens
VLFVVPLII

SEQ ID NO: 33369 - protein, 9 aa, Homo Sapiens
VLIPKLPQL

SEQ ID NO: 33370 - protein, 9 aa, Homo Sapiens
VLNNVAHTF

SEQ ID NO: 33371 - protein, 9 aa, Homo Sapiens
VLPESLPVL

SEQ ID NO: 33372 - protein, 9 aa, Homo Sapiens
VLPGHFNTF

SEQ ID NO: 33373 - protein, 9 aa, Homo Sapiens
VLPILPLLF

SEQ ID NO: 33374 - protein, 9 aa, Homo Sapiens
VLPIRVHTI

SEQ ID NO: 33375 - protein, 9 aa, Homo Sapiens
VLPKLYVKL

SEQ ID NO: 33376 - protein, 9 aa, Homo Sapiens
VLPNTALHL

SEQ ID NO: 33377 - protein, 9 aa, Homo Sapiens
VLPPSVPFF

SEQ ID NO: 33378 - protein, 9 aa, Homo Sapiens
VLPQRFPQF

SEQ ID NO: 33379 - protein, 9 aa, Homo Sapiens
VLPSVLNKF

SEQ ID NO: 33380 - protein, 9 aa, Homo Sapiens
VMADIRELI

SEQ ID NO: 33381 - protein, 9 aa, Homo Sapiens
VMAPRTLVL

SEQ ID NO: 33382 - protein, 9 aa, Homo Sapiens
VMPSSFFLL

SEQ ID NO: 33383 - protein, 9 aa, Homo Sapiens
VMSATFAKF

SEQ ID NO: 33384 - protein, 9 aa, Homo Sapiens
VQAGVTYLF

SEQ ID NO: 33385 - protein, 9 aa, Homo Sapiens
VQPPHLFLW

SEQ ID NO: 33386 - protein, 9 aa, Homo Sapiens
VQPRNWLLF

SEQ ID NO: 33387 - protein, 9 aa, Homo Sapiens
VQPSKYHFL

SEQ ID NO: 33388 - protein, 9 aa, Homo Sapiens
VWGVPIPVF

SEQ ID NO: 33389 - protein, 9 aa, Homo Sapiens
VWIYDPVHF

SEQ ID NO: 33390 - protein, 9 aa, Homo Sapiens
VWLPASVLF

SEQ ID NO: 33391 - protein, 9 aa, Homo Sapiens
VWLPYLYTL

SEQ ID NO: 33392 - protein, 9 aa, Homo Sapiens
VWVPFIYSF

SEQ ID NO: 33393 - protein, 9 aa, Homo Sapiens
VYADKLLNI

SEQ ID NO: 33394 - protein, 9 aa, Homo Sapiens
VYADQPHIF

SEQ ID NO: 33395 - protein, 9 aa, Homo Sapiens
VYAEIMAVL

SEQ ID NO: 33396 - protein, 9 aa, Homo Sapiens
VYAFNLDTF

SEQ ID NO: 33397 - protein, 9 aa, Homo Sapiens
VYAFSIENF

SEQ ID NO: 33398 - protein, 9 aa, Homo Sapiens
VYAGMITVF

SEQ ID NO: 33399 - protein, 9 aa, Homo Sapiens
VYAHFPINV

SEQ ID NO: 33400 - protein, 9 aa, Homo Sapiens
VYAILTHGI

SEQ ID NO: 33401 - protein, 9 aa, Homo Sapiens
VYAKYWIYV

SEQ ID NO: 33402 - protein, 9 aa, Homo Sapiens
VYALKVRTI

SEQ ID NO: 33403 - protein, 9 aa, Homo Sapiens
VYALPTIAF

SEQ ID NO: 33404 - protein, 9 aa, Homo Sapiens
VYALVVVSY

SEQ ID NO: 33405 - protein, 9 aa, Homo Sapiens
VYANGIRNI

SEQ ID NO: 33406 - protein, 9 aa, Homo Sapiens
VYAPFIEKL

SEQ ID NO: 33407 - protein, 9 aa, Homo Sapiens
VYAVPILIF

SEQ ID NO: 33408 - protein, 9 aa, Homo Sapiens
VYAVVRGLF

SEQ ID NO: 33409 - protein, 9 aa, Homo Sapiens
VYDPLFSQL

SEQ ID NO: 33410 - protein, 9 aa, Homo Sapiens
VYDTNPAKF

SEQ ID NO: 33411 - protein, 9 aa, Homo Sapiens
VYDTVFKHF

SEQ ID NO: 33412 - protein, 9 aa, Homo Sapiens
VYEEILHQI

SEQ ID NO: 33413 - protein, 9 aa, Homo Sapiens
VYELSAVLI

SEQ ID NO: 33414 - protein, 9 aa, Homo Sapiens
VYERELQTF

SEQ ID NO: 33415 - protein, 9 aa, Homo Sapiens
VYEYVVERF

SEQ ID NO: 33416 - protein, 9 aa, Homo Sapiens
VYFGDPVSL

SEQ ID NO: 33417 - protein, 9 aa, Homo Sapiens
VYFGHWVVM

SEQ ID NO: 33418 - protein, 9 aa, Homo Sapiens
VYFIGAHNI

SEQ ID NO: 33419 - protein, 9 aa, Homo Sapiens
VYFSAAHAL

SEQ ID NO: 33420 - protein, 9 aa, Homo Sapiens
VYGFQWRHF

SEQ ID NO: 33421 - protein, 9 aa, Homo Sapiens
VYGFVREAL

SEQ ID NO: 33422 - protein, 9 aa, Homo Sapiens
VYGPLPQSF

SEQ ID NO: 33423 - protein, 9 aa, Homo Sapiens
VYGSFASKL

SEQ ID NO: 33424 - protein, 9 aa, Homo Sapiens
VYGVVPISL

SEQ ID NO: 33425 - protein, 9 aa, Homo Sapiens
VYHILKVLF

SEQ ID NO: 33426 - protein, 9 aa, Homo Sapiens
VYHNMPLIW

SEQ ID NO: 33427 - protein, 9 aa, Homo Sapiens
VYHSDIPKW

SEQ ID NO: 33428 - protein, 9 aa, Homo Sapiens
VYIAPLKAL

SEQ ID NO: 33429 - protein, 9 aa, Homo Sapiens
VYIDKVRSL

SEQ ID NO: 33430 - protein, 9 aa, Homo Sapiens
VYIGKLNMI

SEQ ID NO: 33431 - protein, 9 aa, Homo Sapiens
VYIHHFDRI

SEQ ID NO: 33432 - protein, 9 aa, Homo Sapiens
VYIKHPVSL

SEQ ID NO: 33433 - protein, 9 aa, Homo Sapiens
VYINTAQEF

SEQ ID NO: 33434 - protein, 9 aa, Homo Sapiens
VYIPAHGRL

SEQ ID NO: 33435 - protein, 9 aa, Homo Sapiens
VYIPCIYVL

SEQ ID NO: 33436 - protein, 9 aa, Homo Sapiens
VYIPNKVLI

SEQ ID NO: 33437 - protein, 9 aa, Homo Sapiens
VYISEHEHF

SEQ ID NO: 33438 - protein, 9 aa, Homo Sapiens
VYISNGQVL

SEQ ID NO: 33439 - protein, 9 aa, Homo Sapiens
VYITPMEAL

SEQ ID NO: 33440 - protein, 9 aa, Homo Sapiens
VYITRAQLM

SEQ ID NO: 33441 - protein, 9 aa, Homo Sapiens
VYIVPVIVL

SEQ ID NO: 33442 - protein, 9 aa, Homo Sapiens
VYIYRYFFL

SEQ ID NO: 33443 - protein, 9 aa, Homo Sapiens
VYKDSIYYI

SEQ ID NO: 33444 - protein, 9 aa, Homo Sapiens
VYKKSIFVF

SEQ ID NO: 33445 - protein, 9 aa, Homo Sapiens
VYKPAQNSW

SEQ ID NO: 33446 - protein, 9 aa, Homo Sapiens
VYKPPGLKW

SEQ ID NO: 33447 - protein, 9 aa, Homo Sapiens
VYKTHIDVI

SEQ ID NO: 33448 - protein, 9 aa, Homo Sapiens
VYKYPFELI

SEQ ID NO: 33449 - protein, 9 aa, Homo Sapiens
VYLDEPIKI

SEQ ID NO: 33450 - protein, 9 aa, Homo Sapiens
VYLDKFIRL

SEQ ID NO: 33451 - protein, 9 aa, Homo Sapiens
VYLEKFMTF

SEQ ID NO: 33452 - protein, 9 aa, Homo Sapiens
VYLHDFQRF

SEQ ID NO: 33453 - protein, 9 aa, Homo Sapiens
VYLKPSYAF

SEQ ID NO: 33454 - protein, 9 aa, Homo Sapiens
VYLKTALGL

SEQ ID NO: 33455 - protein, 9 aa, Homo Sapiens
VYLPCLQNI

SEQ ID NO: 33456 - protein, 9 aa, Homo Sapiens
VYLPLTSHI

SEQ ID NO: 33457 - protein, 9 aa, Homo Sapiens
VYLPRVLDI

SEQ ID NO: 33458 - protein, 9 aa, Homo Sapiens
VYLPTAFLL

SEQ ID NO: 33459 - protein, 9 aa, Homo Sapiens
VYLPTHTSL

SEQ ID NO: 33460 - protein, 9 aa, Homo Sapiens
VYLSNVVLF

SEQ ID NO: 33461 - protein, 9 aa, Homo Sapiens
VYMDWYEKF

SEQ ID NO: 33462 - protein, 9 aa, Homo Sapiens
VYMGLLAVF

SEQ ID NO: 33463 - protein, 9 aa, Homo Sapiens
VYMIRVYLL

SEQ ID NO: 33464 - protein, 9 aa, Homo Sapiens
VYMNRVKEI

SEQ ID NO: 33465 - protein, 9 aa, Homo Sapiens
VYMPCLYVY

SEQ ID NO: 33466 - protein, 9 aa, Homo Sapiens
VYNENLVHM

SEQ ID NO: 33467 - protein, 9 aa, Homo Sapiens
VYNPELDKW

SEQ ID NO: 33468 - protein, 9 aa, Homo Sapiens
VYNPVRAEW

SEQ ID NO: 33469 - protein, 9 aa, Homo Sapiens
VYPADVVLF

SEQ ID NO: 33470 - protein, 9 aa, Homo Sapiens
VYPAGFVYI

SEQ ID NO: 33471 - protein, 9 aa, Homo Sapiens
VYPAVMVLL

SEQ ID NO: 33472 - protein, 9 aa, Homo Sapiens
VYPDGIRHI

SEQ ID NO: 33473 - protein, 9 aa, Homo Sapiens
VYPEESLVI

SEQ ID NO: 33474 - protein, 9 aa, Homo Sapiens
VYPERTPLL

SEQ ID NO: 33475 - protein, 9 aa, Homo Sapiens
VYPGDPLRF

SEQ ID NO: 33476 - protein, 9 aa, Homo Sapiens
VYPGIAVFF

SEQ ID NO: 33477 - protein, 9 aa, Homo Sapiens
VYPGYYLTF

SEQ ID NO: 33478 - protein, 9 aa, Homo Sapiens
VYPLKFFFL

SEQ ID NO: 33479 - protein, 9 aa, Homo Sapiens
VYPLMKEYF

SEQ ID NO: 33480 - protein, 9 aa, Homo Sapiens
VYPNWAIGL

SEQ ID NO: 33481 - protein, 9 aa, Homo Sapiens
VYPPPHQVF

SEQ ID NO: 33482 - protein, 9 aa, Homo Sapiens
VYPQRLNFV

SEQ ID NO: 33483 - protein, 9 aa, Homo Sapiens
VYPSSLSKI

SEQ ID NO: 33484 - protein, 9 aa, Homo Sapiens
VYPTAVHVL

SEQ ID NO: 33485 - protein, 9 aa, Homo Sapiens
VYPWTQRFF

SEQ ID NO: 33486 - protein, 9 aa, Homo Sapiens
VYQEIWIGM

SEQ ID NO: 33487 - protein, 9 aa, Homo Sapiens
VYQHGLTGF

SEQ ID NO: 33488 - protein, 9 aa, Homo Sapiens
VYQHLFTRI

SEQ ID NO: 33489 - protein, 9 aa, Homo Sapiens
VYQIFDTFF

SEQ ID NO: 33490 - protein, 9 aa, Homo Sapiens
VYQLRFQFL

SEQ ID NO: 33491 - protein, 9 aa, Homo Sapiens
VYQNIFTAM

SEQ ID NO: 33492 - protein, 9 aa, Homo Sapiens
VYQYMHETI

SEQ ID NO: 33493 - protein, 9 aa, Homo Sapiens
VYSAGVYRL

SEQ ID NO: 33494 - protein, 9 aa, Homo Sapiens
VYSFGFERL

SEQ ID NO: 33495 - protein, 9 aa, Homo Sapiens
VYSFVTPTF

SEQ ID NO: 33496 - protein, 9 aa, Homo Sapiens
VYSGGVYLF

SEQ ID NO: 33497 - protein, 9 aa, Homo Sapiens
VYSIISVQL

SEQ ID NO: 33498 - protein, 9 aa, Homo Sapiens
VYSIRLAYL

SEQ ID NO: 33499 - protein, 9 aa, Homo Sapiens
VYSIVPQSW

SEQ ID NO: 33500 - protein, 9 aa, Homo Sapiens
VYSPHVLNL

SEQ ID NO: 33501 - protein, 9 aa, Homo Sapiens
VYSPKSPSL

SEQ ID NO: 33502 - protein, 9 aa, Homo Sapiens
VYSQFITQL

SEQ ID NO: 33503 - protein, 9 aa, Homo Sapiens
VYSRTFTWL

SEQ ID NO: 33504 - protein, 9 aa, Homo Sapiens
VYSTPTPFF

SEQ ID NO: 33505 - protein, 9 aa, Homo Sapiens
VYTDFAFRI

SEQ ID NO: 33506 - protein, 9 aa, Homo Sapiens
VYTDILIGL

SEQ ID NO: 33507 - protein, 9 aa, Homo Sapiens
VYTEAIADI

SEQ ID NO: 33508 - protein, 9 aa, Homo Sapiens
VYTGDALRI

SEQ ID NO: 33509 - protein, 9 aa, Homo Sapiens
VYTGIDHHW

SEQ ID NO: 33510 - protein, 9 aa, Homo Sapiens
VYTIDFNSM

SEQ ID NO: 33511 - protein, 9 aa, Homo Sapiens
VYTKALSSL

SEQ ID NO: 33512 - protein, 9 aa, Homo Sapiens
VYTLDIPVL

SEQ ID NO: 33513 - protein, 9 aa, Homo Sapiens
VYTLLTTHL

SEQ ID NO: 33514 - protein, 9 aa, Homo Sapiens
VYTQHQPFL

SEQ ID NO: 33515 - protein, 9 aa, Homo Sapiens
VYTRHMTWI

SEQ ID NO: 33516 - protein, 9 aa, Homo Sapiens
VYTSVVEEL

SEQ ID NO: 33517 - protein, 9 aa, Homo Sapiens
VYTTNIQEL

SEQ ID NO: 33518 - protein, 9 aa, Homo Sapiens
VYTTTVHWL

SEQ ID NO: 33519 - protein, 9 aa, Homo Sapiens
VYTVVDEMF

SEQ ID NO: 33520 - protein, 9 aa, Homo Sapiens
VYTYIQSRF

SEQ ID NO: 33521 - protein, 9 aa, Homo Sapiens
VYVAALKTL

SEQ ID NO: 33522 - protein, 9 aa, Homo Sapiens
VYVAAVREF

SEQ ID NO: 33523 - protein, 9 aa, Homo Sapiens
VYVAIQAVL

SEQ ID NO: 33524 - protein, 9 aa, Homo Sapiens
VYVATRPTI

SEQ ID NO: 33525 - protein, 9 aa, Homo Sapiens
VYVDAVGQF

SEQ ID NO: 33526 - protein, 9 aa, Homo Sapiens
VYVGFQVQL

SEQ ID NO: 33527 - protein, 9 aa, Homo Sapiens
VYVGTLKLI

SEQ ID NO: 33528 - protein, 9 aa, Homo Sapiens
VYVKDLSSF

SEQ ID NO: 33529 - protein, 9 aa, Homo Sapiens
VYVLTVTEI

SEQ ID NO: 33530 - protein, 9 aa, Homo Sapiens
VYVQELQKL

SEQ ID NO: 33531 - protein, 9 aa, Homo Sapiens
VYVQNVVKL

SEQ ID NO: 33532 - protein, 9 aa, Homo Sapiens
VYVVGTAHF

SEQ ID NO: 33533 - protein, 9 aa, Homo Sapiens
VYWEGYVRF

SEQ ID NO: 33534 - protein, 9 aa, Homo Sapiens
VYWKIYNSI

SEQ ID NO: 33535 - protein, 9 aa, Homo Sapiens
VYWTQLNMF

SEQ ID NO: 33536 - protein, 9 aa, Homo Sapiens
VYYPELFVW

SEQ ID NO: 33537 - protein, 9 aa, Homo Sapiens
VYYPVRHHL

SEQ ID NO: 33538 - protein, 9 aa, Homo Sapiens
WYMDNPQNL

SEQ ID NO: 33539 - protein, 9 aa, Homo Sapiens
YFIADLPHL

SEQ ID NO: 33540 - protein, 9 aa, Homo Sapiens
YFINRSWEW

SEQ ID NO: 33541 - protein, 9 aa, Homo Sapiens
YFIPEFNLF

SEQ ID NO: 33542 - protein, 9 aa, Homo Sapiens
YFISHVLAF

SEQ ID NO: 33543 - protein, 9 aa, Homo Sapiens
YFLDKIDVI

SEQ ID NO: 33544 - protein, 9 aa, Homo Sapiens
YFLKGVLVF

SEQ ID NO: 33545 - protein, 9 aa, Homo Sapiens
YFPPKGYAF

SEQ ID NO: 33546 - protein, 9 aa, Homo Sapiens
YFSSGKYYW

SEQ ID NO: 33547 - protein, 9 aa, Homo Sapiens
YGLVIYAGF

SEQ ID NO: 33548 - protein, 9 aa, Homo Sapiens
YLPHLFPSF

SEQ ID NO: 33549 - protein, 9 aa, Homo Sapiens
YLPPLFWRF

SEQ ID NO: 33550 - protein, 9 aa, Homo Sapiens
YLPSSFPVL

SEQ ID NO: 33551 - protein, 9 aa, Homo Sapiens
YLPTLWVKL

SEQ ID NO: 33552 - protein, 9 aa, Homo Sapiens
YQTPRLWLF

SEQ ID NO: 33553 - protein, 9 aa, Homo Sapiens
YVIQKFFEF

SEQ ID NO: 33554 - protein, 9 aa, Homo Sapiens
YWIDIQLRW

SEQ ID NO: 33555 - protein, 9 aa, Homo Sapiens
YWMHVQNTF

SEQ ID NO: 33556 - protein, 9 aa, Homo Sapiens
YWPDVIHSF

SEQ ID NO: 33557 - protein, 9 aa, Homo Sapiens
YWPVIPLKF

SEQ ID NO: 33558 - protein, 9 aa, Homo Sapiens
YYAEVETRI

SEQ ID NO: 33559 - protein, 9 aa, Homo Sapiens
YYASDVWSF

SEQ ID NO: 33560 - protein, 9 aa, Homo Sapiens
YYASIAKAF

SEQ ID NO: 33561 - protein, 9 aa, Homo Sapiens
YYAVCQNLL

SEQ ID NO: 33562 - protein, 9 aa, Homo Sapiens
YYDKAFDRI

SEQ ID NO: 33563 - protein, 9 aa, Homo Sapiens
YYDKHFTEF

SEQ ID NO: 33564 - protein, 9 aa, Homo Sapiens
YYDPHQATF

SEQ ID NO: 33565 - protein, 9 aa, Homo Sapiens
YYDPKHVIF

SEQ ID NO: 33566 - protein, 9 aa, Homo Sapiens
YYEDNKQFF

SEQ ID NO: 33567 - protein, 9 aa, Homo Sapiens
YYEEQHPEL

SEQ ID NO: 33568 - protein, 9 aa, Homo Sapiens
YYEKQFPEI

SEQ ID NO: 33569 - protein, 9 aa, Homo Sapiens
YYEVHKELF

SEQ ID NO: 33570 - protein, 9 aa, Homo Sapiens
YYEYNHDLF

SEQ ID NO: 33571 - protein, 9 aa, Homo Sapiens
YYFDSYAHF

SEQ ID NO: 33572 - protein, 9 aa, Homo Sapiens
YYFPVKNVI

SEQ ID NO: 33573 - protein, 9 aa, Homo Sapiens
YYFSKLIEF

SEQ ID NO: 33574 - protein, 9 aa, Homo Sapiens
YYGDVIWVI

SEQ ID NO: 33575 - protein, 9 aa, Homo Sapiens
YYGEHLFML

SEQ ID NO: 33576 - protein, 9 aa, Homo Sapiens
YYGILQEKI

SEQ ID NO: 33577 - protein, 9 aa, Homo Sapiens
YYGLYRDLF

SEQ ID NO: 33578 - protein, 9 aa, Homo Sapiens
YYIDCIRQV

SEQ ID NO: 33579 - protein, 9 aa, Homo Sapiens
YYIDKLEYL

SEQ ID NO: 33580 - protein, 9 aa, Homo Sapiens
YYIFIPSKF

SEQ ID NO: 33581 - protein, 9 aa, Homo Sapiens
YYIIYRNVF

SEQ ID NO: 33582 - protein, 9 aa, Homo Sapiens
YYIRFFITY

SEQ ID NO: 33583 - protein, 9 aa, Homo Sapiens
YYISPRITF

SEQ ID NO: 33584 - protein, 9 aa, Homo Sapiens
YYITTRAQF

SEQ ID NO: 33585 - protein, 9 aa, Homo Sapiens
YYKQFFDRV

SEQ ID NO: 33586 - protein, 9 aa, Homo Sapiens
YYLDHSILL

SEQ ID NO: 33587 - protein, 9 aa, Homo Sapiens
YYLGKILEM

SEQ ID NO: 33588 - protein, 9 aa, Homo Sapiens
YYLNDLDRI

SEQ ID NO: 33589 - protein, 9 aa, Homo Sapiens
YYLNDLERI

SEQ ID NO: 33590 - protein, 9 aa, Homo Sapiens
YYLNEIQSF

SEQ ID NO: 33591 - protein, 9 aa, Homo Sapiens
YYLNLIELF

SEQ ID NO: 33592 - protein, 9 aa, Homo Sapiens
YYLNRTHML

SEQ ID NO: 33593 - protein, 9 aa, Homo Sapiens
YYLSKIEEL

SEQ ID NO: 33594 - protein, 9 aa, Homo Sapiens
YYLSYIEEW

SEQ ID NO: 33595 - protein, 9 aa, Homo Sapiens
YYLTFVQEL

SEQ ID NO: 33596 - protein, 9 aa, Homo Sapiens
YYLTHGLYL

SEQ ID NO: 33597 - protein, 9 aa, Homo Sapiens
YYMDYLAAL

SEQ ID NO: 33598 - protein, 9 aa, Homo Sapiens
YYMELTKLL

SEQ ID NO: 33599 - protein, 9 aa, Homo Sapiens
YYNGKWEFL

SEQ ID NO: 33600 - protein, 9 aa, Homo Sapiens
YYNGMVVFW

SEQ ID NO: 33601 - protein, 9 aa, Homo Sapiens
YYNKVSTVF

SEQ ID NO: 33602 - protein, 9 aa, Homo Sapiens
YYPELAFQF

SEQ ID NO: 33603 - protein, 9 aa, Homo Sapiens
YYPEYKLLF

SEQ ID NO: 33604 - protein, 9 aa, Homo Sapiens
YYQDTPKQI

SEQ ID NO: 33605 - protein, 9 aa, Homo Sapiens
YYQEVLQQL

SEQ ID NO: 33606 - protein, 9 aa, Homo Sapiens
YYQEYPMSI

SEQ ID NO: 33607 - protein, 9 aa, Homo Sapiens
YYQHIVTTL

SEQ ID NO: 33608 - protein, 9 aa, Homo Sapiens
YYQNYFEKL

SEQ ID NO: 33609 - protein, 9 aa, Homo Sapiens
YYQPLVHLL

SEQ ID NO: 33610 - protein, 9 aa, Homo Sapiens
YYQSSVQYL

SEQ ID NO: 33611 - protein, 9 aa, Homo Sapiens
YYQTDLVNI

SEQ ID NO: 33612 - protein, 9 aa, Homo Sapiens
YYRIFTWRF

SEQ ID NO: 33613 - protein, 9 aa, Homo Sapiens
YYRPRFFLL

SEQ ID NO: 33614 - protein, 9 aa, Homo Sapiens
YYSAVTPHL

SEQ ID NO: 33615 - protein, 9 aa, Homo Sapiens
YYSLIKMVF

SEQ ID NO: 33616 - protein, 9 aa, Homo Sapiens
YYSPHGHIL

SEQ ID NO: 33617 - protein, 9 aa, Homo Sapiens
YYTDFLITL

SEQ ID NO: 33618 - protein, 9 aa, Homo Sapiens
YYTDIMHTL

SEQ ID NO: 33619 - protein, 9 aa, Homo Sapiens
YYTEFPTVL

SEQ ID NO: 33620 - protein, 9 aa, Homo Sapiens
YYTKVYQEI

SEQ ID NO: 33621 - protein, 9 aa, Homo Sapiens
YYTPITPHL

SEQ ID NO: 33622 - protein, 9 aa, Homo Sapiens
YYTREVMLI

SEQ ID NO: 33623 - protein, 9 aa, Homo Sapiens
YYVNGTYRL

SEQ ID NO: 33624 - protein, 9 aa, Homo Sapiens
YYVRAVLHL

SEQ ID NO: 33625 - protein, 9 aa, Homo Sapiens
YYVRAWVVF

SEQ ID NO: 33626 - protein, 9 aa, Homo Sapiens
YYVWLQHTL

SEQ ID NO: 33627 - protein, 9 aa, Homo Sapiens
YYWQTSAKW

SEQ ID NO: 33628 - protein, 9 aa, Homo Sapiens
YYYINYTTI

SEQ ID NO: 33629 - protein, 10 aa, Homo Sapiens
AFFGDVVLRF

SEQ ID NO: 33630 - protein, 10 aa, Homo Sapiens
AFLYNDQLIW

SEQ ID NO: 33631 - protein, 10 aa, Homo Sapiens
AWAPKPYHKF

SEQ ID NO: 33632 - protein, 10 aa, Homo Sapiens
AYADLVKQAW

SEQ ID NO: 33633 - protein, 10 aa, Homo Sapiens
AYAELIKQMW

SEQ ID NO: 33634 - protein, 10 aa, Homo Sapiens
AYAPQGWIAF

SEQ ID NO: 33635 - protein, 10 aa, Homo Sapiens
AYARIGNSYF

SEQ ID NO: 33636 - protein, 10 aa, Homo Sapiens
AYFKRYQVKF

SEQ ID NO: 33637 - protein, 10 aa, Homo Sapiens
AYFPELIANF

SEQ ID NO: 33638 - protein, 10 aa, Homo Sapiens
AYGELRAMVL

SEQ ID NO: 33639 - protein, 10 aa, Homo Sapiens
AYGHFGRDSF

SEQ ID NO: 33640 - protein, 10 aa, Homo Sapiens
AYIAVGSISF

SEQ ID NO: 33641 - protein, 10 aa, Homo Sapiens
AYLDKKHTIF

SEQ ID NO: 33642 - protein, 10 aa, Homo Sapiens
AYLESFYKFC

SEQ ID NO: 33643 - protein, 10 aa, Homo Sapiens
AYLPEWKENI

SEQ ID NO: 33644 - protein, 10 aa, Homo Sapiens
AYLPPLQQVF

SEQ ID NO: 33645 - protein, 10 aa, Homo Sapiens
AYMDAPKAAL

SEQ ID NO: 33646 - protein, 10 aa, Homo Sapiens
AYMRSLFDYF

SEQ ID NO: 33647 - protein, 10 aa, Homo Sapiens
AYNDNWFITF

SEQ ID NO: 33648 - protein, 10 aa, Homo Sapiens
AYNEGIINLL

SEQ ID NO: 33649 - protein, 10 aa, Homo Sapiens
AYNPMARDLF

SEQ ID NO: 33650 - protein, 10 aa, Homo Sapiens
AYPDFAPQKF

SEQ ID NO: 33651 - protein, 10 aa, Homo Sapiens
AYPPAPFMHI

SEQ ID NO: 33652 - protein, 10 aa, Homo Sapiens
AYSAAKSWVF

SEQ ID NO: 33653 - protein, 10 aa, Homo Sapiens
AYVKGGLSTF

SEQ ID NO: 33654 - protein, 10 aa, Homo Sapiens
DYAAIRDNYF

SEQ ID NO: 33655 - protein, 10 aa, Homo Sapiens
DYMNLLGMIF

SEQ ID NO: 33656 - protein, 10 aa, Homo Sapiens
DYYPEYKLLF

SEQ ID NO: 33657 - protein, 10 aa, Homo Sapiens
EYIAAFLSHF

SEQ ID NO: 33658 - protein, 10 aa, Homo Sapiens
EYIPDLYNHF

SEQ ID NO: 33659 - protein, 10 aa, Homo Sapiens
EYLKNVLLQF

SEQ ID NO: 33660 - protein, 10 aa, Homo Sapiens
EYNSDLHQFF

SEQ ID NO: 33661 - protein, 10 aa, Homo Sapiens
EYPDRIMNTF

SEQ ID NO: 33662 - protein, 10 aa, Homo Sapiens
EYPLSCFALF

SEQ ID NO: 33663 - protein, 10 aa, Homo Sapiens
EYPRSLFPSL

SEQ ID NO: 33664 - protein, 10 aa, Homo Sapiens
EYSKYLQQAF

SEQ ID NO: 33665 - protein, 10 aa, Homo Sapiens
EYYDKAFDRI

SEQ ID NO: 33666 - protein, 10 aa, Homo Sapiens
FFLIGPPLLI

SEQ ID NO: 33667 - protein, 10 aa, Homo Sapiens
FYIDKDMIHI

SEQ ID NO: 33668 - protein, 10 aa, Homo Sapiens
FYINVEREEW

SEQ ID NO: 33669 - protein, 10 aa, Homo Sapiens
FYLFPNRLEW

SEQ ID NO: 33670 - protein, 10 aa, Homo Sapiens
FYNQVSTPLL

SEQ ID NO: 33671 - protein, 10 aa, Homo Sapiens
FYPPHPDYTW

SEQ ID NO: 33672 - protein, 10 aa, Homo Sapiens
FYQKEHWNYF

SEQ ID NO: 33673 - protein, 10 aa, Homo Sapiens
FYSEILDKKF

SEQ ID NO: 33674 - protein, 10 aa, Homo Sapiens
GFIMPIEVHF

SEQ ID NO: 33675 - protein, 10 aa, Homo Sapiens
GYPETLVNLI

SEQ ID NO: 33676 - protein, 10 aa, Homo Sapiens
GYTPDWIFLL

SEQ ID NO: 33677 - protein, 10 aa, Homo Sapiens
GYYNGKWEFL

SEQ ID NO: 33678 - protein, 10 aa, Homo Sapiens
HYFDPQYFEF

SEQ ID NO: 33679 - protein, 10 aa, Homo Sapiens
HYIDAGYLGF

SEQ ID NO: 33680 - protein, 10 aa, Homo Sapiens
HYIYIENQFF

SEQ ID NO: 33681 - protein, 10 aa, Homo Sapiens
HYMPPPYASL

SEQ ID NO: 33682 - protein, 10 aa, Homo Sapiens
HYQDVSCLQF

SEQ ID NO: 33683 - protein, 10 aa, Homo Sapiens
IFFGGLVFKF

SEQ ID NO: 33684 - protein, 10 aa, Homo Sapiens
IFHPTQPWVF

SEQ ID NO: 33685 - protein, 10 aa, Homo Sapiens
IFIDPGYQTF

SEQ ID NO: 33686 - protein, 10 aa, Homo Sapiens
IFIQNSKLYF

SEQ ID NO: 33687 - protein, 10 aa, Homo Sapiens
IFLPILRTGF

SEQ ID NO: 33688 - protein, 10 aa, Homo Sapiens
IFPKPPLYTF

SEQ ID NO: 33689 - protein, 10 aa, Homo Sapiens
IFTDLYYLTF

SEQ ID NO: 33690 - protein, 10 aa, Homo Sapiens
IKYPENFFLL

SEQ ID NO: 33691 - protein, 10 aa, Homo Sapiens
IWPPFQPPAW

SEQ ID NO: 33692 - protein, 10 aa, Homo Sapiens
IYADLNQNDF

SEQ ID NO: 33693 - protein, 10 aa, Homo Sapiens
IYADNQVMHF

SEQ ID NO: 33694 - protein, 10 aa, Homo Sapiens
IYADYIAPLF

SEQ ID NO: 33695 - protein, 10 aa, Homo Sapiens
IYAGAIKSSF

SEQ ID NO: 33696 - protein, 10 aa, Homo Sapiens
IYAGVGEFSF

SEQ ID NO: 33697 - protein, 10 aa, Homo Sapiens
IYANFNRIIL

SEQ ID NO: 33698 - protein, 10 aa, Homo Sapiens
IYFASVSETF

SEQ ID NO: 33699 - protein, 10 aa, Homo Sapiens
IYFDQVLVNI

SEQ ID NO: 33700 - protein, 10 aa, Homo Sapiens
IYFKNSENLW

SEQ ID NO: 33701 - protein, 10 aa, Homo Sapiens
IYFRSYKLLL

SEQ ID NO: 33702 - protein, 10 aa, Homo Sapiens
IYGEKLQFIF

SEQ ID NO: 33703 - protein, 10 aa, Homo Sapiens
IYGHWSIMKW

SEQ ID NO: 33704 - protein, 10 aa, Homo Sapiens
IYHNPTANSF

SEQ ID NO: 33705 - protein, 10 aa, Homo Sapiens
IYHTGTFAQI

SEQ ID NO: 33706 - protein, 10 aa, Homo Sapiens
IYIDASCLTW

SEQ ID NO: 33707 - protein, 10 aa, Homo Sapiens
IYISKIVVEF

SEQ ID NO: 33708 - protein, 10 aa, Homo Sapiens
IYISTLKTEF

SEQ ID NO: 33709 - protein, 10 aa, Homo Sapiens
IYKDLPFETL

SEQ ID NO: 33710 - protein, 10 aa, Homo Sapiens
IYKPVTDFFL

SEQ ID NO: 33711 - protein, 10 aa, Homo Sapiens
IYLDTHFRLL

SEQ ID NO: 33712 - protein, 10 aa, Homo Sapiens
IYLTADNLVL

SEQ ID NO: 33713 - protein, 10 aa, Homo Sapiens
IYLTFPVAMF

SEQ ID NO: 33714 - protein, 10 aa, Homo Sapiens
IYMDTLNIFM

SEQ ID NO: 33715 - protein, 10 aa, Homo Sapiens
IYMVHIQVTL

SEQ ID NO: 33716 - protein, 10 aa, Homo Sapiens
IYNGKLFDLL

SEQ ID NO: 33717 - protein, 10 aa, Homo Sapiens
IYPDLLGLQW

SEQ ID NO: 33718 - protein, 10 aa, Homo Sapiens
IYPELQIERF

SEQ ID NO: 33719 - protein, 10 aa, Homo Sapiens
IYPEYILPGI

SEQ ID NO: 33720 - protein, 10 aa, Homo Sapiens
IYPLHELALW

SEQ ID NO: 33721 - protein, 10 aa, Homo Sapiens
IYPRTQLPTW

SEQ ID NO: 33722 - protein, 10 aa, Homo Sapiens
IYPSKWIARL

SEQ ID NO: 33723 - protein, 10 aa, Homo Sapiens
IYPSPTGVLI

SEQ ID NO: 33724 - protein, 10 aa, Homo Sapiens
IYPVDLGDKF

SEQ ID NO: 33725 - protein, 10 aa, Homo Sapiens
IYQDSFEQRF

SEQ ID NO: 33726 - protein, 10 aa, Homo Sapiens
IYSDDLGVTW

SEQ ID NO: 33727 - protein, 10 aa, Homo Sapiens
IYSDTQFPSL

SEQ ID NO: 33728 - protein, 10 aa, Homo Sapiens
IYSPLLFKYF

SEQ ID NO: 33729 - protein, 10 aa, Homo Sapiens
IYSTLLQNNI

SEQ ID NO: 33730 - protein, 10 aa, Homo Sapiens
IYTDMGRFTI

SEQ ID NO: 33731 - protein, 10 aa, Homo Sapiens
IYTEMTGKLI

SEQ ID NO: 33732 - protein, 10 aa, Homo Sapiens
IYVQALIFRL

SEQ ID NO: 33733 - protein, 10 aa, Homo Sapiens
IYYTGKYQSL

SEQ ID NO: 33734 - protein, 10 aa, Homo Sapiens
KFIDPIYQVW

SEQ ID NO: 33735 - protein, 10 aa, Homo Sapiens
KFILALKVLF

SEQ ID NO: 33736 - protein, 10 aa, Homo Sapiens
KFLEHTNFEF

SEQ ID NO: 33737 - protein, 10 aa, Homo Sapiens
KFMGVQMETF

SEQ ID NO: 33738 - protein, 10 aa, Homo Sapiens
KFMPVEGMVF

SEQ ID NO: 33739 - protein, 10 aa, Homo Sapiens
KLPNFGFVVF

SEQ ID NO: 33740 - protein, 10 aa, Homo Sapiens
KMPKMKMPTF

SEQ ID NO: 33741 - protein, 10 aa, Homo Sapiens
KWNPTAGVAF

SEQ ID NO: 33742 - protein, 10 aa, Homo Sapiens
KWYDRRDYVF

SEQ ID NO: 33743 - protein, 10 aa, Homo Sapiens
KYFEVPSVLL

SEQ ID NO: 33744 - protein, 10 aa, Homo Sapiens
KYIDQGIAEL

SEQ ID NO: 33745 - protein, 10 aa, Homo Sapiens
KYIERIITRF

SEQ ID NO: 33746 - protein, 10 aa, Homo Sapiens
KYIESPVLFL

SEQ ID NO: 33747 - protein, 10 aa, Homo Sapiens
KYIETTPLTI

SEQ ID NO: 33748 - protein, 10 aa, Homo Sapiens
KYITDWQNVF

SEQ ID NO: 33749 - protein, 10 aa, Homo Sapiens
KYLADPSNLF

SEQ ID NO: 33750 - protein, 10 aa, Homo Sapiens
KYLDVKFEYL

SEQ ID NO: 33751 - protein, 10 aa, Homo Sapiens
KYLEDFITNI

SEQ ID NO: 33752 - protein, 10 aa, Homo Sapiens
KYLEDMKTYF

SEQ ID NO: 33753 - protein, 10 aa, Homo Sapiens
KYLKPSGNMF

SEQ ID NO: 33754 - protein, 10 aa, Homo Sapiens
KYLLTPVNFF

SEQ ID NO: 33755 - protein, 10 aa, Homo Sapiens
KYLPEWTAWL

SEQ ID NO: 33756 - protein, 10 aa, Homo Sapiens
KYLSVQGQLF

SEQ ID NO: 33757 - protein, 10 aa, Homo Sapiens
KYLTEGLLQF

SEQ ID NO: 33758 - protein, 10 aa, Homo Sapiens
KYLTQVDILL

SEQ ID NO: 33759 - protein, 10 aa, Homo Sapiens
KYLVIGDLLF

SEQ ID NO: 33760 - protein, 10 aa, Homo Sapiens
KYMDVVKERI

SEQ ID NO: 33761 - protein, 10 aa, Homo Sapiens
KYMTAVVKLF

SEQ ID NO: 33762 - protein, 10 aa, Homo Sapiens
KYNIYSPLLF

SEQ ID NO: 33763 - protein, 10 aa, Homo Sapiens
KYPDLFQVNL

SEQ ID NO: 33764 - protein, 10 aa, Homo Sapiens
KYPGFLLNNF

SEQ ID NO: 33765 - protein, 10 aa, Homo Sapiens
KYQILNNEVF

SEQ ID NO: 33766 - protein, 10 aa, Homo Sapiens
KYTEITATYF

SEQ ID NO: 33767 - protein, 10 aa, Homo Sapiens
KYWDVPPPGF

SEQ ID NO: 33768 - protein, 10 aa, Homo Sapiens
KYYEDNKQFF

SEQ ID NO: 33769 - protein, 10 aa, Homo Sapiens
LFFYPLDFTF

SEQ ID NO: 33770 - protein, 10 aa, Homo Sapiens
LFLPFPLPLF

SEQ ID NO: 33771 - protein, 10 aa, Homo Sapiens
LFLPRTDYSF

SEQ ID NO: 33772 - protein, 10 aa, Homo Sapiens
LYAANPGQLF

SEQ ID NO: 33773 - protein, 10 aa, Homo Sapiens
LYADVGGKQF

SEQ ID NO: 33774 - protein, 10 aa, Homo Sapiens
LYAEIRDKNF

SEQ ID NO: 33775 - protein, 10 aa, Homo Sapiens
LYAQLVQQRF

SEQ ID NO: 33776 - protein, 10 aa, Homo Sapiens
LYAVLVHTGF

SEQ ID NO: 33777 - protein, 10 aa, Homo Sapiens
LYGELCALLF

SEQ ID NO: 33778 - protein, 10 aa, Homo Sapiens
LYIDRPLPYL

SEQ ID NO: 33779 - protein, 10 aa, Homo Sapiens
LYIPPTHTFL

SEQ ID NO: 33780 - protein, 10 aa, Homo Sapiens
LYIQTDHLFF

SEQ ID NO: 33781 - protein, 10 aa, Homo Sapiens
LYIYPQSLNF

SEQ ID NO: 33782 - protein, 10 aa, Homo Sapiens
LYLDKATLIW

SEQ ID NO: 33783 - protein, 10 aa, Homo Sapiens
LYLEPQGTLF

SEQ ID NO: 33784 - protein, 10 aa, Homo Sapiens
LYLKVKGNVF

SEQ ID NO: 33785 - protein, 10 aa, Homo Sapiens
LYMVNGPPHF

SEQ ID NO: 33786 - protein, 10 aa, Homo Sapiens
LYNKDAVIEF

SEQ ID NO: 33787 - protein, 10 aa, Homo Sapiens
LYNPKITSEL

SEQ ID NO: 33788 - protein, 10 aa, Homo Sapiens
LYPDGVFYDL

SEQ ID NO: 33789 - protein, 10 aa, Homo Sapiens
LYPHIDKQYL

SEQ ID NO: 33790 - protein, 10 aa, Homo Sapiens
LYPRLKVLAF

SEQ ID NO: 33791 - protein, 10 aa, Homo Sapiens
LYQDQILEKF

SEQ ID NO: 33792 - protein, 10 aa, Homo Sapiens
LYQILQGIVF

SEQ ID NO: 33793 - protein, 10 aa, Homo Sapiens
LYQPNFNTNF

SEQ ID NO: 33794 - protein, 10 aa, Homo Sapiens
LYRDVMRETF

SEQ ID NO: 33795 - protein, 10 aa, Homo Sapiens
LYRDVTLETF

SEQ ID NO: 33796 - protein, 10 aa, Homo Sapiens
LYSILDEVIF

SEQ ID NO: 33797 - protein, 10 aa, Homo Sapiens
LYVPALSALW

SEQ ID NO: 33798 - protein, 10 aa, Homo Sapiens
LYVYPQRLNF

SEQ ID NO: 33799 - protein, 10 aa, Homo Sapiens
MFQTAVGHSF

SEQ ID NO: 33800 - protein, 10 aa, Homo Sapiens
MWKEGNRIHF

SEQ ID NO: 33801 - protein, 10 aa, Homo Sapiens
MWSPTHPALF

SEQ ID NO: 33802 - protein, 10 aa, Homo Sapiens
MYGDYKYTYW

SEQ ID NO: 33803 - protein, 10 aa, Homo Sapiens
MYINDKLPYF

SEQ ID NO: 33804 - protein, 10 aa, Homo Sapiens
MYIVGQYPRF

SEQ ID NO: 33805 - protein, 10 aa, Homo Sapiens
MYLPEAKESF

SEQ ID NO: 33806 - protein, 10 aa, Homo Sapiens
MYMENFIEHL

SEQ ID NO: 33807 - protein, 10 aa, Homo Sapiens
MYPGLQVYTF

SEQ ID NO: 33808 - protein, 10 aa, Homo Sapiens
MYPRLGGFVM

SEQ ID NO: 33809 - protein, 10 aa, Homo Sapiens
NFLHPINTIF

SEQ ID NO: 33810 - protein, 10 aa, Homo Sapiens
NPIHYNITSI

SEQ ID NO: 33811 - protein, 10 aa, Homo Sapiens
NYAGRWDVLI

SEQ ID NO: 33812 - protein, 10 aa, Homo Sapiens
NYATGQWTRF

SEQ ID NO: 33813 - protein, 10 aa, Homo Sapiens
NYFIPEFNLF

SEQ ID NO: 33814 - protein, 10 aa, Homo Sapiens
NYGDYFNVFF

SEQ ID NO: 33815 - protein, 10 aa, Homo Sapiens
NYIDIVKYVF

SEQ ID NO: 33816 - protein, 10 aa, Homo Sapiens
NYIEKNMERF

SEQ ID NO: 33817 - protein, 10 aa, Homo Sapiens
NYITPNPIFF

SEQ ID NO: 33818 - protein, 10 aa, Homo Sapiens
NYIVPDKQIF

SEQ ID NO: 33819 - protein, 10 aa, Homo Sapiens
NYKDLNGNVF

SEQ ID NO: 33820 - protein, 10 aa, Homo Sapiens
NYKNPDQVYL

SEQ ID NO: 33821 - protein, 10 aa, Homo Sapiens
NYKPPNAEEF

SEQ ID NO: 33822 - protein, 10 aa, Homo Sapiens
NYLLESPHRF

SEQ ID NO: 33823 - protein, 10 aa, Homo Sapiens
NYMMDWKNQF

SEQ ID NO: 33824 - protein, 10 aa, Homo Sapiens
NYPDRNLPTI

SEQ ID NO: 33825 - protein, 10 aa, Homo Sapiens
NYVVIGTCTF

SEQ ID NO: 33826 - protein, 10 aa, Homo Sapiens
NYYEVHKELF

SEQ ID NO: 33827 - protein, 10 aa, Homo Sapiens
PFHPPLQLFF

SEQ ID NO: 33828 - protein, 10 aa, Homo Sapiens
PFYRGERITF

SEQ ID NO: 33829 - protein, 10 aa, Homo Sapiens
PGALLKYIGP

SEQ ID NO: 33830 - protein, 10 aa, Homo Sapiens
PWFAGNKITF

SEQ ID NO: 33831 - protein, 10 aa, Homo Sapiens
PYAKPIPAQF

SEQ ID NO: 33832 - protein, 10 aa, Homo Sapiens
PYNPIIGETF

SEQ ID NO: 33833 - protein, 10 aa, Homo Sapiens
PYSEPMPLSF

SEQ ID NO: 33834 - protein, 10 aa, Homo Sapiens
PYSPRFLEVF

SEQ ID NO: 33835 - protein, 10 aa, Homo Sapiens
PYTDVNIVTI

SEQ ID NO: 33836 - protein, 10 aa, Homo Sapiens
QVYMDWYEKF

SEQ ID NO: 33837 - protein, 10 aa, Homo Sapiens
QYFDSRGMFI

SEQ ID NO: 33838 - protein, 10 aa, Homo Sapiens
QYFSSGKYYW

SEQ ID NO: 33839 - protein, 10 aa, Homo Sapiens
QYGSALAHFF

SEQ ID NO: 33840 - protein, 10 aa, Homo Sapiens
QYLDNLLVRF

SEQ ID NO: 33841 - protein, 10 aa, Homo Sapiens
QYLHRFAAYF

SEQ ID NO: 33842 - protein, 10 aa, Homo Sapiens
QYLPAIRALW

SEQ ID NO: 33843 - protein, 10 aa, Homo Sapiens
QYLTFKPQTF

SEQ ID NO: 33844 - protein, 10 aa, Homo Sapiens
QYMEEIYHRI

SEQ ID NO: 33845 - protein, 10 aa, Homo Sapiens
QYNPKFQTLF

SEQ ID NO: 33846 - protein, 10 aa, Homo Sapiens
QYNTYPIKLF

SEQ ID NO: 33847 - protein, 10 aa, Homo Sapiens
QYPVIIHLIW

SEQ ID NO: 33848 - protein, 10 aa, Homo Sapiens
QYSDALEHLL

SEQ ID NO: 33849 - protein, 10 aa, Homo Sapiens
QYSNNIRQLL

SEQ ID NO: 33850 - protein, 10 aa, Homo Sapiens
QYWEAQGWTF

SEQ ID NO: 33851 - protein, 10 aa, Homo Sapiens
RFLDDLGLKF

SEQ ID NO: 33852 - protein, 10 aa, Homo Sapiens
RFLESHWFVW

SEQ ID NO: 33853 - protein, 10 aa, Homo Sapiens
RFPEELTQTF

SEQ ID NO: 33854 - protein, 10 aa, Homo Sapiens
RLDLPPYPSF

SEQ ID NO: 33855 - protein, 10 aa, Homo Sapiens
RLFDPINLVF

SEQ ID NO: 33856 - protein, 10 aa, Homo Sapiens
RWFQPAIPSW

SEQ ID NO: 33857 - protein, 10 aa, Homo Sapiens
RWFTHASPTL

SEQ ID NO: 33858 - protein, 10 aa, Homo Sapiens
RWLAQPYYLL

SEQ ID NO: 33859 - protein, 10 aa, Homo Sapiens
RWLDGSPVTL

SEQ ID NO: 33860 - protein, 10 aa, Homo Sapiens
RWSPVRPLVF

SEQ ID NO: 33861 - protein, 10 aa, Homo Sapiens
RWSTISENLF

SEQ ID NO: 33862 - protein, 10 aa, Homo Sapiens
RYAEEVGIFF

SEQ ID NO: 33863 - protein, 10 aa, Homo Sapiens
RYAKIVEIPF

SEQ ID NO: 33864 - protein, 10 aa, Homo Sapiens
RYAVVLNATW

SEQ ID NO: 33865 - protein, 10 aa, Homo Sapiens
RYFDPANGKF

SEQ ID NO: 33866 - protein, 10 aa, Homo Sapiens
RYFDVGLHNF

SEQ ID NO: 33867 - protein, 10 aa, Homo Sapiens
RYFISHVLAF

SEQ ID NO: 33868 - protein, 10 aa, Homo Sapiens
RYFPTQALNF

SEQ ID NO: 33869 - protein, 10 aa, Homo Sapiens
RYIDRIHIFF

SEQ ID NO: 33870 - protein, 10 aa, Homo Sapiens
RYIHPQQEAF

SEQ ID NO: 33871 - protein, 10 aa, Homo Sapiens
RYIPSLPDRI

SEQ ID NO: 33872 - protein, 10 aa, Homo Sapiens
RYIQPWESEF

SEQ ID NO: 33873 - protein, 10 aa, Homo Sapiens
RYIQWVEENF

SEQ ID NO: 33874 - protein, 10 aa, Homo Sapiens
RYKGPGFEYF

SEQ ID NO: 33875 - protein, 10 aa, Homo Sapiens
RYLDLILNDF

SEQ ID NO: 33876 - protein, 10 aa, Homo Sapiens
RYLENGKETL

SEQ ID NO: 33877 - protein, 10 aa, Homo Sapiens
RYLNKAFHIW

SEQ ID NO: 33878 - protein, 10 aa, Homo Sapiens
RYLNSQQQYF

SEQ ID NO: 33879 - protein, 10 aa, Homo Sapiens
RYLPTGSFPF

SEQ ID NO: 33880 - protein, 10 aa, Homo Sapiens
RYLRELPLLF

SEQ ID NO: 33881 - protein, 10 aa, Homo Sapiens
RYMDQWVPVI

SEQ ID NO: 33882 - protein, 10 aa, Homo Sapiens
RYMPQNPCII

SEQ ID NO: 33883 - protein, 10 aa, Homo Sapiens
RYMPQNPHII

SEQ ID NO: 33884 - protein, 10 aa, Homo Sapiens
RYPDNLKHLY

SEQ ID NO: 33885 - protein, 10 aa, Homo Sapiens
RYPDTIALTF

SEQ ID NO: 33886 - protein, 10 aa, Homo Sapiens
RYPNSHTHYF

SEQ ID NO: 33887 - protein, 10 aa, Homo Sapiens
RYPPDIRATF

SEQ ID NO: 33888 - protein, 10 aa, Homo Sapiens
RYPPKSGNYF

SEQ ID NO: 33889 - protein, 10 aa, Homo Sapiens
RYPVCKFPSL

SEQ ID NO: 33890 - protein, 10 aa, Homo Sapiens
RYPVGRFPSL

SEQ ID NO: 33891 - protein, 10 aa, Homo Sapiens
RYQNIWNINL

SEQ ID NO: 33892 - protein, 10 aa, Homo Sapiens
RYSNLILNLF

SEQ ID NO: 33893 - protein, 10 aa, Homo Sapiens
RYSTPHAFTF

SEQ ID NO: 33894 - protein, 10 aa, Homo Sapiens
RYTDIDYQVF

SEQ ID NO: 33895 - protein, 10 aa, Homo Sapiens
RYTVGGLETF

SEQ ID NO: 33896 - protein, 10 aa, Homo Sapiens
RYVFQSENTF

SEQ ID NO: 33897 - protein, 10 aa, Homo Sapiens
RYYDVPIATL

SEQ ID NO: 33898 - protein, 10 aa, Homo Sapiens
SFFKISYLTF

SEQ ID NO: 33899 - protein, 10 aa, Homo Sapiens
SWMELPGLKF

SEQ ID NO: 33900 - protein, 10 aa, Homo Sapiens
SYASLQQNKW

SEQ ID NO: 33901 - protein, 10 aa, Homo Sapiens
SYDPLRIYLF

SEQ ID NO: 33902 - protein, 10 aa, Homo Sapiens
SYFEHNLETW

SEQ ID NO: 33903 - protein, 10 aa, Homo Sapiens
SYFEKGPLTF

SEQ ID NO: 33904 - protein, 10 aa, Homo Sapiens
SYIDRLISVF

SEQ ID NO: 33905 - protein, 10 aa, Homo Sapiens
SYIPYNPQQF

SEQ ID NO: 33906 - protein, 10 aa, Homo Sapiens
SYKPAPFFVL

SEQ ID NO: 33907 - protein, 10 aa, Homo Sapiens
SYLDCELTKF

SEQ ID NO: 33908 - protein, 10 aa, Homo Sapiens
SYLDQVKLQF

SEQ ID NO: 33909 - protein, 10 aa, Homo Sapiens
SYLEKQVVTF

SEQ ID NO: 33910 - protein, 10 aa, Homo Sapiens
SYLLPAIVHI

SEQ ID NO: 33911 - protein, 10 aa, Homo Sapiens
SYLLPGMASF

SEQ ID NO: 33912 - protein, 10 aa, Homo Sapiens
SYLMYNKEHI

SEQ ID NO: 33913 - protein, 10 aa, Homo Sapiens
SYLPVGSVSF

SEQ ID NO: 33914 - protein, 10 aa, Homo Sapiens
SYMFVDENTF

SEQ ID NO: 33915 - protein, 10 aa, Homo Sapiens
SYMPARVVVF

SEQ ID NO: 33916 - protein, 10 aa, Homo Sapiens
SYNHFAAIYF

SEQ ID NO: 33917 - protein, 10 aa, Homo Sapiens
SYPELVKMVW

SEQ ID NO: 33918 - protein, 10 aa, Homo Sapiens
SYPQEVIPTF

SEQ ID NO: 33919 - protein, 10 aa, Homo Sapiens
SYVDKNLELF

SEQ ID NO: 33920 - protein, 10 aa, Homo Sapiens
TFAVTDELVF

SEQ ID NO: 33921 - protein, 10 aa, Homo Sapiens
TWFNQPARKI

SEQ ID NO: 33922 - protein, 10 aa, Homo Sapiens
TWFPKTPMLF

SEQ ID NO: 33923 - protein, 10 aa, Homo Sapiens
TWYPVSIPAF

SEQ ID NO: 33924 - protein, 10 aa, Homo Sapiens
TYFNGDLKNF

SEQ ID NO: 33925 - protein, 10 aa, Homo Sapiens
TYIIPRSVLF

SEQ ID NO: 33926 - protein, 10 aa, Homo Sapiens
TYIPGTQITF

SEQ ID NO: 33927 - protein, 10 aa, Homo Sapiens
TYIPPLLVAF

SEQ ID NO: 33928 - protein, 10 aa, Homo Sapiens
TYIRLYGRKF

SEQ ID NO: 33929 - protein, 10 aa, Homo Sapiens
TYLDQVKIRF

SEQ ID NO: 33930 - protein, 10 aa, Homo Sapiens
TYMDRVFKQF

SEQ ID NO: 33931 - protein, 10 aa, Homo Sapiens
TYMGHTGAVW

SEQ ID NO: 33932 - protein, 10 aa, Homo Sapiens
TYNEPGSQVF

SEQ ID NO: 33933 - protein, 10 aa, Homo Sapiens
TYNKHINISF

SEQ ID NO: 33934 - protein, 10 aa, Homo Sapiens
TYNPNMPFKW

SEQ ID NO: 33935 - protein, 10 aa, Homo Sapiens
TYPQLEGFKF

SEQ ID NO: 33936 - protein, 10 aa, Homo Sapiens
TYQHVPVESF

SEQ ID NO: 33937 - protein, 10 aa, Homo Sapiens
TYRPLNDVHI

SEQ ID NO: 33938 - protein, 10 aa, Homo Sapiens
TYSPALNKMF

SEQ ID NO: 33939 - protein, 10 aa, Homo Sapiens
TYTDVTPRQF

SEQ ID NO: 33940 - protein, 10 aa, Homo Sapiens
TYTSYLDKFF

SEQ ID NO: 33941 - protein, 10 aa, Homo Sapiens
VFDTAIAHLF

SEQ ID NO: 33942 - protein, 10 aa, Homo Sapiens
VFFKELIQEF

SEQ ID NO: 33943 - protein, 10 aa, Homo Sapiens
VFFKGFKWGF

SEQ ID NO: 33944 - protein, 10 aa, Homo Sapiens
VFHPSQDLVF

SEQ ID NO: 33945 - protein, 10 aa, Homo Sapiens
VFINVPTVSF

SEQ ID NO: 33946 - protein, 10 aa, Homo Sapiens
VFLNLHTLKF

SEQ ID NO: 33947 - protein, 10 aa, Homo Sapiens
VFLPREDHLF

SEQ ID NO: 33948 - protein, 10 aa, Homo Sapiens
VFMFPVGLYY

SEQ ID NO: 33949 - protein, 10 aa, Homo Sapiens
VFPRLHNVLF

SEQ ID NO: 33950 - protein, 10 aa, Homo Sapiens
VFVQGPAWQF

SEQ ID NO: 33951 - protein, 10 aa, Homo Sapiens
VQPRNWLLFA

SEQ ID NO: 33952 - protein, 10 aa, Homo Sapiens
VSAAGLVQGL

SEQ ID NO: 33953 - protein, 10 aa, Homo Sapiens
VWDTAGQEKF

SEQ ID NO: 33954 - protein, 10 aa, Homo Sapiens
VWFPDMMPTW

SEQ ID NO: 33955 - protein, 10 aa, Homo Sapiens
VWLEEELKTF

SEQ ID NO: 33956 - protein, 10 aa, Homo Sapiens
VWNPRSHEKL

SEQ ID NO: 33957 - protein, 10 aa, Homo Sapiens
VWTPIPVLTW

SEQ ID NO: 33958 - protein, 10 aa, Homo Sapiens
VYAALQRQLL

SEQ ID NO: 33959 - protein, 10 aa, Homo Sapiens
VYADTCFSTI

SEQ ID NO: 33960 - protein, 10 aa, Homo Sapiens
VYAEVSRLLL

SEQ ID NO: 33961 - protein, 10 aa, Homo Sapiens
VYAHIYHQHF

SEQ ID NO: 33962 - protein, 10 aa, Homo Sapiens
VYAILTHGIF

SEQ ID NO: 33963 - protein, 10 aa, Homo Sapiens
VYAVIPAEKF

SEQ ID NO: 33964 - protein, 10 aa, Homo Sapiens
VYDDMAFRYL

SEQ ID NO: 33965 - protein, 10 aa, Homo Sapiens
VYDPSLKTLL

SEQ ID NO: 33966 - protein, 10 aa, Homo Sapiens
VYFEGSDFKF

SEQ ID NO: 33967 - protein, 10 aa, Homo Sapiens
VYFEGSIYEI

SEQ ID NO: 33968 - protein, 10 aa, Homo Sapiens
VYFPALTSLL

SEQ ID NO: 33969 - protein, 10 aa, Homo Sapiens
VYIHPSSALF

SEQ ID NO: 33970 - protein, 10 aa, Homo Sapiens
VYILPAAYFW

SEQ ID NO: 33971 - protein, 10 aa, Homo Sapiens
VYIPVLPPHL

SEQ ID NO: 33972 - protein, 10 aa, Homo Sapiens
VYIRGSKIRF

SEQ ID NO: 33973 - protein, 10 aa, Homo Sapiens
VYITNFHVRM

SEQ ID NO: 33974 - protein, 10 aa, Homo Sapiens
VYITNYRLYL

SEQ ID NO: 33975 - protein, 10 aa, Homo Sapiens
VYKAFVMETF

SEQ ID NO: 33976 - protein, 10 aa, Homo Sapiens
VYKDSFELKF

SEQ ID NO: 33977 - protein, 10 aa, Homo Sapiens
VYLAKLGNFF

SEQ ID NO: 33978 - protein, 10 aa, Homo Sapiens
VYLDRKLLTL

SEQ ID NO: 33979 - protein, 10 aa, Homo Sapiens
VYLGLPIFRF

SEQ ID NO: 33980 - protein, 10 aa, Homo Sapiens
VYLPCLQNIF

SEQ ID NO: 33981 - protein, 10 aa, Homo Sapiens
VYLPGSRQTL

SEQ ID NO: 33982 - protein, 10 aa, Homo Sapiens
VYLPPEAFTF

SEQ ID NO: 33983 - protein, 10 aa, Homo Sapiens
VYLQNWSHVL

SEQ ID NO: 33984 - protein, 10 aa, Homo Sapiens
VYLTIKPLNL

SEQ ID NO: 33985 - protein, 10 aa, Homo Sapiens
VYNEKIHDLL

SEQ ID NO: 33986 - protein, 10 aa, Homo Sapiens
VYNENLVHMI

SEQ ID NO: 33987 - protein, 10 aa, Homo Sapiens
VYNEQIRDLL

SEQ ID NO: 33988 - protein, 10 aa, Homo Sapiens
VYNIHLAVNF

SEQ ID NO: 33989 - protein, 10 aa, Homo Sapiens
VYNNIMRHYL

SEQ ID NO: 33990 - protein, 10 aa, Homo Sapiens
VYNPLLFDKL

SEQ ID NO: 33991 - protein, 10 aa, Homo Sapiens
VYNSWKNNKF

SEQ ID NO: 33992 - protein, 10 aa, Homo Sapiens
VYPDTVALTF

SEQ ID NO: 33993 - protein, 10 aa, Homo Sapiens
VYPEKLATKF

SEQ ID NO: 33994 - protein, 10 aa, Homo Sapiens
VYPESIPRKF

SEQ ID NO: 33995 - protein, 10 aa, Homo Sapiens
VYPLYTIVFI

SEQ ID NO: 33996 - protein, 10 aa, Homo Sapiens
VYQPVTTECF

SEQ ID NO: 33997 - protein, 10 aa, Homo Sapiens
VYSAAILEYL

SEQ ID NO: 33998 - protein, 10 aa, Homo Sapiens
VYSDLHAFYY

SEQ ID NO: 33999 - protein, 10 aa, Homo Sapiens
VYSEVAAYEF

SEQ ID NO: 34000 - protein, 10 aa, Homo Sapiens
VYSIINGIVF

SEQ ID NO: 34001 - protein, 10 aa, Homo Sapiens
VYSPNMRWII

SEQ ID NO: 34002 - protein, 10 aa, Homo Sapiens
VYTLDIPVLF

SEQ ID NO: 34003 - protein, 10 aa, Homo Sapiens
VYTPTDTLVF

SEQ ID NO: 34004 - protein, 10 aa, Homo Sapiens
VYTPVDSLVF

SEQ ID NO: 34005 - protein, 10 aa, Homo Sapiens
VYTVVDEMFL

SEQ ID NO: 34006 - protein, 10 aa, Homo Sapiens
VYVDFEGINF

SEQ ID NO: 34007 - protein, 10 aa, Homo Sapiens
VYVPKEEQLF

SEQ ID NO: 34008 - protein, 10 aa, Homo Sapiens
WYPFFRGVTI

SEQ ID NO: 34009 - protein, 10 aa, Homo Sapiens
YFFDAAKLMF

SEQ ID NO: 34010 - protein, 10 aa, Homo Sapiens
YFISPQGLKF

SEQ ID NO: 34011 - protein, 10 aa, Homo Sapiens
YFISPTGHSL

SEQ ID NO: 34012 - protein, 10 aa, Homo Sapiens
YNILRGIGKL

SEQ ID NO: 34013 - protein, 10 aa, Homo Sapiens
YWKIYNSIYI

SEQ ID NO: 34014 - protein, 10 aa, Homo Sapiens
YYDDLKYRYF

SEQ ID NO: 34015 - protein, 10 aa, Homo Sapiens
YYFEGIKQTF

SEQ ID NO: 34016 - protein, 10 aa, Homo Sapiens
YYGPLNLLTF

SEQ ID NO: 34017 - protein, 10 aa, Homo Sapiens
YYIDDVFHAL

SEQ ID NO: 34018 - protein, 10 aa, Homo Sapiens
YYINKISSTL

SEQ ID NO: 34019 - protein, 10 aa, Homo Sapiens
YYIQNGIQSF

SEQ ID NO: 34020 - protein, 10 aa, Homo Sapiens
YYLQGGFNKF

SEQ ID NO: 34021 - protein, 10 aa, Homo Sapiens
YYLQHPPISF

SEQ ID NO: 34022 - protein, 10 aa, Homo Sapiens
YYLTPDGQRF

SEQ ID NO: 34023 - protein, 10 aa, Homo Sapiens
YYMELTKLLL

SEQ ID NO: 34024 - protein, 10 aa, Homo Sapiens
YYMKDLPTSF

SEQ ID NO: 34025 - protein, 10 aa, Homo Sapiens
YYMTPRDFLF

SEQ ID NO: 34026 - protein, 10 aa, Homo Sapiens
YYNAAGFNKL

SEQ ID NO: 34027 - protein, 10 aa, Homo Sapiens
YYNKVSTVFW

SEQ ID NO: 34028 - protein, 10 aa, Homo Sapiens
YYPAQGVQQF

SEQ ID NO: 34029 - protein, 10 aa, Homo Sapiens
YYQTPRLWLF

SEQ ID NO: 34030 - protein, 10 aa, Homo Sapiens
YYSHLEGARF

SEQ ID NO: 34031 - protein, 10 aa, Homo Sapiens
YYTWTDGYRF

SEQ ID NO: 34032 - protein, 11 aa, Homo Sapiens
AFLDKQNQVKF

SEQ ID NO: 34033 - protein, 11 aa, Homo Sapiens
AFLEINRQLLF

SEQ ID NO: 34034 - protein, 11 aa, Homo Sapiens
ARLQQLLFVIF

SEQ ID NO: 34035 - protein, 11 aa, Homo Sapiens
AWLPHVADFRW

SEQ ID NO: 34036 - protein, 11 aa, Homo Sapiens
AYAPQGWIAFF

SEQ ID NO: 34037 - protein, 11 aa, Homo Sapiens
AYATFIVTNYW

SEQ ID NO: 34038 - protein, 11 aa, Homo Sapiens
AYIPLNNYLVF

SEQ ID NO: 34039 - protein, 11 aa, Homo Sapiens
AYLECIERITF

SEQ ID NO: 34040 - protein, 11 aa, Homo Sapiens
AYLPVNESFGF

SEQ ID NO: 34041 - protein, 11 aa, Homo Sapiens
AYMELQQKAEF

SEQ ID NO: 34042 - protein, 11 aa, Homo Sapiens
AYMQEPLFVEF

SEQ ID NO: 34043 - protein, 11 aa, Homo Sapiens
AYPPAPFMHIL

SEQ ID NO: 34044 - protein, 11 aa, Homo Sapiens
AYSTAPGYYSW

SEQ ID NO: 34045 - protein, 11 aa, Homo Sapiens
AYSTVPGYYSW

SEQ ID NO: 34046 - protein, 11 aa, Homo Sapiens
AYYPAQGVQQF

SEQ ID NO: 34047 - protein, 11 aa, Homo Sapiens
AYYSHLEGARF

SEQ ID NO: 34048 - protein, 11 aa, Homo Sapiens
DYIDGILIKTF

SEQ ID NO: 34049 - protein, 11 aa, Homo Sapiens
DYLDSIYFNRF

SEQ ID NO: 34050 - protein, 11 aa, Homo Sapiens
DYVPPELITLF

SEQ ID NO: 34051 - protein, 11 aa, Homo Sapiens
EFPDKVFAEKW

SEQ ID NO: 34052 - protein, 11 aa, Homo Sapiens
EWSPYTKIFQF

SEQ ID NO: 34053 - protein, 11 aa, Homo Sapiens
EYFRVPDSATF

SEQ ID NO: 34054 - protein, 11 aa, Homo Sapiens
EYIPEGEILVI

SEQ ID NO: 34055 - protein, 11 aa, Homo Sapiens
EYLDRIGQLFF

SEQ ID NO: 34056 - protein, 11 aa, Homo Sapiens
EYLPIGGLAEF

SEQ ID NO: 34057 - protein, 11 aa, Homo Sapiens
EYLSKQDLLFL

SEQ ID NO: 34058 - protein, 11 aa, Homo Sapiens
EYLTPEEMVTF

SEQ ID NO: 34059 - protein, 11 aa, Homo Sapiens
EYMLEKSFYQF

SEQ ID NO: 34060 - protein, 11 aa, Homo Sapiens
EYMPGGDLVNL

SEQ ID NO: 34061 - protein, 11 aa, Homo Sapiens
EYMRSGLYSTF

SEQ ID NO: 34062 - protein, 11 aa, Homo Sapiens
EYQLIDCAQYF

SEQ ID NO: 34063 - protein, 11 aa, Homo Sapiens
EYSLFPGQVVI

SEQ ID NO: 34064 - protein, 11 aa, Homo Sapiens
EYVDDTQFLRF

SEQ ID NO: 34065 - protein, 11 aa, Homo Sapiens
FYIPDGSFTNI

SEQ ID NO: 34066 - protein, 11 aa, Homo Sapiens
FYIPPLATHTI

SEQ ID NO: 34067 - protein, 11 aa, Homo Sapiens
FYLNQSTAYHF

SEQ ID NO: 34068 - protein, 11 aa, Homo Sapiens
FYLPGLAPVNF

SEQ ID NO: 34069 - protein, 11 aa, Homo Sapiens
FYLPKDAVKHL

SEQ ID NO: 34070 - protein, 11 aa, Homo Sapiens
FYLPLDAIKQL

SEQ ID NO: 34071 - protein, 11 aa, Homo Sapiens
FYPEEVSSMVL

SEQ ID NO: 34072 - protein, 11 aa, Homo Sapiens
FYQPDLKYLSF

SEQ ID NO: 34073 - protein, 11 aa, Homo Sapiens
FYVPAEPKLAF

SEQ ID NO: 34074 - protein, 11 aa, Homo Sapiens
GFYPAEITLTW

SEQ ID NO: 34075 - protein, 11 aa, Homo Sapiens
GWLPPELLGLW

SEQ ID NO: 34076 - protein, 11 aa, Homo Sapiens
GWYDEEHPLVF

SEQ ID NO: 34077 - protein, 11 aa, Homo Sapiens
GYADKNLIAKW

SEQ ID NO: 34078 - protein, 11 aa, Homo Sapiens
GYLPNQLFRTF

SEQ ID NO: 34079 - protein, 11 aa, Homo Sapiens
HYNSDLNNLLF

SEQ ID NO: 34080 - protein, 11 aa, Homo Sapiens
HYSQELSLLYL

SEQ ID NO: 34081 - protein, 11 aa, Homo Sapiens
HYVDLKDRPFF

SEQ ID NO: 34082 - protein, 11 aa, Homo Sapiens
IFITEKHGNYF

SEQ ID NO: 34083 - protein, 11 aa, Homo Sapiens
IFKPPDPDNTF

SEQ ID NO: 34084 - protein, 11 aa, Homo Sapiens
IFLDPHTTQTF

SEQ ID NO: 34085 - protein, 11 aa, Homo Sapiens
IFSPTSNLLLL

SEQ ID NO: 34086 - protein, 11 aa, Homo Sapiens
IFSQKLGYLLF

SEQ ID NO: 34087 - protein, 11 aa, Homo Sapiens
IFSTITSKMNL

SEQ ID NO: 34088 - protein, 11 aa, Homo Sapiens
IYAKVDRLEAF

SEQ ID NO: 34089 - protein, 11 aa, Homo Sapiens
IYDHINEGKLW

SEQ ID NO: 34090 - protein, 11 aa, Homo Sapiens
IYDPNLAFLRF

SEQ ID NO: 34091 - protein, 11 aa, Homo Sapiens
IYDTSTDRLLW

SEQ ID NO: 34092 - protein, 11 aa, Homo Sapiens
IYEIIDNSQGF

SEQ ID NO: 34093 - protein, 11 aa, Homo Sapiens
IYFPEGSGVKI

SEQ ID NO: 34094 - protein, 11 aa, Homo Sapiens
IYFPKKEAVTF

SEQ ID NO: 34095 - protein, 11 aa, Homo Sapiens
IYLAPGDYHCF

SEQ ID NO: 34096 - protein, 11 aa, Homo Sapiens
IYLLENGLNLF

SEQ ID NO: 34097 - protein, 11 aa, Homo Sapiens
IYLNHIEPLKI

SEQ ID NO: 34098 - protein, 11 aa, Homo Sapiens
IYLPEADSILF

SEQ ID NO: 34099 - protein, 11 aa, Homo Sapiens
IYLPIANVARI

SEQ ID NO: 34100 - protein, 11 aa, Homo Sapiens
IYMEDGLIKQI

SEQ ID NO: 34101 - protein, 11 aa, Homo Sapiens
IYNGDMEKILL

SEQ ID NO: 34102 - protein, 11 aa, Homo Sapiens
IYPATIASIDF

SEQ ID NO: 34103 - protein, 11 aa, Homo Sapiens
IYPPINVLPSL

SEQ ID NO: 34104 - protein, 11 aa, Homo Sapiens
IYPSNMQTMLL

SEQ ID NO: 34105 - protein, 11 aa, Homo Sapiens
IYPTGLFTPEL

SEQ ID NO: 34106 - protein, 11 aa, Homo Sapiens
IYQDRDQFAKL

SEQ ID NO: 34107 - protein, 11 aa, Homo Sapiens
IYQEIILANHF

SEQ ID NO: 34108 - protein, 11 aa, Homo Sapiens
IYREFREEESL

SEQ ID NO: 34109 - protein, 11 aa, Homo Sapiens
IYRGPFADENF

SEQ ID NO: 34110 - protein, 11 aa, Homo Sapiens
IYSEVMEALKL

SEQ ID NO: 34111 - protein, 11 aa, Homo Sapiens
IYSPDHSSNNF

SEQ ID NO: 34112 - protein, 11 aa, Homo Sapiens
IYSPDHTNNSF

SEQ ID NO: 34113 - protein, 11 aa, Homo Sapiens
IYSRIDRLEAF

SEQ ID NO: 34114 - protein, 11 aa, Homo Sapiens
IYSTLVTCVTF

SEQ ID NO: 34115 - protein, 11 aa, Homo Sapiens
IYSVFRNAASF

SEQ ID NO: 34116 - protein, 11 aa, Homo Sapiens
IYTDQAGQWRI

SEQ ID NO: 34117 - protein, 11 aa, Homo Sapiens
IYTHGLALLGF

SEQ ID NO: 34118 - protein, 11 aa, Homo Sapiens
IYTVKVEDLTF

SEQ ID NO: 34119 - protein, 11 aa, Homo Sapiens
IYVGIESNHLL

SEQ ID NO: 34120 - protein, 11 aa, Homo Sapiens
IYVNPANTHQF

SEQ ID NO: 34121 - protein, 11 aa, Homo Sapiens
KFYPPKVELFF

SEQ ID NO: 34122 - protein, 11 aa, Homo Sapiens
KIKYPENFFLL

SEQ ID NO: 34123 - protein, 11 aa, Homo Sapiens
KLPDVYGVFQF

SEQ ID NO: 34124 - protein, 11 aa, Homo Sapiens
KWFTDTSIILF

SEQ ID NO: 34125 - protein, 11 aa, Homo Sapiens
KWFTETSIILF

SEQ ID NO: 34126 - protein, 11 aa, Homo Sapiens
KWLEPLKNLRF

SEQ ID NO: 34127 - protein, 11 aa, Homo Sapiens
KYDPSIGIYGL

SEQ ID NO: 34128 - protein, 11 aa, Homo Sapiens
KYFAQEALTVL

SEQ ID NO: 34129 - protein, 11 aa, Homo Sapiens
KYIDKTIRVKF

SEQ ID NO: 34130 - protein, 11 aa, Homo Sapiens
KYIDQKFVLQL

SEQ ID NO: 34131 - protein, 11 aa, Homo Sapiens
KYIENLDNITF

SEQ ID NO: 34132 - protein, 11 aa, Homo Sapiens
KYISKPENLKL

SEQ ID NO: 34133 - protein, 11 aa, Homo Sapiens
KYISPETMVAL

SEQ ID NO: 34134 - protein, 11 aa, Homo Sapiens
KYITQGQLLQF

SEQ ID NO: 34135 - protein, 11 aa, Homo Sapiens
KYKNSEINFSF

SEQ ID NO: 34136 - protein, 11 aa, Homo Sapiens
KYLAILGSVTF

SEQ ID NO: 34137 - protein, 11 aa, Homo Sapiens
KYLDEDTIYHL

SEQ ID NO: 34138 - protein, 11 aa, Homo Sapiens
KYLDEFLLNKI

SEQ ID NO: 34139 - protein, 11 aa, Homo Sapiens
KYLEESTIRHF

SEQ ID NO: 34140 - protein, 11 aa, Homo Sapiens
KYLNENQLSQL

SEQ ID NO: 34141 - protein, 11 aa, Homo Sapiens
KYLNWDAVFRF

SEQ ID NO: 34142 - protein, 11 aa, Homo Sapiens
KYLYEEYLQAF

SEQ ID NO: 34143 - protein, 11 aa, Homo Sapiens
KYMGIPQIRQL

SEQ ID NO: 34144 - protein, 11 aa, Homo Sapiens
KYMPNVKVAVF

SEQ ID NO: 34145 - protein, 11 aa, Homo Sapiens
KYMPSVKVSVF

SEQ ID NO: 34146 - protein, 11 aa, Homo Sapiens
KYPENDLFRKL

SEQ ID NO: 34147 - protein, 11 aa, Homo Sapiens
KYPGHLAAITL

SEQ ID NO: 34148 - protein, 11 aa, Homo Sapiens
KYQEVTNNLEF

SEQ ID NO: 34149 - protein, 11 aa, Homo Sapiens
KYSVINEINKI

SEQ ID NO: 34150 - protein, 11 aa, Homo Sapiens
LFIPSSKLLFL

SEQ ID NO: 34151 - protein, 11 aa, Homo Sapiens
LFLDSNGLFLF

SEQ ID NO: 34152 - protein, 11 aa, Homo Sapiens
LPISTPHPIGF

SEQ ID NO: 34153 - protein, 11 aa, Homo Sapiens
LYIGWDKHYGF

SEQ ID NO: 34154 - protein, 11 aa, Homo Sapiens
LYISEAEGLKF

SEQ ID NO: 34155 - protein, 11 aa, Homo Sapiens
LYLPQEQLTHW

SEQ ID NO: 34156 - protein, 11 aa, Homo Sapiens
LYPAAQLQHLW

SEQ ID NO: 34157 - protein, 11 aa, Homo Sapiens
LYPDRELQSQW

SEQ ID NO: 34158 - protein, 11 aa, Homo Sapiens
LYPNIDKDHAF

SEQ ID NO: 34159 - protein, 11 aa, Homo Sapiens
LYYTWTDGYRF

SEQ ID NO: 34160 - protein, 11 aa, Homo Sapiens
MYADPNFVRTF

SEQ ID NO: 34161 - protein, 11 aa, Homo Sapiens
MYMTVSIIDRF

SEQ ID NO: 34162 - protein, 11 aa, Homo Sapiens
NYAIFDEGHML

SEQ ID NO: 34163 - protein, 11 aa, Homo Sapiens
NYFFDAAKLMF

SEQ ID NO: 34164 - protein, 11 aa, Homo Sapiens
NYFPGGVALIW

SEQ ID NO: 34165 - protein, 11 aa, Homo Sapiens
NYIPQGSIDSL

SEQ ID NO: 34166 - protein, 11 aa, Homo Sapiens
NYIPVKNGKQF

SEQ ID NO: 34167 - protein, 11 aa, Homo Sapiens
NYIPYLTKLKF

SEQ ID NO: 34168 - protein, 11 aa, Homo Sapiens
NYKSEEEFIHI

SEQ ID NO: 34169 - protein, 11 aa, Homo Sapiens
NYLDPRISIAW

SEQ ID NO: 34170 - protein, 11 aa, Homo Sapiens
NYLDPRITVAW

SEQ ID NO: 34171 - protein, 11 aa, Homo Sapiens
NYLPAINGIVF

SEQ ID NO: 34172 - protein, 11 aa, Homo Sapiens
NYNPYIGGLGI

SEQ ID NO: 34173 - protein, 11 aa, Homo Sapiens
NYPETLGRLLI

SEQ ID NO: 34174 - protein, 11 aa, Homo Sapiens
NYPPQYLILKL

SEQ ID NO: 34175 - protein, 11 aa, Homo Sapiens
NYSDVMSKLGF

SEQ ID NO: 34176 - protein, 11 aa, Homo Sapiens
NYSGAAEYLYF

SEQ ID NO: 34177 - protein, 11 aa, Homo Sapiens
NYSPVSRIGLF

SEQ ID NO: 34178 - protein, 11 aa, Homo Sapiens
NYSTVPQKQTL

SEQ ID NO: 34179 - protein, 11 aa, Homo Sapiens
NYVEEKLIPTW

SEQ ID NO: 34180 - protein, 11 aa, Homo Sapiens
NYYPGSLFLTW

SEQ ID NO: 34181 - protein, 11 aa, Homo Sapiens
PFFNPIQTQVF

SEQ ID NO: 34182 - protein, 11 aa, Homo Sapiens
PFIKSQHELLF

SEQ ID NO: 34183 - protein, 11 aa, Homo Sapiens
PYFPIPEEYTF

SEQ ID NO: 34184 - protein, 11 aa, Homo Sapiens
PYMDSPQSIGF

SEQ ID NO: 34185 - protein, 11 aa, Homo Sapiens
PYPGCEFFKEY

SEQ ID NO: 34186 - protein, 11 aa, Homo Sapiens
PYQATIDGVRF

SEQ ID NO: 34187 - protein, 11 aa, Homo Sapiens
PYQNGFTFHTW

SEQ ID NO: 34188 - protein, 11 aa, Homo Sapiens
PYSDKLFEMVL

SEQ ID NO: 34189 - protein, 11 aa, Homo Sapiens
QLPQPDVFPLF

SEQ ID NO: 34190 - protein, 11 aa, Homo Sapiens
QWPQPDKPMFF

SEQ ID NO: 34191 - protein, 11 aa, Homo Sapiens
QYGIFPDNFTF

SEQ ID NO: 34192 - protein, 11 aa, Homo Sapiens
QYLNKNALTTL

SEQ ID NO: 34193 - protein, 11 aa, Homo Sapiens
QYPPVNWAALL

SEQ ID NO: 34194 - protein, 11 aa, Homo Sapiens
QYPVYWDHLEF

SEQ ID NO: 34195 - protein, 11 aa, Homo Sapiens
QYQDTKGFSTW

SEQ ID NO: 34196 - protein, 11 aa, Homo Sapiens
QYSRFSLENNF

SEQ ID NO: 34197 - protein, 11 aa, Homo Sapiens
RFAHGTAGLVF

SEQ ID NO: 34198 - protein, 11 aa, Homo Sapiens
RFFPYTSSQMF

SEQ ID NO: 34199 - protein, 11 aa, Homo Sapiens
RFLAEEGFYKF

SEQ ID NO: 34200 - protein, 11 aa, Homo Sapiens
RFLNAENAQKF

SEQ ID NO: 34201 - protein, 11 aa, Homo Sapiens
RFLNDPGHLLW

SEQ ID NO: 34202 - protein, 11 aa, Homo Sapiens
RFRPVPLGQTF

SEQ ID NO: 34203 - protein, 11 aa, Homo Sapiens
RWFTHASPTLF

SEQ ID NO: 34204 - protein, 11 aa, Homo Sapiens
RWLKDSSLLTL

SEQ ID NO: 34205 - protein, 11 aa, Homo Sapiens
RWLPQKNAAQF

SEQ ID NO: 34206 - protein, 11 aa, Homo Sapiens
RYAPPPSFSEF

SEQ ID NO: 34207 - protein, 11 aa, Homo Sapiens
RYFDVGLHNFL

SEQ ID NO: 34208 - protein, 11 aa, Homo Sapiens
RYFISHVLAFF

SEQ ID NO: 34209 - protein, 11 aa, Homo Sapiens
RYFPDRNVALF

SEQ ID NO: 34210 - protein, 11 aa, Homo Sapiens
RYGLPAAWSTF

SEQ ID NO: 34211 - protein, 11 aa, Homo Sapiens
RYIEFHSQSGF

SEQ ID NO: 34212 - protein, 11 aa, Homo Sapiens
RYISDQLFTNF

SEQ ID NO: 34213 - protein, 11 aa, Homo Sapiens
RYISPDQLADL

SEQ ID NO: 34214 - protein, 11 aa, Homo Sapiens
RYITEALIKKL

SEQ ID NO: 34215 - protein, 11 aa, Homo Sapiens
RYLDSLKAIVF

SEQ ID NO: 34216 - protein, 11 aa, Homo Sapiens
RYLDVSILGKF

SEQ ID NO: 34217 - protein, 11 aa, Homo Sapiens
RYLMDPDTFTF

SEQ ID NO: 34218 - protein, 11 aa, Homo Sapiens
RYLPEDFMESL

SEQ ID NO: 34219 - protein, 11 aa, Homo Sapiens
RYLPTGSFPFL

SEQ ID NO: 34220 - protein, 11 aa, Homo Sapiens
RYLSPKWIKMF

SEQ ID NO: 34221 - protein, 11 aa, Homo Sapiens
RYLSPKYIKMF

SEQ ID NO: 34222 - protein, 11 aa, Homo Sapiens
RYMDLAENARF

SEQ ID NO: 34223 - protein, 11 aa, Homo Sapiens
RYMLTAGLTAF

SEQ ID NO: 34224 - protein, 11 aa, Homo Sapiens
RYMSPMEAQEF

SEQ ID NO: 34225 - protein, 11 aa, Homo Sapiens
RYNERLDRLFI

SEQ ID NO: 34226 - protein, 11 aa, Homo Sapiens
RYPDNLKHLYL

SEQ ID NO: 34227 - protein, 11 aa, Homo Sapiens
RYPNKLDTITW

SEQ ID NO: 34228 - protein, 11 aa, Homo Sapiens
RYPSTGMLVLF

SEQ ID NO: 34229 - protein, 11 aa, Homo Sapiens
RYPTSIASLAF

SEQ ID NO: 34230 - protein, 11 aa, Homo Sapiens
RYQDGVYWAEF

SEQ ID NO: 34231 - protein, 11 aa, Homo Sapiens
RYQESLGNTVF

SEQ ID NO: 34232 - protein, 11 aa, Homo Sapiens
RYRPDMPCFLL

SEQ ID NO: 34233 - protein, 11 aa, Homo Sapiens
RYSAGWDAKFF

SEQ ID NO: 34234 - protein, 11 aa, Homo Sapiens
RYSEAITQSVL

SEQ ID NO: 34235 - protein, 11 aa, Homo Sapiens
RYSGVNQSMLF

SEQ ID NO: 34236 - protein, 11 aa, Homo Sapiens
RYSTGLAGNLL

SEQ ID NO: 34237 - protein, 11 aa, Homo Sapiens
RYTNGHLFTTI

SEQ ID NO: 34238 - protein, 11 aa, Homo Sapiens
RYTPEQDTMTF

SEQ ID NO: 34239 - protein, 11 aa, Homo Sapiens
RYVASYLLAAL

SEQ ID NO: 34240 - protein, 11 aa, Homo Sapiens
RYVEQKAGITF

SEQ ID NO: 34241 - protein, 11 aa, Homo Sapiens
RYVLYPNNFQF

SEQ ID NO: 34242 - protein, 11 aa, Homo Sapiens
RYYFEGIKQTF

SEQ ID NO: 34243 - protein, 11 aa, Homo Sapiens
SFLHGNASLLF

SEQ ID NO: 34244 - protein, 11 aa, Homo Sapiens
SFLPGLHLLTF

SEQ ID NO: 34245 - protein, 11 aa, Homo Sapiens
SFMPNSPRFLL

SEQ ID NO: 34246 - protein, 11 aa, Homo Sapiens
SFNPLTSLLQW

SEQ ID NO: 34247 - protein, 11 aa, Homo Sapiens
SYINPDHLKYF

SEQ ID NO: 34248 - protein, 11 aa, Homo Sapiens
SYIPIFPQLYF

SEQ ID NO: 34249 - protein, 11 aa, Homo Sapiens
SYIRPEDIVNF

SEQ ID NO: 34250 - protein, 11 aa, Homo Sapiens
SYISDGKEYLF

SEQ ID NO: 34251 - protein, 11 aa, Homo Sapiens
SYLDMSKVIIF

SEQ ID NO: 34252 - protein, 11 aa, Homo Sapiens
SYLEPGSIRHI

SEQ ID NO: 34253 - protein, 11 aa, Homo Sapiens
SYLEPTSVTNF

SEQ ID NO: 34254 - protein, 11 aa, Homo Sapiens
SYLERHGLINF

SEQ ID NO: 34255 - protein, 11 aa, Homo Sapiens
SYLKGDNFFRF

SEQ ID NO: 34256 - protein, 11 aa, Homo Sapiens
SYLSHSEQLVF

SEQ ID NO: 34257 - protein, 11 aa, Homo Sapiens
SYMEVPTYLNF

SEQ ID NO: 34258 - protein, 11 aa, Homo Sapiens
SYMGHFDLLNY

SEQ ID NO: 34259 - protein, 11 aa, Homo Sapiens
SYMVRELLIQF

SEQ ID NO: 34260 - protein, 11 aa, Homo Sapiens
SYMWTINNFSF

SEQ ID NO: 34261 - protein, 11 aa, Homo Sapiens
SYNPAENAVLL

SEQ ID NO: 34262 - protein, 11 aa, Homo Sapiens
SYPTFFPRFEF

SEQ ID NO: 34263 - protein, 11 aa, Homo Sapiens
SYTPVGLIQNL

SEQ ID NO: 34264 - protein, 11 aa, Homo Sapiens
SYVCPDLVKEF

SEQ ID NO: 34265 - protein, 11 aa, Homo Sapiens
SYYGPLNLLTF

SEQ ID NO: 34266 - protein, 11 aa, Homo Sapiens
TLPSRVFHPAF

SEQ ID NO: 34267 - protein, 11 aa, Homo Sapiens
TWFTAGAKLLF

SEQ ID NO: 34268 - protein, 11 aa, Homo Sapiens
TWLVNSAAHLF

SEQ ID NO: 34269 - protein, 11 aa, Homo Sapiens
TWSADSKVLLF

SEQ ID NO: 34270 - protein, 11 aa, Homo Sapiens
TYAELMQTLRF

SEQ ID NO: 34271 - protein, 11 aa, Homo Sapiens
TYAPLFSLPSF

SEQ ID NO: 34272 - protein, 11 aa, Homo Sapiens
TYFPTWEGLFW

SEQ ID NO: 34273 - protein, 11 aa, Homo Sapiens
TYGDAGLTYTF

SEQ ID NO: 34274 - protein, 11 aa, Homo Sapiens
TYGGSWKFLTF

SEQ ID NO: 34275 - protein, 11 aa, Homo Sapiens
TYHEVVDEIYF

SEQ ID NO: 34276 - protein, 11 aa, Homo Sapiens
TYIHALDNGLF

SEQ ID NO: 34277 - protein, 11 aa, Homo Sapiens
TYIPSTQNPAF

SEQ ID NO: 34278 - protein, 11 aa, Homo Sapiens
TYLDLLGTWVF

SEQ ID NO: 34279 - protein, 11 aa, Homo Sapiens
TYLEAHRIVKM

SEQ ID NO: 34280 - protein, 11 aa, Homo Sapiens
TYLPAGQSVLL

SEQ ID NO: 34281 - protein, 11 aa, Homo Sapiens
TYLPREILNLI

SEQ ID NO: 34282 - protein, 11 aa, Homo Sapiens
TYMDAQLFKKV

SEQ ID NO: 34283 - protein, 11 aa, Homo Sapiens
TYPEGLEVLHF

SEQ ID NO: 34284 - protein, 11 aa, Homo Sapiens
TYPNTYIFDLF

SEQ ID NO: 34285 - protein, 11 aa, Homo Sapiens
TYPSQDVFLVI

SEQ ID NO: 34286 - protein, 11 aa, Homo Sapiens
TYSPFGDSPLF

SEQ ID NO: 34287 - protein, 11 aa, Homo Sapiens
TYTDVTPRQFF

SEQ ID NO: 34288 - protein, 11 aa, Homo Sapiens
TYTNAFAFTQF

SEQ ID NO: 34289 - protein, 11 aa, Homo Sapiens
VFMKPGLPTTF

SEQ ID NO: 34290 - protein, 11 aa, Homo Sapiens
VFPSMPIKLQL

SEQ ID NO: 34291 - protein, 11 aa, Homo Sapiens
VLPDADTLLHF

SEQ ID NO: 34292 - protein, 11 aa, Homo Sapiens
VLPNSDFLVHF

SEQ ID NO: 34293 - protein, 11 aa, Homo Sapiens
VMLGTQLLYKF

SEQ ID NO: 34294 - protein, 11 aa, Homo Sapiens
VQPKQDAFANF

SEQ ID NO: 34295 - protein, 11 aa, Homo Sapiens
VVFHPSQDLVF

SEQ ID NO: 34296 - protein, 11 aa, Homo Sapiens
VVPSGGFFPTI

SEQ ID NO: 34297 - protein, 11 aa, Homo Sapiens
VWFNIGSVDTF

SEQ ID NO: 34298 - protein, 11 aa, Homo Sapiens
VYAHFPINVVI

SEQ ID NO: 34299 - protein, 11 aa, Homo Sapiens
VYAPPVGGFSF

SEQ ID NO: 34300 - protein, 11 aa, Homo Sapiens
VYFISPQGLKF

SEQ ID NO: 34301 - protein, 11 aa, Homo Sapiens
VYFQARLYHTL

SEQ ID NO: 34302 - protein, 11 aa, Homo Sapiens
VYGNERFIQYL

SEQ ID NO: 34303 - protein, 11 aa, Homo Sapiens
VYILKGGYERF

SEQ ID NO: 34304 - protein, 11 aa, Homo Sapiens
VYISYLDSVHF

SEQ ID NO: 34305 - protein, 11 aa, Homo Sapiens
VYITGKEVFSF

SEQ ID NO: 34306 - protein, 11 aa, Homo Sapiens
VYLDGHLITTV

SEQ ID NO: 34307 - protein, 11 aa, Homo Sapiens
VYLDPLVFREF

SEQ ID NO: 34308 - protein, 11 aa, Homo Sapiens
VYLPEAMPASF

SEQ ID NO: 34309 - protein, 11 aa, Homo Sapiens
VYLTDPQGLVL

SEQ ID NO: 34310 - protein, 11 aa, Homo Sapiens
VYLTPESKSSF

SEQ ID NO: 34311 - protein, 11 aa, Homo Sapiens
VYMPASSYQSL

SEQ ID NO: 34312 - protein, 11 aa, Homo Sapiens
VYNIHLAVNFL

SEQ ID NO: 34313 - protein, 11 aa, Homo Sapiens
VYNTVSEGTHF

SEQ ID NO: 34314 - protein, 11 aa, Homo Sapiens
VYPANERFWYF

SEQ ID NO: 34315 - protein, 11 aa, Homo Sapiens
VYPASKMFPFI

SEQ ID NO: 34316 - protein, 11 aa, Homo Sapiens
VYPFPTFQPAF

SEQ ID NO: 34317 - protein, 11 aa, Homo Sapiens
VYPPIQVHVTL

SEQ ID NO: 34318 - protein, 11 aa, Homo Sapiens
VYPPPHQVFTW

SEQ ID NO: 34319 - protein, 11 aa, Homo Sapiens
VYPSRAVITTM

SEQ ID NO: 34320 - protein, 11 aa, Homo Sapiens
VYQEPIPTAQL

SEQ ID NO: 34321 - protein, 11 aa, Homo Sapiens
VYQSLANLIRW

SEQ ID NO: 34322 - protein, 11 aa, Homo Sapiens
VYQVGGVTAYF

SEQ ID NO: 34323 - protein, 11 aa, Homo Sapiens
VYQYGSALAHF

SEQ ID NO: 34324 - protein, 11 aa, Homo Sapiens
VYRNKDALSHF

SEQ ID NO: 34325 - protein, 11 aa, Homo Sapiens
VYSEAARVLQF

SEQ ID NO: 34326 - protein, 11 aa, Homo Sapiens
VYSETVDLIKF

SEQ ID NO: 34327 - protein, 11 aa, Homo Sapiens
VYSPFVLLNTL

SEQ ID NO: 34328 - protein, 11 aa, Homo Sapiens
VYSPHVLNLTL

SEQ ID NO: 34329 - protein, 11 aa, Homo Sapiens
VYSQIPAAVKL

SEQ ID NO: 34330 - protein, 11 aa, Homo Sapiens
VYTDLTPLSKF

SEQ ID NO: 34331 - protein, 11 aa, Homo Sapiens
VYTEGERLYLF

SEQ ID NO: 34332 - protein, 11 aa, Homo Sapiens
VYTPVASRQSL

SEQ ID NO: 34333 - protein, 11 aa, Homo Sapiens
VYVDLGGSHVF

SEQ ID NO: 34334 - protein, 11 aa, Homo Sapiens
VYVIEPHSMEF

SEQ ID NO: 34335 - protein, 11 aa, Homo Sapiens
VYVTSPLVNNF

SEQ ID NO: 34336 - protein, 11 aa, Homo Sapiens
VYVWIYDPVHF

SEQ ID NO: 34337 - protein, 11 aa, Homo Sapiens
YYDANQSMYVF

SEQ ID NO: 34338 - protein, 11 aa, Homo Sapiens
YYIDADLLREI

SEQ ID NO: 34339 - protein, 11 aa, Homo Sapiens
YYIEGIENSVF

SEQ ID NO: 34340 - protein, 11 aa, Homo Sapiens
YYIKYNTIETF

SEQ ID NO: 34341 - protein, 11 aa, Homo Sapiens
YYLHQNNIVHL

SEQ ID NO: 34342 - protein, 11 aa, Homo Sapiens
YYLPDGSTIEI

SEQ ID NO: 34343 - protein, 11 aa, Homo Sapiens
YYNPDLLLHTL

SEQ ID NO: 34344 - protein, 11 aa, Homo Sapiens
YYNPHLLLNTL

SEQ ID NO: 34345 - protein, 11 aa, Homo Sapiens
YYPSTPGRYSI

SEQ ID NO: 34346 - protein, 11 aa, Homo Sapiens
YYSKSVGFMQW

SEQ ID NO: 34347 - protein, 11 aa, Homo Sapiens
YYSPHGHILVL

SEQ ID NO: 34348 - protein, 8 aa, Homo Sapiens
APKPYHKF

SEQ ID NO: 34349 - protein, 8 aa, Homo Sapiens
FHEVPLKF

SEQ ID NO: 34350 - protein, 8 aa, Homo Sapiens
IYTVGKRF

SEQ ID NO: 34351 - protein, 8 aa, Homo Sapiens
PPVGGFSF

SEQ ID NO: 34352 - protein, 8 aa, Homo Sapiens
QVSTHEQS

SEQ ID NO: 34353 - protein, 8 aa, Homo Sapiens
VFFKGFKW

SEQ ID NO: 34354 - protein, 8 aa, Homo Sapiens
VFKNGNAF

SEQ ID NO: 34355 - protein, 8 aa, Homo Sapiens
VFSIGPVF

SEQ ID NO: 34356 - protein, 8 aa, Homo Sapiens
VSLTACKV

SEQ ID NO: 34357 - protein, 8 aa, Homo Sapiens
VYGGGSMW

SEQ ID NO: 34358 - protein, 8 aa, Homo Sapiens
YHPNVDKL

SEQ ID NO: 34359 - protein, 8 aa, Homo Sapiens
YIKHPHLF

SEQ ID NO: 34360 - protein, 8 aa, Homo Sapiens
YIKHPVSL

SEQ ID NO: 34361 - protein, 8 aa, Homo Sapiens
YISEHEHF

SEQ ID NO: 34362 - protein, 8 aa, Homo Sapiens
YWSHPRKF

SEQ ID NO: 34363 - protein, 9 aa, Homo Sapiens
AFGPAFALF

SEQ ID NO: 34364 - protein, 9 aa, Homo Sapiens
AFHPRYPLF

SEQ ID NO: 34365 - protein, 9 aa, Homo Sapiens
AFHPTAQLL

SEQ ID NO: 34366 - protein, 9 aa, Homo Sapiens
AFIDRHPRL

SEQ ID NO: 34367 - protein, 9 aa, Homo Sapiens
AFIDTQLYI

SEQ ID NO: 34368 - protein, 9 aa, Homo Sapiens
AFIEKHWTF

SEQ ID NO: 34369 - protein, 9 aa, Homo Sapiens
AFIGPALLF

SEQ ID NO: 34370 - protein, 9 aa, Homo Sapiens
AFIKIKMAF

SEQ ID NO: 34371 - protein, 9 aa, Homo Sapiens
AFINKFVQF

SEQ ID NO: 34372 - protein, 9 aa, Homo Sapiens
AFLKVSSVF

SEQ ID NO: 34373 - protein, 9 aa, Homo Sapiens
AFMKGVFTF

SEQ ID NO: 34374 - protein, 9 aa, Homo Sapiens
AFMVNGQKF

SEQ ID NO: 34375 - protein, 9 aa, Homo Sapiens
AFNPEPLVL

SEQ ID NO: 34376 - protein, 9 aa, Homo Sapiens
AFQNDVYEW

SEQ ID NO: 34377 - protein, 9 aa, Homo Sapiens
AFSPDSYFL

SEQ ID NO: 34378 - protein, 9 aa, Homo Sapiens
AFTTHPSQF

SEQ ID NO: 34379 - protein, 9 aa, Homo Sapiens
AFTVVQPTF

SEQ ID NO: 34380 - protein, 9 aa, Homo Sapiens
AFVDNHHEW

SEQ ID NO: 34381 - protein, 9 aa, Homo Sapiens
ALPAAFHTW

SEQ ID NO: 34382 - protein, 9 aa, Homo Sapiens
ALPDQSFLW

SEQ ID NO: 34383 - protein, 9 aa, Homo Sapiens
AWHPHTNKF

SEQ ID NO: 34384 - protein, 9 aa, Homo Sapiens
AYAANPHSF

SEQ ID NO: 34385 - protein, 9 aa, Homo Sapiens
AYAGARFVF

SEQ ID NO: 34386 - protein, 9 aa, Homo Sapiens
AYATHPFKF

SEQ ID NO: 34387 - protein, 9 aa, Homo Sapiens
AYDTVRWEF

SEQ ID NO: 34388 - protein, 9 aa, Homo Sapiens
AYEHKFYEI

SEQ ID NO: 34389 - protein, 9 aa, Homo Sapiens
AYGKDFHLI

SEQ ID NO: 34390 - protein, 9 aa, Homo Sapiens
AYGLVSATF

SEQ ID NO: 34391 - protein, 9 aa, Homo Sapiens
AYGNVFSAF

SEQ ID NO: 34392 - protein, 9 aa, Homo Sapiens
AYHNSPAYL

SEQ ID NO: 34393 - protein, 9 aa, Homo Sapiens
AYIADHLGF

SEQ ID NO: 34394 - protein, 9 aa, Homo Sapiens
AYIERMNYI

SEQ ID NO: 34395 - protein, 9 aa, Homo Sapiens
AYIKGGWIL

SEQ ID NO: 34396 - protein, 9 aa, Homo Sapiens
AYIPTPIYF

SEQ ID NO: 34397 - protein, 9 aa, Homo Sapiens
AYISGLDVF

SEQ ID NO: 34398 - protein, 9 aa, Homo Sapiens
AYKPGALTF

SEQ ID NO: 34399 - protein, 9 aa, Homo Sapiens
AYKYIQELW

SEQ ID NO: 34400 - protein, 9 aa, Homo Sapiens
AYLCYRFLF

SEQ ID NO: 34401 - protein, 9 aa, Homo Sapiens
AYLDKSPQF

SEQ ID NO: 34402 - protein, 9 aa, Homo Sapiens
AYLEAHETF

SEQ ID NO: 34403 - protein, 9 aa, Homo Sapiens
AYLEAIHNF

SEQ ID NO: 34404 - protein, 9 aa, Homo Sapiens
AYLESFYKF

SEQ ID NO: 34405 - protein, 9 aa, Homo Sapiens
AYLHSHALI

SEQ ID NO: 34406 - protein, 9 aa, Homo Sapiens
AYLIQVHKW

SEQ ID NO: 34407 - protein, 9 aa, Homo Sapiens
AYLPTGKQF

SEQ ID NO: 34408 - protein, 9 aa, Homo Sapiens
AYLPVNESF

SEQ ID NO: 34409 - protein, 9 aa, Homo Sapiens
AYLTHHQRI

SEQ ID NO: 34410 - protein, 9 aa, Homo Sapiens
AYMPHTFFI

SEQ ID NO: 34411 - protein, 9 aa, Homo Sapiens
AYNPNTQTF

SEQ ID NO: 34412 - protein, 9 aa, Homo Sapiens
AYQHLFYLL

SEQ ID NO: 34413 - protein, 9 aa, Homo Sapiens
AYTLLGHEF

SEQ ID NO: 34414 - protein, 9 aa, Homo Sapiens
AYTLLLHTW

SEQ ID NO: 34415 - protein, 9 aa, Homo Sapiens
AYTPFHAVL

SEQ ID NO: 34416 - protein, 9 aa, Homo Sapiens
AYTPVLNQF

SEQ ID NO: 34417 - protein, 9 aa, Homo Sapiens
AYTTEHWLV

SEQ ID NO: 34418 - protein, 9 aa, Homo Sapiens
AYVHMVTHF

SEQ ID NO: 34419 - protein, 9 aa, Homo Sapiens
AYVQIKTIW

SEQ ID NO: 34420 - protein, 9 aa, Homo Sapiens
CFAPYHLVL

SEQ ID NO: 34421 - protein, 9 aa, Homo Sapiens
CFNHNGNIF

SEQ ID NO: 34422 - protein, 9 aa, Homo Sapiens
CFSPNRYWL

SEQ ID NO: 34423 - protein, 9 aa, Homo Sapiens
CYGGTAAVF

SEQ ID NO: 34424 - protein, 9 aa, Homo Sapiens
CYIKILHQL

SEQ ID NO: 34425 - protein, 9 aa, Homo Sapiens
DFPTISLEF

SEQ ID NO: 34426 - protein, 9 aa, Homo Sapiens
DFVSFFPAF

SEQ ID NO: 34427 - protein, 9 aa, Homo Sapiens
DLFRKALEL

SEQ ID NO: 34428 - protein, 9 aa, Homo Sapiens
EFHPNPDVL

SEQ ID NO: 34429 - protein, 9 aa, Homo Sapiens
EFINSIILF

SEQ ID NO: 34430 - protein, 9 aa, Homo Sapiens
EFITVHSML

SEQ ID NO: 34431 - protein, 9 aa, Homo Sapiens
EFKEAFNMI

SEQ ID NO: 34432 - protein, 9 aa, Homo Sapiens
EFKEAFSLF

SEQ ID NO: 34433 - protein, 9 aa, Homo Sapiens
EFLKNPQKF

SEQ ID NO: 34434 - protein, 9 aa, Homo Sapiens
EFLKYFGTF

SEQ ID NO: 34435 - protein, 9 aa, Homo Sapiens
EFLLTHPVL

SEQ ID NO: 34436 - protein, 9 aa, Homo Sapiens
EFLTKTAKF

SEQ ID NO: 34437 - protein, 9 aa, Homo Sapiens
EFMDTFFFI

SEQ ID NO: 34438 - protein, 9 aa, Homo Sapiens
EFNSTPAVF

SEQ ID NO: 34439 - protein, 9 aa, Homo Sapiens
EFTKSIAKF

SEQ ID NO: 34440 - protein, 9 aa, Homo Sapiens
EFTPHHAGF

SEQ ID NO: 34441 - protein, 9 aa, Homo Sapiens
EFTSPPSLF

SEQ ID NO: 34442 - protein, 9 aa, Homo Sapiens
EFVAKGHLF

SEQ ID NO: 34443 - protein, 9 aa, Homo Sapiens
ELPKHYFSF

SEQ ID NO: 34444 - protein, 9 aa, Homo Sapiens
EPSVSIPFL

SEQ ID NO: 34445 - protein, 9 aa, Homo Sapiens
EWPPFVVTL

SEQ ID NO: 34446 - protein, 9 aa, Homo Sapiens
EYAHLFEVF

SEQ ID NO: 34447 - protein, 9 aa, Homo Sapiens
EYIQFVPLL

SEQ ID NO: 34448 - protein, 9 aa, Homo Sapiens
EYLEAHLKF

SEQ ID NO: 34449 - protein, 9 aa, Homo Sapiens
EYLENALKL

SEQ ID NO: 34450 - protein, 9 aa, Homo Sapiens
EYLHQHWIL

SEQ ID NO: 34451 - protein, 9 aa, Homo Sapiens
EYLIVFPKL

SEQ ID NO: 34452 - protein, 9 aa, Homo Sapiens
EYMAQHLVF

SEQ ID NO: 34453 - protein, 9 aa, Homo Sapiens
EYMEHVYLI

SEQ ID NO: 34454 - protein, 9 aa, Homo Sapiens
EYTDVYPEI

SEQ ID NO: 34455 - protein, 9 aa, Homo Sapiens
EYVEKFYRI

SEQ ID NO: 34456 - protein, 9 aa, Homo Sapiens
EYVEKPLKL

SEQ ID NO: 34457 - protein, 9 aa, Homo Sapiens
EYVPGAHQF

SEQ ID NO: 34458 - protein, 9 aa, Homo Sapiens
EYVSQHLVF

SEQ ID NO: 34459 - protein, 9 aa, Homo Sapiens
FFDPHQSTF

SEQ ID NO: 34460 - protein, 9 aa, Homo Sapiens
FFGPVGFNF

SEQ ID NO: 34461 - protein, 9 aa, Homo Sapiens
FFHQGYDLF

SEQ ID NO: 34462 - protein, 9 aa, Homo Sapiens
FFIAGRYEF

SEQ ID NO: 34463 - protein, 9 aa, Homo Sapiens
FFKDSPLLL

SEQ ID NO: 34464 - protein, 9 aa, Homo Sapiens
FFNSVRSVF

SEQ ID NO: 34465 - protein, 9 aa, Homo Sapiens
FLPFPLPLF

SEQ ID NO: 34466 - protein, 9 aa, Homo Sapiens
FLPRKFPSL

SEQ ID NO: 34467 - protein, 9 aa, Homo Sapiens
FWDPSVNLF

SEQ ID NO: 34468 - protein, 9 aa, Homo Sapiens
FYAELYHII

SEQ ID NO: 34469 - protein, 9 aa, Homo Sapiens
FYFALRDTL

SEQ ID NO: 34470 - protein, 9 aa, Homo Sapiens
FYFASKLVL

SEQ ID NO: 34471 - protein, 9 aa, Homo Sapiens
FYHEAVVLF

SEQ ID NO: 34472 - protein, 9 aa, Homo Sapiens
FYHKYFNYL

SEQ ID NO: 34473 - protein, 9 aa, Homo Sapiens
FYITSRTQF

SEQ ID NO: 34474 - protein, 9 aa, Homo Sapiens
FYLLISKTF

SEQ ID NO: 34475 - protein, 9 aa, Homo Sapiens
FYMDTSHLF

SEQ ID NO: 34476 - protein, 9 aa, Homo Sapiens
FYQRFPLSF

SEQ ID NO: 34477 - protein, 9 aa, Homo Sapiens
FYTAIAQAF

SEQ ID NO: 34478 - protein, 9 aa, Homo Sapiens
FYTLIPHDF

SEQ ID NO: 34479 - protein, 9 aa, Homo Sapiens
FYTVIPHNF

SEQ ID NO: 34480 - protein, 9 aa, Homo Sapiens
GFQVKAYTF

SEQ ID NO: 34481 - protein, 9 aa, Homo Sapiens
GFTPVFLQF

SEQ ID NO: 34482 - protein, 9 aa, Homo Sapiens
GYCPNHPVI

SEQ ID NO: 34483 - protein, 9 aa, Homo Sapiens
GYIERPQLI

SEQ ID NO: 34484 - protein, 9 aa, Homo Sapiens
GYIKNKLVF

SEQ ID NO: 34485 - protein, 9 aa, Homo Sapiens
GYSPYQLTW

SEQ ID NO: 34486 - protein, 9 aa, Homo Sapiens
HFHPSVALF

SEQ ID NO: 34487 - protein, 9 aa, Homo Sapiens
HFIAEHYMF

SEQ ID NO: 34488 - protein, 9 aa, Homo Sapiens
HFIEIHHHL

SEQ ID NO: 34489 - protein, 9 aa, Homo Sapiens
HFIEKAHTL

SEQ ID NO: 34490 - protein, 9 aa, Homo Sapiens
HFIFFVQEF

SEQ ID NO: 34491 - protein, 9 aa, Homo Sapiens
HFITKGYVI

SEQ ID NO: 34492 - protein, 9 aa, Homo Sapiens
HFLDRHLVF

SEQ ID NO: 34493 - protein, 9 aa, Homo Sapiens
HFLEQHPLL

SEQ ID NO: 34494 - protein, 9 aa, Homo Sapiens
HFSHAGALF

SEQ ID NO: 34495 - protein, 9 aa, Homo Sapiens
HYHPIVQRF

SEQ ID NO: 34496 - protein, 9 aa, Homo Sapiens
HYILHNSFF

SEQ ID NO: 34497 - protein, 9 aa, Homo Sapiens
HYIRKYNRF

SEQ ID NO: 34498 - protein, 9 aa, Homo Sapiens
HYKPTPLYF

SEQ ID NO: 34499 - protein, 9 aa, Homo Sapiens
HYPPVQVLF

SEQ ID NO: 34500 - protein, 9 aa, Homo Sapiens
HYSLFPLLF

SEQ ID NO: 34501 - protein, 9 aa, Homo Sapiens
HYSPIYLSF

SEQ ID NO: 34502 - protein, 9 aa, Homo Sapiens
HYTIVFNTF

SEQ ID NO: 34503 - protein, 9 aa, Homo Sapiens
IFCETRAEW

SEQ ID NO: 34504 - protein, 9 aa, Homo Sapiens
IFFENHPYF

SEQ ID NO: 34505 - protein, 9 aa, Homo Sapiens
IFFPGVSEF

SEQ ID NO: 34506 - protein, 9 aa, Homo Sapiens
IFGPVQPLF

SEQ ID NO: 34507 - protein, 9 aa, Homo Sapiens
IFGVIIDTF

SEQ ID NO: 34508 - protein, 9 aa, Homo Sapiens
IFHDISLRF

SEQ ID NO: 34509 - protein, 9 aa, Homo Sapiens
IFHEVPLKF

SEQ ID NO: 34510 - protein, 9 aa, Homo Sapiens
IFHEVSQLI

SEQ ID NO: 34511 - protein, 9 aa, Homo Sapiens
IFIDKIYSI

SEQ ID NO: 34512 - protein, 9 aa, Homo Sapiens
IFIKNHIRF

SEQ ID NO: 34513 - protein, 9 aa, Homo Sapiens
IFIPTSFLL

SEQ ID NO: 34514 - protein, 9 aa, Homo Sapiens
IFIRNVLLF

SEQ ID NO: 34515 - protein, 9 aa, Homo Sapiens
IFKDKPIKL

SEQ ID NO: 34516 - protein, 9 aa, Homo Sapiens
IFLKRMPSI

SEQ ID NO: 34517 - protein, 9 aa, Homo Sapiens
IFLNKTFQW

SEQ ID NO: 34518 - protein, 9 aa, Homo Sapiens
IFLSQPILL

SEQ ID NO: 34519 - protein, 9 aa, Homo Sapiens
IFNAVSLRW

SEQ ID NO: 34520 - protein, 9 aa, Homo Sapiens
IFNGTFVKL

SEQ ID NO: 34521 - protein, 9 aa, Homo Sapiens
IFNQNNHNF

SEQ ID NO: 34522 - protein, 9 aa, Homo Sapiens
IFPYKGYIW

SEQ ID NO: 34523 - protein, 9 aa, Homo Sapiens
IFQDVLLQF

SEQ ID NO: 34524 - protein, 9 aa, Homo Sapiens
IFQGNVHNF

SEQ ID NO: 34525 - protein, 9 aa, Homo Sapiens
IFRAFTELF

SEQ ID NO: 34526 - protein, 9 aa, Homo Sapiens
IFRPDNFVF

SEQ ID NO: 34527 - protein, 9 aa, Homo Sapiens
IFSKIVSLF

SEQ ID NO: 34528 - protein, 9 aa, Homo Sapiens
IFSNVRINL

SEQ ID NO: 34529 - protein, 9 aa, Homo Sapiens
IFSPNVVNL

SEQ ID NO: 34530 - protein, 9 aa, Homo Sapiens
IFSPTSNLL

SEQ ID NO: 34531 - protein, 9 aa, Homo Sapiens
IFSPVFNFF

SEQ ID NO: 34532 - protein, 9 aa, Homo Sapiens
IFTARLYYF

SEQ ID NO: 34533 - protein, 9 aa, Homo Sapiens
IFTDIFHYL

SEQ ID NO: 34534 - protein, 9 aa, Homo Sapiens
IFTDLSSRF

SEQ ID NO: 34535 - protein, 9 aa, Homo Sapiens
IFTDVALKF

SEQ ID NO: 34536 - protein, 9 aa, Homo Sapiens
IFTGARVFF

SEQ ID NO: 34537 - protein, 9 aa, Homo Sapiens
IFTKVIQEI

SEQ ID NO: 34538 - protein, 9 aa, Homo Sapiens
IFTNTVARF

SEQ ID NO: 34539 - protein, 9 aa, Homo Sapiens
IFTPIVEHL

SEQ ID NO: 34540 - protein, 9 aa, Homo Sapiens
IFTPKPTLF

SEQ ID NO: 34541 - protein, 9 aa, Homo Sapiens
IFVARLYYF

SEQ ID NO: 34542 - protein, 9 aa, Homo Sapiens
IFVDTNLYF

SEQ ID NO: 34543 - protein, 9 aa, Homo Sapiens
IFVTNPVTL

SEQ ID NO: 34544 - protein, 9 aa, Homo Sapiens
IITPIHEQW

SEQ ID NO: 34545 - protein, 9 aa, Homo Sapiens
ILPGSLFRF

SEQ ID NO: 34546 - protein, 9 aa, Homo Sapiens
ILPIKFPHL

SEQ ID NO: 34547 - protein, 9 aa, Homo Sapiens
ILPVYHSLF

SEQ ID NO: 34548 - protein, 9 aa, Homo Sapiens
IMPEKFEFW

SEQ ID NO: 34549 - protein, 9 aa, Homo Sapiens
IMPSSSHLF

SEQ ID NO: 34550 - protein, 9 aa, Homo Sapiens
IMPTIFNLI

SEQ ID NO: 34551 - protein, 9 aa, Homo Sapiens
IWIPYCIKL

SEQ ID NO: 34552 - protein, 9 aa, Homo Sapiens
IWISKLPHF

SEQ ID NO: 34553 - protein, 9 aa, Homo Sapiens
IWRPITATF

SEQ ID NO: 34554 - protein, 9 aa, Homo Sapiens
IWTDVFQTL

SEQ ID NO: 34555 - protein, 9 aa, Homo Sapiens
IYAFVGEKF

SEQ ID NO: 34556 - protein, 9 aa, Homo Sapiens
IYAPPLPSL

SEQ ID NO: 34557 - protein, 9 aa, Homo Sapiens
IYAPQGLLL

SEQ ID NO: 34558 - protein, 9 aa, Homo Sapiens
IYAPTLLVF

SEQ ID NO: 34559 - protein, 9 aa, Homo Sapiens
IYDKTSVLF

SEQ ID NO: 34560 - protein, 9 aa, Homo Sapiens
IYDSVKVYF

SEQ ID NO: 34561 - protein, 9 aa, Homo Sapiens
IYEPNFIFF

SEQ ID NO: 34562 - protein, 9 aa, Homo Sapiens
IYFPYVLKI

SEQ ID NO: 34563 - protein, 9 aa, Homo Sapiens
IYGEKTYAF

SEQ ID NO: 34564 - protein, 9 aa, Homo Sapiens
IYGGSDSRF

SEQ ID NO: 34565 - protein, 9 aa, Homo Sapiens
IYGYVAEQF

SEQ ID NO: 34566 - protein, 9 aa, Homo Sapiens
IYHNGVLEF

SEQ ID NO: 34567 - protein, 9 aa, Homo Sapiens
IYHPNVDKL

SEQ ID NO: 34568 - protein, 9 aa, Homo Sapiens
IYHQVAVQF

SEQ ID NO: 34569 - protein, 9 aa, Homo Sapiens
IYIAGHPAF

SEQ ID NO: 34570 - protein, 9 aa, Homo Sapiens
IYIDRGVVF

SEQ ID NO: 34571 - protein, 9 aa, Homo Sapiens
IYIKHPHLF

SEQ ID NO: 34572 - protein, 9 aa, Homo Sapiens
IYIKQIKTF

SEQ ID NO: 34573 - protein, 9 aa, Homo Sapiens
IYKAPSENW

SEQ ID NO: 34574 - protein, 9 aa, Homo Sapiens
IYKGIPLQL

SEQ ID NO: 34575 - protein, 9 aa, Homo Sapiens
IYKPVTDFF

SEQ ID NO: 34576 - protein, 9 aa, Homo Sapiens
IYKTSILVF

SEQ ID NO: 34577 - protein, 9 aa, Homo Sapiens
IYLDTHFRL

SEQ ID NO: 34578 - protein, 9 aa, Homo Sapiens
IYLERFPIF

SEQ ID NO: 34579 - protein, 9 aa, Homo Sapiens
IYLIHHQRF

SEQ ID NO: 34580 - protein, 9 aa, Homo Sapiens
IYLLIHNNF

SEQ ID NO: 34581 - protein, 9 aa, Homo Sapiens
IYLPYLHEW

SEQ ID NO: 34582 - protein, 9 aa, Homo Sapiens
IYLSKPTHW

SEQ ID NO: 34583 - protein, 9 aa, Homo Sapiens
IYMDTLNIF

SEQ ID NO: 34584 - protein, 9 aa, Homo Sapiens
IYNMIFHEL

SEQ ID NO: 34585 - protein, 9 aa, Homo Sapiens
IYPDSFTVL

SEQ ID NO: 34586 - protein, 9 aa, Homo Sapiens
IYPEVVHMF

SEQ ID NO: 34587 - protein, 9 aa, Homo Sapiens
IYPPKLHQF

SEQ ID NO: 34588 - protein, 9 aa, Homo Sapiens
IYPWVHVVI

SEQ ID NO: 34589 - protein, 9 aa, Homo Sapiens
IYQDVTLKW

SEQ ID NO: 34590 - protein, 9 aa, Homo Sapiens
IYQKAFEHL

SEQ ID NO: 34591 - protein, 9 aa, Homo Sapiens
IYQQNHMVL

SEQ ID NO: 34592 - protein, 9 aa, Homo Sapiens
IYQRDPLKL

SEQ ID NO: 34593 - protein, 9 aa, Homo Sapiens
IYQRHVYNL

SEQ ID NO: 34594 - protein, 9 aa, Homo Sapiens
IYQYIQSRF

SEQ ID NO: 34595 - protein, 9 aa, Homo Sapiens
IYSAERFLI

SEQ ID NO: 34596 - protein, 9 aa, Homo Sapiens
IYSEVATLI

SEQ ID NO: 34597 - protein, 9 aa, Homo Sapiens
IYSFHTLSF

SEQ ID NO: 34598 - protein, 9 aa, Homo Sapiens
IYSKLGLGF

SEQ ID NO: 34599 - protein, 9 aa, Homo Sapiens
IYSTAFDYF

SEQ ID NO: 34600 - protein, 9 aa, Homo Sapiens
IYSTKLYRF

SEQ ID NO: 34601 - protein, 9 aa, Homo Sapiens
IYSVNKEQL

SEQ ID NO: 34602 - protein, 9 aa, Homo Sapiens
IYTDIIYIF

SEQ ID NO: 34603 - protein, 9 aa, Homo Sapiens
IYTFPHASF

SEQ ID NO: 34604 - protein, 9 aa, Homo Sapiens
IYTMIYRNL

SEQ ID NO: 34605 - protein, 9 aa, Homo Sapiens
IYTSSVNRL

SEQ ID NO: 34606 - protein, 9 aa, Homo Sapiens
IYTTFRDVF

SEQ ID NO: 34607 - protein, 9 aa, Homo Sapiens
IYVHDLLTF

SEQ ID NO: 34608 - protein, 9 aa, Homo Sapiens
IYVIPQPHF

SEQ ID NO: 34609 - protein, 9 aa, Homo Sapiens
IYVISAETF

SEQ ID NO: 34610 - protein, 9 aa, Homo Sapiens
IYVPSSYHL

SEQ ID NO: 34611 - protein, 9 aa, Homo Sapiens
IYVVGGYSW

SEQ ID NO: 34612 - protein, 9 aa, Homo Sapiens
IYWDGPLAL

SEQ ID NO: 34613 - protein, 9 aa, Homo Sapiens
IYYVDVQKF

SEQ ID NO: 34614 - protein, 9 aa, Homo Sapiens
KFAEEFYSF

SEQ ID NO: 34615 - protein, 9 aa, Homo Sapiens
KFFEMVNTI

SEQ ID NO: 34616 - protein, 9 aa, Homo Sapiens
KFFYQKEHW

SEQ ID NO: 34617 - protein, 9 aa, Homo Sapiens
KFIDKQLEL

SEQ ID NO: 34618 - protein, 9 aa, Homo Sapiens
KFIDTTSKF

SEQ ID NO: 34619 - protein, 9 aa, Homo Sapiens
KFIKSFLVF

SEQ ID NO: 34620 - protein, 9 aa, Homo Sapiens
KFIWTNHKF

SEQ ID NO: 34621 - protein, 9 aa, Homo Sapiens
KFLAPYTTF

SEQ ID NO: 34622 - protein, 9 aa, Homo Sapiens
KFLEQVHQL

SEQ ID NO: 34623 - protein, 9 aa, Homo Sapiens
KFLESTDSF

SEQ ID NO: 34624 - protein, 9 aa, Homo Sapiens
KFLEYFHKL

SEQ ID NO: 34625 - protein, 9 aa, Homo Sapiens
KFMHTPHQF

SEQ ID NO: 34626 - protein, 9 aa, Homo Sapiens
KFNPVSFTW

SEQ ID NO: 34627 - protein, 9 aa, Homo Sapiens
KFSEIPQRL

SEQ ID NO: 34628 - protein, 9 aa, Homo Sapiens
KFSPFADTF

SEQ ID NO: 34629 - protein, 9 aa, Homo Sapiens
KFSPNTSQF

SEQ ID NO: 34630 - protein, 9 aa, Homo Sapiens
KFSPRPLKF

SEQ ID NO: 34631 - protein, 9 aa, Homo Sapiens
KFTPVASKF

SEQ ID NO: 34632 - protein, 9 aa, Homo Sapiens
KFVDSTFYL

SEQ ID NO: 34633 - protein, 9 aa, Homo Sapiens
KFVETHPEF

SEQ ID NO: 34634 - protein, 9 aa, Homo Sapiens
KFVNKSYLL

SEQ ID NO: 34635 - protein, 9 aa, Homo Sapiens
KFYGNRHLI

SEQ ID NO: 34636 - protein, 9 aa, Homo Sapiens
KGAVWKALF

SEQ ID NO: 34637 - protein, 9 aa, Homo Sapiens
KLPANHPLL

SEQ ID NO: 34638 - protein, 9 aa, Homo Sapiens
KLPEKTQTF

SEQ ID NO: 34639 - protein, 9 aa, Homo Sapiens
KLPSKFKKF

SEQ ID NO: 34640 - protein, 9 aa, Homo Sapiens
KLPSNLPQL

SEQ ID NO: 34641 - protein, 9 aa, Homo Sapiens
KMLDNFYNF

SEQ ID NO: 34642 - protein, 9 aa, Homo Sapiens
KMPLSTHRF

SEQ ID NO: 34643 - protein, 9 aa, Homo Sapiens
KQSPLDIHL

SEQ ID NO: 34644 - protein, 9 aa, Homo Sapiens
KWFFQKLRF

SEQ ID NO: 34645 - protein, 9 aa, Homo Sapiens
KWPETPLLL

SEQ ID NO: 34646 - protein, 9 aa, Homo Sapiens
KYAPRPIFI

SEQ ID NO: 34647 - protein, 9 aa, Homo Sapiens
KYEELFPAF

SEQ ID NO: 34648 - protein, 9 aa, Homo Sapiens
KYFEKQFEL

SEQ ID NO: 34649 - protein, 9 aa, Homo Sapiens
KYFHPPAHL

SEQ ID NO: 34650 - protein, 9 aa, Homo Sapiens
KYFLWEEKF

SEQ ID NO: 34651 - protein, 9 aa, Homo Sapiens
KYGNQLVRL

SEQ ID NO: 34652 - protein, 9 aa, Homo Sapiens
KYHDNAQLI

SEQ ID NO: 34653 - protein, 9 aa, Homo Sapiens
KYIDFDHVF

SEQ ID NO: 34654 - protein, 9 aa, Homo Sapiens
KYIDQKFVL

SEQ ID NO: 34655 - protein, 9 aa, Homo Sapiens
KYIDYLMTW

SEQ ID NO: 34656 - protein, 9 aa, Homo Sapiens
KYIESPVLF

SEQ ID NO: 34657 - protein, 9 aa, Homo Sapiens
KYIHSANVL

SEQ ID NO: 34658 - protein, 9 aa, Homo Sapiens
KYIKDDFRF

SEQ ID NO: 34659 - protein, 9 aa, Homo Sapiens
KYINTDAKF

SEQ ID NO: 34660 - protein, 9 aa, Homo Sapiens
KYIQRQETI

SEQ ID NO: 34661 - protein, 9 aa, Homo Sapiens
KYISGPHEL

SEQ ID NO: 34662 - protein, 9 aa, Homo Sapiens
KYISKPENL

SEQ ID NO: 34663 - protein, 9 aa, Homo Sapiens
KYITQGQLL

SEQ ID NO: 34664 - protein, 9 aa, Homo Sapiens
KYKDAANLL

SEQ ID NO: 34665 - protein, 9 aa, Homo Sapiens
KYKEAAHLL

SEQ ID NO: 34666 - protein, 9 aa, Homo Sapiens
KYKGIFNGF

SEQ ID NO: 34667 - protein, 9 aa, Homo Sapiens
KYLEHPLLL

SEQ ID NO: 34668 - protein, 9 aa, Homo Sapiens
KYLESFLAF

SEQ ID NO: 34669 - protein, 9 aa, Homo Sapiens
KYLLHSLVF

SEQ ID NO: 34670 - protein, 9 aa, Homo Sapiens
KYLLTPVNF

SEQ ID NO: 34671 - protein, 9 aa, Homo Sapiens
KYLSGIAHF

SEQ ID NO: 34672 - protein, 9 aa, Homo Sapiens
KYLTQHERI

SEQ ID NO: 34673 - protein, 9 aa, Homo Sapiens
KYLYQKIMF

SEQ ID NO: 34674 - protein, 9 aa, Homo Sapiens
KYMDINFDF

SEQ ID NO: 34675 - protein, 9 aa, Homo Sapiens
KYMDVQFDF

SEQ ID NO: 34676 - protein, 9 aa, Homo Sapiens
KYMLKANLI

SEQ ID NO: 34677 - protein, 9 aa, Homo Sapiens
KYMVYPQTF

SEQ ID NO: 34678 - protein, 9 aa, Homo Sapiens
KYNANFVTF

SEQ ID NO: 34679 - protein, 9 aa, Homo Sapiens
KYNPTWHCI

SEQ ID NO: 34680 - protein, 9 aa, Homo Sapiens
KYPENFFLL

SEQ ID NO: 34681 - protein, 9 aa, Homo Sapiens
KYPHYFPLL

SEQ ID NO: 34682 - protein, 9 aa, Homo Sapiens
KYPHYFPVM

SEQ ID NO: 34683 - protein, 9 aa, Homo Sapiens
KYPNVFKKI

SEQ ID NO: 34684 - protein, 9 aa, Homo Sapiens
KYPSPFFVF

SEQ ID NO: 34685 - protein, 9 aa, Homo Sapiens
KYQAHGYAF

SEQ ID NO: 34686 - protein, 9 aa, Homo Sapiens
KYQEVTNNL

SEQ ID NO: 34687 - protein, 9 aa, Homo Sapiens
KYQHLKAEF

SEQ ID NO: 34688 - protein, 9 aa, Homo Sapiens
KYQHTGAVL

SEQ ID NO: 34689 - protein, 9 aa, Homo Sapiens
KYSPFVVSF

SEQ ID NO: 34690 - protein, 9 aa, Homo Sapiens
KYVEVFHKI

SEQ ID NO: 34691 - protein, 9 aa, Homo Sapiens
KYVKVFHKF

SEQ ID NO: 34692 - protein, 9 aa, Homo Sapiens
KYVKVFNKF

SEQ ID NO: 34693 - protein, 9 aa, Homo Sapiens
KYVSGEFRF

SEQ ID NO: 34694 - protein, 9 aa, Homo Sapiens
KYVTVYNLI

SEQ ID NO: 34695 - protein, 9 aa, Homo Sapiens
LEGKRFLEL

SEQ ID NO: 34696 - protein, 9 aa, Homo Sapiens
LFIATSQKF

SEQ ID NO: 34697 - protein, 9 aa, Homo Sapiens
LFIDNIFRF

SEQ ID NO: 34698 - protein, 9 aa, Homo Sapiens
LFIEATEKF

SEQ ID NO: 34699 - protein, 9 aa, Homo Sapiens
LFIQGKLLF

SEQ ID NO: 34700 - protein, 9 aa, Homo Sapiens
LFIRDPLTL

SEQ ID NO: 34701 - protein, 9 aa, Homo Sapiens
LFKDQMELF

SEQ ID NO: 34702 - protein, 9 aa, Homo Sapiens
LFKHFADLL

SEQ ID NO: 34703 - protein, 9 aa, Homo Sapiens
LFKNDPLFF

SEQ ID NO: 34704 - protein, 9 aa, Homo Sapiens
LFLDRTYVL

SEQ ID NO: 34705 - protein, 9 aa, Homo Sapiens
LFLDTVSTF

SEQ ID NO: 34706 - protein, 9 aa, Homo Sapiens
LFLEHAHNL

SEQ ID NO: 34707 - protein, 9 aa, Homo Sapiens
LFLEKAMQL

SEQ ID NO: 34708 - protein, 9 aa, Homo Sapiens
LFLPLHELW

SEQ ID NO: 34709 - protein, 9 aa, Homo Sapiens
LFNGCPLRI

SEQ ID NO: 34710 - protein, 9 aa, Homo Sapiens
LFPGKAFSW

SEQ ID NO: 34711 - protein, 9 aa, Homo Sapiens
LFPLVPLHW

SEQ ID NO: 34712 - protein, 9 aa, Homo Sapiens
LFPPEPLVL

SEQ ID NO: 34713 - protein, 9 aa, Homo Sapiens
LFQQVPYQF

SEQ ID NO: 34714 - protein, 9 aa, Homo Sapiens
LFQRTAWVF

SEQ ID NO: 34715 - protein, 9 aa, Homo Sapiens
LFSHNRAHF

SEQ ID NO: 34716 - protein, 9 aa, Homo Sapiens
LFTDTGYIW

SEQ ID NO: 34717 - protein, 9 aa, Homo Sapiens
LFTKTHPQW

SEQ ID NO: 34718 - protein, 9 aa, Homo Sapiens
LFTSSRLFF

SEQ ID NO: 34719 - protein, 9 aa, Homo Sapiens
LFTSVYPTL

SEQ ID NO: 34720 - protein, 9 aa, Homo Sapiens
LLPDKWFDI

SEQ ID NO: 34721 - protein, 9 aa, Homo Sapiens
LLPEHFLFL

SEQ ID NO: 34722 - protein, 9 aa, Homo Sapiens
LLPGKTYSF

SEQ ID NO: 34723 - protein, 9 aa, Homo Sapiens
LLPSRQFGF

SEQ ID NO: 34724 - protein, 9 aa, Homo Sapiens
LMSLIINTF

SEQ ID NO: 34725 - protein, 9 aa, Homo Sapiens
LTVGNNKTL

SEQ ID NO: 34726 - protein, 9 aa, Homo Sapiens
LWAPRPFNL

SEQ ID NO: 34727 - protein, 9 aa, Homo Sapiens
LYAISAVYF

SEQ ID NO: 34728 - protein, 9 aa, Homo Sapiens
LYCGKTLLF

SEQ ID NO: 34729 - protein, 9 aa, Homo Sapiens
LYDKDHYKL

SEQ ID NO: 34730 - protein, 9 aa, Homo Sapiens
LYDPVISKL

SEQ ID NO: 34731 - protein, 9 aa, Homo Sapiens
LYFHINQTL

SEQ ID NO: 34732 - protein, 9 aa, Homo Sapiens
LYHDIFSRL

SEQ ID NO: 34733 - protein, 9 aa, Homo Sapiens
LYIDFGGKF

SEQ ID NO: 34734 - protein, 9 aa, Homo Sapiens
LYIDSRQNL

SEQ ID NO: 34735 - protein, 9 aa, Homo Sapiens
LYIGDGYVI

SEQ ID NO: 34736 - protein, 9 aa, Homo Sapiens
LYIGSSKTF

SEQ ID NO: 34737 - protein, 9 aa, Homo Sapiens
LYIPIFSTF

SEQ ID NO: 34738 - protein, 9 aa, Homo Sapiens
LYIQSHYQL

SEQ ID NO: 34739 - protein, 9 aa, Homo Sapiens
LYIVEPLKF

SEQ ID NO: 34740 - protein, 9 aa, Homo Sapiens
LYIVHPTMF

SEQ ID NO: 34741 - protein, 9 aa, Homo Sapiens
LYKFSADEF

SEQ ID NO: 34742 - protein, 9 aa, Homo Sapiens
LYLECSAKF

SEQ ID NO: 34743 - protein, 9 aa, Homo Sapiens
LYLILIMCN

SEQ ID NO: 34744 - protein, 9 aa, Homo Sapiens
LYMDKFEEF

SEQ ID NO: 34745 - protein, 9 aa, Homo Sapiens
LYPDHFHLL

SEQ ID NO: 34746 - protein, 9 aa, Homo Sapiens
LYPLTNYTF

SEQ ID NO: 34747 - protein, 9 aa, Homo Sapiens
LYPQFMFHL

SEQ ID NO: 34748 - protein, 9 aa, Homo Sapiens
LYQDGVFKF

SEQ ID NO: 34749 - protein, 9 aa, Homo Sapiens
LYQDKFPFF

SEQ ID NO: 34750 - protein, 9 aa, Homo Sapiens
LYQFNPAFF

SEQ ID NO: 34751 - protein, 9 aa, Homo Sapiens
LYQRAFQHL

SEQ ID NO: 34752 - protein, 9 aa, Homo Sapiens
LYRLQFNEF

SEQ ID NO: 34753 - protein, 9 aa, Homo Sapiens
LYRNFPLTI

SEQ ID NO: 34754 - protein, 9 aa, Homo Sapiens
LYSSEQLLI

SEQ ID NO: 34755 - protein, 9 aa, Homo Sapiens
LYSTIRPYL

SEQ ID NO: 34756 - protein, 9 aa, Homo Sapiens
LYTEKFEEF

SEQ ID NO: 34757 - protein, 9 aa, Homo Sapiens
LYTMNPNKF

SEQ ID NO: 34758 - protein, 9 aa, Homo Sapiens
LYTPEHHLI

SEQ ID NO: 34759 - protein, 9 aa, Homo Sapiens
LYTPHSWLL

SEQ ID NO: 34760 - protein, 9 aa, Homo Sapiens
LYTPKPQVI

SEQ ID NO: 34761 - protein, 9 aa, Homo Sapiens
LYTPVLIRF

SEQ ID NO: 34762 - protein, 9 aa, Homo Sapiens
LYTYIQSRF

SEQ ID NO: 34763 - protein, 9 aa, Homo Sapiens
LYVDFPQHL

SEQ ID NO: 34764 - protein, 9 aa, Homo Sapiens
LYVIGGNHF

SEQ ID NO: 34765 - protein, 9 aa, Homo Sapiens
LYVMVNAKF

SEQ ID NO: 34766 - protein, 9 aa, Homo Sapiens
LYWSHPRKF

SEQ ID NO: 34767 - protein, 9 aa, Homo Sapiens
MFLDRPQQW

SEQ ID NO: 34768 - protein, 9 aa, Homo Sapiens
MYIARQLSF

SEQ ID NO: 34769 - protein, 9 aa, Homo Sapiens
MYPYIFHVL

SEQ ID NO: 34770 - protein, 9 aa, Homo Sapiens
MYSGALLFF

SEQ ID NO: 34771 - protein, 9 aa, Homo Sapiens
NFCNIHVSL

SEQ ID NO: 34772 - protein, 9 aa, Homo Sapiens
NFGQHPFVF

SEQ ID NO: 34773 - protein, 9 aa, Homo Sapiens
NFHQTFATW

SEQ ID NO: 34774 - protein, 9 aa, Homo Sapiens
NFICPALEF

SEQ ID NO: 34775 - protein, 9 aa, Homo Sapiens
NFKLLSHSL

SEQ ID NO: 34776 - protein, 9 aa, Homo Sapiens
NFLSRSFYW

SEQ ID NO: 34777 - protein, 9 aa, Homo Sapiens
NFLWTPLHF

SEQ ID NO: 34778 - protein, 9 aa, Homo Sapiens
NFQIEHHLF

SEQ ID NO: 34779 - protein, 9 aa, Homo Sapiens
NFTKYPKKF

SEQ ID NO: 34780 - protein, 9 aa, Homo Sapiens
NFTNVAATF

SEQ ID NO: 34781 - protein, 9 aa, Homo Sapiens
NFTSTHLLL

SEQ ID NO: 34782 - protein, 9 aa, Homo Sapiens
NFVSFPLYL

SEQ ID NO: 34783 - protein, 9 aa, Homo Sapiens
NYAAALETF

SEQ ID NO: 34784 - protein, 9 aa, Homo Sapiens
NYAWVYYHL

SEQ ID NO: 34785 - protein, 9 aa, Homo Sapiens
NYCESRYHF

SEQ ID NO: 34786 - protein, 9 aa, Homo Sapiens
NYFHLAVAF

SEQ ID NO: 34787 - protein, 9 aa, Homo Sapiens
NYFLWTEKF

SEQ ID NO: 34788 - protein, 9 aa, Homo Sapiens
NYGQYFTLW

SEQ ID NO: 34789 - protein, 9 aa, Homo Sapiens
NYHAQHYHL

SEQ ID NO: 34790 - protein, 9 aa, Homo Sapiens
NYIEKVVAI

SEQ ID NO: 34791 - protein, 9 aa, Homo Sapiens
NYIHVGAQL

SEQ ID NO: 34792 - protein, 9 aa, Homo Sapiens
NYIKRNWRI

SEQ ID NO: 34793 - protein, 9 aa, Homo Sapiens
NYKKFYEAF

SEQ ID NO: 34794 - protein, 9 aa, Homo Sapiens
NYKKFYEQF

SEQ ID NO: 34795 - protein, 9 aa, Homo Sapiens
NYKLTSITF

SEQ ID NO: 34796 - protein, 9 aa, Homo Sapiens
NYLHLDYNF

SEQ ID NO: 34797 - protein, 9 aa, Homo Sapiens
NYLKDGPYI

SEQ ID NO: 34798 - protein, 9 aa, Homo Sapiens
NYLSHHLTI

SEQ ID NO: 34799 - protein, 9 aa, Homo Sapiens
NYLSIFRKF

SEQ ID NO: 34800 - protein, 9 aa, Homo Sapiens
NYMPGQLTI

SEQ ID NO: 34801 - protein, 9 aa, Homo Sapiens
NYQVQFVTL

SEQ ID NO: 34802 - protein, 9 aa, Homo Sapiens
NYRPHPQRF

SEQ ID NO: 34803 - protein, 9 aa, Homo Sapiens
NYSNIRFQF

SEQ ID NO: 34804 - protein, 9 aa, Homo Sapiens
NYSPYVNYF

SEQ ID NO: 34805 - protein, 9 aa, Homo Sapiens
NYSYLHCEW

SEQ ID NO: 34806 - protein, 9 aa, Homo Sapiens
NYTEAAYTL

SEQ ID NO: 34807 - protein, 9 aa, Homo Sapiens
NYTGVQILL

SEQ ID NO: 34808 - protein, 9 aa, Homo Sapiens
NYTLVSHLI

SEQ ID NO: 34809 - protein, 9 aa, Homo Sapiens
PFAKPLPTF

SEQ ID NO: 34810 - protein, 9 aa, Homo Sapiens
PFAPAIQTF

SEQ ID NO: 34811 - protein, 9 aa, Homo Sapiens
PFCDGSHFF

SEQ ID NO: 34812 - protein, 9 aa, Homo Sapiens
PFFSIPVVW

SEQ ID NO: 34813 - protein, 9 aa, Homo Sapiens
PFIDSQHVI

SEQ ID NO: 34814 - protein, 9 aa, Homo Sapiens
PFKSPSIGF

SEQ ID NO: 34815 - protein, 9 aa, Homo Sapiens
PFLDIQKRF

SEQ ID NO: 34816 - protein, 9 aa, Homo Sapiens
PFLPKPLFF

SEQ ID NO: 34817 - protein, 9 aa, Homo Sapiens
PFLTKPAGF

SEQ ID NO: 34818 - protein, 9 aa, Homo Sapiens
PFTDQIFHF

SEQ ID NO: 34819 - protein, 9 aa, Homo Sapiens
PFTHFLAFF

SEQ ID NO: 34820 - protein, 9 aa, Homo Sapiens
PFTSLHVQL

SEQ ID NO: 34821 - protein, 9 aa, Homo Sapiens
PFVDHVFTF

SEQ ID NO: 34822 - protein, 9 aa, Homo Sapiens
PSGGFFPTI

SEQ ID NO: 34823 - protein, 9 aa, Homo Sapiens
PWLFDAPKF

SEQ ID NO: 34824 - protein, 9 aa, Homo Sapiens
PYCSKPITL

SEQ ID NO: 34825 - protein, 9 aa, Homo Sapiens
PYFNAPVYL

SEQ ID NO: 34826 - protein, 9 aa, Homo Sapiens
PYHIYPFIF

SEQ ID NO: 34827 - protein, 9 aa, Homo Sapiens
PYHPHPHVF

SEQ ID NO: 34828 - protein, 9 aa, Homo Sapiens
PYISNIYLI

SEQ ID NO: 34829 - protein, 9 aa, Homo Sapiens
PYKVTQDEL

SEQ ID NO: 34830 - protein, 9 aa, Homo Sapiens
PYLDKFFAL

SEQ ID NO: 34831 - protein, 9 aa, Homo Sapiens
PYLFHVVTF

SEQ ID NO: 34832 - protein, 9 aa, Homo Sapiens
PYLISGSKF

SEQ ID NO: 34833 - protein, 9 aa, Homo Sapiens
PYMAKFVVF

SEQ ID NO: 34834 - protein, 9 aa, Homo Sapiens
PYMANVYLI

SEQ ID NO: 34835 - protein, 9 aa, Homo Sapiens
PYMSSPCHI

SEQ ID NO: 34836 - protein, 9 aa, Homo Sapiens
PYNDYFEYF

SEQ ID NO: 34837 - protein, 9 aa, Homo Sapiens
PYNHQHEYF

SEQ ID NO: 34838 - protein, 9 aa, Homo Sapiens
PYPPPPPEF

SEQ ID NO: 34839 - protein, 9 aa, Homo Sapiens
PYRPIPVTW

SEQ ID NO: 34840 - protein, 9 aa, Homo Sapiens
PYSDSTAKL

SEQ ID NO: 34841 - protein, 9 aa, Homo Sapiens
PYSPPAFRF

SEQ ID NO: 34842 - protein, 9 aa, Homo Sapiens
PYSPPTFRF

SEQ ID NO: 34843 - protein, 9 aa, Homo Sapiens
PYVDNSYKW

SEQ ID NO: 34844 - protein, 9 aa, Homo Sapiens
PYYSKFILI

SEQ ID NO: 34845 - protein, 9 aa, Homo Sapiens
QFFIHPLMI

SEQ ID NO: 34846 - protein, 9 aa, Homo Sapiens
QFHDLMELF

SEQ ID NO: 34847 - protein, 9 aa, Homo Sapiens
QFHPDGLIF

SEQ ID NO: 34848 - protein, 9 aa, Homo Sapiens
QFIDKPVCF

SEQ ID NO: 34849 - protein, 9 aa, Homo Sapiens
QFIGYPITL

SEQ ID NO: 34850 - protein, 9 aa, Homo Sapiens
QFNPKFMTF

SEQ ID NO: 34851 - protein, 9 aa, Homo Sapiens
QFTDTPLQI

SEQ ID NO: 34852 - protein, 9 aa, Homo Sapiens
QFTENHLQF

SEQ ID NO: 34853 - protein, 9 aa, Homo Sapiens
QFVPKSHLF

SEQ ID NO: 34854 - protein, 9 aa, Homo Sapiens
QLPELFHKI

SEQ ID NO: 34855 - protein, 9 aa, Homo Sapiens
QMPTVHYEF

SEQ ID NO: 34856 - protein, 9 aa, Homo Sapiens
QWPELLLRF

SEQ ID NO: 34857 - protein, 9 aa, Homo Sapiens
QYASAFHFL

SEQ ID NO: 34858 - protein, 9 aa, Homo Sapiens
QYAVLLNRF

SEQ ID NO: 34859 - protein, 9 aa, Homo Sapiens
QYEPLFHML

SEQ ID NO: 34860 - protein, 9 aa, Homo Sapiens
QYILFPLRF

SEQ ID NO: 34861 - protein, 9 aa, Homo Sapiens
QYLECPQYL

SEQ ID NO: 34862 - protein, 9 aa, Homo Sapiens
QYLEEAPKF

SEQ ID NO: 34863 - protein, 9 aa, Homo Sapiens
QYLIKHHNI

SEQ ID NO: 34864 - protein, 9 aa, Homo Sapiens
QYMELFNKI

SEQ ID NO: 34865 - protein, 9 aa, Homo Sapiens
QYNPHVHQL

SEQ ID NO: 34866 - protein, 9 aa, Homo Sapiens
QYNTYPIKL

SEQ ID NO: 34867 - protein, 9 aa, Homo Sapiens
QYPFPLPVF

SEQ ID NO: 34868 - protein, 9 aa, Homo Sapiens
QYSPLLAAF

SEQ ID NO: 34869 - protein, 9 aa, Homo Sapiens
QYTPHSHQF

SEQ ID NO: 34870 - protein, 9 aa, Homo Sapiens
QYVDFHNQL

SEQ ID NO: 34871 - protein, 9 aa, Homo Sapiens
QYYFNQHIF

SEQ ID NO: 34872 - protein, 9 aa, Homo Sapiens
RFCDAHLVL

SEQ ID NO: 34873 - protein, 9 aa, Homo Sapiens
RFCDNVWTF

SEQ ID NO: 34874 - protein, 9 aa, Homo Sapiens
RFEEAHFTF

SEQ ID NO: 34875 - protein, 9 aa, Homo Sapiens
RFEEKHAYF

SEQ ID NO: 34876 - protein, 9 aa, Homo Sapiens
RFFSDKETF

SEQ ID NO: 34877 - protein, 9 aa, Homo Sapiens
RFHEICSNL

SEQ ID NO: 34878 - protein, 9 aa, Homo Sapiens
RFHPKQLYF

SEQ ID NO: 34879 - protein, 9 aa, Homo Sapiens
RFHPTPLLL

SEQ ID NO: 34880 - protein, 9 aa, Homo Sapiens
RFHQLDVKF

SEQ ID NO: 34881 - protein, 9 aa, Homo Sapiens
RFIDAVYKL

SEQ ID NO: 34882 - protein, 9 aa, Homo Sapiens
RFIGATANF

SEQ ID NO: 34883 - protein, 9 aa, Homo Sapiens
RFILNLPTF

SEQ ID NO: 34884 - protein, 9 aa, Homo Sapiens
RFIPYTEEF

SEQ ID NO: 34885 - protein, 9 aa, Homo Sapiens
RFLAATFLL

SEQ ID NO: 34886 - protein, 9 aa, Homo Sapiens
RFLDKALEL

SEQ ID NO: 34887 - protein, 9 aa, Homo Sapiens
RFLLEGQVF

SEQ ID NO: 34888 - protein, 9 aa, Homo Sapiens
RFLPEALFL

SEQ ID NO: 34889 - protein, 9 aa, Homo Sapiens
RFLPSPVVI

SEQ ID NO: 34890 - protein, 9 aa, Homo Sapiens
RFLTGPLNL

SEQ ID NO: 34891 - protein, 9 aa, Homo Sapiens
RFLVKSHYI

SEQ ID NO: 34892 - protein, 9 aa, Homo Sapiens
RFMDGHITF

SEQ ID NO: 34893 - protein, 9 aa, Homo Sapiens
RFPNFTNQL

SEQ ID NO: 34894 - protein, 9 aa, Homo Sapiens
RFQEKFFIF

SEQ ID NO: 34895 - protein, 9 aa, Homo Sapiens
RFSEIPMKL

SEQ ID NO: 34896 - protein, 9 aa, Homo Sapiens
RFSLNTVEL

SEQ ID NO: 34897 - protein, 9 aa, Homo Sapiens
RFTLPPLVF

SEQ ID NO: 34898 - protein, 9 aa, Homo Sapiens
RFTYVLQDW

SEQ ID NO: 34899 - protein, 9 aa, Homo Sapiens
RFVMKAHSF

SEQ ID NO: 34900 - protein, 9 aa, Homo Sapiens
RFYYDPPEF

SEQ ID NO: 34901 - protein, 9 aa, Homo Sapiens
RGFHWRQKF

SEQ ID NO: 34902 - protein, 9 aa, Homo Sapiens
RISLPLPNF

SEQ ID NO: 34903 - protein, 9 aa, Homo Sapiens
RLPEEWSQW

SEQ ID NO: 34904 - protein, 9 aa, Homo Sapiens
RLPEPLPSW

SEQ ID NO: 34905 - protein, 9 aa, Homo Sapiens
RLPLRLFLI

SEQ ID NO: 34906 - protein, 9 aa, Homo Sapiens
RWHINFTTF

SEQ ID NO: 34907 - protein, 9 aa, Homo Sapiens
RWLAQPYYL

SEQ ID NO: 34908 - protein, 9 aa, Homo Sapiens
RWPKKSAEF

SEQ ID NO: 34909 - protein, 9 aa, Homo Sapiens
RWTDGLYYL

SEQ ID NO: 34910 - protein, 9 aa, Homo Sapiens
RWTEYGLTF

SEQ ID NO: 34911 - protein, 9 aa, Homo Sapiens
RYALIMHKL

SEQ ID NO: 34912 - protein, 9 aa, Homo Sapiens
RYCEGHFSL

SEQ ID NO: 34913 - protein, 9 aa, Homo Sapiens
RYDNVTILF

SEQ ID NO: 34914 - protein, 9 aa, Homo Sapiens
RYFENPQVI

SEQ ID NO: 34915 - protein, 9 aa, Homo Sapiens
RYFKTPRKF

SEQ ID NO: 34916 - protein, 9 aa, Homo Sapiens
RYGDGGSTF

SEQ ID NO: 34917 - protein, 9 aa, Homo Sapiens
RYGIHPAKF

SEQ ID NO: 34918 - protein, 9 aa, Homo Sapiens
RYGNTPFLF

SEQ ID NO: 34919 - protein, 9 aa, Homo Sapiens
RYIDRIHIF

SEQ ID NO: 34920 - protein, 9 aa, Homo Sapiens
RYIDTHNRV

SEQ ID NO: 34921 - protein, 9 aa, Homo Sapiens
RYIFAKNLF

SEQ ID NO: 34922 - protein, 9 aa, Homo Sapiens
RYILEPFFI

SEQ ID NO: 34923 - protein, 9 aa, Homo Sapiens
RYINNPLLI

SEQ ID NO: 34924 - protein, 9 aa, Homo Sapiens
RYIPTAAAF

SEQ ID NO: 34925 - protein, 9 aa, Homo Sapiens
RYIRDAHTF

SEQ ID NO: 34926 - protein, 9 aa, Homo Sapiens
RYKEKVAEL

SEQ ID NO: 34927 - protein, 9 aa, Homo Sapiens
RYKLYQEMF

SEQ ID NO: 34928 - protein, 9 aa, Homo Sapiens
RYKQDVERF

SEQ ID NO: 34929 - protein, 9 aa, Homo Sapiens
RYLAEKYEW

SEQ ID NO: 34930 - protein, 9 aa, Homo Sapiens
RYLDLFTSF

SEQ ID NO: 34931 - protein, 9 aa, Homo Sapiens
RYLDLLTTW

SEQ ID NO: 34932 - protein, 9 aa, Homo Sapiens
RYLEKNVKL

SEQ ID NO: 34933 - protein, 9 aa, Homo Sapiens
RYLEKPMEI

SEQ ID NO: 34934 - protein, 9 aa, Homo Sapiens
RYLEQLHQL

SEQ ID NO: 34935 - protein, 9 aa, Homo Sapiens
RYLEYFEKI

SEQ ID NO: 34936 - protein, 9 aa, Homo Sapiens
RYLHKPYLI

SEQ ID NO: 34937 - protein, 9 aa, Homo Sapiens
RYLLKFEQI

SEQ ID NO: 34938 - protein, 9 aa, Homo Sapiens
RYLNEFEEL

SEQ ID NO: 34939 - protein, 9 aa, Homo Sapiens
RYLNKAFHI

SEQ ID NO: 34940 - protein, 9 aa, Homo Sapiens
RYLPDTLLL

SEQ ID NO: 34941 - protein, 9 aa, Homo Sapiens
RYLPQCSYF

SEQ ID NO: 34942 - protein, 9 aa, Homo Sapiens
RYLQTLTTI

SEQ ID NO: 34943 - protein, 9 aa, Homo Sapiens
RYLTVAAVF

SEQ ID NO: 34944 - protein, 9 aa, Homo Sapiens
RYMPDICVI

SEQ ID NO: 34945 - protein, 9 aa, Homo Sapiens
RYMPQNPHI

SEQ ID NO: 34946 - protein, 9 aa, Homo Sapiens
RYNEKCFKL

SEQ ID NO: 34947 - protein, 9 aa, Homo Sapiens
RYNPENNTW

SEQ ID NO: 34948 - protein, 9 aa, Homo Sapiens
RYNPNLNTW

SEQ ID NO: 34949 - protein, 9 aa, Homo Sapiens
RYNSQLLSF

SEQ ID NO: 34950 - protein, 9 aa, Homo Sapiens
RYPCFFNTL

SEQ ID NO: 34951 - protein, 9 aa, Homo Sapiens
RYPDSHQLF

SEQ ID NO: 34952 - protein, 9 aa, Homo Sapiens
RYPSNLQLF

SEQ ID NO: 34953 - protein, 9 aa, Homo Sapiens
RYSDSTFTF

SEQ ID NO: 34954 - protein, 9 aa, Homo Sapiens
RYSEYAEEF

SEQ ID NO: 34955 - protein, 9 aa, Homo Sapiens
RYSPVLSRF

SEQ ID NO: 34956 - protein, 9 aa, Homo Sapiens
RYSRKGFLF

SEQ ID NO: 34957 - protein, 9 aa, Homo Sapiens
RYTIVQQQI

SEQ ID NO: 34958 - protein, 9 aa, Homo Sapiens
RYTLQASTF

SEQ ID NO: 34959 - protein, 9 aa, Homo Sapiens
RYTPVGRSF

SEQ ID NO: 34960 - protein, 9 aa, Homo Sapiens
RYTTAGQLW

SEQ ID NO: 34961 - protein, 9 aa, Homo Sapiens
RYVPRASYF

SEQ ID NO: 34962 - protein, 9 aa, Homo Sapiens
RYYHCAVTL

SEQ ID NO: 34963 - protein, 9 aa, Homo Sapiens
SFCDKVMRW

SEQ ID NO: 34964 - protein, 9 aa, Homo Sapiens
SFHNIHNTF

SEQ ID NO: 34965 - protein, 9 aa, Homo Sapiens
SFHQVDYTF

SEQ ID NO: 34966 - protein, 9 aa, Homo Sapiens
SFIGAFLTF

SEQ ID NO: 34967 - protein, 9 aa, Homo Sapiens
SFINSNLKF

SEQ ID NO: 34968 - protein, 9 aa, Homo Sapiens
SFIQHYYQL

SEQ ID NO: 34969 - protein, 9 aa, Homo Sapiens
SFISGLFNF

SEQ ID NO: 34970 - protein, 9 aa, Homo Sapiens
SFITSSWTF

SEQ ID NO: 34971 - protein, 9 aa, Homo Sapiens
SFLFVHPEW

SEQ ID NO: 34972 - protein, 9 aa, Homo Sapiens
SFLKFHPEL

SEQ ID NO: 34973 - protein, 9 aa, Homo Sapiens
SFLPVHLGF

SEQ ID NO: 34974 - protein, 9 aa, Homo Sapiens
SFLPVVSTF

SEQ ID NO: 34975 - protein, 9 aa, Homo Sapiens
SFLTIPLCL

SEQ ID NO: 34976 - protein, 9 aa, Homo Sapiens
SFMPNSPRF

SEQ ID NO: 34977 - protein, 9 aa, Homo Sapiens
SFNPYSEFI

SEQ ID NO: 34978 - protein, 9 aa, Homo Sapiens
SFNSLPLLI

SEQ ID NO: 34979 - protein, 9 aa, Homo Sapiens
SFSHSGYQF

SEQ ID NO: 34980 - protein, 9 aa, Homo Sapiens
SFSTVHEKF

SEQ ID NO: 34981 - protein, 9 aa, Homo Sapiens
SFSTVTNTF

SEQ ID NO: 34982 - protein, 9 aa, Homo Sapiens
SFTPVGDVF

SEQ ID NO: 34983 - protein, 9 aa, Homo Sapiens
SFTQIQATF

SEQ ID NO: 34984 - protein, 9 aa, Homo Sapiens
SFVLLPLVW

SEQ ID NO: 34985 - protein, 9 aa, Homo Sapiens
SLPDFCHKF

SEQ ID NO: 34986 - protein, 9 aa, Homo Sapiens
SLPEDFYHF

SEQ ID NO: 34987 - protein, 9 aa, Homo Sapiens
SLPGNFFYL

SEQ ID NO: 34988 - protein, 9 aa, Homo Sapiens
SLPKFYLLF

SEQ ID NO: 34989 - protein, 9 aa, Homo Sapiens
SPSTSIFFI

SEQ ID NO: 34990 - protein, 9 aa, Homo Sapiens
SWYHGALTF

SEQ ID NO: 34991 - protein, 9 aa, Homo Sapiens
SYIALPLTL

SEQ ID NO: 34992 - protein, 9 aa, Homo Sapiens
SYIDVAVKL

SEQ ID NO: 34993 - protein, 9 aa, Homo Sapiens
SYIEHIFEI

SEQ ID NO: 34994 - protein, 9 aa, Homo Sapiens
SYIELPAYL

SEQ ID NO: 34995 - protein, 9 aa, Homo Sapiens
SYIGVHQQI

SEQ ID NO: 34996 - protein, 9 aa, Homo Sapiens
SYIHQRYIL

SEQ ID NO: 34997 - protein, 9 aa, Homo Sapiens
SYIISGCLF

SEQ ID NO: 34998 - protein, 9 aa, Homo Sapiens
SYIPSTVFF

SEQ ID NO: 34999 - protein, 9 aa, Homo Sapiens
SYLDSVHFF

SEQ ID NO: 35000 - protein, 9 aa, Homo Sapiens
SYLPISPTF

SEQ ID NO: 35001 - protein, 9 aa, Homo Sapiens
SYLPLAHMF

SEQ ID NO: 35002 - protein, 9 aa, Homo Sapiens
SYLQSLLLF

SEQ ID NO: 35003 - protein, 9 aa, Homo Sapiens
SYLSSILRF

SEQ ID NO: 35004 - protein, 9 aa, Homo Sapiens
SYLTIHHRI

SEQ ID NO: 35005 - protein, 9 aa, Homo Sapiens
SYMEVPTYL

SEQ ID NO: 35006 - protein, 9 aa, Homo Sapiens
SYMGHFDLL

SEQ ID NO: 35007 - protein, 9 aa, Homo Sapiens
SYPDLLPTF

SEQ ID NO: 35008 - protein, 9 aa, Homo Sapiens
SYPNVFLVF

SEQ ID NO: 35009 - protein, 9 aa, Homo Sapiens
SYPTFFPRF

SEQ ID NO: 35010 - protein, 9 aa, Homo Sapiens
SYQDVHLLL

SEQ ID NO: 35011 - protein, 9 aa, Homo Sapiens
SYQKVIELF

SEQ ID NO: 35012 - protein, 9 aa, Homo Sapiens
SYSDPPLKF

SEQ ID NO: 35013 - protein, 9 aa, Homo Sapiens
SYSPQAFKF

SEQ ID NO: 35014 - protein, 9 aa, Homo Sapiens
SYTHIQYLF

SEQ ID NO: 35015 - protein, 9 aa, Homo Sapiens
SYTRLFSNF

SEQ ID NO: 35016 - protein, 9 aa, Homo Sapiens
SYTSVKENF

SEQ ID NO: 35017 - protein, 9 aa, Homo Sapiens
SYTYLSLGF

SEQ ID NO: 35018 - protein, 9 aa, Homo Sapiens
SYVRSLPFF

SEQ ID NO: 35019 - protein, 9 aa, Homo Sapiens
SYYKDALRF

SEQ ID NO: 35020 - protein, 9 aa, Homo Sapiens
TFDDVAVTF

SEQ ID NO: 35021 - protein, 9 aa, Homo Sapiens
TFESSHYLL

SEQ ID NO: 35022 - protein, 9 aa, Homo Sapiens
TFFPFHEYF

SEQ ID NO: 35023 - protein, 9 aa, Homo Sapiens
TFHALPSHF

SEQ ID NO: 35024 - protein, 9 aa, Homo Sapiens
TFHSFFQHF

SEQ ID NO: 35025 - protein, 9 aa, Homo Sapiens
TFILQKILL

SEQ ID NO: 35026 - protein, 9 aa, Homo Sapiens
TFISYSVTF

SEQ ID NO: 35027 - protein, 9 aa, Homo Sapiens
TFKDVGNLL

SEQ ID NO: 35028 - protein, 9 aa, Homo Sapiens
TFLLTRELW

SEQ ID NO: 35029 - protein, 9 aa, Homo Sapiens
TFLMSSFTF

SEQ ID NO: 35030 - protein, 9 aa, Homo Sapiens
TFLNHPALI

SEQ ID NO: 35031 - protein, 9 aa, Homo Sapiens
TFPSLLLVF

SEQ ID NO: 35032 - protein, 9 aa, Homo Sapiens
TFSDVEAHF

SEQ ID NO: 35033 - protein, 9 aa, Homo Sapiens
TFSPHFHHF

SEQ ID NO: 35034 - protein, 9 aa, Homo Sapiens
TFTDHVMLF

SEQ ID NO: 35035 - protein, 9 aa, Homo Sapiens
TFTFSHATF

SEQ ID NO: 35036 - protein, 9 aa, Homo Sapiens
TFTKIVNKW

SEQ ID NO: 35037 - protein, 9 aa, Homo Sapiens
TFTNQIHKW

SEQ ID NO: 35038 - protein, 9 aa, Homo Sapiens
TFTPFPHAI

SEQ ID NO: 35039 - protein, 9 aa, Homo Sapiens
TLSDIFLLF

SEQ ID NO: 35040 - protein, 9 aa, Homo Sapiens
TMLGKFYHF

SEQ ID NO: 35041 - protein, 9 aa, Homo Sapiens
TYDIGHVLL

SEQ ID NO: 35042 - protein, 9 aa, Homo Sapiens
TYDPFHNCW

SEQ ID NO: 35043 - protein, 9 aa, Homo Sapiens
TYFSTPLLL

SEQ ID NO: 35044 - protein, 9 aa, Homo Sapiens
TYGEIFEKF

SEQ ID NO: 35045 - protein, 9 aa, Homo Sapiens
TYHGVFVNI

SEQ ID NO: 35046 - protein, 9 aa, Homo Sapiens
TYHPGVPVF

SEQ ID NO: 35047 - protein, 9 aa, Homo Sapiens
TYIKSPPFF

SEQ ID NO: 35048 - protein, 9 aa, Homo Sapiens
TYINPFVSF

SEQ ID NO: 35049 - protein, 9 aa, Homo Sapiens
TYIRCPSFF

SEQ ID NO: 35050 - protein, 9 aa, Homo Sapiens
TYITSVSRL

SEQ ID NO: 35051 - protein, 9 aa, Homo Sapiens
TYKDYVDLF

SEQ ID NO: 35052 - protein, 9 aa, Homo Sapiens
TYKPNPNQI

SEQ ID NO: 35053 - protein, 9 aa, Homo Sapiens
TYLDIPLVI

SEQ ID NO: 35054 - protein, 9 aa, Homo Sapiens
TYLEKAIKI

SEQ ID NO: 35055 - protein, 9 aa, Homo Sapiens
TYLPQTYII

SEQ ID NO: 35056 - protein, 9 aa, Homo Sapiens
TYLPTSPLL

SEQ ID NO: 35057 - protein, 9 aa, Homo Sapiens
TYLTIFDLF

SEQ ID NO: 35058 - protein, 9 aa, Homo Sapiens
TYNQKHSLF

SEQ ID NO: 35059 - protein, 9 aa, Homo Sapiens
TYNYPVHYF

SEQ ID NO: 35060 - protein, 9 aa, Homo Sapiens
TYPQTPLHL

SEQ ID NO: 35061 - protein, 9 aa, Homo Sapiens
TYQDIQNTI

SEQ ID NO: 35062 - protein, 9 aa, Homo Sapiens
TYQRWQFTL

SEQ ID NO: 35063 - protein, 9 aa, Homo Sapiens
TYQVLAVTF

SEQ ID NO: 35064 - protein, 9 aa, Homo Sapiens
TYSKKHFRI

SEQ ID NO: 35065 - protein, 9 aa, Homo Sapiens
TYSNFHPLL

SEQ ID NO: 35066 - protein, 9 aa, Homo Sapiens
TYTDRVFFL

SEQ ID NO: 35067 - protein, 9 aa, Homo Sapiens
TYTSARTLL

SEQ ID NO: 35068 - protein, 9 aa, Homo Sapiens
TYTYEKLLW

SEQ ID NO: 35069 - protein, 9 aa, Homo Sapiens
TYVPWPLML

SEQ ID NO: 35070 - protein, 9 aa, Homo Sapiens
TYVSFPLEL

SEQ ID NO: 35071 - protein, 9 aa, Homo Sapiens
TYVSGTLRF

SEQ ID NO: 35072 - protein, 9 aa, Homo Sapiens
VFADVETHF

SEQ ID NO: 35073 - protein, 9 aa, Homo Sapiens
VFAGVFNTF

SEQ ID NO: 35074 - protein, 9 aa, Homo Sapiens
VFDPKVFTF

SEQ ID NO: 35075 - protein, 9 aa, Homo Sapiens
VFDPVQKTL

SEQ ID NO: 35076 - protein, 9 aa, Homo Sapiens
VFDPVTKLW

SEQ ID NO: 35077 - protein, 9 aa, Homo Sapiens
VFEDVFVYF

SEQ ID NO: 35078 - protein, 9 aa, Homo Sapiens
VFESWMHHW

SEQ ID NO: 35079 - protein, 9 aa, Homo Sapiens
VFGGQRLTL

SEQ ID NO: 35080 - protein, 9 aa, Homo Sapiens
VFGYHGYTF

SEQ ID NO: 35081 - protein, 9 aa, Homo Sapiens
VFIDGPLAL

SEQ ID NO: 35082 - protein, 9 aa, Homo Sapiens
VFIDKQTNL

SEQ ID NO: 35083 - protein, 9 aa, Homo Sapiens
VFIGNLNTL

SEQ ID NO: 35084 - protein, 9 aa, Homo Sapiens
VFIGTGHLL

SEQ ID NO: 35085 - protein, 9 aa, Homo Sapiens
VFIRGGEEF

SEQ ID NO: 35086 - protein, 9 aa, Homo Sapiens
VFKEKHHSW

SEQ ID NO: 35087 - protein, 9 aa, Homo Sapiens
VFKNDQDTW

SEQ ID NO: 35088 - protein, 9 aa, Homo Sapiens
VFKPISSTW

SEQ ID NO: 35089 - protein, 9 aa, Homo Sapiens
VFKPIVEKF

SEQ ID NO: 35090 - protein, 9 aa, Homo Sapiens
VFLALPCKF

SEQ ID NO: 35091 - protein, 9 aa, Homo Sapiens
VFLKSPIVI

SEQ ID NO: 35092 - protein, 9 aa, Homo Sapiens
VFLLKPLKW

SEQ ID NO: 35093 - protein, 9 aa, Homo Sapiens
VFLRAINKF

SEQ ID NO: 35094 - protein, 9 aa, Homo Sapiens
VFLSPLTTF

SEQ ID NO: 35095 - protein, 9 aa, Homo Sapiens
VFLTDTIRI

SEQ ID NO: 35096 - protein, 9 aa, Homo Sapiens
VFNDVRLLL

SEQ ID NO: 35097 - protein, 9 aa, Homo Sapiens
VFNGCPLRI

SEQ ID NO: 35098 - protein, 9 aa, Homo Sapiens
VFNPAKELI

SEQ ID NO: 35099 - protein, 9 aa, Homo Sapiens
VFPDFYLHL

SEQ ID NO: 35100 - protein, 9 aa, Homo Sapiens
VFPDKGYSF

SEQ ID NO: 35101 - protein, 9 aa, Homo Sapiens
VFPEKGYSF

SEQ ID NO: 35102 - protein, 9 aa, Homo Sapiens
VFPFRTFYL

SEQ ID NO: 35103 - protein, 9 aa, Homo Sapiens
VFPGHPVQF

SEQ ID NO: 35104 - protein, 9 aa, Homo Sapiens
VFPTRTARF

SEQ ID NO: 35105 - protein, 9 aa, Homo Sapiens
VFQDRQYQI

SEQ ID NO: 35106 - protein, 9 aa, Homo Sapiens
VFRLQFDEF

SEQ ID NO: 35107 - protein, 9 aa, Homo Sapiens
VFSLIGLHF

SEQ ID NO: 35108 - protein, 9 aa, Homo Sapiens
VFSPDGHLF

SEQ ID NO: 35109 - protein, 9 aa, Homo Sapiens
VFSTVVIHF

SEQ ID NO: 35110 - protein, 9 aa, Homo Sapiens
VFTAFTEEF

SEQ ID NO: 35111 - protein, 9 aa, Homo Sapiens
VFTDEMAHF

SEQ ID NO: 35112 - protein, 9 aa, Homo Sapiens
VFTEVANLF

SEQ ID NO: 35113 - protein, 9 aa, Homo Sapiens
VFTFVYDTI

SEQ ID NO: 35114 - protein, 9 aa, Homo Sapiens
VFTGGALYF

SEQ ID NO: 35115 - protein, 9 aa, Homo Sapiens
VFTGVVTKL

SEQ ID NO: 35116 - protein, 9 aa, Homo Sapiens
VFTIKADVW

SEQ ID NO: 35117 - protein, 9 aa, Homo Sapiens
VFTLKPLEF

SEQ ID NO: 35118 - protein, 9 aa, Homo Sapiens
VFTNTIKLI

SEQ ID NO: 35119 - protein, 9 aa, Homo Sapiens
VFTPVTTEI

SEQ ID NO: 35120 - protein, 9 aa, Homo Sapiens
VFTPVVQRI

SEQ ID NO: 35121 - protein, 9 aa, Homo Sapiens
VFTRSELKF

SEQ ID NO: 35122 - protein, 9 aa, Homo Sapiens
VFTSVRQKI

SEQ ID NO: 35123 - protein, 9 aa, Homo Sapiens
VFTVGPKTF

SEQ ID NO: 35124 - protein, 9 aa, Homo Sapiens
VFTYVGALF

SEQ ID NO: 35125 - protein, 9 aa, Homo Sapiens
VFVATFLRY

SEQ ID NO: 35126 - protein, 9 aa, Homo Sapiens
VFVDRAACF

SEQ ID NO: 35127 - protein, 9 aa, Homo Sapiens
VFVEATHVL

SEQ ID NO: 35128 - protein, 9 aa, Homo Sapiens
VFVGKGITF

SEQ ID NO: 35129 - protein, 9 aa, Homo Sapiens
VFVKPLVLF

SEQ ID NO: 35130 - protein, 9 aa, Homo Sapiens
VFVNIQYTL

SEQ ID NO: 35131 - protein, 9 aa, Homo Sapiens
VFVNTHHIL

SEQ ID NO: 35132 - protein, 9 aa, Homo Sapiens
VFVPVAYSL

SEQ ID NO: 35133 - protein, 9 aa, Homo Sapiens
VFYELAHQL

SEQ ID NO: 35134 - protein, 9 aa, Homo Sapiens
VFYPFVDLI

SEQ ID NO: 35135 - protein, 9 aa, Homo Sapiens
VFYPYPQYF

SEQ ID NO: 35136 - protein, 9 aa, Homo Sapiens
VLFFFNLLF

SEQ ID NO: 35137 - protein, 9 aa, Homo Sapiens
VLPGHFNTF

SEQ ID NO: 35138 - protein, 9 aa, Homo Sapiens
VLPHFNVLF

SEQ ID NO: 35139 - protein, 9 aa, Homo Sapiens
VLPKLYVKL

SEQ ID NO: 35140 - protein, 9 aa, Homo Sapiens
VLPNIHPEL

SEQ ID NO: 35141 - protein, 9 aa, Homo Sapiens
VLPNTALHL

SEQ ID NO: 35142 - protein, 9 aa, Homo Sapiens
VLPSVLNKF

SEQ ID NO: 35143 - protein, 9 aa, Homo Sapiens
VMAPRTLVL

SEQ ID NO: 35144 - protein, 9 aa, Homo Sapiens
VMPSSFFLL

SEQ ID NO: 35145 - protein, 9 aa, Homo Sapiens
VMSATFAKF

SEQ ID NO: 35146 - protein, 9 aa, Homo Sapiens
VSAYPSFKF

SEQ ID NO: 35147 - protein, 9 aa, Homo Sapiens
VWCMKALEF

SEQ ID NO: 35148 - protein, 9 aa, Homo Sapiens
VYADQPHIF

SEQ ID NO: 35149 - protein, 9 aa, Homo Sapiens
VYAFNLDTF

SEQ ID NO: 35150 - protein, 9 aa, Homo Sapiens
VYAHFPINV

SEQ ID NO: 35151 - protein, 9 aa, Homo Sapiens
VYALPTIAF

SEQ ID NO: 35152 - protein, 9 aa, Homo Sapiens
VYAPPVGGF

SEQ ID NO: 35153 - protein, 9 aa, Homo Sapiens
VYASDRATF

SEQ ID NO: 35154 - protein, 9 aa, Homo Sapiens
VYCARFVEL

SEQ ID NO: 35155 - protein, 9 aa, Homo Sapiens
VYCIGQRKF

SEQ ID NO: 35156 - protein, 9 aa, Homo Sapiens
VYDSVAFPE

SEQ ID NO: 35157 - protein, 9 aa, Homo Sapiens
VYDTNPAKF

SEQ ID NO: 35158 - protein, 9 aa, Homo Sapiens
VYDTVFKHF

SEQ ID NO: 35159 - protein, 9 aa, Homo Sapiens
VYDVVELKF

SEQ ID NO: 35160 - protein, 9 aa, Homo Sapiens
VYENVSHFL

SEQ ID NO: 35161 - protein, 9 aa, Homo Sapiens
VYGPLPQSF

SEQ ID NO: 35162 - protein, 9 aa, Homo Sapiens
VYHILKVLF

SEQ ID NO: 35163 - protein, 9 aa, Homo Sapiens
VYHKPPNAF

SEQ ID NO: 35164 - protein, 9 aa, Homo Sapiens
VYHKPPSAF

SEQ ID NO: 35165 - protein, 9 aa, Homo Sapiens
VYHNLKNVI

SEQ ID NO: 35166 - protein, 9 aa, Homo Sapiens
VYHNTEDLW

SEQ ID NO: 35167 - protein, 9 aa, Homo Sapiens
VYIGVHVPF

SEQ ID NO: 35168 - protein, 9 aa, Homo Sapiens
VYIHHFDRI

SEQ ID NO: 35169 - protein, 9 aa, Homo Sapiens
VYIKHPVSL

SEQ ID NO: 35170 - protein, 9 aa, Homo Sapiens
VYINTAQEF

SEQ ID NO: 35171 - protein, 9 aa, Homo Sapiens
VYIPCIYVL

SEQ ID NO: 35172 - protein, 9 aa, Homo Sapiens
VYIPNKVLI

SEQ ID NO: 35173 - protein, 9 aa, Homo Sapiens
VYISEHEHF

SEQ ID NO: 35174 - protein, 9 aa, Homo Sapiens
VYISNGQVL

SEQ ID NO: 35175 - protein, 9 aa, Homo Sapiens
VYIVPVIVL

SEQ ID NO: 35176 - protein, 9 aa, Homo Sapiens
VYKDLVLLL

SEQ ID NO: 35177 - protein, 9 aa, Homo Sapiens
VYKKSIFVF

SEQ ID NO: 35178 - protein, 9 aa, Homo Sapiens
VYKKYPNVF

SEQ ID NO: 35179 - protein, 9 aa, Homo Sapiens
VYKLHRETF

SEQ ID NO: 35180 - protein, 9 aa, Homo Sapiens
VYKPAQNSW

SEQ ID NO: 35181 - protein, 9 aa, Homo Sapiens
VYLDKFIRL

SEQ ID NO: 35182 - protein, 9 aa, Homo Sapiens
VYLEKFMTF

SEQ ID NO: 35183 - protein, 9 aa, Homo Sapiens
VYLHDFQRF

SEQ ID NO: 35184 - protein, 9 aa, Homo Sapiens
VYLIEHPSL

SEQ ID NO: 35185 - protein, 9 aa, Homo Sapiens
VYLLRSYCF

SEQ ID NO: 35186 - protein, 9 aa, Homo Sapiens
VYLPTAFLL

SEQ ID NO: 35187 - protein, 9 aa, Homo Sapiens
VYLPTHTSL

SEQ ID NO: 35188 - protein, 9 aa, Homo Sapiens
VYLSNVVLF

SEQ ID NO: 35189 - protein, 9 aa, Homo Sapiens
VYMDWYEKF

SEQ ID NO: 35190 - protein, 9 aa, Homo Sapiens
VYMIRVYLL

SEQ ID NO: 35191 - protein, 9 aa, Homo Sapiens
VYMNRVKEI

SEQ ID NO: 35192 - protein, 9 aa, Homo Sapiens
VYNAVLELF

SEQ ID NO: 35193 - protein, 9 aa, Homo Sapiens
VYNKVHITL

SEQ ID NO: 35194 - protein, 9 aa, Homo Sapiens
VYNPHSDTW

SEQ ID NO: 35195 - protein, 9 aa, Homo Sapiens
VYNPMPFEL

SEQ ID NO: 35196 - protein, 9 aa, Homo Sapiens
VYNPVIYVF

SEQ ID NO: 35197 - protein, 9 aa, Homo Sapiens
VYNPVRAEW

SEQ ID NO: 35198 - protein, 9 aa, Homo Sapiens
VYPEESLVI

SEQ ID NO: 35199 - protein, 9 aa, Homo Sapiens
VYPERTPLL

SEQ ID NO: 35200 - protein, 9 aa, Homo Sapiens
VYPGDPLRF

SEQ ID NO: 35201 - protein, 9 aa, Homo Sapiens
VYPGIAVFF

SEQ ID NO: 35202 - protein, 9 aa, Homo Sapiens
VYPGYYLTF

SEQ ID NO: 35203 - protein, 9 aa, Homo Sapiens
VYPLKFFFL

SEQ ID NO: 35204 - protein, 9 aa, Homo Sapiens
VYPPHSHSI

SEQ ID NO: 35205 - protein, 9 aa, Homo Sapiens
VYPPPHQVF

SEQ ID NO: 35206 - protein, 9 aa, Homo Sapiens
VYPWTQRFF

SEQ ID NO: 35207 - protein, 9 aa, Homo Sapiens
VYQHLFTRI

SEQ ID NO: 35208 - protein, 9 aa, Homo Sapiens
VYQLRFQFL

SEQ ID NO: 35209 - protein, 9 aa, Homo Sapiens
VYQYMHETI

SEQ ID NO: 35210 - protein, 9 aa, Homo Sapiens
VYRQDCETF

SEQ ID NO: 35211 - protein, 9 aa, Homo Sapiens
VYSAGVYRL

SEQ ID NO: 35212 - protein, 9 aa, Homo Sapiens
VYSEVHFTL

SEQ ID NO: 35213 - protein, 9 aa, Homo Sapiens
VYSGGVYLF

SEQ ID NO: 35214 - protein, 9 aa, Homo Sapiens
VYSIVPQSW

SEQ ID NO: 35215 - protein, 9 aa, Homo Sapiens
VYSPHVLNL

SEQ ID NO: 35216 - protein, 9 aa, Homo Sapiens
VYSPKSPSL

SEQ ID NO: 35217 - protein, 9 aa, Homo Sapiens
VYSTPTPFF

SEQ ID NO: 35218 - protein, 9 aa, Homo Sapiens
VYSVFGFSF

SEQ ID NO: 35219 - protein, 9 aa, Homo Sapiens
VYTDFAFRI

SEQ ID NO: 35220 - protein, 9 aa, Homo Sapiens
VYTDVAYYL

SEQ ID NO: 35221 - protein, 9 aa, Homo Sapiens
VYTGDALRI

SEQ ID NO: 35222 - protein, 9 aa, Homo Sapiens
VYTKANPTF

SEQ ID NO: 35223 - protein, 9 aa, Homo Sapiens
VYTKVKCKI

SEQ ID NO: 35224 - protein, 9 aa, Homo Sapiens
VYTTTRSHL

SEQ ID NO: 35225 - protein, 9 aa, Homo Sapiens
VYTWVKQCW

SEQ ID NO: 35226 - protein, 9 aa, Homo Sapiens
VYTYIQSRF

SEQ ID NO: 35227 - protein, 9 aa, Homo Sapiens
VYVATRPTI

SEQ ID NO: 35228 - protein, 9 aa, Homo Sapiens
VYVKHSISF

SEQ ID NO: 35229 - protein, 9 aa, Homo Sapiens
VYVQHPITF

SEQ ID NO: 35230 - protein, 9 aa, Homo Sapiens
VYVQNVVKL

SEQ ID NO: 35231 - protein, 9 aa, Homo Sapiens
VYVQPPLEL

SEQ ID NO: 35232 - protein, 9 aa, Homo Sapiens
VYVSDNIRI

SEQ ID NO: 35233 - protein, 9 aa, Homo Sapiens
VYVVGTAHF

SEQ ID NO: 35234 - protein, 9 aa, Homo Sapiens
VYWKIYNSI

SEQ ID NO: 35235 - protein, 9 aa, Homo Sapiens
VYWTQLNMF

SEQ ID NO: 35236 - protein, 9 aa, Homo Sapiens
VYYPVRHHL

SEQ ID NO: 35237 - protein, 9 aa, Homo Sapiens
YFDPANGKF

SEQ ID NO: 35238 - protein, 9 aa, Homo Sapiens
YFEGIKQTF

SEQ ID NO: 35239 - protein, 9 aa, Homo Sapiens
YFIPEFNLF

SEQ ID NO: 35240 - protein, 9 aa, Homo Sapiens
YFISHILAF

SEQ ID NO: 35241 - protein, 9 aa, Homo Sapiens
YFKDTHPKF

SEQ ID NO: 35242 - protein, 9 aa, Homo Sapiens
YFKRYQVKF

SEQ ID NO: 35243 - protein, 9 aa, Homo Sapiens
YFLDKIDVI

SEQ ID NO: 35244 - protein, 9 aa, Homo Sapiens
YFLKGVLVF

SEQ ID NO: 35245 - protein, 9 aa, Homo Sapiens
YFLPDHPEL

SEQ ID NO: 35246 - protein, 9 aa, Homo Sapiens
YFLQRHELL

SEQ ID NO: 35247 - protein, 9 aa, Homo Sapiens
YFLTTRQTL

SEQ ID NO: 35248 - protein, 9 aa, Homo Sapiens
YFNPHTVTL

SEQ ID NO: 35249 - protein, 9 aa, Homo Sapiens
YFSLIPTGF

SEQ ID NO: 35250 - protein, 9 aa, Homo Sapiens
YFSPSGKKF

SEQ ID NO: 35251 - protein, 9 aa, Homo Sapiens
YFSSGKYYW

SEQ ID NO: 35252 - protein, 9 aa, Homo Sapiens
YFYHGVHKI

SEQ ID NO: 35253 - protein, 9 aa, Homo Sapiens
YLPISHPRF

SEQ ID NO: 35254 - protein, 9 aa, Homo Sapiens
YVIQKFFEF

SEQ ID NO: 35255 - protein, 9 aa, Homo Sapiens
YWMHVQNTF

SEQ ID NO: 35256 - protein, 9 aa, Homo Sapiens
YWPVIPLKF

SEQ ID NO: 35257 - protein, 9 aa, Homo Sapiens
YYDKHFTEF

SEQ ID NO: 35258 - protein, 9 aa, Homo Sapiens
YYDPHQATF

SEQ ID NO: 35259 - protein, 9 aa, Homo Sapiens
YYDPKHVIF

SEQ ID NO: 35260 - protein, 9 aa, Homo Sapiens
YYEEQHPEL

SEQ ID NO: 35261 - protein, 9 aa, Homo Sapiens
YYEKQFPEI

SEQ ID NO: 35262 - protein, 9 aa, Homo Sapiens
YYEVHKELF

SEQ ID NO: 35263 - protein, 9 aa, Homo Sapiens
YYEYNHDLF

SEQ ID NO: 35264 - protein, 9 aa, Homo Sapiens
YYFALAHTV

SEQ ID NO: 35265 - protein, 9 aa, Homo Sapiens
YYFDSYAHF

SEQ ID NO: 35266 - protein, 9 aa, Homo Sapiens
YYFVFDHAL

SEQ ID NO: 35267 - protein, 9 aa, Homo Sapiens
YYGQGFPSF

SEQ ID NO: 35268 - protein, 9 aa, Homo Sapiens
YYHARVYEF

SEQ ID NO: 35269 - protein, 9 aa, Homo Sapiens
YYIDKLEYL

SEQ ID NO: 35270 - protein, 9 aa, Homo Sapiens
YYIFIPSKF

SEQ ID NO: 35271 - protein, 9 aa, Homo Sapiens
YYIIYRNVF

SEQ ID NO: 35272 - protein, 9 aa, Homo Sapiens
YYISPRITF

SEQ ID NO: 35273 - protein, 9 aa, Homo Sapiens
YYITTRAQF

SEQ ID NO: 35274 - protein, 9 aa, Homo Sapiens
YYITTRVQF

SEQ ID NO: 35275 - protein, 9 aa, Homo Sapiens
YYLDHSILL

SEQ ID NO: 35276 - protein, 9 aa, Homo Sapiens
YYLLADYHF

SEQ ID NO: 35277 - protein, 9 aa, Homo Sapiens
YYLNDLERI

SEQ ID NO: 35278 - protein, 9 aa, Homo Sapiens
YYLSDSPLL

SEQ ID NO: 35279 - protein, 9 aa, Homo Sapiens
YYLTDNLTF

SEQ ID NO: 35280 - protein, 9 aa, Homo Sapiens
YYLTHGLYL

SEQ ID NO: 35281 - protein, 9 aa, Homo Sapiens
YYNGKWEFL

SEQ ID NO: 35282 - protein, 9 aa, Homo Sapiens
YYNKVSTVF

SEQ ID NO: 35283 - protein, 9 aa, Homo Sapiens
YYPEYKLLF

SEQ ID NO: 35284 - protein, 9 aa, Homo Sapiens
YYPNPPLVL

SEQ ID NO: 35285 - protein, 9 aa, Homo Sapiens
YYQDTPKQI

SEQ ID NO: 35286 - protein, 9 aa, Homo Sapiens
YYQGGKFQF

SEQ ID NO: 35287 - protein, 9 aa, Homo Sapiens
YYQHIVTTL

SEQ ID NO: 35288 - protein, 9 aa, Homo Sapiens
YYQNYFEKL

SEQ ID NO: 35289 - protein, 9 aa, Homo Sapiens
YYSPHGHIL

SEQ ID NO: 35290 - protein, 9 aa, Homo Sapiens
YYTDIMHTL

SEQ ID NO: 35291 - protein, 9 aa, Homo Sapiens
YYTEFPTVL

SEQ ID NO: 35292 - protein, 9 aa, Homo Sapiens
YYTKGFALL

SEQ ID NO: 35293 - protein, 9 aa, Homo Sapiens
YYTPITPHL

SEQ ID NO: 35294 - protein, 9 aa, Homo Sapiens
YYTSVTPVL

SEQ ID NO: 35295 - protein, 9 aa, Homo Sapiens
YYVDFFKTL

SEQ ID NO: 35296 - protein, 9 aa, Homo Sapiens
YYVNGTYRL

SEQ ID NO: 35297 - protein, 9 aa, Homo Sapiens
YYVRILSTI

SEQ ID NO: 35298 - protein, 9 aa, Homo Sapiens
YYVWLQHTL

SEQ ID NO: 35299 - protein, 9 aa, Homo Sapiens
YYWQTSAKW

SEQ ID NO: 35300 - protein, 10 aa, Homo Sapiens
AFFEGPPFKF

SEQ ID NO: 35301 - protein, 10 aa, Homo Sapiens
AFHYIFNVQL

SEQ ID NO: 35302 - protein, 10 aa, Homo Sapiens
AFIRVVGSEF

SEQ ID NO: 35303 - protein, 10 aa, Homo Sapiens
AFLTFPGLRL

SEQ ID NO: 35304 - protein, 10 aa, Homo Sapiens
AWAPKPYHKF

SEQ ID NO: 35305 - protein, 10 aa, Homo Sapiens
AWARPLSVSF

SEQ ID NO: 35306 - protein, 10 aa, Homo Sapiens
AYTPQTHTSF

SEQ ID NO: 35307 - protein, 10 aa, Homo Sapiens
CYKLPDNVTF

SEQ ID NO: 35308 - protein, 10 aa, Homo Sapiens
EFHESGLLRF

SEQ ID NO: 35309 - protein, 10 aa, Homo Sapiens
FFHPKPVPGF

SEQ ID NO: 35310 - protein, 10 aa, Homo Sapiens
FFKPHWDEKF

SEQ ID NO: 35311 - protein, 10 aa, Homo Sapiens
FFLGLPPLLL

SEQ ID NO: 35312 - protein, 10 aa, Homo Sapiens
FFLIGPPLLI

SEQ ID NO: 35313 - protein, 10 aa, Homo Sapiens
FFLTPPCARW

SEQ ID NO: 35314 - protein, 10 aa, Homo Sapiens
FHPEAHAITL

SEQ ID NO: 35315 - protein, 10 aa, Homo Sapiens
FYLFPNRLEW

SEQ ID NO: 35316 - protein, 10 aa, Homo Sapiens
FYNSVKPIQI

SEQ ID NO: 35317 - protein, 10 aa, Homo Sapiens
GFIMPIEVHF

SEQ ID NO: 35318 - protein, 10 aa, Homo Sapiens
GLASRKPLVL

SEQ ID NO: 35319 - protein, 10 aa, Homo Sapiens
HFGPINSVAF

SEQ ID NO: 35320 - protein, 10 aa, Homo Sapiens
HYFDPQYFEF

SEQ ID NO: 35321 - protein, 10 aa, Homo Sapiens
HYIYIENQFF

SEQ ID NO: 35322 - protein, 10 aa, Homo Sapiens
HYMPPPYASL

SEQ ID NO: 35323 - protein, 10 aa, Homo Sapiens
HYNTDGSMLF

SEQ ID NO: 35324 - protein, 10 aa, Homo Sapiens
HYQDVSCLQF

SEQ ID NO: 35325 - protein, 10 aa, Homo Sapiens
IDSTNLKTHF

SEQ ID NO: 35326 - protein, 10 aa, Homo Sapiens
IFASIAGLEF

SEQ ID NO: 35327 - protein, 10 aa, Homo Sapiens
IFASIPGLEF

SEQ ID NO: 35328 - protein, 10 aa, Homo Sapiens
IFHPTQPWVF

SEQ ID NO: 35329 - protein, 10 aa, Homo Sapiens
IFIDPGYQTF

SEQ ID NO: 35330 - protein, 10 aa, Homo Sapiens
IFIDRDPTVF

SEQ ID NO: 35331 - protein, 10 aa, Homo Sapiens
IFIIPGNPGF

SEQ ID NO: 35332 - protein, 10 aa, Homo Sapiens
IFIQNSKLYF

SEQ ID NO: 35333 - protein, 10 aa, Homo Sapiens
IFLPILRTGF

SEQ ID NO: 35334 - protein, 10 aa, Homo Sapiens
IFNPRTGQLF

SEQ ID NO: 35335 - protein, 10 aa, Homo Sapiens
IFPECPHVYF

SEQ ID NO: 35336 - protein, 10 aa, Homo Sapiens
IFSKGGLVLW

SEQ ID NO: 35337 - protein, 10 aa, Homo Sapiens
IFTDLYYLTF

SEQ ID NO: 35338 - protein, 10 aa, Homo Sapiens
ILPTLVPWYF

SEQ ID NO: 35339 - protein, 10 aa, Homo Sapiens
IRDVYTLETF

SEQ ID NO: 35340 - protein, 10 aa, Homo Sapiens
IWDTAGQERF

SEQ ID NO: 35341 - protein, 10 aa, Homo Sapiens
IYADNQVMHF

SEQ ID NO: 35342 - protein, 10 aa, Homo Sapiens
IYADYIAPLF

SEQ ID NO: 35343 - protein, 10 aa, Homo Sapiens
IYDTSTDRLL

SEQ ID NO: 35344 - protein, 10 aa, Homo Sapiens
IYFDGDFGHF

SEQ ID NO: 35345 - protein, 10 aa, Homo Sapiens
IYHHALHSRW

SEQ ID NO: 35346 - protein, 10 aa, Homo Sapiens
IYHHTGNNTF

SEQ ID NO: 35347 - protein, 10 aa, Homo Sapiens
IYHNPTANSF

SEQ ID NO: 35348 - protein, 10 aa, Homo Sapiens
IYIDASCLTW

SEQ ID NO: 35349 - protein, 10 aa, Homo Sapiens
IYISTLKTEF

SEQ ID NO: 35350 - protein, 10 aa, Homo Sapiens
IYKPVTDFFL

SEQ ID NO: 35351 - protein, 10 aa, Homo Sapiens
IYLQLDCARF

SEQ ID NO: 35352 - protein, 10 aa, Homo Sapiens
IYLTFPVAMF

SEQ ID NO: 35353 - protein, 10 aa, Homo Sapiens
IYMVHIQVTL

SEQ ID NO: 35354 - protein, 10 aa, Homo Sapiens
IYPELQIERF

SEQ ID NO: 35355 - protein, 10 aa, Homo Sapiens
IYPRTQLPTW

SEQ ID NO: 35356 - protein, 10 aa, Homo Sapiens
IYPSPTGVLI

SEQ ID NO: 35357 - protein, 10 aa, Homo Sapiens
IYRDVKPENF

SEQ ID NO: 35358 - protein, 10 aa, Homo Sapiens
KFIDPIYQVW

SEQ ID NO: 35359 - protein, 10 aa, Homo Sapiens
KFINYVKNCF

SEQ ID NO: 35360 - protein, 10 aa, Homo Sapiens
KFLDPITGTF

SEQ ID NO: 35361 - protein, 10 aa, Homo Sapiens
KFLEHTNFEF

SEQ ID NO: 35362 - protein, 10 aa, Homo Sapiens
KFMPVEGMVF

SEQ ID NO: 35363 - protein, 10 aa, Homo Sapiens
KFMTHVASQF

SEQ ID NO: 35364 - protein, 10 aa, Homo Sapiens
KFNPLNTNQF

SEQ ID NO: 35365 - protein, 10 aa, Homo Sapiens
KLPDGYEFKF

SEQ ID NO: 35366 - protein, 10 aa, Homo Sapiens
KLPNFGFVVF

SEQ ID NO: 35367 - protein, 10 aa, Homo Sapiens
KMPKVKMPKF

SEQ ID NO: 35368 - protein, 10 aa, Homo Sapiens
KWNPTAGVAF

SEQ ID NO: 35369 - protein, 10 aa, Homo Sapiens
KYIERIITRF

SEQ ID NO: 35370 - protein, 10 aa, Homo Sapiens
KYITDWQNVF

SEQ ID NO: 35371 - protein, 10 aa, Homo Sapiens
KYLEDMKTYF

SEQ ID NO: 35372 - protein, 10 aa, Homo Sapiens
KYLKPSGNMF

SEQ ID NO: 35373 - protein, 10 aa, Homo Sapiens
KYLNQTSRSF

SEQ ID NO: 35374 - protein, 10 aa, Homo Sapiens
KYLSVQGQLF

SEQ ID NO: 35375 - protein, 10 aa, Homo Sapiens
KYLTEGLLQF

SEQ ID NO: 35376 - protein, 10 aa, Homo Sapiens
KYLTQVDILL

SEQ ID NO: 35377 - protein, 10 aa, Homo Sapiens
KYLVIGDLLF

SEQ ID NO: 35378 - protein, 10 aa, Homo Sapiens
KYMDVVKERI

SEQ ID NO: 35379 - protein, 10 aa, Homo Sapiens
KYMTAVVKLF

SEQ ID NO: 35380 - protein, 10 aa, Homo Sapiens
KYSPNCKLLI

SEQ ID NO: 35381 - protein, 10 aa, Homo Sapiens
KYTEITATYF

SEQ ID NO: 35382 - protein, 10 aa, Homo Sapiens
LFIPSSKLLF

SEQ ID NO: 35383 - protein, 10 aa, Homo Sapiens
LFLPRTDYSF

SEQ ID NO: 35384 - protein, 10 aa, Homo Sapiens
LYADVGGKQF

SEQ ID NO: 35385 - protein, 10 aa, Homo Sapiens
LYIDRPLPYL

SEQ ID NO: 35386 - protein, 10 aa, Homo Sapiens
LYIYPQSLNF

SEQ ID NO: 35387 - protein, 10 aa, Homo Sapiens
LYLDKATLIW

SEQ ID NO: 35388 - protein, 10 aa, Homo Sapiens
LYLKVKGNVF

SEQ ID NO: 35389 - protein, 10 aa, Homo Sapiens
LYQPNFNTNF

SEQ ID NO: 35390 - protein, 10 aa, Homo Sapiens
LYVLGTATRW

SEQ ID NO: 35391 - protein, 10 aa, Homo Sapiens
MFLTVTRLYF

SEQ ID NO: 35392 - protein, 10 aa, Homo Sapiens
MWSPTHPALF

SEQ ID NO: 35393 - protein, 10 aa, Homo Sapiens
MYDIFPFKKL

SEQ ID NO: 35394 - protein, 10 aa, Homo Sapiens
NFFPIAGLEF

SEQ ID NO: 35395 - protein, 10 aa, Homo Sapiens
NFLELTELKF

SEQ ID NO: 35396 - protein, 10 aa, Homo Sapiens
NFLHPINTIF

SEQ ID NO: 35397 - protein, 10 aa, Homo Sapiens
NWTTAAPLLL

SEQ ID NO: 35398 - protein, 10 aa, Homo Sapiens
NYITPNPIFF

SEQ ID NO: 35399 - protein, 10 aa, Homo Sapiens
NYKDLNGNVF

SEQ ID NO: 35400 - protein, 10 aa, Homo Sapiens
NYNGHTCLHL

SEQ ID NO: 35401 - protein, 10 aa, Homo Sapiens
PDTVAPIWNL

SEQ ID NO: 35402 - protein, 10 aa, Homo Sapiens
PFIAGPYNRL

SEQ ID NO: 35403 - protein, 10 aa, Homo Sapiens
PFIPASNLFF

SEQ ID NO: 35404 - protein, 10 aa, Homo Sapiens
PYAKPIPAQF

SEQ ID NO: 35405 - protein, 10 aa, Homo Sapiens
PYNPIIGETF

SEQ ID NO: 35406 - protein, 10 aa, Homo Sapiens
PYTDVNIVTI

SEQ ID NO: 35407 - protein, 10 aa, Homo Sapiens
QFIEPFEEKF

SEQ ID NO: 35408 - protein, 10 aa, Homo Sapiens
QFTELTRLYL

SEQ ID NO: 35409 - protein, 10 aa, Homo Sapiens
QTLLCHLLIL

SEQ ID NO: 35410 - protein, 10 aa, Homo Sapiens
QYFSSGKYYW

SEQ ID NO: 35411 - protein, 10 aa, Homo Sapiens
QYLPAIRALW

SEQ ID NO: 35412 - protein, 10 aa, Homo Sapiens
QYLTFKPQTF

SEQ ID NO: 35413 - protein, 10 aa, Homo Sapiens
RFCDSSGNSF

SEQ ID NO: 35414 - protein, 10 aa, Homo Sapiens
RFGNAFLNRF

SEQ ID NO: 35415 - protein, 10 aa, Homo Sapiens
RFGPNGGLVF

SEQ ID NO: 35416 - protein, 10 aa, Homo Sapiens
RFIRPMGLRF

SEQ ID NO: 35417 - protein, 10 aa, Homo Sapiens
RFLDDLGLKF

SEQ ID NO: 35418 - protein, 10 aa, Homo Sapiens
RFLPHGQLLF

SEQ ID NO: 35419 - protein, 10 aa, Homo Sapiens
RFLVDQGYSF

SEQ ID NO: 35420 - protein, 10 aa, Homo Sapiens
RLPDTALPTL

SEQ ID NO: 35421 - protein, 10 aa, Homo Sapiens
RLPSVPFETI

SEQ ID NO: 35422 - protein, 10 aa, Homo Sapiens
RMPNSPAPHF

SEQ ID NO: 35423 - protein, 10 aa, Homo Sapiens
RWFQPAIPSW

SEQ ID NO: 35424 - protein, 10 aa, Homo Sapiens
RWFTHASPTL

SEQ ID NO: 35425 - protein, 10 aa, Homo Sapiens
RWSPVRPLVF

SEQ ID NO: 35426 - protein, 10 aa, Homo Sapiens
RYAVVLNATW

SEQ ID NO: 35427 - protein, 10 aa, Homo Sapiens
RYFDPANGKF

SEQ ID NO: 35428 - protein, 10 aa, Homo Sapiens
RYFPTQALNF

SEQ ID NO: 35429 - protein, 10 aa, Homo Sapiens
RYIDRIHIFF

SEQ ID NO: 35430 - protein, 10 aa, Homo Sapiens
RYIHPQQEAF

SEQ ID NO: 35431 - protein, 10 aa, Homo Sapiens
RYIKNPRIVL

SEQ ID NO: 35432 - protein, 10 aa, Homo Sapiens
RYKGPGFEYF

SEQ ID NO: 35433 - protein, 10 aa, Homo Sapiens
RYLHVEGGNF

SEQ ID NO: 35434 - protein, 10 aa, Homo Sapiens
RYLNSQQQYF

SEQ ID NO: 35435 - protein, 10 aa, Homo Sapiens
RYNHITATYF

SEQ ID NO: 35436 - protein, 10 aa, Homo Sapiens
RYPDTIALTF

SEQ ID NO: 35437 - protein, 10 aa, Homo Sapiens
RYPNSHTHYF

SEQ ID NO: 35438 - protein, 10 aa, Homo Sapiens
RYPPKSGNYF

SEQ ID NO: 35439 - protein, 10 aa, Homo Sapiens
RYQKSTELLI

SEQ ID NO: 35440 - protein, 10 aa, Homo Sapiens
RYTVGGLETF

SEQ ID NO: 35441 - protein, 10 aa, Homo Sapiens
RYVFQSENTF

SEQ ID NO: 35442 - protein, 10 aa, Homo Sapiens
RYYEYNHDLF

SEQ ID NO: 35443 - protein, 10 aa, Homo Sapiens
SFFKISYLTF

SEQ ID NO: 35444 - protein, 10 aa, Homo Sapiens
SFHKFHYLTF

SEQ ID NO: 35445 - protein, 10 aa, Homo Sapiens
SFIPDQHMVF

SEQ ID NO: 35446 - protein, 10 aa, Homo Sapiens
SFLVPSLLQF

SEQ ID NO: 35447 - protein, 10 aa, Homo Sapiens
SWMELPGLKF

SEQ ID NO: 35448 - protein, 10 aa, Homo Sapiens
SYIAAISARF

SEQ ID NO: 35449 - protein, 10 aa, Homo Sapiens
SYLDQVKLQF

SEQ ID NO: 35450 - protein, 10 aa, Homo Sapiens
SYLEKQVVTF

SEQ ID NO: 35451 - protein, 10 aa, Homo Sapiens
SYVNKIKTRF

SEQ ID NO: 35452 - protein, 10 aa, Homo Sapiens
TLPPPPYPHL

SEQ ID NO: 35453 - protein, 10 aa, Homo Sapiens
TYIPPLLVAF

SEQ ID NO: 35454 - protein, 10 aa, Homo Sapiens
TYMGHTGAVW

SEQ ID NO: 35455 - protein, 10 aa, Homo Sapiens
TYPQLEGFKF

SEQ ID NO: 35456 - protein, 10 aa, Homo Sapiens
TYTDVTPRQF

SEQ ID NO: 35457 - protein, 10 aa, Homo Sapiens
VFDTAIAHLF

SEQ ID NO: 35458 - protein, 10 aa, Homo Sapiens
VFFEVSPVSF

SEQ ID NO: 35459 - protein, 10 aa, Homo Sapiens
VFFKELIQEF

SEQ ID NO: 35460 - protein, 10 aa, Homo Sapiens
VFFYNPTTRL

SEQ ID NO: 35461 - protein, 10 aa, Homo Sapiens
VFHDGDSVVF

SEQ ID NO: 35462 - protein, 10 aa, Homo Sapiens
VFHKPQPFQF

SEQ ID NO: 35463 - protein, 10 aa, Homo Sapiens
VFHPSQDLVF

SEQ ID NO: 35464 - protein, 10 aa, Homo Sapiens
VFIKAPESLF

SEQ ID NO: 35465 - protein, 10 aa, Homo Sapiens
VFLPREDHLF

SEQ ID NO: 35466 - protein, 10 aa, Homo Sapiens
VFLVPTGEVF

SEQ ID NO: 35467 - protein, 10 aa, Homo Sapiens
VFMKSVKLEW

SEQ ID NO: 35468 - protein, 10 aa, Homo Sapiens
VFNTAVAPLI

SEQ ID NO: 35469 - protein, 10 aa, Homo Sapiens
VFRTPPYHKM

SEQ ID NO: 35470 - protein, 10 aa, Homo Sapiens
VFSTVVIHFL

SEQ ID NO: 35471 - protein, 10 aa, Homo Sapiens
VFTKSPYQEF

SEQ ID NO: 35472 - protein, 10 aa, Homo Sapiens
VFVSPGATYF

SEQ ID NO: 35473 - protein, 10 aa, Homo Sapiens
VFWDPSVNLF

SEQ ID NO: 35474 - protein, 10 aa, Homo Sapiens
VFWKSGNALF

SEQ ID NO: 35475 - protein, 10 aa, Homo Sapiens
VFWLPHNMDF

SEQ ID NO: 35476 - protein, 10 aa, Homo Sapiens
VHAPPMQLGF

SEQ ID NO: 35477 - protein, 10 aa, Homo Sapiens
VHMPCLGHTF

SEQ ID NO: 35478 - protein, 10 aa, Homo Sapiens
VLPQVQHPKN

SEQ ID NO: 35479 - protein, 10 aa, Homo Sapiens
VLPTLPFHVL

SEQ ID NO: 35480 - protein, 10 aa, Homo Sapiens
VWDTAGQEKF

SEQ ID NO: 35481 - protein, 10 aa, Homo Sapiens
VYAEVSRLLL

SEQ ID NO: 35482 - protein, 10 aa, Homo Sapiens
VYAHIYHQHF

SEQ ID NO: 35483 - protein, 10 aa, Homo Sapiens
VYAVIPAEKF

SEQ ID NO: 35484 - protein, 10 aa, Homo Sapiens
VYFEGSDFKF

SEQ ID NO: 35485 - protein, 10 aa, Homo Sapiens
VYIHPSSALF

SEQ ID NO: 35486 - protein, 10 aa, Homo Sapiens
VYIRGSKIRF

SEQ ID NO: 35487 - protein, 10 aa, Homo Sapiens
VYKAFVMETF

SEQ ID NO: 35488 - protein, 10 aa, Homo Sapiens
VYKDSFELKF

SEQ ID NO: 35489 - protein, 10 aa, Homo Sapiens
VYLAKLGNFF

SEQ ID NO: 35490 - protein, 10 aa, Homo Sapiens
VYLPPEAFTF

SEQ ID NO: 35491 - protein, 10 aa, Homo Sapiens
VYLTIKPLNL

SEQ ID NO: 35492 - protein, 10 aa, Homo Sapiens
VYNENLVHMI

SEQ ID NO: 35493 - protein, 10 aa, Homo Sapiens
VYNPYAALSI

SEQ ID NO: 35494 - protein, 10 aa, Homo Sapiens
VYNSWKNNKF

SEQ ID NO: 35495 - protein, 10 aa, Homo Sapiens
VYSEVAAYEF

SEQ ID NO: 35496 - protein, 10 aa, Homo Sapiens
VYTPTDTLVF

SEQ ID NO: 35497 - protein, 10 aa, Homo Sapiens
VYTPVDSLVF

SEQ ID NO: 35498 - protein, 10 aa, Homo Sapiens
VYTVVDEMFL

SEQ ID NO: 35499 - protein, 10 aa, Homo Sapiens
YDAEISQIHQ

SEQ ID NO: 35500 - protein, 10 aa, Homo Sapiens
YFFDAAKLMF

SEQ ID NO: 35501 - protein, 10 aa, Homo Sapiens
YFHDATRVYL

SEQ ID NO: 35502 - protein, 10 aa, Homo Sapiens
YFIAPTGHSL

SEQ ID NO: 35503 - protein, 10 aa, Homo Sapiens
YFIPATGHSL

SEQ ID NO: 35504 - protein, 10 aa, Homo Sapiens
YFISPQGLKF

SEQ ID NO: 35505 - protein, 10 aa, Homo Sapiens
YFISPTGHSL

SEQ ID NO: 35506 - protein, 10 aa, Homo Sapiens
YFITPTGHSL

SEQ ID NO: 35507 - protein, 10 aa, Homo Sapiens
YFRDGDLVTF

SEQ ID NO: 35508 - protein, 10 aa, Homo Sapiens
YYFEGIKQTF

SEQ ID NO: 35509 - protein, 10 aa, Homo Sapiens
YYINKISSTL

SEQ ID NO: 35510 - protein, 10 aa, Homo Sapiens
YYLTPDGQRF

SEQ ID NO: 35511 - protein, 10 aa, Homo Sapiens
YYMELTKLLL

SEQ ID NO: 35512 - protein, 10 aa, Homo Sapiens
YYMTPRDFLF

SEQ ID NO: 35513 - protein, 10 aa, Homo Sapiens
YYRYPTGESY

SEQ ID NO: 35514 - protein, 10 aa, Homo Sapiens
YYSHLEGARF

SEQ ID NO: 35515 - protein, 10 aa, Homo Sapiens
YYSPLRDLLL

SEQ ID NO: 35516 - protein, 11 aa, Homo Sapiens
AFHPTAQLLLI

SEQ ID NO: 35517 - protein, 11 aa, Homo Sapiens
AFLDKQNQVKF

SEQ ID NO: 35518 - protein, 11 aa, Homo Sapiens
AFLEINRQLLF

SEQ ID NO: 35519 - protein, 11 aa, Homo Sapiens
AFYPPHPDYTW

SEQ ID NO: 35520 - protein, 11 aa, Homo Sapiens
AYCPNDYHQLF

SEQ ID NO: 35521 - protein, 11 aa, Homo Sapiens
AYHNVTAEQLF

SEQ ID NO: 35522 - protein, 11 aa, Homo Sapiens
AYIPLNNYLVF

SEQ ID NO: 35523 - protein, 11 aa, Homo Sapiens
AYLECIERITF

SEQ ID NO: 35524 - protein, 11 aa, Homo Sapiens
AYLPKKNGLYL

SEQ ID NO: 35525 - protein, 11 aa, Homo Sapiens
AYLPVNESFGF

SEQ ID NO: 35526 - protein, 11 aa, Homo Sapiens
AYSTVPGYYSW

SEQ ID NO: 35527 - protein, 11 aa, Homo Sapiens
AYYPAQGVQQF

SEQ ID NO: 35528 - protein, 11 aa, Homo Sapiens
CWSPDGSRLLF

SEQ ID NO: 35529 - protein, 11 aa, Homo Sapiens
DFLPADIQAQF

SEQ ID NO: 35530 - protein, 11 aa, Homo Sapiens
EFLPQSAFLKW

SEQ ID NO: 35531 - protein, 11 aa, Homo Sapiens
EWSFINSNLKF

SEQ ID NO: 35532 - protein, 11 aa, Homo Sapiens
EWSPYTKIFQF

SEQ ID NO: 35533 - protein, 11 aa, Homo Sapiens
EYLHIDQRLVF

SEQ ID NO: 35534 - protein, 11 aa, Homo Sapiens
EYLPIGGLAEF

SEQ ID NO: 35535 - protein, 11 aa, Homo Sapiens
EYLTPEEMVTF

SEQ ID NO: 35536 - protein, 11 aa, Homo Sapiens
FWATPGFFNKF

SEQ ID NO: 35537 - protein, 11 aa, Homo Sapiens
FYLNQSTAYHF

SEQ ID NO: 35538 - protein, 11 aa, Homo Sapiens
FYLPLDAIKQL

SEQ ID NO: 35539 - protein, 11 aa, Homo Sapiens
FYVPAEPKLAF

SEQ ID NO: 35540 - protein, 11 aa, Homo Sapiens
GFIDKNRDFLF

SEQ ID NO: 35541 - protein, 11 aa, Homo Sapiens
GFPSSVAALRF

SEQ ID NO: 35542 - protein, 11 aa, Homo Sapiens
HFHPSNPEHLF

SEQ ID NO: 35543 - protein, 11 aa, Homo Sapiens
HLDIDHNKKID

SEQ ID NO: 35544 - protein, 11 aa, Homo Sapiens
HYFQNTQGLIF

SEQ ID NO: 35545 - protein, 11 aa, Homo Sapiens
IFINQPQLTKF

SEQ ID NO: 35546 - protein, 11 aa, Homo Sapiens
IFIQNSKLYFF

SEQ ID NO: 35547 - protein, 11 aa, Homo Sapiens
IFKPPDPDNTF

SEQ ID NO: 35548 - protein, 11 aa, Homo Sapiens
IFLDPHTTQTF

SEQ ID NO: 35549 - protein, 11 aa, Homo Sapiens
IFLDQKCQNIL

SEQ ID NO: 35550 - protein, 11 aa, Homo Sapiens
IFSPTSNLLLL

SEQ ID NO: 35551 - protein, 11 aa, Homo Sapiens
IFSPYNEVLSF

SEQ ID NO: 35552 - protein, 11 aa, Homo Sapiens
IFSTITSKMNL

SEQ ID NO: 35553 - protein, 11 aa, Homo Sapiens
ILKVARQSLTM

SEQ ID NO: 35554 - protein, 11 aa, Homo Sapiens
ITQIEHEVSSS

SEQ ID NO: 35555 - protein, 11 aa, Homo Sapiens
IYDPNLAFLRF

SEQ ID NO: 35556 - protein, 11 aa, Homo Sapiens
IYDTSTDRLLW

SEQ ID NO: 35557 - protein, 11 aa, Homo Sapiens
IYFPKKEAVTF

SEQ ID NO: 35558 - protein, 11 aa, Homo Sapiens
IYLAPGDYHCF

SEQ ID NO: 35559 - protein, 11 aa, Homo Sapiens
IYMDPHYCQSF

SEQ ID NO: 35560 - protein, 11 aa, Homo Sapiens
IYPSDSFRQSL

SEQ ID NO: 35561 - protein, 11 aa, Homo Sapiens
IYRGPFADENF

SEQ ID NO: 35562 - protein, 11 aa, Homo Sapiens
IYTVKVEDLTF

SEQ ID NO: 35563 - protein, 11 aa, Homo Sapiens
IYVNPANTHQF

SEQ ID NO: 35564 - protein, 11 aa, Homo Sapiens
KFIHKPGSYIF

SEQ ID NO: 35565 - protein, 11 aa, Homo Sapiens
KFSPNTSQFLL

SEQ ID NO: 35566 - protein, 11 aa, Homo Sapiens
KFYPPKVELFF

SEQ ID NO: 35567 - protein, 11 aa, Homo Sapiens
KLPDVYGVFQF

SEQ ID NO: 35568 - protein, 11 aa, Homo Sapiens
KWLEPLKNLRF

SEQ ID NO: 35569 - protein, 11 aa, Homo Sapiens
KYIDKTIRVKF

SEQ ID NO: 35570 - protein, 11 aa, Homo Sapiens
KYISKPENLKL

SEQ ID NO: 35571 - protein, 11 aa, Homo Sapiens
KYITQGQLLQF

SEQ ID NO: 35572 - protein, 11 aa, Homo Sapiens
KYKNSEINFSF

SEQ ID NO: 35573 - protein, 11 aa, Homo Sapiens
KYMPNVKVAVF

SEQ ID NO: 35574 - protein, 11 aa, Homo Sapiens
KYQEVTNNLEF

SEQ ID NO: 35575 - protein, 11 aa, Homo Sapiens
LFIDQPQFLKF

SEQ ID NO: 35576 - protein, 11 aa, Homo Sapiens
LFIPSSKLLFL

SEQ ID NO: 35577 - protein, 11 aa, Homo Sapiens
LFVRAQELHTF

SEQ ID NO: 35578 - protein, 11 aa, Homo Sapiens
LGPEIFFHPEF

SEQ ID NO: 35579 - protein, 11 aa, Homo Sapiens
LLLKLLDFQNR

SEQ ID NO: 35580 - protein, 11 aa, Homo Sapiens
LPISTPHPIGF

SEQ ID NO: 35581 - protein, 11 aa, Homo Sapiens
LYISEAEGLKF

SEQ ID NO: 35582 - protein, 11 aa, Homo Sapiens
MWSPTHPALFA

SEQ ID NO: 35583 - protein, 11 aa, Homo Sapiens
NFISGAGILRL

SEQ ID NO: 35584 - protein, 11 aa, Homo Sapiens
NYFFDAAKLMF

SEQ ID NO: 35585 - protein, 11 aa, Homo Sapiens
NYIPVKNGKQF

SEQ ID NO: 35586 - protein, 11 aa, Homo Sapiens
NYLDPRISIAW

SEQ ID NO: 35587 - protein, 11 aa, Homo Sapiens
NYLPAINGIVF

SEQ ID NO: 35588 - protein, 11 aa, Homo Sapiens
NYSGAAEYLYF

SEQ ID NO: 35589 - protein, 11 aa, Homo Sapiens
NYSPVSRIGLF

SEQ ID NO: 35590 - protein, 11 aa, Homo Sapiens
NYSTVPQKQTL

SEQ ID NO: 35591 - protein, 11 aa, Homo Sapiens
PFFNPIQTQVF

SEQ ID NO: 35592 - protein, 11 aa, Homo Sapiens
PFIKSQHELLF

SEQ ID NO: 35593 - protein, 11 aa, Homo Sapiens
PWKSLASIVQF

SEQ ID NO: 35594 - protein, 11 aa, Homo Sapiens
PYQATIDGVRF

SEQ ID NO: 35595 - protein, 11 aa, Homo Sapiens
QLPQPDVFPLF

SEQ ID NO: 35596 - protein, 11 aa, Homo Sapiens
QWPQPDKPMFF

SEQ ID NO: 35597 - protein, 11 aa, Homo Sapiens
QYPVYWDHLEF

SEQ ID NO: 35598 - protein, 11 aa, Homo Sapiens
RFIAPAASLGF

SEQ ID NO: 35599 - protein, 11 aa, Homo Sapiens
RFIHNSHDLTY

SEQ ID NO: 35600 - protein, 11 aa, Homo Sapiens
RFLNDPGHLLW

SEQ ID NO: 35601 - protein, 11 aa, Homo Sapiens
RFLNSSNDHRF

SEQ ID NO: 35602 - protein, 11 aa, Homo Sapiens
RFLQDPYSTTF

SEQ ID NO: 35603 - protein, 11 aa, Homo Sapiens
RFNEYSKVLQF

SEQ ID NO: 35604 - protein, 11 aa, Homo Sapiens
RFRPVPLGQTF

SEQ ID NO: 35605 - protein, 11 aa, Homo Sapiens
RFVPLPASAKW

SEQ ID NO: 35606 - protein, 11 aa, Homo Sapiens
RFVTGNKILRI

SEQ ID NO: 35607 - protein, 11 aa, Homo Sapiens
RYISDQLFTNF

SEQ ID NO: 35608 - protein, 11 aa, Homo Sapiens
RYLDSLKAIVF

SEQ ID NO: 35609 - protein, 11 aa, Homo Sapiens
RYLDVSILGKF

SEQ ID NO: 35610 - protein, 11 aa, Homo Sapiens
RYLPKGFLNQF

SEQ ID NO: 35611 - protein, 11 aa, Homo Sapiens
RYLPTGSFPFL

SEQ ID NO: 35612 - protein, 11 aa, Homo Sapiens
RYLSPKYIKMF

SEQ ID NO: 35613 - protein, 11 aa, Homo Sapiens
RYPDNLKHLYL

SEQ ID NO: 35614 - protein, 11 aa, Homo Sapiens
RYPTSIASLAF

SEQ ID NO: 35615 - protein, 11 aa, Homo Sapiens
RYSGVNQSMLF

SEQ ID NO: 35616 - protein, 11 aa, Homo Sapiens
RYTPEQDTMTF

SEQ ID NO: 35617 - protein, 11 aa, Homo Sapiens
RYTSPVNPAVF

SEQ ID NO: 35618 - protein, 11 aa, Homo Sapiens
RYVEQKAGITF

SEQ ID NO: 35619 - protein, 11 aa, Homo Sapiens
SFCSKPEILEW

SEQ ID NO: 35620 - protein, 11 aa, Homo Sapiens
SFHAASESLKF

SEQ ID NO: 35621 - protein, 11 aa, Homo Sapiens
SFIPSSVPATF

SEQ ID NO: 35622 - protein, 11 aa, Homo Sapiens
SFLHGNASLLF

SEQ ID NO: 35623 - protein, 11 aa, Homo Sapiens
SFMPNSPRFLL

SEQ ID NO: 35624 - protein, 11 aa, Homo Sapiens
SIIAEVKAQYE

SEQ ID NO: 35625 - protein, 11 aa, Homo Sapiens
SYISDGKEYLF

SEQ ID NO: 35626 - protein, 11 aa, Homo Sapiens
SYLAVIEGAKF

SEQ ID NO: 35627 - protein, 11 aa, Homo Sapiens
SYLDMSKVIIF

SEQ ID NO: 35628 - protein, 11 aa, Homo Sapiens
SYLSHSEQLVF

SEQ ID NO: 35629 - protein, 11 aa, Homo Sapiens
SYMEVPTYLNF

SEQ ID NO: 35630 - protein, 11 aa, Homo Sapiens
SYYGPLNLLTF

SEQ ID NO: 35631 - protein, 11 aa, Homo Sapiens
TFCDSQLRLLF

SEQ ID NO: 35632 - protein, 11 aa, Homo Sapiens
TFIRHIALLGF

SEQ ID NO: 35633 - protein, 11 aa, Homo Sapiens
TFLFPIQAKTF

SEQ ID NO: 35634 - protein, 11 aa, Homo Sapiens
TFPNIASATKF

SEQ ID NO: 35635 - protein, 11 aa, Homo Sapiens
TFTAAAVGAVF

SEQ ID NO: 35636 - protein, 11 aa, Homo Sapiens
TLPSRVFHPAF

SEQ ID NO: 35637 - protein, 11 aa, Homo Sapiens
TMSGVTTCLRF

SEQ ID NO: 35638 - protein, 11 aa, Homo Sapiens
TWFTAGAKLLF

SEQ ID NO: 35639 - protein, 11 aa, Homo Sapiens
TWLVNSAAHLF

SEQ ID NO: 35640 - protein, 11 aa, Homo Sapiens
TYHEVVDEIYF

SEQ ID NO: 35641 - protein, 11 aa, Homo Sapiens
TYIHALDNGLF

SEQ ID NO: 35642 - protein, 11 aa, Homo Sapiens
TYLPAGQSVLL

SEQ ID NO: 35643 - protein, 11 aa, Homo Sapiens
TYLPREILNLI

SEQ ID NO: 35644 - protein, 11 aa, Homo Sapiens
TYSSGHNRLYF

SEQ ID NO: 35645 - protein, 11 aa, Homo Sapiens
TYTDVTPRQFF

SEQ ID NO: 35646 - protein, 11 aa, Homo Sapiens
VFFDEANKQVF

SEQ ID NO: 35647 - protein, 11 aa, Homo Sapiens
VFHAHSSVLNF

SEQ ID NO: 35648 - protein, 11 aa, Homo Sapiens
VFKEINTQILF

SEQ ID NO: 35649 - protein, 11 aa, Homo Sapiens
VFMKPGLPTTF

SEQ ID NO: 35650 - protein, 11 aa, Homo Sapiens
VFMPQHIMAIL

SEQ ID NO: 35651 - protein, 11 aa, Homo Sapiens
VFPSMPIKLQL

SEQ ID NO: 35652 - protein, 11 aa, Homo Sapiens
VFQPSPLASQF

SEQ ID NO: 35653 - protein, 11 aa, Homo Sapiens
VFSGFGPIMRF

SEQ ID NO: 35654 - protein, 11 aa, Homo Sapiens
VISKEAQLLVF

SEQ ID NO: 35655 - protein, 11 aa, Homo Sapiens
VLPDADTLLHF

SEQ ID NO: 35656 - protein, 11 aa, Homo Sapiens
VLPNSDFLVHF

SEQ ID NO: 35657 - protein, 11 aa, Homo Sapiens
VVPSGGFFPTI

SEQ ID NO: 35658 - protein, 11 aa, Homo Sapiens
VYAPPVGGFSF

SEQ ID NO: 35659 - protein, 11 aa, Homo Sapiens
VYISSSAGARW

SEQ ID NO: 35660 - protein, 11 aa, Homo Sapiens
VYITGKEVFSF

SEQ ID NO: 35661 - protein, 11 aa, Homo Sapiens
VYLDPLVFREF

SEQ ID NO: 35662 - protein, 11 aa, Homo Sapiens
VYNTVSEGTHF

SEQ ID NO: 35663 - protein, 11 aa, Homo Sapiens
VYPASKMFPFI

SEQ ID NO: 35664 - protein, 11 aa, Homo Sapiens
VYQAGSGQLMF

SEQ ID NO: 35665 - protein, 11 aa, Homo Sapiens
VYQEPIPTAQL

SEQ ID NO: 35666 - protein, 11 aa, Homo Sapiens
VYQSLANLIRW

SEQ ID NO: 35667 - protein, 11 aa, Homo Sapiens
VYRNKDALSHF

SEQ ID NO: 35668 - protein, 11 aa, Homo Sapiens
VYSEAARVLQF

SEQ ID NO: 35669 - protein, 11 aa, Homo Sapiens
VYSQIPAAVKL

SEQ ID NO: 35670 - protein, 11 aa, Homo Sapiens
VYTPVASRQSL

SEQ ID NO: 35671 - protein, 11 aa, Homo Sapiens
VYVDLGGSHVF

SEQ ID NO: 35672 - protein, 11 aa, Homo Sapiens
VYVIEPHSMEF

SEQ ID NO: 35673 - protein, 11 aa, Homo Sapiens
YFILNSSCLRL

SEQ ID NO: 35674 - protein, 11 aa, Homo Sapiens
YFVSKAKTRVF

SEQ ID NO: 35675 - protein, 11 aa, Homo Sapiens
YYHPPNLLELF

SEQ ID NO: 35676 - protein, 11 aa, Homo Sapiens
YYIDADLLREI

SEQ ID NO: 35677 - protein, 11 aa, Homo Sapiens
YYIKYNTIETF

SEQ ID NO: 35678 - protein, 11 aa, Homo Sapiens
YYLHQNNIVHL

SEQ ID NO: 35679 - protein, 11 aa, Homo Sapiens
YYLRPVSQQEF

SEQ ID NO: 35680 - protein, 11 aa, Homo Sapiens
YYSPHGHILVL

SEQ ID NO: 35681 - protein, 11 aa, Homo Sapiens
YYSQESKVLYL

SEQ ID NO: 35682 - protein, 8 aa, Homo Sapiens
DLLLNCSL

SEQ ID NO: 35683 - protein, 8 aa, Homo Sapiens
DPDVLNSL

SEQ ID NO: 35684 - protein, 8 aa, Homo Sapiens
EVGRITKW

SEQ ID NO: 35685 - protein, 8 aa, Homo Sapiens
FEVDTVAP

SEQ ID NO: 35686 - protein, 8 aa, Homo Sapiens
FNEKSKEL

SEQ ID NO: 35687 - protein, 8 aa, Homo Sapiens
FSGVYKKL

SEQ ID NO: 35688 - protein, 8 aa, Homo Sapiens
IDVITKTW

SEQ ID NO: 35689 - protein, 8 aa, Homo Sapiens
IEEHLGKF

SEQ ID NO: 35690 - protein, 8 aa, Homo Sapiens
IEKLLTSY

SEQ ID NO: 35691 - protein, 8 aa, Homo Sapiens
INSDPVDL

SEQ ID NO: 35692 - protein, 8 aa, Homo Sapiens
PDEVIKKW

SEQ ID NO: 35693 - protein, 8 aa, Homo Sapiens
PINGNGKQ

SEQ ID NO: 35694 - protein, 8 aa, Homo Sapiens
YDCKVEHW

SEQ ID NO: 35695 - protein, 8 aa, Homo Sapiens
YDCRVEHW

SEQ ID NO: 35696 - protein, 9 aa, Homo Sapiens
AIIERTASF

SEQ ID NO: 35697 - protein, 9 aa, Homo Sapiens
ATAQRVAAW

SEQ ID NO: 35698 - protein, 9 aa, Homo Sapiens
AVAEEYLSF

SEQ ID NO: 35699 - protein, 9 aa, Homo Sapiens
AVAGAISSF

SEQ ID NO: 35700 - protein, 9 aa, Homo Sapiens
AVIAIFKSY

SEQ ID NO: 35701 - protein, 9 aa, Homo Sapiens
AVISSVAHY

SEQ ID NO: 35702 - protein, 9 aa, Homo Sapiens
AVKEKISKF

SEQ ID NO: 35703 - protein, 9 aa, Homo Sapiens
AVKERIAKF

SEQ ID NO: 35704 - protein, 9 aa, Homo Sapiens
AVKNQIALW

SEQ ID NO: 35705 - protein, 9 aa, Homo Sapiens
AVLDSASLY

SEQ ID NO: 35706 - protein, 9 aa, Homo Sapiens
AVVGQYQSY

SEQ ID NO: 35707 - protein, 9 aa, Homo Sapiens
AVYGGGSMW

SEQ ID NO: 35708 - protein, 9 aa, Homo Sapiens
CVISKVLTF

SEQ ID NO: 35709 - protein, 9 aa, Homo Sapiens
DAAAGMLSF

SEQ ID NO: 35710 - protein, 9 aa, Homo Sapiens
DAAQHTRTW

SEQ ID NO: 35711 - protein, 9 aa, Homo Sapiens
DAIGPREQW

SEQ ID NO: 35712 - protein, 9 aa, Homo Sapiens
DAISAGKNW

SEQ ID NO: 35713 - protein, 9 aa, Homo Sapiens
DAVGRVQGW

SEQ ID NO: 35714 - protein, 9 aa, Homo Sapiens
DIADNFEAF

SEQ ID NO: 35715 - protein, 9 aa, Homo Sapiens
DIHEVRIGW

SEQ ID NO: 35716 - protein, 9 aa, Homo Sapiens
DIIDDVDSF

SEQ ID NO: 35717 - protein, 9 aa, Homo Sapiens
DIIDDVESF

SEQ ID NO: 35718 - protein, 9 aa, Homo Sapiens
DIISRIPKI

SEQ ID NO: 35719 - protein, 9 aa, Homo Sapiens
DIITDVATF

SEQ ID NO: 35720 - protein, 9 aa, Homo Sapiens
DIKLRVSEW

SEQ ID NO: 35721 - protein, 9 aa, Homo Sapiens
DIKPNFPSW

SEQ ID NO: 35722 - protein, 9 aa, Homo Sapiens
DIPTDFEGW

SEQ ID NO: 35723 - protein, 9 aa, Homo Sapiens
DIVPPASTW

SEQ ID NO: 35724 - protein, 9 aa, Homo Sapiens
DLCQRVPTW

SEQ ID NO: 35725 - protein, 9 aa, Homo Sapiens
DLCTRVPTW

SEQ ID NO: 35726 - protein, 9 aa, Homo Sapiens
DLIEHFSQF

SEQ ID NO: 35727 - protein, 9 aa, Homo Sapiens
DLIEKLLNY

SEQ ID NO: 35728 - protein, 9 aa, Homo Sapiens
DLIGHIVEF

SEQ ID NO: 35729 - protein, 9 aa, Homo Sapiens
DLIKETKLS

SEQ ID NO: 35730 - protein, 9 aa, Homo Sapiens
DLPQSIGMW

SEQ ID NO: 35731 - protein, 9 aa, Homo Sapiens
DMAFRYLSW

SEQ ID NO: 35732 - protein, 9 aa, Homo Sapiens
DPVDIYKSW

SEQ ID NO: 35733 - protein, 9 aa, Homo Sapiens
DQIPQQTAW

SEQ ID NO: 35734 - protein, 9 aa, Homo Sapiens
DQKADVSAW

SEQ ID NO: 35735 - protein, 9 aa, Homo Sapiens
DSHGGSLEW

SEQ ID NO: 35736 - protein, 9 aa, Homo Sapiens
DSKSKGLQW

SEQ ID NO: 35737 - protein, 9 aa, Homo Sapiens
DSLPSVSSI

SEQ ID NO: 35738 - protein, 9 aa, Homo Sapiens
DSSPVSTPF

SEQ ID NO: 35739 - protein, 9 aa, Homo Sapiens
DTAHIFCQW

SEQ ID NO: 35740 - protein, 9 aa, Homo Sapiens
DTCVHLNQW

SEQ ID NO: 35741 - protein, 9 aa, Homo Sapiens
DTFNHLTTW

SEQ ID NO: 35742 - protein, 9 aa, Homo Sapiens
DTHKATLVW

SEQ ID NO: 35743 - protein, 9 aa, Homo Sapiens
DTIARLPCL

SEQ ID NO: 35744 - protein, 9 aa, Homo Sapiens
DTIRMIDAY

SEQ ID NO: 35745 - protein, 9 aa, Homo Sapiens
DTISINHNW

SEQ ID NO: 35746 - protein, 9 aa, Homo Sapiens
DTISPTLGF

SEQ ID NO: 35747 - protein, 9 aa, Homo Sapiens
DTKQMMSSF

SEQ ID NO: 35748 - protein, 9 aa, Homo Sapiens
DTMDHYRTF

SEQ ID NO: 35749 - protein, 9 aa, Homo Sapiens
DTMEFIRSF

SEQ ID NO: 35750 - protein, 9 aa, Homo Sapiens
DTPEEIARW

SEQ ID NO: 35751 - protein, 9 aa, Homo Sapiens
DTPGHGSGW

SEQ ID NO: 35752 - protein, 9 aa, Homo Sapiens
DTPGHTLSW

SEQ ID NO: 35753 - protein, 9 aa, Homo Sapiens
DTQKEGTAW

SEQ ID NO: 35754 - protein, 9 aa, Homo Sapiens
DTRDYICEF

SEQ ID NO: 35755 - protein, 9 aa, Homo Sapiens
DTSDIVHIW

SEQ ID NO: 35756 - protein, 9 aa, Homo Sapiens
DTSGPRKEW

SEQ ID NO: 35757 - protein, 9 aa, Homo Sapiens
DTTSFDSAW

SEQ ID NO: 35758 - protein, 9 aa, Homo Sapiens
DTVKKIESF

SEQ ID NO: 35759 - protein, 9 aa, Homo Sapiens
DTVPSVSSI

SEQ ID NO: 35760 - protein, 9 aa, Homo Sapiens
DVAEPYKVY

SEQ ID NO: 35761 - protein, 9 aa, Homo Sapiens
DVANKIGII

SEQ ID NO: 35762 - protein, 9 aa, Homo Sapiens
DVAPTQPRW

SEQ ID NO: 35763 - protein, 9 aa, Homo Sapiens
DVAPTRPRW

SEQ ID NO: 35764 - protein, 9 aa, Homo Sapiens
DVIADIQTI

SEQ ID NO: 35765 - protein, 9 aa, Homo Sapiens
DVIDNIMRL

SEQ ID NO: 35766 - protein, 9 aa, Homo Sapiens
DVIERVIQY

SEQ ID NO: 35767 - protein, 9 aa, Homo Sapiens
DVIESVNLL

SEQ ID NO: 35768 - protein, 9 aa, Homo Sapiens
DVIGCFADF

SEQ ID NO: 35769 - protein, 9 aa, Homo Sapiens
DVIGCFANF

SEQ ID NO: 35770 - protein, 9 aa, Homo Sapiens
DVIGTLSGF

SEQ ID NO: 35771 - protein, 9 aa, Homo Sapiens
DVIKAVSTI

SEQ ID NO: 35772 - protein, 9 aa, Homo Sapiens
DVIRLIMQY

SEQ ID NO: 35773 - protein, 9 aa, Homo Sapiens
DVISNIETF

SEQ ID NO: 35774 - protein, 9 aa, Homo Sapiens
DVISSIRNF

SEQ ID NO: 35775 - protein, 9 aa, Homo Sapiens
DVISSIRQL

SEQ ID NO: 35776 - protein, 9 aa, Homo Sapiens
DVKDYIQEY

SEQ ID NO: 35777 - protein, 9 aa, Homo Sapiens
DVKKRILEF

SEQ ID NO: 35778 - protein, 9 aa, Homo Sapiens
DVKPFVPRF

SEQ ID NO: 35779 - protein, 9 aa, Homo Sapiens
DVKSEIYSF

SEQ ID NO: 35780 - protein, 9 aa, Homo Sapiens
DVMKRSESW

SEQ ID NO: 35781 - protein, 9 aa, Homo Sapiens
DVNGKIIVW

SEQ ID NO: 35782 - protein, 9 aa, Homo Sapiens
DVPEKSSLF

SEQ ID NO: 35783 - protein, 9 aa, Homo Sapiens
DVRERLQAW

SEQ ID NO: 35784 - protein, 9 aa, Homo Sapiens
DVRVSQTTW

SEQ ID NO: 35785 - protein, 9 aa, Homo Sapiens
DVSPVVSTY

SEQ ID NO: 35786 - protein, 9 aa, Homo Sapiens
DVTAQFESY

SEQ ID NO: 35787 - protein, 9 aa, Homo Sapiens
DVTDFISHL

SEQ ID NO: 35788 - protein, 9 aa, Homo Sapiens
DVTEQISRF

SEQ ID NO: 35789 - protein, 9 aa, Homo Sapiens
DVTGPHEAF

SEQ ID NO: 35790 - protein, 9 aa, Homo Sapiens
DVTGVVRQW

SEQ ID NO: 35791 - protein, 9 aa, Homo Sapiens
DVTVKMSTY

SEQ ID NO: 35792 - protein, 9 aa, Homo Sapiens
DVVDKTPVI

SEQ ID NO: 35793 - protein, 9 aa, Homo Sapiens
DVVGGLMAW

SEQ ID NO: 35794 - protein, 9 aa, Homo Sapiens
DVVKKIESF

SEQ ID NO: 35795 - protein, 9 aa, Homo Sapiens
DVVKTYKSF

SEQ ID NO: 35796 - protein, 9 aa, Homo Sapiens
DVVPAVRKW

SEQ ID NO: 35797 - protein, 9 aa, Homo Sapiens
DVVTKYSNF

SEQ ID NO: 35798 - protein, 9 aa, Homo Sapiens
EAAGPHEAF

SEQ ID NO: 35799 - protein, 9 aa, Homo Sapiens
EAAGPRVSW

SEQ ID NO: 35800 - protein, 9 aa, Homo Sapiens
EAARPSGSW

SEQ ID NO: 35801 - protein, 9 aa, Homo Sapiens
EAATRLSAY

SEQ ID NO: 35802 - protein, 9 aa, Homo Sapiens
EAAYRVLHW

SEQ ID NO: 35803 - protein, 9 aa, Homo Sapiens
EAIEQILKY

SEQ ID NO: 35804 - protein, 9 aa, Homo Sapiens
EAIGAVIHY

SEQ ID NO: 35805 - protein, 9 aa, Homo Sapiens
EAIQDLWQW

SEQ ID NO: 35806 - protein, 9 aa, Homo Sapiens
EAISYYSKY

SEQ ID NO: 35807 - protein, 9 aa, Homo Sapiens
EAIYETHTW

SEQ ID NO: 35808 - protein, 9 aa, Homo Sapiens
EAKPHMESY

SEQ ID NO: 35809 - protein, 9 aa, Homo Sapiens
EALERSSSW

SEQ ID NO: 35810 - protein, 9 aa, Homo Sapiens
EANDRNETW

SEQ ID NO: 35811 - protein, 9 aa, Homo Sapiens
EARKKINSW

SEQ ID NO: 35812 - protein, 9 aa, Homo Sapiens
EAVKQYSSY

SEQ ID NO: 35813 - protein, 9 aa, Homo Sapiens
EAVQAISMF

SEQ ID NO: 35814 - protein, 9 aa, Homo Sapiens
EIAEKMATF

SEQ ID NO: 35815 - protein, 9 aa, Homo Sapiens
EIAGHIMEF

SEQ ID NO: 35816 - protein, 9 aa, Homo Sapiens
EIFFHYSEF

SEQ ID NO: 35817 - protein, 9 aa, Homo Sapiens
EIHIQIGQF

SEQ ID NO: 35818 - protein, 9 aa, Homo Sapiens
EIIDRMPVI

SEQ ID NO: 35819 - protein, 9 aa, Homo Sapiens
EIIGPYASW

SEQ ID NO: 35820 - protein, 9 aa, Homo Sapiens
EIIHEIAVL

SEQ ID NO: 35821 - protein, 9 aa, Homo Sapiens
EIIKHMAKL

SEQ ID NO: 35822 - protein, 9 aa, Homo Sapiens
EIIKIIGKY

SEQ ID NO: 35823 - protein, 9 aa, Homo Sapiens
EIIKLYSCI

SEQ ID NO: 35824 - protein, 9 aa, Homo Sapiens
EIIKNTDSW

SEQ ID NO: 35825 - protein, 9 aa, Homo Sapiens
EIIPMFSNL

SEQ ID NO: 35826 - protein, 9 aa, Homo Sapiens
EIITDFSGI

SEQ ID NO: 35827 - protein, 9 aa, Homo Sapiens
EIITPYRSF

SEQ ID NO: 35828 - protein, 9 aa, Homo Sapiens
EIKEVILEF

SEQ ID NO: 35829 - protein, 9 aa, Homo Sapiens
EIKQKIDSY

SEQ ID NO: 35830 - protein, 9 aa, Homo Sapiens
EIMTRIQTY

SEQ ID NO: 35831 - protein, 9 aa, Homo Sapiens
EIPEQFLSY

SEQ ID NO: 35832 - protein, 9 aa, Homo Sapiens
EIPGKFMGY

SEQ ID NO: 35833 - protein, 9 aa, Homo Sapiens
EIRQQIPVF

SEQ ID NO: 35834 - protein, 9 aa, Homo Sapiens
EIRRFIKSY

SEQ ID NO: 35835 - protein, 9 aa, Homo Sapiens
EISERIVQW

SEQ ID NO: 35836 - protein, 9 aa, Homo Sapiens
EITPRIRVW

SEQ ID NO: 35837 - protein, 9 aa, Homo Sapiens
EIVGTLLGF

SEQ ID NO: 35838 - protein, 9 aa, Homo Sapiens
EIVKEVSTY

SEQ ID NO: 35839 - protein, 9 aa, Homo Sapiens
EIVKKYTQF

SEQ ID NO: 35840 - protein, 9 aa, Homo Sapiens
EIVKQITSI

SEQ ID NO: 35841 - protein, 9 aa, Homo Sapiens
EIVTTIPTI

SEQ ID NO: 35842 - protein, 9 aa, Homo Sapiens
EIVWSIKSF

SEQ ID NO: 35843 - protein, 9 aa, Homo Sapiens
EIYEESSTW

SEQ ID NO: 35844 - protein, 9 aa, Homo Sapiens
ELAENILKW

SEQ ID NO: 35845 - protein, 9 aa, Homo Sapiens
ELAKQITSY

SEQ ID NO: 35846 - protein, 9 aa, Homo Sapiens
ELFEGVQKW

SEQ ID NO: 35847 - protein, 9 aa, Homo Sapiens
ELIAKIPNF

SEQ ID NO: 35848 - protein, 9 aa, Homo Sapiens
ELIERIPEL

SEQ ID NO: 35849 - protein, 9 aa, Homo Sapiens
ELIPEYLNF

SEQ ID NO: 35850 - protein, 9 aa, Homo Sapiens
ELIREYLEF

SEQ ID NO: 35851 - protein, 9 aa, Homo Sapiens
ELIRKIEAY

SEQ ID NO: 35852 - protein, 9 aa, Homo Sapiens
ELIRTIMGW

SEQ ID NO: 35853 - protein, 9 aa, Homo Sapiens
ELIRYISEL

SEQ ID NO: 35854 - protein, 9 aa, Homo Sapiens
ELKDFFQSY

SEQ ID NO: 35855 - protein, 9 aa, Homo Sapiens
ELKDTYARW

SEQ ID NO: 35856 - protein, 9 aa, Homo Sapiens
ELKEFFMSF

SEQ ID NO: 35857 - protein, 9 aa, Homo Sapiens
ELKEKIQRW

SEQ ID NO: 35858 - protein, 9 aa, Homo Sapiens
ELKERIREY

SEQ ID NO: 35859 - protein, 9 aa, Homo Sapiens
ELPQSVLKW

SEQ ID NO: 35860 - protein, 9 aa, Homo Sapiens
ELQEKMVSF

SEQ ID NO: 35861 - protein, 9 aa, Homo Sapiens
ELRPGLIGW

SEQ ID NO: 35862 - protein, 9 aa, Homo Sapiens
ELSSQMSSF

SEQ ID NO: 35863 - protein, 9 aa, Homo Sapiens
ELTEEINKW

SEQ ID NO: 35864 - protein, 9 aa, Homo Sapiens
ELVKKIAIY

SEQ ID NO: 35865 - protein, 9 aa, Homo Sapiens
ELVKRILNF

SEQ ID NO: 35866 - protein, 9 aa, Homo Sapiens
EMMKSYVAW

SEQ ID NO: 35867 - protein, 9 aa, Homo Sapiens
EPVERVSTW

SEQ ID NO: 35868 - protein, 9 aa, Homo Sapiens
EQIDKSGSW

SEQ ID NO: 35869 - protein, 9 aa, Homo Sapiens
EQTPIHISW

SEQ ID NO: 35870 - protein, 9 aa, Homo Sapiens
EQVEERLSF

SEQ ID NO: 35871 - protein, 9 aa, Homo Sapiens
ESAPVHNSF

SEQ ID NO: 35872 - protein, 9 aa, Homo Sapiens
ESIAWFTVF

SEQ ID NO: 35873 - protein, 9 aa, Homo Sapiens
ESIDKIARW

SEQ ID NO: 35874 - protein, 9 aa, Homo Sapiens
ESIEYVQTF

SEQ ID NO: 35875 - protein, 9 aa, Homo Sapiens
ESIQGLSSW

SEQ ID NO: 35876 - protein, 9 aa, Homo Sapiens
ETAAGVGRF

SEQ ID NO: 35877 - protein, 9 aa, Homo Sapiens
ETAFGYKGL

SEQ ID NO: 35878 - protein, 9 aa, Homo Sapiens
ETAFKFKAL

SEQ ID NO: 35879 - protein, 9 aa, Homo Sapiens
ETAGAIMAF

SEQ ID NO: 35880 - protein, 9 aa, Homo Sapiens
ETAGRYITY

SEQ ID NO: 35881 - protein, 9 aa, Homo Sapiens
ETAHEAEQW

SEQ ID NO: 35882 - protein, 9 aa, Homo Sapiens
ETALGIGGF

SEQ ID NO: 35883 - protein, 9 aa, Homo Sapiens
ETFDDLPKW

SEQ ID NO: 35884 - protein, 9 aa, Homo Sapiens
ETFHHSSNW

SEQ ID NO: 35885 - protein, 9 aa, Homo Sapiens
ETFWETTKW

SEQ ID NO: 35886 - protein, 9 aa, Homo Sapiens
ETHRDLSSW

SEQ ID NO: 35887 - protein, 9 aa, Homo Sapiens
ETIASVRSL

SEQ ID NO: 35888 - protein, 9 aa, Homo Sapiens
ETIDRFNNY

SEQ ID NO: 35889 - protein, 9 aa, Homo Sapiens
ETIDVHSGY

SEQ ID NO: 35890 - protein, 9 aa, Homo Sapiens
ETIERLQQL

SEQ ID NO: 35891 - protein, 9 aa, Homo Sapiens
ETIESINQL

SEQ ID NO: 35892 - protein, 9 aa, Homo Sapiens
ETIETINQL

SEQ ID NO: 35893 - protein, 9 aa, Homo Sapiens
ETIHPRKSY

SEQ ID NO: 35894 - protein, 9 aa, Homo Sapiens
ETIPKAVSF

SEQ ID NO: 35895 - protein, 9 aa, Homo Sapiens
ETIQGTGSW

SEQ ID NO: 35896 - protein, 9 aa, Homo Sapiens
ETIQHTEAF

SEQ ID NO: 35897 - protein, 9 aa, Homo Sapiens
ETIQTYRSV

SEQ ID NO: 35898 - protein, 9 aa, Homo Sapiens
ETIRNIDCY

SEQ ID NO: 35899 - protein, 9 aa, Homo Sapiens
ETIRNIPHL

SEQ ID NO: 35900 - protein, 9 aa, Homo Sapiens
ETITKFLQL

SEQ ID NO: 35901 - protein, 9 aa, Homo Sapiens
ETIVIINKF

SEQ ID NO: 35902 - protein, 9 aa, Homo Sapiens
ETKEVYRHF

SEQ ID NO: 35903 - protein, 9 aa, Homo Sapiens
ETKEYFESW

SEQ ID NO: 35904 - protein, 9 aa, Homo Sapiens
ETKKQYDSF

SEQ ID NO: 35905 - protein, 9 aa, Homo Sapiens
ETKNTLRAF

SEQ ID NO: 35906 - protein, 9 aa, Homo Sapiens
ETKQFFLQF

SEQ ID NO: 35907 - protein, 9 aa, Homo Sapiens
ETKSRFTEY

SEQ ID NO: 35908 - protein, 9 aa, Homo Sapiens
ETLKLISGW

SEQ ID NO: 35909 - protein, 9 aa, Homo Sapiens
ETNTHVKCF

SEQ ID NO: 35910 - protein, 9 aa, Homo Sapiens
ETNTVVQTY

SEQ ID NO: 35911 - protein, 9 aa, Homo Sapiens
ETPGQILGW

SEQ ID NO: 35912 - protein, 9 aa, Homo Sapiens
ETPLHISGF

SEQ ID NO: 35913 - protein, 9 aa, Homo Sapiens
ETPPLFHSY

SEQ ID NO: 35914 - protein, 9 aa, Homo Sapiens
ETPRSVPGF

SEQ ID NO: 35915 - protein, 9 aa, Homo Sapiens
ETRKIVREF

SEQ ID NO: 35916 - protein, 9 aa, Homo Sapiens
ETRKMISTW

SEQ ID NO: 35917 - protein, 9 aa, Homo Sapiens
ETSEQVTRW

SEQ ID NO: 35918 - protein, 9 aa, Homo Sapiens
ETTDLLAHW

SEQ ID NO: 35919 - protein, 9 aa, Homo Sapiens
ETTVHASGW

SEQ ID NO: 35920 - protein, 9 aa, Homo Sapiens
ETTVKLLEF

SEQ ID NO: 35921 - protein, 9 aa, Homo Sapiens
ETVADVRTL

SEQ ID NO: 35922 - protein, 9 aa, Homo Sapiens
ETVGKFIQY

SEQ ID NO: 35923 - protein, 9 aa, Homo Sapiens
ETVKEILSI

SEQ ID NO: 35924 - protein, 9 aa, Homo Sapiens
ETVKKFMAL

SEQ ID NO: 35925 - protein, 9 aa, Homo Sapiens
ETVRELTEF

SEQ ID NO: 35926 - protein, 9 aa, Homo Sapiens
ETVRQIRQI

SEQ ID NO: 35927 - protein, 9 aa, Homo Sapiens
ETVRSILKI

SEQ ID NO: 35928 - protein, 9 aa, Homo Sapiens
ETVSGLKGY

SEQ ID NO: 35929 - protein, 9 aa, Homo Sapiens
ETVVRYEKF

SEQ ID NO: 35930 - protein, 9 aa, Homo Sapiens
ETVWHLEEF

SEQ ID NO: 35931 - protein, 9 aa, Homo Sapiens
ETVWRLEEF

SEQ ID NO: 35932 - protein, 9 aa, Homo Sapiens
ETYIRSGTY

SEQ ID NO: 35933 - protein, 9 aa, Homo Sapiens
ETYRGGMAI

SEQ ID NO: 35934 - protein, 9 aa, Homo Sapiens
EVAAAIAGY

SEQ ID NO: 35935 - protein, 9 aa, Homo Sapiens
EVAAVLLHF

SEQ ID NO: 35936 - protein, 9 aa, Homo Sapiens
EVAEAYEVL

SEQ ID NO: 35937 - protein, 9 aa, Homo Sapiens
EVAEKAGTF

SEQ ID NO: 35938 - protein, 9 aa, Homo Sapiens
EVAGHLRTY

SEQ ID NO: 35939 - protein, 9 aa, Homo Sapiens
EVAGPREAF

SEQ ID NO: 35940 - protein, 9 aa, Homo Sapiens
EVAKSLSAL

SEQ ID NO: 35941 - protein, 9 aa, Homo Sapiens
EVAPAGASY

SEQ ID NO: 35942 - protein, 9 aa, Homo Sapiens
EVAPALSVF

SEQ ID NO: 35943 - protein, 9 aa, Homo Sapiens
EVAPAPKSW

SEQ ID NO: 35944 - protein, 9 aa, Homo Sapiens
EVAPDAKSF

SEQ ID NO: 35945 - protein, 9 aa, Homo Sapiens
EVAPSFGTL

SEQ ID NO: 35946 - protein, 9 aa, Homo Sapiens
EVAQQGTMW

SEQ ID NO: 35947 - protein, 9 aa, Homo Sapiens
EVASALRSF

SEQ ID NO: 35948 - protein, 9 aa, Homo Sapiens
EVASNITSF

SEQ ID NO: 35949 - protein, 9 aa, Homo Sapiens
EVASVYQSY

SEQ ID NO: 35950 - protein, 9 aa, Homo Sapiens
EVATRMQSF

SEQ ID NO: 35951 - protein, 9 aa, Homo Sapiens
EVAVKMKQY

SEQ ID NO: 35952 - protein, 9 aa, Homo Sapiens
EVFHPTHEW

SEQ ID NO: 35953 - protein, 9 aa, Homo Sapiens
EVHDYIRAY

SEQ ID NO: 35954 - protein, 9 aa, Homo Sapiens
EVHEKLRGW

SEQ ID NO: 35955 - protein, 9 aa, Homo Sapiens
EVHESYKHL

SEQ ID NO: 35956 - protein, 9 aa, Homo Sapiens
EVHIQLSEW

SEQ ID NO: 35957 - protein, 9 aa, Homo Sapiens
EVIAKNNSF

SEQ ID NO: 35958 - protein, 9 aa, Homo Sapiens
EVIALLHSL

SEQ ID NO: 35959 - protein, 9 aa, Homo Sapiens
EVIDVVRTM

SEQ ID NO: 35960 - protein, 9 aa, Homo Sapiens
EVIEKFDYV

SEQ ID NO: 35961 - protein, 9 aa, Homo Sapiens
EVIGGLCSL

SEQ ID NO: 35962 - protein, 9 aa, Homo Sapiens
EVIGKITAL

SEQ ID NO: 35963 - protein, 9 aa, Homo Sapiens
EVIIPHSGW

SEQ ID NO: 35964 - protein, 9 aa, Homo Sapiens
EVIKELAQI

SEQ ID NO: 35965 - protein, 9 aa, Homo Sapiens
EVIKEVQEF

SEQ ID NO: 35966 - protein, 9 aa, Homo Sapiens
EVIKSQEVF

SEQ ID NO: 35967 - protein, 9 aa, Homo Sapiens
EVILKNITW

SEQ ID NO: 35968 - protein, 9 aa, Homo Sapiens
EVINRIQKL

SEQ ID NO: 35969 - protein, 9 aa, Homo Sapiens
EVIPGYEEL

SEQ ID NO: 35970 - protein, 9 aa, Homo Sapiens
EVIPLVQTF

SEQ ID NO: 35971 - protein, 9 aa, Homo Sapiens
EVIPPMKEF

SEQ ID NO: 35972 - protein, 9 aa, Homo Sapiens
EVIPPYYSY

SEQ ID NO: 35973 - protein, 9 aa, Homo Sapiens
EVIPTHTVY

SEQ ID NO: 35974 - protein, 9 aa, Homo Sapiens
EVIQALPKL

SEQ ID NO: 35975 - protein, 9 aa, Homo Sapiens
EVIQAYETL

SEQ ID NO: 35976 - protein, 9 aa, Homo Sapiens
EVIQEIKSF

SEQ ID NO: 35977 - protein, 9 aa, Homo Sapiens
EVIQNMTEF

SEQ ID NO: 35978 - protein, 9 aa, Homo Sapiens
EVIQWLAKL

SEQ ID NO: 35979 - protein, 9 aa, Homo Sapiens
EVIRELAGI

SEQ ID NO: 35980 - protein, 9 aa, Homo Sapiens
EVIRELICY

SEQ ID NO: 35981 - protein, 9 aa, Homo Sapiens
EVIRHDATW

SEQ ID NO: 35982 - protein, 9 aa, Homo Sapiens
EVIRTLPSL

SEQ ID NO: 35983 - protein, 9 aa, Homo Sapiens
EVIRVCQVW

SEQ ID NO: 35984 - protein, 9 aa, Homo Sapiens
EVISGYEEL

SEQ ID NO: 35985 - protein, 9 aa, Homo Sapiens
EVISHIGKL

SEQ ID NO: 35986 - protein, 9 aa, Homo Sapiens
EVISKLYAV

SEQ ID NO: 35987 - protein, 9 aa, Homo Sapiens
EVISKTPTL

SEQ ID NO: 35988 - protein, 9 aa, Homo Sapiens
EVISRQATI

SEQ ID NO: 35989 - protein, 9 aa, Homo Sapiens
EVISSLEKY

SEQ ID NO: 35990 - protein, 9 aa, Homo Sapiens
EVISSVSEL

SEQ ID NO: 35991 - protein, 9 aa, Homo Sapiens
EVISVLQKY

SEQ ID NO: 35992 - protein, 9 aa, Homo Sapiens
EVITGIRII

SEQ ID NO: 35993 - protein, 9 aa, Homo Sapiens
EVITKFINV

SEQ ID NO: 35994 - protein, 9 aa, Homo Sapiens
EVKEDIAKL

SEQ ID NO: 35995 - protein, 9 aa, Homo Sapiens
EVKEEVKKF

SEQ ID NO: 35996 - protein, 9 aa, Homo Sapiens
EVKEMMTTW

SEQ ID NO: 35997 - protein, 9 aa, Homo Sapiens
EVKKLMRKY

SEQ ID NO: 35998 - protein, 9 aa, Homo Sapiens
EVKKTLQQF

SEQ ID NO: 35999 - protein, 9 aa, Homo Sapiens
EVKLKVDSF

SEQ ID NO: 36000 - protein, 9 aa, Homo Sapiens
EVKPDDLEW

SEQ ID NO: 36001 - protein, 9 aa, Homo Sapiens
EVKRPGESL

SEQ ID NO: 36002 - protein, 9 aa, Homo Sapiens
EVLDHMGTF

SEQ ID NO: 36003 - protein, 9 aa, Homo Sapiens
EVLEHFQAF

SEQ ID NO: 36004 - protein, 9 aa, Homo Sapiens
EVLKRLGMW

SEQ ID NO: 36005 - protein, 9 aa, Homo Sapiens
EVMEIMSRF

SEQ ID NO: 36006 - protein, 9 aa, Homo Sapiens
EVMKRIQSL

SEQ ID NO: 36007 - protein, 9 aa, Homo Sapiens
EVMKYITSL

SEQ ID NO: 36008 - protein, 9 aa, Homo Sapiens
EVMPKICRL

SEQ ID NO: 36009 - protein, 9 aa, Homo Sapiens
EVMQKYIRY

SEQ ID NO: 36010 - protein, 9 aa, Homo Sapiens
EVMSLMSSL

SEQ ID NO: 36011 - protein, 9 aa, Homo Sapiens
EVPEKIAEL

SEQ ID NO: 36012 - protein, 9 aa, Homo Sapiens
EVPHEVAQY

SEQ ID NO: 36013 - protein, 9 aa, Homo Sapiens
EVPKKLTEW

SEQ ID NO: 36014 - protein, 9 aa, Homo Sapiens
EVPKVYSCL

SEQ ID NO: 36015 - protein, 9 aa, Homo Sapiens
EVPSMASSW

SEQ ID NO: 36016 - protein, 9 aa, Homo Sapiens
EVPTQLVSY

SEQ ID NO: 36017 - protein, 9 aa, Homo Sapiens
EVPVYVPKW

SEQ ID NO: 36018 - protein, 9 aa, Homo Sapiens
EVQDKYECL

SEQ ID NO: 36019 - protein, 9 aa, Homo Sapiens
EVQDSIHRW

SEQ ID NO: 36020 - protein, 9 aa, Homo Sapiens
EVQDSYEAY

SEQ ID NO: 36021 - protein, 9 aa, Homo Sapiens
EVQEGFLRF

SEQ ID NO: 36022 - protein, 9 aa, Homo Sapiens
EVQSLYREI

SEQ ID NO: 36023 - protein, 9 aa, Homo Sapiens
EVRQGLKAY

SEQ ID NO: 36024 - protein, 9 aa, Homo Sapiens
EVRTGGMAF

SEQ ID NO: 36025 - protein, 9 aa, Homo Sapiens
EVSQKFTSI

SEQ ID NO: 36026 - protein, 9 aa, Homo Sapiens
EVSSISSKF

SEQ ID NO: 36027 - protein, 9 aa, Homo Sapiens
EVSVPTFSW

SEQ ID NO: 36028 - protein, 9 aa, Homo Sapiens
EVTDLLASF

SEQ ID NO: 36029 - protein, 9 aa, Homo Sapiens
EVTEIISQF

SEQ ID NO: 36030 - protein, 9 aa, Homo Sapiens
EVTELLARY

SEQ ID NO: 36031 - protein, 9 aa, Homo Sapiens
EVTFIYQKL

SEQ ID NO: 36032 - protein, 9 aa, Homo Sapiens
EVTGPHEAF

SEQ ID NO: 36033 - protein, 9 aa, Homo Sapiens
EVTSKLKSY

SEQ ID NO: 36034 - protein, 9 aa, Homo Sapiens
EVTVDFHCW

SEQ ID NO: 36035 - protein, 9 aa, Homo Sapiens
EVVAEVQEF

SEQ ID NO: 36036 - protein, 9 aa, Homo Sapiens
EVVAFIQHF

SEQ ID NO: 36037 - protein, 9 aa, Homo Sapiens
EVVAGIKEY

SEQ ID NO: 36038 - protein, 9 aa, Homo Sapiens
EVVAKVMEL

SEQ ID NO: 36039 - protein, 9 aa, Homo Sapiens
EVVCIRSTW

SEQ ID NO: 36040 - protein, 9 aa, Homo Sapiens
EVVDFSSHY

SEQ ID NO: 36041 - protein, 9 aa, Homo Sapiens
EVVDNSSNW

SEQ ID NO: 36042 - protein, 9 aa, Homo Sapiens
EVVEKYEIY

SEQ ID NO: 36043 - protein, 9 aa, Homo Sapiens
EVVENLLNY

SEQ ID NO: 36044 - protein, 9 aa, Homo Sapiens
EVVERLLSV

SEQ ID NO: 36045 - protein, 9 aa, Homo Sapiens
EVVERVLTF

SEQ ID NO: 36046 - protein, 9 aa, Homo Sapiens
EVVGKIRSL

SEQ ID NO: 36047 - protein, 9 aa, Homo Sapiens
EVVGVYGSF

SEQ ID NO: 36048 - protein, 9 aa, Homo Sapiens
EVVGYFGRF

SEQ ID NO: 36049 - protein, 9 aa, Homo Sapiens
EVVHKIIEL

SEQ ID NO: 36050 - protein, 9 aa, Homo Sapiens
EVVHQLQEI

SEQ ID NO: 36051 - protein, 9 aa, Homo Sapiens
EVVKILERW

SEQ ID NO: 36052 - protein, 9 aa, Homo Sapiens
EVVNLFLHF

SEQ ID NO: 36053 - protein, 9 aa, Homo Sapiens
EVVPEYVTL

SEQ ID NO: 36054 - protein, 9 aa, Homo Sapiens
EVVRETGEY

SEQ ID NO: 36055 - protein, 9 aa, Homo Sapiens
EVVRKILLL

SEQ ID NO: 36056 - protein, 9 aa, Homo Sapiens
EVVSPLSSW

SEQ ID NO: 36057 - protein, 9 aa, Homo Sapiens
EVVSVLHVF

SEQ ID NO: 36058 - protein, 9 aa, Homo Sapiens
EVVTALTTL

SEQ ID NO: 36059 - protein, 9 aa, Homo Sapiens
EVVTTIPTI

SEQ ID NO: 36060 - protein, 9 aa, Homo Sapiens
EVYAGSHQY

SEQ ID NO: 36061 - protein, 9 aa, Homo Sapiens
EVYAKANSF

SEQ ID NO: 36062 - protein, 9 aa, Homo Sapiens
EVYDDFLHY

SEQ ID NO: 36063 - protein, 9 aa, Homo Sapiens
EVYHKSMTL

SEQ ID NO: 36064 - protein, 9 aa, Homo Sapiens
FSAEQIARW

SEQ ID NO: 36065 - protein, 9 aa, Homo Sapiens
FTINGITNW

SEQ ID NO: 36066 - protein, 9 aa, Homo Sapiens
FTKPPIGTW

SEQ ID NO: 36067 - protein, 9 aa, Homo Sapiens
FTVDQIRAI

SEQ ID NO: 36068 - protein, 9 aa, Homo Sapiens
FVEEEHQTW

SEQ ID NO: 36069 - protein, 9 aa, Homo Sapiens
FVGPVVGGW

SEQ ID NO: 36070 - protein, 9 aa, Homo Sapiens
FVKEKLLKW

SEQ ID NO: 36071 - protein, 9 aa, Homo Sapiens
FVNEAISHW

SEQ ID NO: 36072 - protein, 9 aa, Homo Sapiens
FVQQRYLSY

SEQ ID NO: 36073 - protein, 9 aa, Homo Sapiens
FVVEQVESY

SEQ ID NO: 36074 - protein, 9 aa, Homo Sapiens
FVVQNPSSW

SEQ ID NO: 36075 - protein, 9 aa, Homo Sapiens
GEIAAAVSF

SEQ ID NO: 36076 - protein, 9 aa, Homo Sapiens
GTIAEVGKW

SEQ ID NO: 36077 - protein, 9 aa, Homo Sapiens
GTIKKFLSL

SEQ ID NO: 36078 - protein, 9 aa, Homo Sapiens
GVADGVGGW

SEQ ID NO: 36079 - protein, 9 aa, Homo Sapiens
GVIWKTIGW

SEQ ID NO: 36080 - protein, 9 aa, Homo Sapiens
HAATTSLSW

SEQ ID NO: 36081 - protein, 9 aa, Homo Sapiens
HAIDIICGF

SEQ ID NO: 36082 - protein, 9 aa, Homo Sapiens
HIAENILSY

SEQ ID NO: 36083 - protein, 9 aa, Homo Sapiens
HIIGRIESY

SEQ ID NO: 36084 - protein, 9 aa, Homo Sapiens
HLIQNIPGF

SEQ ID NO: 36085 - protein, 9 aa, Homo Sapiens
HTADISSHF

SEQ ID NO: 36086 - protein, 9 aa, Homo Sapiens
HTATHILNF

SEQ ID NO: 36087 - protein, 9 aa, Homo Sapiens
HTIGKTVEY

SEQ ID NO: 36088 - protein, 9 aa, Homo Sapiens
HTIGPFSSF

SEQ ID NO: 36089 - protein, 9 aa, Homo Sapiens
HTKTTLPTF

SEQ ID NO: 36090 - protein, 9 aa, Homo Sapiens
HTQENCETW

SEQ ID NO: 36091 - protein, 9 aa, Homo Sapiens
HTQTGVSTW

SEQ ID NO: 36092 - protein, 9 aa, Homo Sapiens
HTSSTTSAW

SEQ ID NO: 36093 - protein, 9 aa, Homo Sapiens
HTVEDYQAI

SEQ ID NO: 36094 - protein, 9 aa, Homo Sapiens
HTVGLSSTW

SEQ ID NO: 36095 - protein, 9 aa, Homo Sapiens
HTVPDMGKW

SEQ ID NO: 36096 - protein, 9 aa, Homo Sapiens
HVGPILVGW

SEQ ID NO: 36097 - protein, 9 aa, Homo Sapiens
HVHSEFESF

SEQ ID NO: 36098 - protein, 9 aa, Homo Sapiens
HVIDDFVQF

SEQ ID NO: 36099 - protein, 9 aa, Homo Sapiens
HVPFKFQSF

SEQ ID NO: 36100 - protein, 9 aa, Homo Sapiens
HVPNTYTCF

SEQ ID NO: 36101 - protein, 9 aa, Homo Sapiens
HVQELYQEW

SEQ ID NO: 36102 - protein, 9 aa, Homo Sapiens
HVSDLSSSW

SEQ ID NO: 36103 - protein, 9 aa, Homo Sapiens
HVSGPFVQF

SEQ ID NO: 36104 - protein, 9 aa, Homo Sapiens
HVVAHFHEW

SEQ ID NO: 36105 - protein, 9 aa, Homo Sapiens
HVVEFSTAW

SEQ ID NO: 36106 - protein, 9 aa, Homo Sapiens
IIIPSYASW

SEQ ID NO: 36107 - protein, 9 aa, Homo Sapiens
ITKDVVLQW

SEQ ID NO: 36108 - protein, 9 aa, Homo Sapiens
ITKKQVSVW

SEQ ID NO: 36109 - protein, 9 aa, Homo Sapiens
ITPEVLPGW

SEQ ID NO: 36110 - protein, 9 aa, Homo Sapiens
KVKKTIPSW

SEQ ID NO: 36111 - protein, 9 aa, Homo Sapiens
LEVIPGYEE

SEQ ID NO: 36112 - protein, 9 aa, Homo Sapiens
LNLPEAASY

SEQ ID NO: 36113 - protein, 9 aa, Homo Sapiens
LTIDHVPIW

SEQ ID NO: 36114 - protein, 9 aa, Homo Sapiens
LVKTEIPNW

SEQ ID NO: 36115 - protein, 9 aa, Homo Sapiens
MTNGFHMTW

SEQ ID NO: 36116 - protein, 9 aa, Homo Sapiens
MVADKFTEL

SEQ ID NO: 36117 - protein, 9 aa, Homo Sapiens
MVADRFSEL

SEQ ID NO: 36118 - protein, 9 aa, Homo Sapiens
NAIEHTLQW

SEQ ID NO: 36119 - protein, 9 aa, Homo Sapiens
NIPEAIASY

SEQ ID NO: 36120 - protein, 9 aa, Homo Sapiens
NIVDKTASF

SEQ ID NO: 36121 - protein, 9 aa, Homo Sapiens
NTINLIHTF

SEQ ID NO: 36122 - protein, 9 aa, Homo Sapiens
NTVDSIESF

SEQ ID NO: 36123 - protein, 9 aa, Homo Sapiens
NVIDKLAQF

SEQ ID NO: 36124 - protein, 9 aa, Homo Sapiens
NVIESFTEL

SEQ ID NO: 36125 - protein, 9 aa, Homo Sapiens
NVIETISSL

SEQ ID NO: 36126 - protein, 9 aa, Homo Sapiens
NVIHNLATY

SEQ ID NO: 36127 - protein, 9 aa, Homo Sapiens
NVKDLTQAW

SEQ ID NO: 36128 - protein, 9 aa, Homo Sapiens
NVKDYYQKW

SEQ ID NO: 36129 - protein, 9 aa, Homo Sapiens
NVPEKYTCY

SEQ ID NO: 36130 - protein, 9 aa, Homo Sapiens
NVREALQAW

SEQ ID NO: 36131 - protein, 9 aa, Homo Sapiens
NVVAQIKPF

SEQ ID NO: 36132 - protein, 9 aa, Homo Sapiens
PDIKLFGKW

SEQ ID NO: 36133 - protein, 9 aa, Homo Sapiens
PEGYVPEHW

SEQ ID NO: 36134 - protein, 9 aa, Homo Sapiens
PGPGSSELR

SEQ ID NO: 36135 - protein, 9 aa, Homo Sapiens
PSNHVIDRW

SEQ ID NO: 36136 - protein, 9 aa, Homo Sapiens
QSTLELSEV

SEQ ID NO: 36137 - protein, 9 aa, Homo Sapiens
QTPAHIAAF

SEQ ID NO: 36138 - protein, 9 aa, Homo Sapiens
QVAPKTLPW

SEQ ID NO: 36139 - protein, 9 aa, Homo Sapiens
QVIEKFEAL

SEQ ID NO: 36140 - protein, 9 aa, Homo Sapiens
SIIQRIQEF

SEQ ID NO: 36141 - protein, 9 aa, Homo Sapiens
SIKEKISMW

SEQ ID NO: 36142 - protein, 9 aa, Homo Sapiens
SSLLEKGLD

SEQ ID NO: 36143 - protein, 9 aa, Homo Sapiens
STAPGYYSW

SEQ ID NO: 36144 - protein, 9 aa, Homo Sapiens
STIETVPYW

SEQ ID NO: 36145 - protein, 9 aa, Homo Sapiens
STIQDYLGF

SEQ ID NO: 36146 - protein, 9 aa, Homo Sapiens
STVPGYYSW

SEQ ID NO: 36147 - protein, 9 aa, Homo Sapiens
SVIATIQEY

SEQ ID NO: 36148 - protein, 9 aa, Homo Sapiens
SVIDIINKY

SEQ ID NO: 36149 - protein, 9 aa, Homo Sapiens
SVIEAVAHF

SEQ ID NO: 36150 - protein, 9 aa, Homo Sapiens
SVIEEHANW

SEQ ID NO: 36151 - protein, 9 aa, Homo Sapiens
SVIEQILHY

SEQ ID NO: 36152 - protein, 9 aa, Homo Sapiens
SVIRKIPAL

SEQ ID NO: 36153 - protein, 9 aa, Homo Sapiens
SVIRTMWAW

SEQ ID NO: 36154 - protein, 9 aa, Homo Sapiens
SVKTTTHSW

SEQ ID NO: 36155 - protein, 9 aa, Homo Sapiens
SVPDALQKW

SEQ ID NO: 36156 - protein, 9 aa, Homo Sapiens
SVPRDLPSW

SEQ ID NO: 36157 - protein, 9 aa, Homo Sapiens
SVVDDIPEF

SEQ ID NO: 36158 - protein, 9 aa, Homo Sapiens
SVVEAIPEF

SEQ ID NO: 36159 - protein, 9 aa, Homo Sapiens
SVVGAISSY

SEQ ID NO: 36160 - protein, 9 aa, Homo Sapiens
SVVKELSSF

SEQ ID NO: 36161 - protein, 9 aa, Homo Sapiens
SVVYGIGTW

SEQ ID NO: 36162 - protein, 9 aa, Homo Sapiens
SVYDTIASW

SEQ ID NO: 36163 - protein, 9 aa, Homo Sapiens
TTIAKYAQY

SEQ ID NO: 36164 - protein, 9 aa, Homo Sapiens
TTICRLESF

SEQ ID NO: 36165 - protein, 9 aa, Homo Sapiens
TTISRFEAL

SEQ ID NO: 36166 - protein, 9 aa, Homo Sapiens
TTSTRIGKF

SEQ ID NO: 36167 - protein, 9 aa, Homo Sapiens
TVETVEVVN

SEQ ID NO: 36168 - protein, 9 aa, Homo Sapiens
TVGPKTFSW

SEQ ID NO: 36169 - protein, 9 aa, Homo Sapiens
TVIEKTESW

SEQ ID NO: 36170 - protein, 9 aa, Homo Sapiens
TVIENIHTI

SEQ ID NO: 36171 - protein, 9 aa, Homo Sapiens
TVKETIHMF

SEQ ID NO: 36172 - protein, 9 aa, Homo Sapiens
TVMGRIATL

SEQ ID NO: 36173 - protein, 9 aa, Homo Sapiens
TVPEKIGVF

SEQ ID NO: 36174 - protein, 9 aa, Homo Sapiens
TVSGTTQSW

SEQ ID NO: 36175 - protein, 9 aa, Homo Sapiens
TVVVRIMEF

SEQ ID NO: 36176 - protein, 9 aa, Homo Sapiens
VPALEASAP

SEQ ID NO: 36177 - protein, 9 aa, Homo Sapiens
VTIKKDVDG

SEQ ID NO: 36178 - protein, 9 aa, Homo Sapiens
VVKERVTEW

SEQ ID NO: 36179 - protein, 9 aa, Homo Sapiens
VVVDAIPVF

SEQ ID NO: 36180 - protein, 9 aa, Homo Sapiens
YIAESRLSW

SEQ ID NO: 36181 - protein, 9 aa, Homo Sapiens
YIATKIGAF

SEQ ID NO: 36182 - protein, 9 aa, Homo Sapiens
YIIQNIPGF

SEQ ID NO: 36183 - protein, 9 aa, Homo Sapiens
YTADPYHAL

SEQ ID NO: 36184 - protein, 9 aa, Homo Sapiens
YTAENICKW

SEQ ID NO: 36185 - protein, 9 aa, Homo Sapiens
YTHEVVTLW

SEQ ID NO: 36186 - protein, 9 aa, Homo Sapiens
YTKDYTEGW

SEQ ID NO: 36187 - protein, 9 aa, Homo Sapiens
YTKFQIATW

SEQ ID NO: 36188 - protein, 9 aa, Homo Sapiens
YTSHITCRW

SEQ ID NO: 36189 - protein, 9 aa, Homo Sapiens
YVAPAYGVY

SEQ ID NO: 36190 - protein, 9 aa, Homo Sapiens
YVHSSVAQW

SEQ ID NO: 36191 - protein, 9 aa, Homo Sapiens
YVIQKFFEF

SEQ ID NO: 36192 - protein, 9 aa, Homo Sapiens
YVPEKYLQF

SEQ ID NO: 36193 - protein, 9 aa, Homo Sapiens
YVQDRVPSY

SEQ ID NO: 36194 - protein, 9 aa, Homo Sapiens
YVTGIIGKW

SEQ ID NO: 36195 - protein, 10 aa, Homo Sapiens
AAADHNYQSY

SEQ ID NO: 36196 - protein, 10 aa, Homo Sapiens
AAAGPGKTSW

SEQ ID NO: 36197 - protein, 10 aa, Homo Sapiens
APPERKYSVW

SEQ ID NO: 36198 - protein, 10 aa, Homo Sapiens
ASFDGRISVY

SEQ ID NO: 36199 - protein, 10 aa, Homo Sapiens
ATNDASLHVW

SEQ ID NO: 36200 - protein, 10 aa, Homo Sapiens
AVFEKGMKAF

SEQ ID NO: 36201 - protein, 10 aa, Homo Sapiens
AVFNRAFYSW

SEQ ID NO: 36202 - protein, 10 aa, Homo Sapiens
AVHDRLLNVW

SEQ ID NO: 36203 - protein, 10 aa, Homo Sapiens
AVIAHDFLAF

SEQ ID NO: 36204 - protein, 10 aa, Homo Sapiens
AVIEANIRSY

SEQ ID NO: 36205 - protein, 10 aa, Homo Sapiens
AVIGDVIRVY

SEQ ID NO: 36206 - protein, 10 aa, Homo Sapiens
AVKVAKGLAW

SEQ ID NO: 36207 - protein, 10 aa, Homo Sapiens
AVLSSSLTHW

SEQ ID NO: 36208 - protein, 10 aa, Homo Sapiens
AVMDHVSDSF

SEQ ID NO: 36209 - protein, 10 aa, Homo Sapiens
AVREDLGGCW

SEQ ID NO: 36210 - protein, 10 aa, Homo Sapiens
AVREGSPANW

SEQ ID NO: 36211 - protein, 10 aa, Homo Sapiens
AVYERELQTF

SEQ ID NO: 36212 - protein, 10 aa, Homo Sapiens
AVYPQATQTY

SEQ ID NO: 36213 - protein, 10 aa, Homo Sapiens
CVQEDSLQAW

SEQ ID NO: 36214 - protein, 10 aa, Homo Sapiens
DALDIHPVGW

SEQ ID NO: 36215 - protein, 10 aa, Homo Sapiens
DAMNREVSSL

SEQ ID NO: 36216 - protein, 10 aa, Homo Sapiens
DIIGVAGNHW

SEQ ID NO: 36217 - protein, 10 aa, Homo Sapiens
DIIRGPILSF

SEQ ID NO: 36218 - protein, 10 aa, Homo Sapiens
DILNGDICKW

SEQ ID NO: 36219 - protein, 10 aa, Homo Sapiens
DIPDQVIRVF

SEQ ID NO: 36220 - protein, 10 aa, Homo Sapiens
DIYGGDYERF

SEQ ID NO: 36221 - protein, 10 aa, Homo Sapiens
DIYNFPIHAF

SEQ ID NO: 36222 - protein, 10 aa, Homo Sapiens
DIYNGKVTSI

SEQ ID NO: 36223 - protein, 10 aa, Homo Sapiens
DLFNGRYHVI

SEQ ID NO: 36224 - protein, 10 aa, Homo Sapiens
DLFTKYYSEW

SEQ ID NO: 36225 - protein, 10 aa, Homo Sapiens
DLIDSCIQSF

SEQ ID NO: 36226 - protein, 10 aa, Homo Sapiens
DLYPSNPVSW

SEQ ID NO: 36227 - protein, 10 aa, Homo Sapiens
DSCDRLTQSW

SEQ ID NO: 36228 - protein, 10 aa, Homo Sapiens
DSFSDLYSSY

SEQ ID NO: 36229 - protein, 10 aa, Homo Sapiens
DSVPRDLPSW

SEQ ID NO: 36230 - protein, 10 aa, Homo Sapiens
DTFGPRAQGW

SEQ ID NO: 36231 - protein, 10 aa, Homo Sapiens
DTIARALPFW

SEQ ID NO: 36232 - protein, 10 aa, Homo Sapiens
DTIGYLLTRY

SEQ ID NO: 36233 - protein, 10 aa, Homo Sapiens
DTIYSILHHF

SEQ ID NO: 36234 - protein, 10 aa, Homo Sapiens
DTKDPAVTEW

SEQ ID NO: 36235 - protein, 10 aa, Homo Sapiens
DTKPGLYTAY

SEQ ID NO: 36236 - protein, 10 aa, Homo Sapiens
DTLSSGVHSW

SEQ ID NO: 36237 - protein, 10 aa, Homo Sapiens
DTPIFDFRVF

SEQ ID NO: 36238 - protein, 10 aa, Homo Sapiens
DTVTKELVSW

SEQ ID NO: 36239 - protein, 10 aa, Homo Sapiens
DTYPEESRSY

SEQ ID NO: 36240 - protein, 10 aa, Homo Sapiens
DVANFYVSQL

SEQ ID NO: 36241 - protein, 10 aa, Homo Sapiens
DVARHFIQRW

SEQ ID NO: 36242 - protein, 10 aa, Homo Sapiens
DVFGYHGYTF

SEQ ID NO: 36243 - protein, 10 aa, Homo Sapiens
DVFRATYAAF

SEQ ID NO: 36244 - protein, 10 aa, Homo Sapiens
DVIAQGIGKL

SEQ ID NO: 36245 - protein, 10 aa, Homo Sapiens
DVIDLRLCNW

SEQ ID NO: 36246 - protein, 10 aa, Homo Sapiens
DVIFHPTQPW

SEQ ID NO: 36247 - protein, 10 aa, Homo Sapiens
DVIGDEICCW

SEQ ID NO: 36248 - protein, 10 aa, Homo Sapiens
DVIHEVAHSW

SEQ ID NO: 36249 - protein, 10 aa, Homo Sapiens
DVINSRTQGF

SEQ ID NO: 36250 - protein, 10 aa, Homo Sapiens
DVIRKPPRNW

SEQ ID NO: 36251 - protein, 10 aa, Homo Sapiens
DVIRNAFACF

SEQ ID NO: 36252 - protein, 10 aa, Homo Sapiens
DVLDHTYQEL

SEQ ID NO: 36253 - protein, 10 aa, Homo Sapiens
DVNESRINAW

SEQ ID NO: 36254 - protein, 10 aa, Homo Sapiens
DVPAHLQNSW

SEQ ID NO: 36255 - protein, 10 aa, Homo Sapiens
DVPERDLTAF

SEQ ID NO: 36256 - protein, 10 aa, Homo Sapiens
DVPGFAIGGL

SEQ ID NO: 36257 - protein, 10 aa, Homo Sapiens
DVPSFGPACY

SEQ ID NO: 36258 - protein, 10 aa, Homo Sapiens
DVTGQFPSSF

SEQ ID NO: 36259 - protein, 10 aa, Homo Sapiens
DVVPVFKEHW

SEQ ID NO: 36260 - protein, 10 aa, Homo Sapiens
DVYDCQVEHW

SEQ ID NO: 36261 - protein, 10 aa, Homo Sapiens
DVYDCRVEHW

SEQ ID NO: 36262 - protein, 10 aa, Homo Sapiens
DVYDIKKQAW

SEQ ID NO: 36263 - protein, 10 aa, Homo Sapiens
DVYWKIYNSI

SEQ ID NO: 36264 - protein, 10 aa, Homo Sapiens
EAFEKSAATW

SEQ ID NO: 36265 - protein, 10 aa, Homo Sapiens
EAFPEKIPLF

SEQ ID NO: 36266 - protein, 10 aa, Homo Sapiens
EAFQHRSVSW

SEQ ID NO: 36267 - protein, 10 aa, Homo Sapiens
EAFTEMMEAY

SEQ ID NO: 36268 - protein, 10 aa, Homo Sapiens
EAKGPRWASW

SEQ ID NO: 36269 - protein, 10 aa, Homo Sapiens
EALGTLMRAW

SEQ ID NO: 36270 - protein, 10 aa, Homo Sapiens
EALGVPYEQW

SEQ ID NO: 36271 - protein, 10 aa, Homo Sapiens
EALHFVAAAW

SEQ ID NO: 36272 - protein, 10 aa, Homo Sapiens
EAMSGHIDQF

SEQ ID NO: 36273 - protein, 10 aa, Homo Sapiens
EAQLRFIQAW

SEQ ID NO: 36274 - protein, 10 aa, Homo Sapiens
EATHVLPLHW

SEQ ID NO: 36275 - protein, 10 aa, Homo Sapiens
EAVAYAVNSW

SEQ ID NO: 36276 - protein, 10 aa, Homo Sapiens
EAVGSVHQAW

SEQ ID NO: 36277 - protein, 10 aa, Homo Sapiens
EAVSLKPTAW

SEQ ID NO: 36278 - protein, 10 aa, Homo Sapiens
EAYDKLLESW

SEQ ID NO: 36279 - protein, 10 aa, Homo Sapiens
EAYDPETRAW

SEQ ID NO: 36280 - protein, 10 aa, Homo Sapiens
EAYNIKSNEW

SEQ ID NO: 36281 - protein, 10 aa, Homo Sapiens
EAYNIRTDSW

SEQ ID NO: 36282 - protein, 10 aa, Homo Sapiens
EAYNSLMKSY

SEQ ID NO: 36283 - protein, 10 aa, Homo Sapiens
EAYPLPGVTY

SEQ ID NO: 36284 - protein, 10 aa, Homo Sapiens
EAYSAKIALF

SEQ ID NO: 36285 - protein, 10 aa, Homo Sapiens
EIAGTVVGHW

SEQ ID NO: 36286 - protein, 10 aa, Homo Sapiens
EIASFECSGY

SEQ ID NO: 36287 - protein, 10 aa, Homo Sapiens
EICADPRVPW

SEQ ID NO: 36288 - protein, 10 aa, Homo Sapiens
EIFDGNVAHI

SEQ ID NO: 36289 - protein, 10 aa, Homo Sapiens
EIFPGNGHCY

SEQ ID NO: 36290 - protein, 10 aa, Homo Sapiens
EIFPLETPAF

SEQ ID NO: 36291 - protein, 10 aa, Homo Sapiens
EIIETGLAAF

SEQ ID NO: 36292 - protein, 10 aa, Homo Sapiens
EIIGKCTTAY

SEQ ID NO: 36293 - protein, 10 aa, Homo Sapiens
EILEKSFSEF

SEQ ID NO: 36294 - protein, 10 aa, Homo Sapiens
EILHFHYTTW

SEQ ID NO: 36295 - protein, 10 aa, Homo Sapiens
EIMDKAYDKF

SEQ ID NO: 36296 - protein, 10 aa, Homo Sapiens
EIMDRAYDSF

SEQ ID NO: 36297 - protein, 10 aa, Homo Sapiens
EIMEHRFKTY

SEQ ID NO: 36298 - protein, 10 aa, Homo Sapiens
EIMRAGMSSL

SEQ ID NO: 36299 - protein, 10 aa, Homo Sapiens
EINENNVREF

SEQ ID NO: 36300 - protein, 10 aa, Homo Sapiens
EIVPFRVAAY

SEQ ID NO: 36301 - protein, 10 aa, Homo Sapiens
EIYAGKKNNW

SEQ ID NO: 36302 - protein, 10 aa, Homo Sapiens
EIYDCKVEHW

SEQ ID NO: 36303 - protein, 10 aa, Homo Sapiens
EIYGGSDSRF

SEQ ID NO: 36304 - protein, 10 aa, Homo Sapiens
EIYNYDPETY

SEQ ID NO: 36305 - protein, 10 aa, Homo Sapiens
EIYPPEVAEF

SEQ ID NO: 36306 - protein, 10 aa, Homo Sapiens
EIYPPKLHQF

SEQ ID NO: 36307 - protein, 10 aa, Homo Sapiens
EIYQKPFQTL

SEQ ID NO: 36308 - protein, 10 aa, Homo Sapiens
EIYTRDGNSY

SEQ ID NO: 36309 - protein, 10 aa, Homo Sapiens
ELFDKKLKEL

SEQ ID NO: 36310 - protein, 10 aa, Homo Sapiens
ELFHKDIEAF

SEQ ID NO: 36311 - protein, 10 aa, Homo Sapiens
ELFMSSFQSY

SEQ ID NO: 36312 - protein, 10 aa, Homo Sapiens
ELHNGTTQSW

SEQ ID NO: 36313 - protein, 10 aa, Homo Sapiens
ELIAKIPNFW

SEQ ID NO: 36314 - protein, 10 aa, Homo Sapiens
ELIQAKVGSF

SEQ ID NO: 36315 - protein, 10 aa, Homo Sapiens
ELLNSKLPRW

SEQ ID NO: 36316 - protein, 10 aa, Homo Sapiens
ELMDHGIVSW

SEQ ID NO: 36317 - protein, 10 aa, Homo Sapiens
ELMHSIVGSY

SEQ ID NO: 36318 - protein, 10 aa, Homo Sapiens
ELMTHHVHTY

SEQ ID NO: 36319 - protein, 10 aa, Homo Sapiens
ELMYGGVSSY

SEQ ID NO: 36320 - protein, 10 aa, Homo Sapiens
ENMWNTGSTY

SEQ ID NO: 36321 - protein, 10 aa, Homo Sapiens
EQINAKVAEW

SEQ ID NO: 36322 - protein, 10 aa, Homo Sapiens
ESAGIHETTY

SEQ ID NO: 36323 - protein, 10 aa, Homo Sapiens
ESIGQRIACY

SEQ ID NO: 36324 - protein, 10 aa, Homo Sapiens
ESRDGRVDSW

SEQ ID NO: 36325 - protein, 10 aa, Homo Sapiens
ESSPGGNLGW

SEQ ID NO: 36326 - protein, 10 aa, Homo Sapiens
ESSPVHTSTF

SEQ ID NO: 36327 - protein, 10 aa, Homo Sapiens
ETAEPWFSTF

SEQ ID NO: 36328 - protein, 10 aa, Homo Sapiens
ETFAQKMDAF

SEQ ID NO: 36329 - protein, 10 aa, Homo Sapiens
ETFGFRGEAL

SEQ ID NO: 36330 - protein, 10 aa, Homo Sapiens
ETFKDFYNCW

SEQ ID NO: 36331 - protein, 10 aa, Homo Sapiens
ETFKEQGNAY

SEQ ID NO: 36332 - protein, 10 aa, Homo Sapiens
ETFQQKMLRF

SEQ ID NO: 36333 - protein, 10 aa, Homo Sapiens
ETFSGVYKKL

SEQ ID NO: 36334 - protein, 10 aa, Homo Sapiens
ETHPVQETTF

SEQ ID NO: 36335 - protein, 10 aa, Homo Sapiens
ETHTNEFITW

SEQ ID NO: 36336 - protein, 10 aa, Homo Sapiens
ETIESRLSEL

SEQ ID NO: 36337 - protein, 10 aa, Homo Sapiens
ETIHIRGGVF

SEQ ID NO: 36338 - protein, 10 aa, Homo Sapiens
ETIKDGVSRF

SEQ ID NO: 36339 - protein, 10 aa, Homo Sapiens
ETIPDGIGKL

SEQ ID NO: 36340 - protein, 10 aa, Homo Sapiens
ETIRPEETAW

SEQ ID NO: 36341 - protein, 10 aa, Homo Sapiens
ETKKPEVASW

SEQ ID NO: 36342 - protein, 10 aa, Homo Sapiens
ETLLGTMQSY

SEQ ID NO: 36343 - protein, 10 aa, Homo Sapiens
ETLPSKIQQW

SEQ ID NO: 36344 - protein, 10 aa, Homo Sapiens
ETMDREFRKW

SEQ ID NO: 36345 - protein, 10 aa, Homo Sapiens
ETMTEKLVKF

SEQ ID NO: 36346 - protein, 10 aa, Homo Sapiens
ETNGPGHQLW

SEQ ID NO: 36347 - protein, 10 aa, Homo Sapiens
ETNPHHPPAW

SEQ ID NO: 36348 - protein, 10 aa, Homo Sapiens
ETPTFKDHSF

SEQ ID NO: 36349 - protein, 10 aa, Homo Sapiens
ETQKKRLLSW

SEQ ID NO: 36350 - protein, 10 aa, Homo Sapiens
ETRPAGDGTF

SEQ ID NO: 36351 - protein, 10 aa, Homo Sapiens
ETTDSILSHF

SEQ ID NO: 36352 - protein, 10 aa, Homo Sapiens
ETTEYLKTSW

SEQ ID NO: 36353 - protein, 10 aa, Homo Sapiens
ETVHFATTQW

SEQ ID NO: 36354 - protein, 10 aa, Homo Sapiens
ETVNHHYLLF

SEQ ID NO: 36355 - protein, 10 aa, Homo Sapiens
ETVNLRSLGF

SEQ ID NO: 36356 - protein, 10 aa, Homo Sapiens
ETVTIEQTSW

SEQ ID NO: 36357 - protein, 10 aa, Homo Sapiens
ETYDPFHNCW

SEQ ID NO: 36358 - protein, 10 aa, Homo Sapiens
ETYNGHLVSC

SEQ ID NO: 36359 - protein, 10 aa, Homo Sapiens
ETYNLLSERW

SEQ ID NO: 36360 - protein, 10 aa, Homo Sapiens
EVADELVSEF

SEQ ID NO: 36361 - protein, 10 aa, Homo Sapiens
EVADRLFSSF

SEQ ID NO: 36362 - protein, 10 aa, Homo Sapiens
EVADYEATTF

SEQ ID NO: 36363 - protein, 10 aa, Homo Sapiens
EVAEESGRLW

SEQ ID NO: 36364 - protein, 10 aa, Homo Sapiens
EVAEVKISHF

SEQ ID NO: 36365 - protein, 10 aa, Homo Sapiens
EVALGGLQSW

SEQ ID NO: 36366 - protein, 10 aa, Homo Sapiens
EVANHVVQAL

SEQ ID NO: 36367 - protein, 10 aa, Homo Sapiens
EVAPCMGDRF

SEQ ID NO: 36368 - protein, 10 aa, Homo Sapiens
EVAPGALLGL

SEQ ID NO: 36369 - protein, 10 aa, Homo Sapiens
EVAPKQLHSL

SEQ ID NO: 36370 - protein, 10 aa, Homo Sapiens
EVAPVISSAY

SEQ ID NO: 36371 - protein, 10 aa, Homo Sapiens
EVAQHLAATY

SEQ ID NO: 36372 - protein, 10 aa, Homo Sapiens
EVAQKCGLSY

SEQ ID NO: 36373 - protein, 10 aa, Homo Sapiens
EVCTATGERW

SEQ ID NO: 36374 - protein, 10 aa, Homo Sapiens
EVDKRVHMTW

SEQ ID NO: 36375 - protein, 10 aa, Homo Sapiens
EVDVSKKTAW

SEQ ID NO: 36376 - protein, 10 aa, Homo Sapiens
EVEGAGVKAW

SEQ ID NO: 36377 - protein, 10 aa, Homo Sapiens
EVEVGDRTSW

SEQ ID NO: 36378 - protein, 10 aa, Homo Sapiens
EVFDKDLSKL

SEQ ID NO: 36379 - protein, 10 aa, Homo Sapiens
EVFDKTYQFL

SEQ ID NO: 36380 - protein, 10 aa, Homo Sapiens
EVFDPDANTW

SEQ ID NO: 36381 - protein, 10 aa, Homo Sapiens
EVFDPIANCW

SEQ ID NO: 36382 - protein, 10 aa, Homo Sapiens
EVFETIIHSY

SEQ ID NO: 36383 - protein, 10 aa, Homo Sapiens
EVFGPPCEAY

SEQ ID NO: 36384 - protein, 10 aa, Homo Sapiens
EVFIHKDKGF

SEQ ID NO: 36385 - protein, 10 aa, Homo Sapiens
EVFMHVSTAY

SEQ ID NO: 36386 - protein, 10 aa, Homo Sapiens
EVFPKEMTKW

SEQ ID NO: 36387 - protein, 10 aa, Homo Sapiens
EVFPLAMNYL

SEQ ID NO: 36388 - protein, 10 aa, Homo Sapiens
EVFPLKVFGY

SEQ ID NO: 36389 - protein, 10 aa, Homo Sapiens
EVFQTKIQEF

SEQ ID NO: 36390 - protein, 10 aa, Homo Sapiens
EVFSFKMVSY

SEQ ID NO: 36391 - protein, 10 aa, Homo Sapiens
EVFTGGIGSY

SEQ ID NO: 36392 - protein, 10 aa, Homo Sapiens
EVFTGGISSY

SEQ ID NO: 36393 - protein, 10 aa, Homo Sapiens
EVFTGHMGKL

SEQ ID NO: 36394 - protein, 10 aa, Homo Sapiens
EVGWHDVAGW

SEQ ID NO: 36395 - protein, 10 aa, Homo Sapiens
EVHMLDIESF

SEQ ID NO: 36396 - protein, 10 aa, Homo Sapiens
EVIASIISRY

SEQ ID NO: 36397 - protein, 10 aa, Homo Sapiens
EVIDEKVQHI

SEQ ID NO: 36398 - protein, 10 aa, Homo Sapiens
EVIDKNSGGW

SEQ ID NO: 36399 - protein, 10 aa, Homo Sapiens
EVIDLMIKEY

SEQ ID NO: 36400 - protein, 10 aa, Homo Sapiens
EVIEKKPEKF

SEQ ID NO: 36401 - protein, 10 aa, Homo Sapiens
EVIENRMAVL

SEQ ID NO: 36402 - protein, 10 aa, Homo Sapiens
EVIERLIKSY

SEQ ID NO: 36403 - protein, 10 aa, Homo Sapiens
EVIESTNLKY

SEQ ID NO: 36404 - protein, 10 aa, Homo Sapiens
EVIGGTNHTL

SEQ ID NO: 36405 - protein, 10 aa, Homo Sapiens
EVIGLLGGRY

SEQ ID NO: 36406 - protein, 10 aa, Homo Sapiens
EVIGQVLSTL

SEQ ID NO: 36407 - protein, 10 aa, Homo Sapiens
EVIGSELKHW

SEQ ID NO: 36408 - protein, 10 aa, Homo Sapiens
EVIHGIFKAY

SEQ ID NO: 36409 - protein, 10 aa, Homo Sapiens
EVIHKLLDGW

SEQ ID NO: 36410 - protein, 10 aa, Homo Sapiens
EVIITPNSAW

SEQ ID NO: 36411 - protein, 10 aa, Homo Sapiens
EVINGNIKTV

SEQ ID NO: 36412 - protein, 10 aa, Homo Sapiens
EVINRSMDTY

SEQ ID NO: 36413 - protein, 10 aa, Homo Sapiens
EVIQGLLKKF

SEQ ID NO: 36414 - protein, 10 aa, Homo Sapiens
EVIQHRFESL

SEQ ID NO: 36415 - protein, 10 aa, Homo Sapiens
EVISGKGQFF

SEQ ID NO: 36416 - protein, 10 aa, Homo Sapiens
EVISQHLVSY

SEQ ID NO: 36417 - protein, 10 aa, Homo Sapiens
EVITNRPKGF

SEQ ID NO: 36418 - protein, 10 aa, Homo Sapiens
EVKLGELPSW

SEQ ID NO: 36419 - protein, 10 aa, Homo Sapiens
EVLDKRYNVY

SEQ ID NO: 36420 - protein, 10 aa, Homo Sapiens
EVLGPKPTFW

SEQ ID NO: 36421 - protein, 10 aa, Homo Sapiens
EVLHVKTESL

SEQ ID NO: 36422 - protein, 10 aa, Homo Sapiens
EVLPAALAVY

SEQ ID NO: 36423 - protein, 10 aa, Homo Sapiens
EVLSKKGHSF

SEQ ID NO: 36424 - protein, 10 aa, Homo Sapiens
EVLTSKGDAW

SEQ ID NO: 36425 - protein, 10 aa, Homo Sapiens
EVMEQGRVTI

SEQ ID NO: 36426 - protein, 10 aa, Homo Sapiens
EVMEQQTISI

SEQ ID NO: 36427 - protein, 10 aa, Homo Sapiens
EVMNQNLAYY

SEQ ID NO: 36428 - protein, 10 aa, Homo Sapiens
EVNASPLKHF

SEQ ID NO: 36429 - protein, 10 aa, Homo Sapiens
EVNDIKTRSW

SEQ ID NO: 36430 - protein, 10 aa, Homo Sapiens
EVNNFPPQSW

SEQ ID NO: 36431 - protein, 10 aa, Homo Sapiens
EVNTEKLTAF

SEQ ID NO: 36432 - protein, 10 aa, Homo Sapiens
EVPGSIPNSW

SEQ ID NO: 36433 - protein, 10 aa, Homo Sapiens
EVPKPFPTHY

SEQ ID NO: 36434 - protein, 10 aa, Homo Sapiens
EVPVHKLQSL

SEQ ID NO: 36435 - protein, 10 aa, Homo Sapiens
EVREEYITAF

SEQ ID NO: 36436 - protein, 10 aa, Homo Sapiens
EVRGGGLTRY

SEQ ID NO: 36437 - protein, 10 aa, Homo Sapiens
EVRVGVTQAY

SEQ ID NO: 36438 - protein, 10 aa, Homo Sapiens
EVSTAKLTAF

SEQ ID NO: 36439 - protein, 10 aa, Homo Sapiens
EVTDHNLHEL

SEQ ID NO: 36440 - protein, 10 aa, Homo Sapiens
EVTEVKVSSW

SEQ ID NO: 36441 - protein, 10 aa, Homo Sapiens
EVTPQSKIAW

SEQ ID NO: 36442 - protein, 10 aa, Homo Sapiens
EVTTHILSQF

SEQ ID NO: 36443 - protein, 10 aa, Homo Sapiens
EVVAGIKEYF

SEQ ID NO: 36444 - protein, 10 aa, Homo Sapiens
EVVDFIQSKI

SEQ ID NO: 36445 - protein, 10 aa, Homo Sapiens
EVVDKKIEEF

SEQ ID NO: 36446 - protein, 10 aa, Homo Sapiens
EVVDSMVQHF

SEQ ID NO: 36447 - protein, 10 aa, Homo Sapiens
EVVEKSESGW

SEQ ID NO: 36448 - protein, 10 aa, Homo Sapiens
EVVGALVTHI

SEQ ID NO: 36449 - protein, 10 aa, Homo Sapiens
EVVGEQVTSY

SEQ ID NO: 36450 - protein, 10 aa, Homo Sapiens
EVVGYLGGRW

SEQ ID NO: 36451 - protein, 10 aa, Homo Sapiens
EVVKDGRPKW

SEQ ID NO: 36452 - protein, 10 aa, Homo Sapiens
EVVKNSVHSW

SEQ ID NO: 36453 - protein, 10 aa, Homo Sapiens
EVVPEPVARW

SEQ ID NO: 36454 - protein, 10 aa, Homo Sapiens
EVVSEPFRSF

SEQ ID NO: 36455 - protein, 10 aa, Homo Sapiens
EVYAHAGATL

SEQ ID NO: 36456 - protein, 10 aa, Homo Sapiens
EVYDPATETW

SEQ ID NO: 36457 - protein, 10 aa, Homo Sapiens
EVYDPGTNTW

SEQ ID NO: 36458 - protein, 10 aa, Homo Sapiens
EVYDPTTNAW

SEQ ID NO: 36459 - protein, 10 aa, Homo Sapiens
EVYEGEVTEL

SEQ ID NO: 36460 - protein, 10 aa, Homo Sapiens
EVYEGVYTNH

SEQ ID NO: 36461 - protein, 10 aa, Homo Sapiens
EVYEHVYETV

SEQ ID NO: 36462 - protein, 10 aa, Homo Sapiens
EVYNLESNEW

SEQ ID NO: 36463 - protein, 10 aa, Homo Sapiens
EVYPFGIVGM

SEQ ID NO: 36464 - protein, 10 aa, Homo Sapiens
EVYQGCGTEL

SEQ ID NO: 36465 - protein, 10 aa, Homo Sapiens
EVYRLAIQSF

SEQ ID NO: 36466 - protein, 10 aa, Homo Sapiens
EVYVSRPSHF

SEQ ID NO: 36467 - protein, 10 aa, Homo Sapiens
FTKTSQGRSW

SEQ ID NO: 36468 - protein, 10 aa, Homo Sapiens
FTVGPKTFSW

SEQ ID NO: 36469 - protein, 10 aa, Homo Sapiens
FVADINSGHW

SEQ ID NO: 36470 - protein, 10 aa, Homo Sapiens
FVFDKTSQSW

SEQ ID NO: 36471 - protein, 10 aa, Homo Sapiens
FVFTHSPFCW

SEQ ID NO: 36472 - protein, 10 aa, Homo Sapiens
FVIPNSTNTW

SEQ ID NO: 36473 - protein, 10 aa, Homo Sapiens
FVTEYTPRSW

SEQ ID NO: 36474 - protein, 10 aa, Homo Sapiens
GAPDAKFSGW

SEQ ID NO: 36475 - protein, 10 aa, Homo Sapiens
GAYDGKIKVW

SEQ ID NO: 36476 - protein, 10 aa, Homo Sapiens
GIGTLIYGHW

SEQ ID NO: 36477 - protein, 10 aa, Homo Sapiens
GIYEGVFKTY

SEQ ID NO: 36478 - protein, 10 aa, Homo Sapiens
GLKETQNMAW

SEQ ID NO: 36479 - protein, 10 aa, Homo Sapiens
GTYENLIHVW

SEQ ID NO: 36480 - protein, 10 aa, Homo Sapiens
GVFDHRMKCW

SEQ ID NO: 36481 - protein, 10 aa, Homo Sapiens
GVFEGKLNVI

SEQ ID NO: 36482 - protein, 10 aa, Homo Sapiens
GVIDVITKTW

SEQ ID NO: 36483 - protein, 10 aa, Homo Sapiens
GVIEKLLTSY

SEQ ID NO: 36484 - protein, 10 aa, Homo Sapiens
GVLPGKPQCW

SEQ ID NO: 36485 - protein, 10 aa, Homo Sapiens
HIISGTCASW

SEQ ID NO: 36486 - protein, 10 aa, Homo Sapiens
HIYEKSGAKW

SEQ ID NO: 36487 - protein, 10 aa, Homo Sapiens
HIYTFPHASF

SEQ ID NO: 36488 - protein, 10 aa, Homo Sapiens
HTADVQLHAW

SEQ ID NO: 36489 - protein, 10 aa, Homo Sapiens
HTAEVNCLSF

SEQ ID NO: 36490 - protein, 10 aa, Homo Sapiens
HTAPPENKTW

SEQ ID NO: 36491 - protein, 10 aa, Homo Sapiens
HTFQNDIHVY

SEQ ID NO: 36492 - protein, 10 aa, Homo Sapiens
HTIGCNAVSW

SEQ ID NO: 36493 - protein, 10 aa, Homo Sapiens
HTIKPALVGW

SEQ ID NO: 36494 - protein, 10 aa, Homo Sapiens
HTMTDDVTFW

SEQ ID NO: 36495 - protein, 10 aa, Homo Sapiens
HVADENLKAF

SEQ ID NO: 36496 - protein, 10 aa, Homo Sapiens
HVAPVTSVEW

SEQ ID NO: 36497 - protein, 10 aa, Homo Sapiens
HVATEPVATW

SEQ ID NO: 36498 - protein, 10 aa, Homo Sapiens
HVFDANTLTW

SEQ ID NO: 36499 - protein, 10 aa, Homo Sapiens
HVFEDSYREL

SEQ ID NO: 36500 - protein, 10 aa, Homo Sapiens
HVFSDGVTNW

SEQ ID NO: 36501 - protein, 10 aa, Homo Sapiens
HVHVHDLQSF

SEQ ID NO: 36502 - protein, 10 aa, Homo Sapiens
HVIEDIKGKW

SEQ ID NO: 36503 - protein, 10 aa, Homo Sapiens
HVIEDIKGRW

SEQ ID NO: 36504 - protein, 10 aa, Homo Sapiens
HVITGLLEHY

SEQ ID NO: 36505 - protein, 10 aa, Homo Sapiens
HVKDANGNSF

SEQ ID NO: 36506 - protein, 10 aa, Homo Sapiens
HVKDEQIEHW

SEQ ID NO: 36507 - protein, 10 aa, Homo Sapiens
HVKDPQSGEW

SEQ ID NO: 36508 - protein, 10 aa, Homo Sapiens
HVNTKSLISW

SEQ ID NO: 36509 - protein, 10 aa, Homo Sapiens
HVPNFIFDEF

SEQ ID NO: 36510 - protein, 10 aa, Homo Sapiens
HVQAPQIGAW

SEQ ID NO: 36511 - protein, 10 aa, Homo Sapiens
HVVDRDTEAW

SEQ ID NO: 36512 - protein, 10 aa, Homo Sapiens
HVVKERVTEW

SEQ ID NO: 36513 - protein, 10 aa, Homo Sapiens
HVVPDQLMAF

SEQ ID NO: 36514 - protein, 10 aa, Homo Sapiens
IVFDSEYCRY

SEQ ID NO: 36515 - protein, 10 aa, Homo Sapiens
LAADFEIGHF

SEQ ID NO: 36516 - protein, 10 aa, Homo Sapiens
LVFPYTHQNW

SEQ ID NO: 36517 - protein, 10 aa, Homo Sapiens
MTAGVDGHSW

SEQ ID NO: 36518 - protein, 10 aa, Homo Sapiens
MTPDQKFIQW

SEQ ID NO: 36519 - protein, 10 aa, Homo Sapiens
MVIEIPVQGW

SEQ ID NO: 36520 - protein, 10 aa, Homo Sapiens
NTFTETNNHW

SEQ ID NO: 36521 - protein, 10 aa, Homo Sapiens
NVHQSVISSW

SEQ ID NO: 36522 - protein, 10 aa, Homo Sapiens
NVIGARRASW

SEQ ID NO: 36523 - protein, 10 aa, Homo Sapiens
NVVGARRSSW

SEQ ID NO: 36524 - protein, 10 aa, Homo Sapiens
NVVGFPLNHF

SEQ ID NO: 36525 - protein, 10 aa, Homo Sapiens
NVVGGRRSAW

SEQ ID NO: 36526 - protein, 10 aa, Homo Sapiens
NVYGFDMSCI

SEQ ID NO: 36527 - protein, 10 aa, Homo Sapiens
QLIERILEAW

SEQ ID NO: 36528 - protein, 10 aa, Homo Sapiens
QTPDFTPTKY

SEQ ID NO: 36529 - protein, 10 aa, Homo Sapiens
QTVDQRLSSW

SEQ ID NO: 36530 - protein, 10 aa, Homo Sapiens
QVADAFLSKF

SEQ ID NO: 36531 - protein, 10 aa, Homo Sapiens
QVADVVVSRW

SEQ ID NO: 36532 - protein, 10 aa, Homo Sapiens
QVYHGLMERY

SEQ ID NO: 36533 - protein, 10 aa, Homo Sapiens
SIDISQSRSW

SEQ ID NO: 36534 - protein, 10 aa, Homo Sapiens
SIDYTVHEAW

SEQ ID NO: 36535 - protein, 10 aa, Homo Sapiens
SIIGVHLDTW

SEQ ID NO: 36536 - protein, 10 aa, Homo Sapiens
SIPDIQAHEW

SEQ ID NO: 36537 - protein, 10 aa, Homo Sapiens
SITDFHPDTW

SEQ ID NO: 36538 - protein, 10 aa, Homo Sapiens
SLPEHNLITW

SEQ ID NO: 36539 - protein, 10 aa, Homo Sapiens
SPAGHSFLSW

SEQ ID NO: 36540 - protein, 10 aa, Homo Sapiens
SPIDFHLQSW

SEQ ID NO: 36541 - protein, 10 aa, Homo Sapiens
SSIDHESSTW

SEQ ID NO: 36542 - protein, 10 aa, Homo Sapiens
STFDDIVHSF

SEQ ID NO: 36543 - protein, 10 aa, Homo Sapiens
STIDDTISKF

SEQ ID NO: 36544 - protein, 10 aa, Homo Sapiens
STIDWEGTSF

SEQ ID NO: 36545 - protein, 10 aa, Homo Sapiens
STPTPFFHTF

SEQ ID NO: 36546 - protein, 10 aa, Homo Sapiens
STYDGFGLAW

SEQ ID NO: 36547 - protein, 10 aa, Homo Sapiens
SVADWKVMAF

SEQ ID NO: 36548 - protein, 10 aa, Homo Sapiens
SVAEITNACF

SEQ ID NO: 36549 - protein, 10 aa, Homo Sapiens
SVAVGSGLSW

SEQ ID NO: 36550 - protein, 10 aa, Homo Sapiens
SVIDGRFEGF

SEQ ID NO: 36551 - protein, 10 aa, Homo Sapiens
SVIERQVGTF

SEQ ID NO: 36552 - protein, 10 aa, Homo Sapiens
SVKDAKIAVY

SEQ ID NO: 36553 - protein, 10 aa, Homo Sapiens
SVMQRLLTGW

SEQ ID NO: 36554 - protein, 10 aa, Homo Sapiens
SVNDGKQASW

SEQ ID NO: 36555 - protein, 10 aa, Homo Sapiens
SVPKPAFISW

SEQ ID NO: 36556 - protein, 10 aa, Homo Sapiens
SVPRGPIAQW

SEQ ID NO: 36557 - protein, 10 aa, Homo Sapiens
SVPYFLFQHW

SEQ ID NO: 36558 - protein, 10 aa, Homo Sapiens
SVVDDWIESY

SEQ ID NO: 36559 - protein, 10 aa, Homo Sapiens
SVVEKLLTNW

SEQ ID NO: 36560 - protein, 10 aa, Homo Sapiens
SVVGGFVSHY

SEQ ID NO: 36561 - protein, 10 aa, Homo Sapiens
SVVSWKTGVF

SEQ ID NO: 36562 - protein, 10 aa, Homo Sapiens
SVYAFSARPL

SEQ ID NO: 36563 - protein, 10 aa, Homo Sapiens
SVYSIVPQSW

SEQ ID NO: 36564 - protein, 10 aa, Homo Sapiens
TILPGNLQSW

SEQ ID NO: 36565 - protein, 10 aa, Homo Sapiens
TTAGFSYEKW

SEQ ID NO: 36566 - protein, 10 aa, Homo Sapiens
TTFEHDIQAL

SEQ ID NO: 36567 - protein, 10 aa, Homo Sapiens
TTPSAVFRVW

SEQ ID NO: 36568 - protein, 10 aa, Homo Sapiens
TTREPSLATW

SEQ ID NO: 36569 - protein, 10 aa, Homo Sapiens
TTVERRFSSW

SEQ ID NO: 36570 - protein, 10 aa, Homo Sapiens
TTYEGIFKTL

SEQ ID NO: 36571 - protein, 10 aa, Homo Sapiens
TVAFVPISGW

SEQ ID NO: 36572 - protein, 10 aa, Homo Sapiens
TVFGGTVTAF

SEQ ID NO: 36573 - protein, 10 aa, Homo Sapiens
TVIEEHLGKF

SEQ ID NO: 36574 - protein, 10 aa, Homo Sapiens
TVIGITPSSF

SEQ ID NO: 36575 - protein, 10 aa, Homo Sapiens
TVLPFNPAAF

SEQ ID NO: 36576 - protein, 10 aa, Homo Sapiens
TVLPGEIQNW

SEQ ID NO: 36577 - protein, 10 aa, Homo Sapiens
TVLPGELQSW

SEQ ID NO: 36578 - protein, 10 aa, Homo Sapiens
TVVERMLSNW

SEQ ID NO: 36579 - protein, 10 aa, Homo Sapiens
TVVGKTYGLW

SEQ ID NO: 36580 - protein, 10 aa, Homo Sapiens
TVYTGIDHHW

SEQ ID NO: 36581 - protein, 10 aa, Homo Sapiens
VTFPFKPESW

SEQ ID NO: 36582 - protein, 10 aa, Homo Sapiens
VVIAEPLQSW

SEQ ID NO: 36583 - protein, 10 aa, Homo Sapiens
YAADIFYSRY

SEQ ID NO: 36584 - protein, 10 aa, Homo Sapiens
YAAPHPLQSY

SEQ ID NO: 36585 - protein, 10 aa, Homo Sapiens
YIHSGLYSSF

SEQ ID NO: 36586 - protein, 10 aa, Homo Sapiens
YINPAKLTPY

SEQ ID NO: 36587 - protein, 10 aa, Homo Sapiens
YIYDKDMEII

SEQ ID NO: 36588 - protein, 10 aa, Homo Sapiens
YLPDYRMKEW

SEQ ID NO: 36589 - protein, 10 aa, Homo Sapiens
YSLEGEVTHW

SEQ ID NO: 36590 - protein, 10 aa, Homo Sapiens
YTFDQKIVEW

SEQ ID NO: 36591 - protein, 10 aa, Homo Sapiens
YVHDDGRVSY

SEQ ID NO: 36592 - protein, 10 aa, Homo Sapiens
YVIPHPVHAF

SEQ ID NO: 36593 - protein, 10 aa, Homo Sapiens
YVLESKLTEF

SEQ ID NO: 36594 - protein, 10 aa, Homo Sapiens
YVLISKPTEW

SEQ ID NO: 36595 - protein, 10 aa, Homo Sapiens
YVNCGHVTAY

SEQ ID NO: 36596 - protein, 10 aa, Homo Sapiens
YVNPANTHQF

SEQ ID NO: 36597 - protein, 11 aa, Homo Sapiens
DAADKAAVVKF

SEQ ID NO: 36598 - protein, 11 aa, Homo Sapiens
DAASGEVVGKF

SEQ ID NO: 36599 - protein, 11 aa, Homo Sapiens
DLNPRRDISSW

SEQ ID NO: 36600 - protein, 11 aa, Homo Sapiens
DLPSNHVIDRW

SEQ ID NO: 36601 - protein, 11 aa, Homo Sapiens
DSIQEFRLSGW

SEQ ID NO: 36602 - protein, 11 aa, Homo Sapiens
DTYDDRAYSSF

SEQ ID NO: 36603 - protein, 11 aa, Homo Sapiens
DVAEGDLIEHF

SEQ ID NO: 36604 - protein, 11 aa, Homo Sapiens
DVAPSTLLPSY

SEQ ID NO: 36605 - protein, 11 aa, Homo Sapiens
DVASGQVVRKF

SEQ ID NO: 36606 - protein, 11 aa, Homo Sapiens
DVGGYKLLNNW

SEQ ID NO: 36607 - protein, 11 aa, Homo Sapiens
DVIDNDSWRLW

SEQ ID NO: 36608 - protein, 11 aa, Homo Sapiens
DVIIHEISHSW

SEQ ID NO: 36609 - protein, 11 aa, Homo Sapiens
DVPDGTVVTVM

SEQ ID NO: 36610 - protein, 11 aa, Homo Sapiens
DVVDSEALQVY

SEQ ID NO: 36611 - protein, 11 aa, Homo Sapiens
DVVKEDAFYSW

SEQ ID NO: 36612 - protein, 11 aa, Homo Sapiens
DVVNKDDIIEW

SEQ ID NO: 36613 - protein, 11 aa, Homo Sapiens
DVVSGSEVLHW

SEQ ID NO: 36614 - protein, 11 aa, Homo Sapiens
EAAGSSLIGHL

SEQ ID NO: 36615 - protein, 11 aa, Homo Sapiens
EAAPGTIRGDF

SEQ ID NO: 36616 - protein, 11 aa, Homo Sapiens
EAICPEGIARL

SEQ ID NO: 36617 - protein, 11 aa, Homo Sapiens
EAIEEVKNGGW

SEQ ID NO: 36618 - protein, 11 aa, Homo Sapiens
EAIPDEVIKKW

SEQ ID NO: 36619 - protein, 11 aa, Homo Sapiens
EAVDGHTVSIF

SEQ ID NO: 36620 - protein, 11 aa, Homo Sapiens
EIAPGLTGSEW

SEQ ID NO: 36621 - protein, 11 aa, Homo Sapiens
EIIGKRGIIGY

SEQ ID NO: 36622 - protein, 11 aa, Homo Sapiens
EIPEGYVPEHW

SEQ ID NO: 36623 - protein, 11 aa, Homo Sapiens
EIYDRREYSRF

SEQ ID NO: 36624 - protein, 11 aa, Homo Sapiens
ELFPDRALSSW

SEQ ID NO: 36625 - protein, 11 aa, Homo Sapiens
ELPPSQILDTW

SEQ ID NO: 36626 - protein, 11 aa, Homo Sapiens
ETADTLMGLRY

SEQ ID NO: 36627 - protein, 11 aa, Homo Sapiens
ETAGPWGQAAW

SEQ ID NO: 36628 - protein, 11 aa, Homo Sapiens
ETASNEVVYRF

SEQ ID NO: 36629 - protein, 11 aa, Homo Sapiens
ETFGHLGALGF

SEQ ID NO: 36630 - protein, 11 aa, Homo Sapiens
ETFPDAKGWIF

SEQ ID NO: 36631 - protein, 11 aa, Homo Sapiens
ETFYNEKEESF

SEQ ID NO: 36632 - protein, 11 aa, Homo Sapiens
ETIDAHDGALW

SEQ ID NO: 36633 - protein, 11 aa, Homo Sapiens
ETIDWKVFESW

SEQ ID NO: 36634 - protein, 11 aa, Homo Sapiens
ETLPFHSGGQW

SEQ ID NO: 36635 - protein, 11 aa, Homo Sapiens
ETMDKKFGSSW

SEQ ID NO: 36636 - protein, 11 aa, Homo Sapiens
ETPDIKLFGKW

SEQ ID NO: 36637 - protein, 11 aa, Homo Sapiens
ETSPAPIPNGF

SEQ ID NO: 36638 - protein, 11 aa, Homo Sapiens
ETSQAGLFRLW

SEQ ID NO: 36639 - protein, 11 aa, Homo Sapiens
ETVDPASLWEY

SEQ ID NO: 36640 - protein, 11 aa, Homo Sapiens
ETVGEEDIRLF

SEQ ID NO: 36641 - protein, 11 aa, Homo Sapiens
ETVVERMLSNW

SEQ ID NO: 36642 - protein, 11 aa, Homo Sapiens
EVAADALGEEW

SEQ ID NO: 36643 - protein, 11 aa, Homo Sapiens
EVADEKMLSGL

SEQ ID NO: 36644 - protein, 11 aa, Homo Sapiens
EVAPAKDVTLL

SEQ ID NO: 36645 - protein, 11 aa, Homo Sapiens
EVAPGYVVTVL

SEQ ID NO: 36646 - protein, 11 aa, Homo Sapiens
EVIDKNSGGWW

SEQ ID NO: 36647 - protein, 11 aa, Homo Sapiens
EVIKLKGYTNW

SEQ ID NO: 36648 - protein, 11 aa, Homo Sapiens
EVIKLKGYTSW

SEQ ID NO: 36649 - protein, 11 aa, Homo Sapiens
EVINKEDFVAL

SEQ ID NO: 36650 - protein, 11 aa, Homo Sapiens
EVISEDAFYKW

SEQ ID NO: 36651 - protein, 11 aa, Homo Sapiens
EVIWSHAIQKY

SEQ ID NO: 36652 - protein, 11 aa, Homo Sapiens
EVKGFVRENVW

SEQ ID NO: 36653 - protein, 11 aa, Homo Sapiens
EVKGQTSGSVW

SEQ ID NO: 36654 - protein, 11 aa, Homo Sapiens
EVLPSTRLGTL

SEQ ID NO: 36655 - protein, 11 aa, Homo Sapiens
EVMDEFDGRSF

SEQ ID NO: 36656 - protein, 11 aa, Homo Sapiens
EVPENNGNNSW

SEQ ID NO: 36657 - protein, 11 aa, Homo Sapiens
EVTDEDTVKRY

SEQ ID NO: 36658 - protein, 11 aa, Homo Sapiens
EVVDARLVSVF

SEQ ID NO: 36659 - protein, 11 aa, Homo Sapiens
EVVGPEGMEKF

SEQ ID NO: 36660 - protein, 11 aa, Homo Sapiens
EVVNKDVLDVY

SEQ ID NO: 36661 - protein, 11 aa, Homo Sapiens
EVYDQEVGTSY

SEQ ID NO: 36662 - protein, 11 aa, Homo Sapiens
EVYTEEDAASY

SEQ ID NO: 36663 - protein, 11 aa, Homo Sapiens
FTAGPDEVRAW

SEQ ID NO: 36664 - protein, 11 aa, Homo Sapiens
FVYDVTKMTSF

SEQ ID NO: 36665 - protein, 11 aa, Homo Sapiens
HTAPSGVGSSW

SEQ ID NO: 36666 - protein, 11 aa, Homo Sapiens
HVAEKETLLAW

SEQ ID NO: 36667 - protein, 11 aa, Homo Sapiens
HVANGPLLHHW

SEQ ID NO: 36668 - protein, 11 aa, Homo Sapiens
HVAPDSIRGSF

SEQ ID NO: 36669 - protein, 11 aa, Homo Sapiens
HVAPSDTVLMF

SEQ ID NO: 36670 - protein, 11 aa, Homo Sapiens
HVPGADILNSY

SEQ ID NO: 36671 - protein, 11 aa, Homo Sapiens
MPVGPDAILRY

SEQ ID NO: 36672 - protein, 11 aa, Homo Sapiens
MVVPEDQLTRW

SEQ ID NO: 36673 - protein, 11 aa, Homo Sapiens
QNSGPGQPAVW

SEQ ID NO: 36674 - protein, 11 aa, Homo Sapiens
SAIDTWSPSEW

SEQ ID NO: 36675 - protein, 11 aa, Homo Sapiens
SVIDSAELQAY

SEQ ID NO: 36676 - protein, 11 aa, Homo Sapiens
SVVPPPLPATW

SEQ ID NO: 36677 - protein, 11 aa, Homo Sapiens
TLPPPKVVDRW

SEQ ID NO: 36678 - protein, 11 aa, Homo Sapiens
TTTPHTLPAAW

SEQ ID NO: 36679 - protein, 11 aa, Homo Sapiens
TVGDDKTVKQW

SEQ ID NO: 36680 - protein, 11 aa, Homo Sapiens
VGLDVTTFSKP

SEQ ID NO: 36681 - protein, 11 aa, Homo Sapiens
VPKTAENFRQF

SEQ ID NO: 36682 - protein, 11 aa, Homo Sapiens
YVIEEDKGDGW

SEQ ID NO: 36683 - protein, 8 aa, Homo Sapiens
DPDVLNSL

SEQ ID NO: 36684 - protein, 8 aa, Homo Sapiens
FEVDTVAP

SEQ ID NO: 36685 - protein, 8 aa, Homo Sapiens
FNEKSKEL

SEQ ID NO: 36686 - protein, 8 aa, Homo Sapiens
FPLKVFGY

SEQ ID NO: 36687 - protein, 8 aa, Homo Sapiens
FTGHMGKL

SEQ ID NO: 36688 - protein, 8 aa, Homo Sapiens
GKRGIIGY

SEQ ID NO: 36689 - protein, 8 aa, Homo Sapiens
IEEHLGKF

SEQ ID NO: 36690 - protein, 8 aa, Homo Sapiens
LAGHGHLY

SEQ ID NO: 36691 - protein, 8 aa, Homo Sapiens
LEQLLALY

SEQ ID NO: 36692 - protein, 8 aa, Homo Sapiens
MSLTACKV

SEQ ID NO: 36693 - protein, 8 aa, Homo Sapiens
NVKVDPEI

SEQ ID NO: 36694 - protein, 8 aa, Homo Sapiens
SPVDNHRY

SEQ ID NO: 36695 - protein, 8 aa, Homo Sapiens
TFTRVQKY

SEQ ID NO: 36696 - protein, 8 aa, Homo Sapiens
TIAKLVKY

SEQ ID NO: 36697 - protein, 8 aa, Homo Sapiens
TIRNIPHL

SEQ ID NO: 36698 - protein, 9 aa, Homo Sapiens
AIIERVQRY

SEQ ID NO: 36699 - protein, 9 aa, Homo Sapiens
APATGAHNY

SEQ ID NO: 36700 - protein, 9 aa, Homo Sapiens
ATKARIPFY

SEQ ID NO: 36701 - protein, 9 aa, Homo Sapiens
AVAEKMLQY

SEQ ID NO: 36702 - protein, 9 aa, Homo Sapiens
AVCDRISRY

SEQ ID NO: 36703 - protein, 9 aa, Homo Sapiens
AVHDITVAY

SEQ ID NO: 36704 - protein, 9 aa, Homo Sapiens
AVISSVAHY

SEQ ID NO: 36705 - protein, 9 aa, Homo Sapiens
AVISTILKY

SEQ ID NO: 36706 - protein, 9 aa, Homo Sapiens
AVKAIIYQY

SEQ ID NO: 36707 - protein, 9 aa, Homo Sapiens
AVKEKISKF

SEQ ID NO: 36708 - protein, 9 aa, Homo Sapiens
AVKEKISMF

SEQ ID NO: 36709 - protein, 9 aa, Homo Sapiens
AVKERIAKF

SEQ ID NO: 36710 - protein, 9 aa, Homo Sapiens
AVRDPYGNR

SEQ ID NO: 36711 - protein, 9 aa, Homo Sapiens
AVVNAIGLY

SEQ ID NO: 36712 - protein, 9 aa, Homo Sapiens
CAPRRKVAL

SEQ ID NO: 36713 - protein, 9 aa, Homo Sapiens
CTYDKVQSY

SEQ ID NO: 36714 - protein, 9 aa, Homo Sapiens
CVIDEIGKM

SEQ ID NO: 36715 - protein, 9 aa, Homo Sapiens
CVIKHAGVY

SEQ ID NO: 36716 - protein, 9 aa, Homo Sapiens
CVISKVLTF

SEQ ID NO: 36717 - protein, 9 aa, Homo Sapiens
CVKEEISRY

SEQ ID NO: 36718 - protein, 9 aa, Homo Sapiens
DIAQVNLKY

SEQ ID NO: 36719 - protein, 9 aa, Homo Sapiens
DIHDKFAEY

SEQ ID NO: 36720 - protein, 9 aa, Homo Sapiens
DIISKIDLM

SEQ ID NO: 36721 - protein, 9 aa, Homo Sapiens
DIISRIPKI

SEQ ID NO: 36722 - protein, 9 aa, Homo Sapiens
DIKEKLCYV

SEQ ID NO: 36723 - protein, 9 aa, Homo Sapiens
DIKPYIAEY

SEQ ID NO: 36724 - protein, 9 aa, Homo Sapiens
DIKRGIPNY

SEQ ID NO: 36725 - protein, 9 aa, Homo Sapiens
DINPHIPQY

SEQ ID NO: 36726 - protein, 9 aa, Homo Sapiens
DIPAHWSDM

SEQ ID NO: 36727 - protein, 9 aa, Homo Sapiens
DIPARVTLM

SEQ ID NO: 36728 - protein, 9 aa, Homo Sapiens
DIPERILTY

SEQ ID NO: 36729 - protein, 9 aa, Homo Sapiens
DIPETCVHY

SEQ ID NO: 36730 - protein, 9 aa, Homo Sapiens
DIPEYVLAY

SEQ ID NO: 36731 - protein, 9 aa, Homo Sapiens
DIRAFDSRF

SEQ ID NO: 36732 - protein, 9 aa, Homo Sapiens
DLANIRSEY

SEQ ID NO: 36733 - protein, 9 aa, Homo Sapiens
DLFGRDLSY

SEQ ID NO: 36734 - protein, 9 aa, Homo Sapiens
DLIEHFSQF

SEQ ID NO: 36735 - protein, 9 aa, Homo Sapiens
DLIEKLLNY

SEQ ID NO: 36736 - protein, 9 aa, Homo Sapiens
DLIGHIVEF

SEQ ID NO: 36737 - protein, 9 aa, Homo Sapiens
DLIGKTSEM

SEQ ID NO: 36738 - protein, 9 aa, Homo Sapiens
DLIKDVLRY

SEQ ID NO: 36739 - protein, 9 aa, Homo Sapiens
DLIKNIPDA

SEQ ID NO: 36740 - protein, 9 aa, Homo Sapiens
DLKDLITRM

SEQ ID NO: 36741 - protein, 9 aa, Homo Sapiens
DLKTKIQKY

SEQ ID NO: 36742 - protein, 9 aa, Homo Sapiens
DLMGLIPKY

SEQ ID NO: 36743 - protein, 9 aa, Homo Sapiens
DLPDIQIKH

SEQ ID NO: 36744 - protein, 9 aa, Homo Sapiens
DLSPITVKY

SEQ ID NO: 36745 - protein, 9 aa, Homo Sapiens
DLVTYITRF

SEQ ID NO: 36746 - protein, 9 aa, Homo Sapiens
DSIPLSSGY

SEQ ID NO: 36747 - protein, 9 aa, Homo Sapiens
DSRPGGYGY

SEQ ID NO: 36748 - protein, 9 aa, Homo Sapiens
DSSPVSTPF

SEQ ID NO: 36749 - protein, 9 aa, Homo Sapiens
DTANKVGTY

SEQ ID NO: 36750 - protein, 9 aa, Homo Sapiens
DTIARLPCL

SEQ ID NO: 36751 - protein, 9 aa, Homo Sapiens
DTIEIITDR

SEQ ID NO: 36752 - protein, 9 aa, Homo Sapiens
DTILANAKY

SEQ ID NO: 36753 - protein, 9 aa, Homo Sapiens
DTINLNSFF

SEQ ID NO: 36754 - protein, 9 aa, Homo Sapiens
DTIRMIDAY

SEQ ID NO: 36755 - protein, 9 aa, Homo Sapiens
DTISKMNDF

SEQ ID NO: 36756 - protein, 9 aa, Homo Sapiens
DTISPTLGF

SEQ ID NO: 36757 - protein, 9 aa, Homo Sapiens
DTISPYSRM

SEQ ID NO: 36758 - protein, 9 aa, Homo Sapiens
DTKEAIANY

SEQ ID NO: 36759 - protein, 9 aa, Homo Sapiens
DTKISIPAF

SEQ ID NO: 36760 - protein, 9 aa, Homo Sapiens
DTKQMMSSF

SEQ ID NO: 36761 - protein, 9 aa, Homo Sapiens
DTLAHVLYY

SEQ ID NO: 36762 - protein, 9 aa, Homo Sapiens
DTLDKVFTY

SEQ ID NO: 36763 - protein, 9 aa, Homo Sapiens
DTLPLATRY

SEQ ID NO: 36764 - protein, 9 aa, Homo Sapiens
DTMGTYHGM

SEQ ID NO: 36765 - protein, 9 aa, Homo Sapiens
DTRDYICEF

SEQ ID NO: 36766 - protein, 9 aa, Homo Sapiens
DTSGPTMRY

SEQ ID NO: 36767 - protein, 9 aa, Homo Sapiens
DTTHNLPEF

SEQ ID NO: 36768 - protein, 9 aa, Homo Sapiens
DTVHHMLLF

SEQ ID NO: 36769 - protein, 9 aa, Homo Sapiens
DTVQHGAVY

SEQ ID NO: 36770 - protein, 9 aa, Homo Sapiens
DTVSTFTSY

SEQ ID NO: 36771 - protein, 9 aa, Homo Sapiens
DVAADIAKY

SEQ ID NO: 36772 - protein, 9 aa, Homo Sapiens
DVAALLIKY

SEQ ID NO: 36773 - protein, 9 aa, Homo Sapiens
DVAAPFGGF

SEQ ID NO: 36774 - protein, 9 aa, Homo Sapiens
DVAEEIANY

SEQ ID NO: 36775 - protein, 9 aa, Homo Sapiens
DVAEFSSRY

SEQ ID NO: 36776 - protein, 9 aa, Homo Sapiens
DVAGIIADY

SEQ ID NO: 36777 - protein, 9 aa, Homo Sapiens
DVAGRVMQY

SEQ ID NO: 36778 - protein, 9 aa, Homo Sapiens
DVANKIGII

SEQ ID NO: 36779 - protein, 9 aa, Homo Sapiens
DVAPFTTKI

SEQ ID NO: 36780 - protein, 9 aa, Homo Sapiens
DVAPHVSLF

SEQ ID NO: 36781 - protein, 9 aa, Homo Sapiens
DVAPTHILY

SEQ ID NO: 36782 - protein, 9 aa, Homo Sapiens
DVARFCNRY

SEQ ID NO: 36783 - protein, 9 aa, Homo Sapiens
DVASFATKL

SEQ ID NO: 36784 - protein, 9 aa, Homo Sapiens
DVATYKVNY

SEQ ID NO: 36785 - protein, 9 aa, Homo Sapiens
DVEAIFSKY

SEQ ID NO: 36786 - protein, 9 aa, Homo Sapiens
DVFTHVLYY

SEQ ID NO: 36787 - protein, 9 aa, Homo Sapiens
DVIARIAQH

SEQ ID NO: 36788 - protein, 9 aa, Homo Sapiens
DVIDNIMRL

SEQ ID NO: 36789 - protein, 9 aa, Homo Sapiens
DVIERVIQY

SEQ ID NO: 36790 - protein, 9 aa, Homo Sapiens
DVIESVNLL

SEQ ID NO: 36791 - protein, 9 aa, Homo Sapiens
DVIETCMAY

SEQ ID NO: 36792 - protein, 9 aa, Homo Sapiens
DVIGCFADF

SEQ ID NO: 36793 - protein, 9 aa, Homo Sapiens
DVIGCFANF

SEQ ID NO: 36794 - protein, 9 aa, Homo Sapiens
DVIGKALQY

SEQ ID NO: 36795 - protein, 9 aa, Homo Sapiens
DVIGTLSGF

SEQ ID NO: 36796 - protein, 9 aa, Homo Sapiens
DVIKEIEDF

SEQ ID NO: 36797 - protein, 9 aa, Homo Sapiens
DVIQAGKEY

SEQ ID NO: 36798 - protein, 9 aa, Homo Sapiens
DVIRDVPLV

SEQ ID NO: 36799 - protein, 9 aa, Homo Sapiens
DVIRLIGQH

SEQ ID NO: 36800 - protein, 9 aa, Homo Sapiens
DVIRLIMQY

SEQ ID NO: 36801 - protein, 9 aa, Homo Sapiens
DVISKRSGY

SEQ ID NO: 36802 - protein, 9 aa, Homo Sapiens
DVISNIETF

SEQ ID NO: 36803 - protein, 9 aa, Homo Sapiens
DVISRIDRM

SEQ ID NO: 36804 - protein, 9 aa, Homo Sapiens
DVISSIRNF

SEQ ID NO: 36805 - protein, 9 aa, Homo Sapiens
DVITCFANF

SEQ ID NO: 36806 - protein, 9 aa, Homo Sapiens
DVKDLIGFF

SEQ ID NO: 36807 - protein, 9 aa, Homo Sapiens
DVKDVIEQY

SEQ ID NO: 36808 - protein, 9 aa, Homo Sapiens
DVKDYIQEY

SEQ ID NO: 36809 - protein, 9 aa, Homo Sapiens
DVKEIMSQH

SEQ ID NO: 36810 - protein, 9 aa, Homo Sapiens
DVKGQTALY

SEQ ID NO: 36811 - protein, 9 aa, Homo Sapiens
DVKKRILEF

SEQ ID NO: 36812 - protein, 9 aa, Homo Sapiens
DVKPFVPRF

SEQ ID NO: 36813 - protein, 9 aa, Homo Sapiens
DVKSLMAKY

SEQ ID NO: 36814 - protein, 9 aa, Homo Sapiens
DVKTQVAEY

SEQ ID NO: 36815 - protein, 9 aa, Homo Sapiens
DVKVGGSKY

SEQ ID NO: 36816 - protein, 9 aa, Homo Sapiens
DVMKDFEEM

SEQ ID NO: 36817 - protein, 9 aa, Homo Sapiens
DVPDGILDF

SEQ ID NO: 36818 - protein, 9 aa, Homo Sapiens
DVPEKSSLF

SEQ ID NO: 36819 - protein, 9 aa, Homo Sapiens
DVPEKWARF

SEQ ID NO: 36820 - protein, 9 aa, Homo Sapiens
DVPELQDKF

SEQ ID NO: 36821 - protein, 9 aa, Homo Sapiens
DVQELLTQY

SEQ ID NO: 36822 - protein, 9 aa, Homo Sapiens
DVRDECSKY

SEQ ID NO: 36823 - protein, 9 aa, Homo Sapiens
DVSPVVSTY

SEQ ID NO: 36824 - protein, 9 aa, Homo Sapiens
DVTDFISHL

SEQ ID NO: 36825 - protein, 9 aa, Homo Sapiens
DVTEQISRF

SEQ ID NO: 36826 - protein, 9 aa, Homo Sapiens
DVTSANAKY

SEQ ID NO: 36827 - protein, 9 aa, Homo Sapiens
DVVDFFQKY

SEQ ID NO: 36828 - protein, 9 aa, Homo Sapiens
DVVEKLNLF

SEQ ID NO: 36829 - protein, 9 aa, Homo Sapiens
DVVFLITKY

SEQ ID NO: 36830 - protein, 9 aa, Homo Sapiens
DVVGDTSGY

SEQ ID NO: 36831 - protein, 9 aa, Homo Sapiens
DVVKKIESF

SEQ ID NO: 36832 - protein, 9 aa, Homo Sapiens
DVVRVVGAY

SEQ ID NO: 36833 - protein, 9 aa, Homo Sapiens
DVYGGTNRY

SEQ ID NO: 36834 - protein, 9 aa, Homo Sapiens
DVYNHFLLY

SEQ ID NO: 36835 - protein, 9 aa, Homo Sapiens
EAAEVILRV

SEQ ID NO: 36836 - protein, 9 aa, Homo Sapiens
EAAPHDIGY

SEQ ID NO: 36837 - protein, 9 aa, Homo Sapiens
EAAPPGELY

SEQ ID NO: 36838 - protein, 9 aa, Homo Sapiens
EAASVPVVY

SEQ ID NO: 36839 - protein, 9 aa, Homo Sapiens
EAFDSTSRF

SEQ ID NO: 36840 - protein, 9 aa, Homo Sapiens
EAFRGVHRY

SEQ ID NO: 36841 - protein, 9 aa, Homo Sapiens
EAIARYQGR

SEQ ID NO: 36842 - protein, 9 aa, Homo Sapiens
EAIEQILKY

SEQ ID NO: 36843 - protein, 9 aa, Homo Sapiens
EAIGIISKM

SEQ ID NO: 36844 - protein, 9 aa, Homo Sapiens
EAIMKVGQM

SEQ ID NO: 36845 - protein, 9 aa, Homo Sapiens
EAIQRTEAY

SEQ ID NO: 36846 - protein, 9 aa, Homo Sapiens
EAIRPYVSR

SEQ ID NO: 36847 - protein, 9 aa, Homo Sapiens
EAISYYSKY

SEQ ID NO: 36848 - protein, 9 aa, Homo Sapiens
EAMHGVFLY

SEQ ID NO: 36849 - protein, 9 aa, Homo Sapiens
EATYVRSYY

SEQ ID NO: 36850 - protein, 9 aa, Homo Sapiens
EAVDIRQIY

SEQ ID NO: 36851 - protein, 9 aa, Homo Sapiens
EAVQAISMF

SEQ ID NO: 36852 - protein, 9 aa, Homo Sapiens
EAVTHIGRV

SEQ ID NO: 36853 - protein, 9 aa, Homo Sapiens
EAVWRLPEF

SEQ ID NO: 36854 - protein, 9 aa, Homo Sapiens
EAYHSVIKY

SEQ ID NO: 36855 - protein, 9 aa, Homo Sapiens
EAYNAVVRY

SEQ ID NO: 36856 - protein, 9 aa, Homo Sapiens
EIADIKSKY

SEQ ID NO: 36857 - protein, 9 aa, Homo Sapiens
EIAEAYLGY

SEQ ID NO: 36858 - protein, 9 aa, Homo Sapiens
EIAEKMATF

SEQ ID NO: 36859 - protein, 9 aa, Homo Sapiens
EIAGHIMEF

SEQ ID NO: 36860 - protein, 9 aa, Homo Sapiens
EIAGVKLLY

SEQ ID NO: 36861 - protein, 9 aa, Homo Sapiens
EIAQVGAKY

SEQ ID NO: 36862 - protein, 9 aa, Homo Sapiens
EIASTDLKY

SEQ ID NO: 36863 - protein, 9 aa, Homo Sapiens
EIFQHLMAY

SEQ ID NO: 36864 - protein, 9 aa, Homo Sapiens
EIIARIAQH

SEQ ID NO: 36865 - protein, 9 aa, Homo Sapiens
EIIEDLAFY

SEQ ID NO: 36866 - protein, 9 aa, Homo Sapiens
EIIEKDTKY

SEQ ID NO: 36867 - protein, 9 aa, Homo Sapiens
EIIEKNFDY

SEQ ID NO: 36868 - protein, 9 aa, Homo Sapiens
EIIGPYASW

SEQ ID NO: 36869 - protein, 9 aa, Homo Sapiens
EIIKEISIM

SEQ ID NO: 36870 - protein, 9 aa, Homo Sapiens
EIIKIIGKY

SEQ ID NO: 36871 - protein, 9 aa, Homo Sapiens
EIIKLIADY

SEQ ID NO: 36872 - protein, 9 aa, Homo Sapiens
EIIKNVPLK

SEQ ID NO: 36873 - protein, 9 aa, Homo Sapiens
EIIPVAAEY

SEQ ID NO: 36874 - protein, 9 aa, Homo Sapiens
EIIQDLAAM

SEQ ID NO: 36875 - protein, 9 aa, Homo Sapiens
EIISEISKL

SEQ ID NO: 36876 - protein, 9 aa, Homo Sapiens
EIISHISQH

SEQ ID NO: 36877 - protein, 9 aa, Homo Sapiens
EIKDILIQY

SEQ ID NO: 36878 - protein, 9 aa, Homo Sapiens
EIKEKICDY

SEQ ID NO: 36879 - protein, 9 aa, Homo Sapiens
EIKERIERV

SEQ ID NO: 36880 - protein, 9 aa, Homo Sapiens
EIKETLRQY

SEQ ID NO: 36881 - protein, 9 aa, Homo Sapiens
EIKEVILEF

SEQ ID NO: 36882 - protein, 9 aa, Homo Sapiens
EIKQIVSEY

SEQ ID NO: 36883 - protein, 9 aa, Homo Sapiens
EIKQKIDSY

SEQ ID NO: 36884 - protein, 9 aa, Homo Sapiens
EIMTRIQTY

SEQ ID NO: 36885 - protein, 9 aa, Homo Sapiens
EIPGKFMGY

SEQ ID NO: 36886 - protein, 9 aa, Homo Sapiens
EIPHEVGDF

SEQ ID NO: 36887 - protein, 9 aa, Homo Sapiens
EIPVGICRY

SEQ ID NO: 36888 - protein, 9 aa, Homo Sapiens
EIRDIILGM

SEQ ID NO: 36889 - protein, 9 aa, Homo Sapiens
EISDIHTKL

SEQ ID NO: 36890 - protein, 9 aa, Homo Sapiens
EISSIISKM

SEQ ID NO: 36891 - protein, 9 aa, Homo Sapiens
EITDKLGLH

SEQ ID NO: 36892 - protein, 9 aa, Homo Sapiens
EIVEKIGVH

SEQ ID NO: 36893 - protein, 9 aa, Homo Sapiens
EIVEKILSV

SEQ ID NO: 36894 - protein, 9 aa, Homo Sapiens
EIVKEVSTY

SEQ ID NO: 36895 - protein, 9 aa, Homo Sapiens
EIVNISSGY

SEQ ID NO: 36896 - protein, 9 aa, Homo Sapiens
EIVPKVAKM

SEQ ID NO: 36897 - protein, 9 aa, Homo Sapiens
EIVPRLPDY

SEQ ID NO: 36898 - protein, 9 aa, Homo Sapiens
EIYSKTTRF

SEQ ID NO: 36899 - protein, 9 aa, Homo Sapiens
EIYSYITKY

SEQ ID NO: 36900 - protein, 9 aa, Homo Sapiens
ELAKQITSY

SEQ ID NO: 36901 - protein, 9 aa, Homo Sapiens
ELANIRSKF

SEQ ID NO: 36902 - protein, 9 aa, Homo Sapiens
ELAPSLPSY

SEQ ID NO: 36903 - protein, 9 aa, Homo Sapiens
ELIAKIPNF

SEQ ID NO: 36904 - protein, 9 aa, Homo Sapiens
ELICHIGSL

SEQ ID NO: 36905 - protein, 9 aa, Homo Sapiens
ELIERIPEL

SEQ ID NO: 36906 - protein, 9 aa, Homo Sapiens
ELIESMPLL

SEQ ID NO: 36907 - protein, 9 aa, Homo Sapiens
ELIETIQEM

SEQ ID NO: 36908 - protein, 9 aa, Homo Sapiens
ELINNVAKA

SEQ ID NO: 36909 - protein, 9 aa, Homo Sapiens
ELIPEYLNF

SEQ ID NO: 36910 - protein, 9 aa, Homo Sapiens
ELIRKIEAY

SEQ ID NO: 36911 - protein, 9 aa, Homo Sapiens
ELIRYISEL

SEQ ID NO: 36912 - protein, 9 aa, Homo Sapiens
ELITKFLQY

SEQ ID NO: 36913 - protein, 9 aa, Homo Sapiens
ELKEKLTEY

SEQ ID NO: 36914 - protein, 9 aa, Homo Sapiens
ELKESLSRM

SEQ ID NO: 36915 - protein, 9 aa, Homo Sapiens
ELKEVIERF

SEQ ID NO: 36916 - protein, 9 aa, Homo Sapiens
ELKHFIAEY

SEQ ID NO: 36917 - protein, 9 aa, Homo Sapiens
ELKKLIGEV

SEQ ID NO: 36918 - protein, 9 aa, Homo Sapiens
ELKKTMALF

SEQ ID NO: 36919 - protein, 9 aa, Homo Sapiens
ELKKVVALY

SEQ ID NO: 36920 - protein, 9 aa, Homo Sapiens
ELKTKISAM

SEQ ID NO: 36921 - protein, 9 aa, Homo Sapiens
ELMAHLTEM

SEQ ID NO: 36922 - protein, 9 aa, Homo Sapiens
ELMQKVSGY

SEQ ID NO: 36923 - protein, 9 aa, Homo Sapiens
ELPDNILNF

SEQ ID NO: 36924 - protein, 9 aa, Homo Sapiens
ELPDTVGEL

SEQ ID NO: 36925 - protein, 9 aa, Homo Sapiens
ELPDYLIKY

SEQ ID NO: 36926 - protein, 9 aa, Homo Sapiens
ELQGHIGRF

SEQ ID NO: 36927 - protein, 9 aa, Homo Sapiens
ELVDLIPEY

SEQ ID NO: 36928 - protein, 9 aa, Homo Sapiens
ELVERLQSY

SEQ ID NO: 36929 - protein, 9 aa, Homo Sapiens
ELVKKIAIY

SEQ ID NO: 36930 - protein, 9 aa, Homo Sapiens
ELVKRILNF

SEQ ID NO: 36931 - protein, 9 aa, Homo Sapiens
ELVTIIPNF

SEQ ID NO: 36932 - protein, 9 aa, Homo Sapiens
ELYHQSVVY

SEQ ID NO: 36933 - protein, 9 aa, Homo Sapiens
EMKEYITKF

SEQ ID NO: 36934 - protein, 9 aa, Homo Sapiens
ENRPKYAGY

SEQ ID NO: 36935 - protein, 9 aa, Homo Sapiens
EPIYIITEY

SEQ ID NO: 36936 - protein, 9 aa, Homo Sapiens
EPIYIVTEY

SEQ ID NO: 36937 - protein, 9 aa, Homo Sapiens
EPVQRIPRY

SEQ ID NO: 36938 - protein, 9 aa, Homo Sapiens
EPVQRVPRY

SEQ ID NO: 36939 - protein, 9 aa, Homo Sapiens
ESADFCNKY

SEQ ID NO: 36940 - protein, 9 aa, Homo Sapiens
ESADLIQHY

SEQ ID NO: 36941 - protein, 9 aa, Homo Sapiens
ESAPVHNSF

SEQ ID NO: 36942 - protein, 9 aa, Homo Sapiens
ESFEDGLKY

SEQ ID NO: 36943 - protein, 9 aa, Homo Sapiens
ESIDIITRA

SEQ ID NO: 36944 - protein, 9 aa, Homo Sapiens
ESSSVVLRY

SEQ ID NO: 36945 - protein, 9 aa, Homo Sapiens
ESSYIATQY

SEQ ID NO: 36946 - protein, 9 aa, Homo Sapiens
ETAAKVALM

SEQ ID NO: 36947 - protein, 9 aa, Homo Sapiens
ETADITHAL

SEQ ID NO: 36948 - protein, 9 aa, Homo Sapiens
ETADVIAKV

SEQ ID NO: 36949 - protein, 9 aa, Homo Sapiens
ETAEKLARF

SEQ ID NO: 36950 - protein, 9 aa, Homo Sapiens
ETAENYLGH

SEQ ID NO: 36951 - protein, 9 aa, Homo Sapiens
ETAFGYKGL

SEQ ID NO: 36952 - protein, 9 aa, Homo Sapiens
ETAGAIMAF

SEQ ID NO: 36953 - protein, 9 aa, Homo Sapiens
ETAGIPSTF

SEQ ID NO: 36954 - protein, 9 aa, Homo Sapiens
ETAGRYITY

SEQ ID NO: 36955 - protein, 9 aa, Homo Sapiens
ETAIYKGDY

SEQ ID NO: 36956 - protein, 9 aa, Homo Sapiens
ETALLSSGF

SEQ ID NO: 36957 - protein, 9 aa, Homo Sapiens
ETAPKSEEF

SEQ ID NO: 36958 - protein, 9 aa, Homo Sapiens
ETAPRLPQH

SEQ ID NO: 36959 - protein, 9 aa, Homo Sapiens
ETAQAIKGM

SEQ ID NO: 36960 - protein, 9 aa, Homo Sapiens
ETASRIAKV

SEQ ID NO: 36961 - protein, 9 aa, Homo Sapiens
ETATLRSGY

SEQ ID NO: 36962 - protein, 9 aa, Homo Sapiens
ETAVAILRF

SEQ ID NO: 36963 - protein, 9 aa, Homo Sapiens
ETAVLLGSY

SEQ ID NO: 36964 - protein, 9 aa, Homo Sapiens
ETAVVNVTY

SEQ ID NO: 36965 - protein, 9 aa, Homo Sapiens
ETAWRWPEF

SEQ ID NO: 36966 - protein, 9 aa, Homo Sapiens
ETCHISNLF

SEQ ID NO: 36967 - protein, 9 aa, Homo Sapiens
ETEQKRLGL

SEQ ID NO: 36968 - protein, 9 aa, Homo Sapiens
ETFEKSRLY

SEQ ID NO: 36969 - protein, 9 aa, Homo Sapiens
ETFHHSSNW

SEQ ID NO: 36970 - protein, 9 aa, Homo Sapiens
ETFNHANGL

SEQ ID NO: 36971 - protein, 9 aa, Homo Sapiens
ETFNTPAMY

SEQ ID NO: 36972 - protein, 9 aa, Homo Sapiens
ETFNVPAMY

SEQ ID NO: 36973 - protein, 9 aa, Homo Sapiens
ETFPGVTAL

SEQ ID NO: 36974 - protein, 9 aa, Homo Sapiens
ETFTRVQKY

SEQ ID NO: 36975 - protein, 9 aa, Homo Sapiens
ETFYSTERY

SEQ ID NO: 36976 - protein, 9 aa, Homo Sapiens
ETIAKLVKY

SEQ ID NO: 36977 - protein, 9 aa, Homo Sapiens
ETIAKYEIM

SEQ ID NO: 36978 - protein, 9 aa, Homo Sapiens
ETIDRFNNY

SEQ ID NO: 36979 - protein, 9 aa, Homo Sapiens
ETIDVHSGY

SEQ ID NO: 36980 - protein, 9 aa, Homo Sapiens
ETIERLQQL

SEQ ID NO: 36981 - protein, 9 aa, Homo Sapiens
ETIESINQL

SEQ ID NO: 36982 - protein, 9 aa, Homo Sapiens
ETIETINQL

SEQ ID NO: 36983 - protein, 9 aa, Homo Sapiens
ETIFSISKA

SEQ ID NO: 36984 - protein, 9 aa, Homo Sapiens
ETIGKYWAA

SEQ ID NO: 36985 - protein, 9 aa, Homo Sapiens
ETIHPRKSY

SEQ ID NO: 36986 - protein, 9 aa, Homo Sapiens
ETIKDLPKM

SEQ ID NO: 36987 - protein, 9 aa, Homo Sapiens
ETINRIKLY

SEQ ID NO: 36988 - protein, 9 aa, Homo Sapiens
ETIPKAVSF

SEQ ID NO: 36989 - protein, 9 aa, Homo Sapiens
ETIQHTEAF

SEQ ID NO: 36990 - protein, 9 aa, Homo Sapiens
ETIQITQKY

SEQ ID NO: 36991 - protein, 9 aa, Homo Sapiens
ETIQNMSKV

SEQ ID NO: 36992 - protein, 9 aa, Homo Sapiens
ETIQVHRRY

SEQ ID NO: 36993 - protein, 9 aa, Homo Sapiens
ETIRNIDCY

SEQ ID NO: 36994 - protein, 9 aa, Homo Sapiens
ETIRNILLH

SEQ ID NO: 36995 - protein, 9 aa, Homo Sapiens
ETIRNIPHL

SEQ ID NO: 36996 - protein, 9 aa, Homo Sapiens
ETISKAQAF

SEQ ID NO: 36997 - protein, 9 aa, Homo Sapiens
ETITVSPEY

SEQ ID NO: 36998 - protein, 9 aa, Homo Sapiens
ETIVIINKF

SEQ ID NO: 36999 - protein, 9 aa, Homo Sapiens
ETIVNVLDF

SEQ ID NO: 37000 - protein, 9 aa, Homo Sapiens
ETKEAMSEM

SEQ ID NO: 37001 - protein, 9 aa, Homo Sapiens
ETMHTLLDY

SEQ ID NO: 37002 - protein, 9 aa, Homo Sapiens
ETNGFISAH

SEQ ID NO: 37003 - protein, 9 aa, Homo Sapiens
ETPDYLLKY

SEQ ID NO: 37004 - protein, 9 aa, Homo Sapiens
ETPEMLPAY

SEQ ID NO: 37005 - protein, 9 aa, Homo Sapiens
ETPRSVPGF

SEQ ID NO: 37006 - protein, 9 aa, Homo Sapiens
ETQIGGERY

SEQ ID NO: 37007 - protein, 9 aa, Homo Sapiens
ETSPIVLRY

SEQ ID NO: 37008 - protein, 9 aa, Homo Sapiens
ETTAVALAY

SEQ ID NO: 37009 - protein, 9 aa, Homo Sapiens
ETTDIISRH

SEQ ID NO: 37010 - protein, 9 aa, Homo Sapiens
ETTEAACRY

SEQ ID NO: 37011 - protein, 9 aa, Homo Sapiens
ETTKIVSEM

SEQ ID NO: 37012 - protein, 9 aa, Homo Sapiens
ETTSIATAR

SEQ ID NO: 37013 - protein, 9 aa, Homo Sapiens
ETTVLVESY

SEQ ID NO: 37014 - protein, 9 aa, Homo Sapiens
ETVEHHTEF

SEQ ID NO: 37015 - protein, 9 aa, Homo Sapiens
ETVGKFIQY

SEQ ID NO: 37016 - protein, 9 aa, Homo Sapiens
ETVKEIKEV

SEQ ID NO: 37017 - protein, 9 aa, Homo Sapiens
ETVLKTTGY

SEQ ID NO: 37018 - protein, 9 aa, Homo Sapiens
ETVNVITLY

SEQ ID NO: 37019 - protein, 9 aa, Homo Sapiens
ETVPKVSIV

SEQ ID NO: 37020 - protein, 9 aa, Homo Sapiens
ETVQTTLKF

SEQ ID NO: 37021 - protein, 9 aa, Homo Sapiens
ETVRELTEF

SEQ ID NO: 37022 - protein, 9 aa, Homo Sapiens
ETVSGLKGY

SEQ ID NO: 37023 - protein, 9 aa, Homo Sapiens
ETVSRVSSV

SEQ ID NO: 37024 - protein, 9 aa, Homo Sapiens
ETVVRYEKF

SEQ ID NO: 37025 - protein, 9 aa, Homo Sapiens
ETVWHLEEF

SEQ ID NO: 37026 - protein, 9 aa, Homo Sapiens
ETVWRLEEF

SEQ ID NO: 37027 - protein, 9 aa, Homo Sapiens
ETYGHKTPY

SEQ ID NO: 37028 - protein, 9 aa, Homo Sapiens
ETYGKIVHY

SEQ ID NO: 37029 - protein, 9 aa, Homo Sapiens
ETYIRSGTY

SEQ ID NO: 37030 - protein, 9 aa, Homo Sapiens
ETYQFSGVY

SEQ ID NO: 37031 - protein, 9 aa, Homo Sapiens
ETYSNLIKL

SEQ ID NO: 37032 - protein, 9 aa, Homo Sapiens
EVAAAIAGY

SEQ ID NO: 37033 - protein, 9 aa, Homo Sapiens
EVAATEIKM

SEQ ID NO: 37034 - protein, 9 aa, Homo Sapiens
EVAAVLLHF

SEQ ID NO: 37035 - protein, 9 aa, Homo Sapiens
EVADRIGDY

SEQ ID NO: 37036 - protein, 9 aa, Homo Sapiens
EVADVGIEV

SEQ ID NO: 37037 - protein, 9 aa, Homo Sapiens
EVAEAITQF

SEQ ID NO: 37038 - protein, 9 aa, Homo Sapiens
EVAEFLARH

SEQ ID NO: 37039 - protein, 9 aa, Homo Sapiens
EVAEHVQYM

SEQ ID NO: 37040 - protein, 9 aa, Homo Sapiens
EVAGFGESR

SEQ ID NO: 37041 - protein, 9 aa, Homo Sapiens
EVAGHLRTY

SEQ ID NO: 37042 - protein, 9 aa, Homo Sapiens
EVAGIVAAR

SEQ ID NO: 37043 - protein, 9 aa, Homo Sapiens
EVAIRLLEM

SEQ ID NO: 37044 - protein, 9 aa, Homo Sapiens
EVAKKLCSF

SEQ ID NO: 37045 - protein, 9 aa, Homo Sapiens
EVANKFAKA

SEQ ID NO: 37046 - protein, 9 aa, Homo Sapiens
EVAPAGASY

SEQ ID NO: 37047 - protein, 9 aa, Homo Sapiens
EVAPALSVF

SEQ ID NO: 37048 - protein, 9 aa, Homo Sapiens
EVAPHPVYY

SEQ ID NO: 37049 - protein, 9 aa, Homo Sapiens
EVAPRLAFA

SEQ ID NO: 37050 - protein, 9 aa, Homo Sapiens
EVAPVISSA

SEQ ID NO: 37051 - protein, 9 aa, Homo Sapiens
EVAQMAAYY

SEQ ID NO: 37052 - protein, 9 aa, Homo Sapiens
EVASNITSF

SEQ ID NO: 37053 - protein, 9 aa, Homo Sapiens
EVASNMARF

SEQ ID NO: 37054 - protein, 9 aa, Homo Sapiens
EVASNVPKV

SEQ ID NO: 37055 - protein, 9 aa, Homo Sapiens
EVASVYQSY

SEQ ID NO: 37056 - protein, 9 aa, Homo Sapiens
EVATFYTMY

SEQ ID NO: 37057 - protein, 9 aa, Homo Sapiens
EVATRMQSF

SEQ ID NO: 37058 - protein, 9 aa, Homo Sapiens
EVCKELHRF

SEQ ID NO: 37059 - protein, 9 aa, Homo Sapiens
EVCRAVLSF

SEQ ID NO: 37060 - protein, 9 aa, Homo Sapiens
EVFDKTYQF

SEQ ID NO: 37061 - protein, 9 aa, Homo Sapiens
EVFEHTVLY

SEQ ID NO: 37062 - protein, 9 aa, Homo Sapiens
EVFESVSAY

SEQ ID NO: 37063 - protein, 9 aa, Homo Sapiens
EVFGRVERY

SEQ ID NO: 37064 - protein, 9 aa, Homo Sapiens
EVFGRVSRF

SEQ ID NO: 37065 - protein, 9 aa, Homo Sapiens
EVFGYLAKY

SEQ ID NO: 37066 - protein, 9 aa, Homo Sapiens
EVFPLAMNY

SEQ ID NO: 37067 - protein, 9 aa, Homo Sapiens
EVFTEILNY

SEQ ID NO: 37068 - protein, 9 aa, Homo Sapiens
EVGGEALGR

SEQ ID NO: 37069 - protein, 9 aa, Homo Sapiens
EVGPAGSQF

SEQ ID NO: 37070 - protein, 9 aa, Homo Sapiens
EVGPKFRGV

SEQ ID NO: 37071 - protein, 9 aa, Homo Sapiens
EVHDLERKY

SEQ ID NO: 37072 - protein, 9 aa, Homo Sapiens
EVHDYIRAY

SEQ ID NO: 37073 - protein, 9 aa, Homo Sapiens
EVHTIPAKM

SEQ ID NO: 37074 - protein, 9 aa, Homo Sapiens
EVIAKNNSF

SEQ ID NO: 37075 - protein, 9 aa, Homo Sapiens
EVIDFSHGL

SEQ ID NO: 37076 - protein, 9 aa, Homo Sapiens
EVIDKCQSF

SEQ ID NO: 37077 - protein, 9 aa, Homo Sapiens
EVIDKYTAV

SEQ ID NO: 37078 - protein, 9 aa, Homo Sapiens
EVIDVFEIM

SEQ ID NO: 37079 - protein, 9 aa, Homo Sapiens
EVIDVVRTM

SEQ ID NO: 37080 - protein, 9 aa, Homo Sapiens
EVIEGYEIA

SEQ ID NO: 37081 - protein, 9 aa, Homo Sapiens
EVIEIMTDR

SEQ ID NO: 37082 - protein, 9 aa, Homo Sapiens
EVIEKFDYV

SEQ ID NO: 37083 - protein, 9 aa, Homo Sapiens
EVIEKTSYL

SEQ ID NO: 37084 - protein, 9 aa, Homo Sapiens
EVIEQIENL

SEQ ID NO: 37085 - protein, 9 aa, Homo Sapiens
EVIGAYKQA

SEQ ID NO: 37086 - protein, 9 aa, Homo Sapiens
EVIGESMEM

SEQ ID NO: 37087 - protein, 9 aa, Homo Sapiens
EVIGGADKY

SEQ ID NO: 37088 - protein, 9 aa, Homo Sapiens
EVIGKITAL

SEQ ID NO: 37089 - protein, 9 aa, Homo Sapiens
EVIGRVPQA

SEQ ID NO: 37090 - protein, 9 aa, Homo Sapiens
EVIHNLPDF

SEQ ID NO: 37091 - protein, 9 aa, Homo Sapiens
EVIKDANLY

SEQ ID NO: 37092 - protein, 9 aa, Homo Sapiens
EVIKELAQI

SEQ ID NO: 37093 - protein, 9 aa, Homo Sapiens
EVIKEVQEF

SEQ ID NO: 37094 - protein, 9 aa, Homo Sapiens
EVIKNFIQY

SEQ ID NO: 37095 - protein, 9 aa, Homo Sapiens
EVIKSMKPK

SEQ ID NO: 37096 - protein, 9 aa, Homo Sapiens
EVINDYHFR

SEQ ID NO: 37097 - protein, 9 aa, Homo Sapiens
EVINRIQKL

SEQ ID NO: 37098 - protein, 9 aa, Homo Sapiens
EVIPLVQTF

SEQ ID NO: 37099 - protein, 9 aa, Homo Sapiens
EVIPNSNFY

SEQ ID NO: 37100 - protein, 9 aa, Homo Sapiens
EVIPPMKEF

SEQ ID NO: 37101 - protein, 9 aa, Homo Sapiens
EVIPPYYSY

SEQ ID NO: 37102 - protein, 9 aa, Homo Sapiens
EVIPTHTVY

SEQ ID NO: 37103 - protein, 9 aa, Homo Sapiens
EVIPYTPAM

SEQ ID NO: 37104 - protein, 9 aa, Homo Sapiens
EVIQALPKL

SEQ ID NO: 37105 - protein, 9 aa, Homo Sapiens
EVIQEIKSF

SEQ ID NO: 37106 - protein, 9 aa, Homo Sapiens
EVIQNMTEF

SEQ ID NO: 37107 - protein, 9 aa, Homo Sapiens
EVIQPYQEF

SEQ ID NO: 37108 - protein, 9 aa, Homo Sapiens
EVIQWLAKL

SEQ ID NO: 37109 - protein, 9 aa, Homo Sapiens
EVIRELICY

SEQ ID NO: 37110 - protein, 9 aa, Homo Sapiens
EVIRILSTM

SEQ ID NO: 37111 - protein, 9 aa, Homo Sapiens
EVIRLIANF

SEQ ID NO: 37112 - protein, 9 aa, Homo Sapiens
EVIRQAGVY

SEQ ID NO: 37113 - protein, 9 aa, Homo Sapiens
EVIRTLPSL

SEQ ID NO: 37114 - protein, 9 aa, Homo Sapiens
EVISHIGKL

SEQ ID NO: 37115 - protein, 9 aa, Homo Sapiens
EVISKLYAV

SEQ ID NO: 37116 - protein, 9 aa, Homo Sapiens
EVISKTPTL

SEQ ID NO: 37117 - protein, 9 aa, Homo Sapiens
EVISKYDQF

SEQ ID NO: 37118 - protein, 9 aa, Homo Sapiens
EVISLINTR

SEQ ID NO: 37119 - protein, 9 aa, Homo Sapiens
EVISSLEKY

SEQ ID NO: 37120 - protein, 9 aa, Homo Sapiens
EVISSVSEL

SEQ ID NO: 37121 - protein, 9 aa, Homo Sapiens
EVISVLQKY

SEQ ID NO: 37122 - protein, 9 aa, Homo Sapiens
EVIVGVNKY

SEQ ID NO: 37123 - protein, 9 aa, Homo Sapiens
EVKARLQKY

SEQ ID NO: 37124 - protein, 9 aa, Homo Sapiens
EVKDKVPSL

SEQ ID NO: 37125 - protein, 9 aa, Homo Sapiens
EVKEDIAKL

SEQ ID NO: 37126 - protein, 9 aa, Homo Sapiens
EVKKLMRKY

SEQ ID NO: 37127 - protein, 9 aa, Homo Sapiens
EVKKTLQQF

SEQ ID NO: 37128 - protein, 9 aa, Homo Sapiens
EVKLEIPSF

SEQ ID NO: 37129 - protein, 9 aa, Homo Sapiens
EVKLKVDSF

SEQ ID NO: 37130 - protein, 9 aa, Homo Sapiens
EVKPVLPEL

SEQ ID NO: 37131 - protein, 9 aa, Homo Sapiens
EVKQKLQEF

SEQ ID NO: 37132 - protein, 9 aa, Homo Sapiens
EVKRLIAEA

SEQ ID NO: 37133 - protein, 9 aa, Homo Sapiens
EVKSHLLDY

SEQ ID NO: 37134 - protein, 9 aa, Homo Sapiens
EVKSRTTLF

SEQ ID NO: 37135 - protein, 9 aa, Homo Sapiens
EVLGILRYI

SEQ ID NO: 37136 - protein, 9 aa, Homo Sapiens
EVLKAVTAL

SEQ ID NO: 37137 - protein, 9 aa, Homo Sapiens
EVLNFLLRY

SEQ ID NO: 37138 - protein, 9 aa, Homo Sapiens
EVMDVFLRF

SEQ ID NO: 37139 - protein, 9 aa, Homo Sapiens
EVMEIMSRF

SEQ ID NO: 37140 - protein, 9 aa, Homo Sapiens
EVMEQVRGY

SEQ ID NO: 37141 - protein, 9 aa, Homo Sapiens
EVMPKICRL

SEQ ID NO: 37142 - protein, 9 aa, Homo Sapiens
EVMPLFAGY

SEQ ID NO: 37143 - protein, 9 aa, Homo Sapiens
EVMQKYIRY

SEQ ID NO: 37144 - protein, 9 aa, Homo Sapiens
EVMRILPRM

SEQ ID NO: 37145 - protein, 9 aa, Homo Sapiens
EVNEWFTKY

SEQ ID NO: 37146 - protein, 9 aa, Homo Sapiens
EVNGLISMY

SEQ ID NO: 37147 - protein, 9 aa, Homo Sapiens
EVNKFQMAY

SEQ ID NO: 37148 - protein, 9 aa, Homo Sapiens
EVNKVISSV

SEQ ID NO: 37149 - protein, 9 aa, Homo Sapiens
EVPDYSMAY

SEQ ID NO: 37150 - protein, 9 aa, Homo Sapiens
EVPEKIAEL

SEQ ID NO: 37151 - protein, 9 aa, Homo Sapiens
EVPGHQSVF

SEQ ID NO: 37152 - protein, 9 aa, Homo Sapiens
EVPHEVAQY

SEQ ID NO: 37153 - protein, 9 aa, Homo Sapiens
EVPHEVGDF

SEQ ID NO: 37154 - protein, 9 aa, Homo Sapiens
EVPHFHHEL

SEQ ID NO: 37155 - protein, 9 aa, Homo Sapiens
EVPNTVHQF

SEQ ID NO: 37156 - protein, 9 aa, Homo Sapiens
EVQDSYEAY

SEQ ID NO: 37157 - protein, 9 aa, Homo Sapiens
EVRGGGLTR

SEQ ID NO: 37158 - protein, 9 aa, Homo Sapiens
EVRQGLKAY

SEQ ID NO: 37159 - protein, 9 aa, Homo Sapiens
EVRTGGMAF

SEQ ID NO: 37160 - protein, 9 aa, Homo Sapiens
EVRWFQSQF

SEQ ID NO: 37161 - protein, 9 aa, Homo Sapiens
EVSAATGRF

SEQ ID NO: 37162 - protein, 9 aa, Homo Sapiens
EVSDRISSL

SEQ ID NO: 37163 - protein, 9 aa, Homo Sapiens
EVSEQILHM

SEQ ID NO: 37164 - protein, 9 aa, Homo Sapiens
EVSGIKAAY

SEQ ID NO: 37165 - protein, 9 aa, Homo Sapiens
EVSGIKALY

SEQ ID NO: 37166 - protein, 9 aa, Homo Sapiens
EVSGKVLEM

SEQ ID NO: 37167 - protein, 9 aa, Homo Sapiens
EVSPIFTQF

SEQ ID NO: 37168 - protein, 9 aa, Homo Sapiens
EVSPKLPEY

SEQ ID NO: 37169 - protein, 9 aa, Homo Sapiens
EVSPNLVRY

SEQ ID NO: 37170 - protein, 9 aa, Homo Sapiens
EVSPYCLLF

SEQ ID NO: 37171 - protein, 9 aa, Homo Sapiens
EVSSHFSHF

SEQ ID NO: 37172 - protein, 9 aa, Homo Sapiens
EVSSISSKF

SEQ ID NO: 37173 - protein, 9 aa, Homo Sapiens
EVSTEVPEM

SEQ ID NO: 37174 - protein, 9 aa, Homo Sapiens
EVTCEISRY

SEQ ID NO: 37175 - protein, 9 aa, Homo Sapiens
EVTDFAGQY

SEQ ID NO: 37176 - protein, 9 aa, Homo Sapiens
EVTDFLSFY

SEQ ID NO: 37177 - protein, 9 aa, Homo Sapiens
EVTEFGNKY

SEQ ID NO: 37178 - protein, 9 aa, Homo Sapiens
EVTEIISQF

SEQ ID NO: 37179 - protein, 9 aa, Homo Sapiens
EVTELLARY

SEQ ID NO: 37180 - protein, 9 aa, Homo Sapiens
EVTELLVKH

SEQ ID NO: 37181 - protein, 9 aa, Homo Sapiens
EVTFVPGLY

SEQ ID NO: 37182 - protein, 9 aa, Homo Sapiens
EVTGKICEM

SEQ ID NO: 37183 - protein, 9 aa, Homo Sapiens
EVTGPHEAF

SEQ ID NO: 37184 - protein, 9 aa, Homo Sapiens
EVTSINSFL

SEQ ID NO: 37185 - protein, 9 aa, Homo Sapiens
EVTSQTSHL

SEQ ID NO: 37186 - protein, 9 aa, Homo Sapiens
EVTTNIPKM

SEQ ID NO: 37187 - protein, 9 aa, Homo Sapiens
EVTWELPQY

SEQ ID NO: 37188 - protein, 9 aa, Homo Sapiens
EVVAEVQEF

SEQ ID NO: 37189 - protein, 9 aa, Homo Sapiens
EVVAFIQHF

SEQ ID NO: 37190 - protein, 9 aa, Homo Sapiens
EVVAGIKEY

SEQ ID NO: 37191 - protein, 9 aa, Homo Sapiens
EVVDEIELL

SEQ ID NO: 37192 - protein, 9 aa, Homo Sapiens
EVVDFSSHY

SEQ ID NO: 37193 - protein, 9 aa, Homo Sapiens
EVVDKINQV

SEQ ID NO: 37194 - protein, 9 aa, Homo Sapiens
EVVDKRNPM

SEQ ID NO: 37195 - protein, 9 aa, Homo Sapiens
EVVDLFRAY

SEQ ID NO: 37196 - protein, 9 aa, Homo Sapiens
EVVDVTWRY

SEQ ID NO: 37197 - protein, 9 aa, Homo Sapiens
EVVEEVEKY

SEQ ID NO: 37198 - protein, 9 aa, Homo Sapiens
EVVEKWLDY

SEQ ID NO: 37199 - protein, 9 aa, Homo Sapiens
EVVEKYEIY

SEQ ID NO: 37200 - protein, 9 aa, Homo Sapiens
EVVELLIKY

SEQ ID NO: 37201 - protein, 9 aa, Homo Sapiens
EVVENLLNY

SEQ ID NO: 37202 - protein, 9 aa, Homo Sapiens
EVVERILFI

SEQ ID NO: 37203 - protein, 9 aa, Homo Sapiens
EVVERLLSV

SEQ ID NO: 37204 - protein, 9 aa, Homo Sapiens
EVVERVEEL

SEQ ID NO: 37205 - protein, 9 aa, Homo Sapiens
EVVERVLTF

SEQ ID NO: 37206 - protein, 9 aa, Homo Sapiens
EVVGIIESR

SEQ ID NO: 37207 - protein, 9 aa, Homo Sapiens
EVVGVYGSF

SEQ ID NO: 37208 - protein, 9 aa, Homo Sapiens
EVVGYFGRF

SEQ ID NO: 37209 - protein, 9 aa, Homo Sapiens
EVVHKIIEL

SEQ ID NO: 37210 - protein, 9 aa, Homo Sapiens
EVVHLILFY

SEQ ID NO: 37211 - protein, 9 aa, Homo Sapiens
EVVIRQLEF

SEQ ID NO: 37212 - protein, 9 aa, Homo Sapiens
EVVKFTQAY

SEQ ID NO: 37213 - protein, 9 aa, Homo Sapiens
EVVKKVNEM

SEQ ID NO: 37214 - protein, 9 aa, Homo Sapiens
EVVKYLLRM

SEQ ID NO: 37215 - protein, 9 aa, Homo Sapiens
EVVPVISPM

SEQ ID NO: 37216 - protein, 9 aa, Homo Sapiens
EVVQQVVLY

SEQ ID NO: 37217 - protein, 9 aa, Homo Sapiens
EVVQRISNV

SEQ ID NO: 37218 - protein, 9 aa, Homo Sapiens
EVVQRLTRM

SEQ ID NO: 37219 - protein, 9 aa, Homo Sapiens
EVVRKILLL

SEQ ID NO: 37220 - protein, 9 aa, Homo Sapiens
EVVSHTSQV

SEQ ID NO: 37221 - protein, 9 aa, Homo Sapiens
EVVSLETRY

SEQ ID NO: 37222 - protein, 9 aa, Homo Sapiens
EVVSNVQEY

SEQ ID NO: 37223 - protein, 9 aa, Homo Sapiens
EVVSQIPNL

SEQ ID NO: 37224 - protein, 9 aa, Homo Sapiens
EVVTVFQYY

SEQ ID NO: 37225 - protein, 9 aa, Homo Sapiens
EVVVQVPYL

SEQ ID NO: 37226 - protein, 9 aa, Homo Sapiens
EVYAGSHQY

SEQ ID NO: 37227 - protein, 9 aa, Homo Sapiens
EVYCIDARY

SEQ ID NO: 37228 - protein, 9 aa, Homo Sapiens
EVYDDFLHY

SEQ ID NO: 37229 - protein, 9 aa, Homo Sapiens
EVYDKICKA

SEQ ID NO: 37230 - protein, 9 aa, Homo Sapiens
EVYEGALLY

SEQ ID NO: 37231 - protein, 9 aa, Homo Sapiens
EVYEKPVQV

SEQ ID NO: 37232 - protein, 9 aa, Homo Sapiens
EVYEKVVDY

SEQ ID NO: 37233 - protein, 9 aa, Homo Sapiens
EVYGSVAKV

SEQ ID NO: 37234 - protein, 9 aa, Homo Sapiens
EVYPGQQYL

SEQ ID NO: 37235 - protein, 9 aa, Homo Sapiens
EVYPHVSTI

SEQ ID NO: 37236 - protein, 9 aa, Homo Sapiens
EVYQHLAHY

SEQ ID NO: 37237 - protein, 9 aa, Homo Sapiens
EVYRHFTGH

SEQ ID NO: 37238 - protein, 9 aa, Homo Sapiens
FAFEHSEEY

SEQ ID NO: 37239 - protein, 9 aa, Homo Sapiens
FIIQNIPGF

SEQ ID NO: 37240 - protein, 9 aa, Homo Sapiens
FLIDKVNAF

SEQ ID NO: 37241 - protein, 9 aa, Homo Sapiens
FLRDKIASY

SEQ ID NO: 37242 - protein, 9 aa, Homo Sapiens
FTAEFSSRY

SEQ ID NO: 37243 - protein, 9 aa, Homo Sapiens
FTAERSSYY

SEQ ID NO: 37244 - protein, 9 aa, Homo Sapiens
FTITKTVEY

SEQ ID NO: 37245 - protein, 9 aa, Homo Sapiens
FTKDQMSHL

SEQ ID NO: 37246 - protein, 9 aa, Homo Sapiens
FTVDGIPYF

SEQ ID NO: 37247 - protein, 9 aa, Homo Sapiens
FVAEQKVEY

SEQ ID NO: 37248 - protein, 9 aa, Homo Sapiens
FVAGVVTFY

SEQ ID NO: 37249 - protein, 9 aa, Homo Sapiens
FVCERTLKY

SEQ ID NO: 37250 - protein, 9 aa, Homo Sapiens
FVIDTTPGM

SEQ ID NO: 37251 - protein, 9 aa, Homo Sapiens
FVIGCYLDR

SEQ ID NO: 37252 - protein, 9 aa, Homo Sapiens
FVIKRLPLF

SEQ ID NO: 37253 - protein, 9 aa, Homo Sapiens
FVINEVCEM

SEQ ID NO: 37254 - protein, 9 aa, Homo Sapiens
FVISNTTGY

SEQ ID NO: 37255 - protein, 9 aa, Homo Sapiens
FVVERQPCM

SEQ ID NO: 37256 - protein, 9 aa, Homo Sapiens
GGFGGGSFR

SEQ ID NO: 37257 - protein, 9 aa, Homo Sapiens
GTAMIFTCF

SEQ ID NO: 37258 - protein, 9 aa, Homo Sapiens
GVTHICPVY

SEQ ID NO: 37259 - protein, 9 aa, Homo Sapiens
HGIDPTGTY

SEQ ID NO: 37260 - protein, 9 aa, Homo Sapiens
HIAENILSY

SEQ ID NO: 37261 - protein, 9 aa, Homo Sapiens
HIIGRIESY

SEQ ID NO: 37262 - protein, 9 aa, Homo Sapiens
HLIQNIPGF

SEQ ID NO: 37263 - protein, 9 aa, Homo Sapiens
HLKDLISLY

SEQ ID NO: 37264 - protein, 9 aa, Homo Sapiens
HSSSIVTAY

SEQ ID NO: 37265 - protein, 9 aa, Homo Sapiens
HTAAMVQQY

SEQ ID NO: 37266 - protein, 9 aa, Homo Sapiens
HTADISSHF

SEQ ID NO: 37267 - protein, 9 aa, Homo Sapiens
HTAEYLTYY

SEQ ID NO: 37268 - protein, 9 aa, Homo Sapiens
HTAHIACKF

SEQ ID NO: 37269 - protein, 9 aa, Homo Sapiens
HTAPNVPHY

SEQ ID NO: 37270 - protein, 9 aa, Homo Sapiens
HTATHILNF

SEQ ID NO: 37271 - protein, 9 aa, Homo Sapiens
HTIGKTVEY

SEQ ID NO: 37272 - protein, 9 aa, Homo Sapiens
HTIGPFSSF

SEQ ID NO: 37273 - protein, 9 aa, Homo Sapiens
HTIHVLSAY

SEQ ID NO: 37274 - protein, 9 aa, Homo Sapiens
HTKENGLPY

SEQ ID NO: 37275 - protein, 9 aa, Homo Sapiens
HTKLSLGSY

SEQ ID NO: 37276 - protein, 9 aa, Homo Sapiens
HTKTTLPTF

SEQ ID NO: 37277 - protein, 9 aa, Homo Sapiens
HTVHVLSAY

SEQ ID NO: 37278 - protein, 9 aa, Homo Sapiens
HTVPIYEGY

SEQ ID NO: 37279 - protein, 9 aa, Homo Sapiens
HVAEQISKM

SEQ ID NO: 37280 - protein, 9 aa, Homo Sapiens
HVAQIYAIR

SEQ ID NO: 37281 - protein, 9 aa, Homo Sapiens
HVHSLLSVF

SEQ ID NO: 37282 - protein, 9 aa, Homo Sapiens
HVIDDFVQF

SEQ ID NO: 37283 - protein, 9 aa, Homo Sapiens
HVIDVKFLY

SEQ ID NO: 37284 - protein, 9 aa, Homo Sapiens
HVIEKMHHV

SEQ ID NO: 37285 - protein, 9 aa, Homo Sapiens
HVINQTGGY

SEQ ID NO: 37286 - protein, 9 aa, Homo Sapiens
HVIRDVAQF

SEQ ID NO: 37287 - protein, 9 aa, Homo Sapiens
HVIYTVNLY

SEQ ID NO: 37288 - protein, 9 aa, Homo Sapiens
HVNGIVQKY

SEQ ID NO: 37289 - protein, 9 aa, Homo Sapiens
HVPEHAVVL

SEQ ID NO: 37290 - protein, 9 aa, Homo Sapiens
HVVAGTAGY

SEQ ID NO: 37291 - protein, 9 aa, Homo Sapiens
IGKRGIIGY

SEQ ID NO: 37292 - protein, 9 aa, Homo Sapiens
IWSHAIQKY

SEQ ID NO: 37293 - protein, 9 aa, Homo Sapiens
LFNLAKDIF

SEQ ID NO: 37294 - protein, 9 aa, Homo Sapiens
MPKVKMPKF

SEQ ID NO: 37295 - protein, 9 aa, Homo Sapiens
MTKRDVPGF

SEQ ID NO: 37296 - protein, 9 aa, Homo Sapiens
MVKRYLTSF

SEQ ID NO: 37297 - protein, 9 aa, Homo Sapiens
MVTEIRLKY

SEQ ID NO: 37298 - protein, 9 aa, Homo Sapiens
NIPAKILSY

SEQ ID NO: 37299 - protein, 9 aa, Homo Sapiens
NLKDFISRF

SEQ ID NO: 37300 - protein, 9 aa, Homo Sapiens
NTIEGTAKY

SEQ ID NO: 37301 - protein, 9 aa, Homo Sapiens
NVADLHEKY

SEQ ID NO: 37302 - protein, 9 aa, Homo Sapiens
NVAEFVCKY

SEQ ID NO: 37303 - protein, 9 aa, Homo Sapiens
NVIDKLAQF

SEQ ID NO: 37304 - protein, 9 aa, Homo Sapiens
NVIGICTHY

SEQ ID NO: 37305 - protein, 9 aa, Homo Sapiens
NVIRLVGKY

SEQ ID NO: 37306 - protein, 9 aa, Homo Sapiens
NVYDFKTTY

SEQ ID NO: 37307 - protein, 9 aa, Homo Sapiens
PDGTVVTVM

SEQ ID NO: 37308 - protein, 9 aa, Homo Sapiens
PEYVLAYID

SEQ ID NO: 37309 - protein, 9 aa, Homo Sapiens
QEQNQEQPI

SEQ ID NO: 37310 - protein, 9 aa, Homo Sapiens
QIKDAIGRY

SEQ ID NO: 37311 - protein, 9 aa, Homo Sapiens
QIVKGLTAL

SEQ ID NO: 37312 - protein, 9 aa, Homo Sapiens
QTIGNHASY

SEQ ID NO: 37313 - protein, 9 aa, Homo Sapiens
QTIRSIGYY

SEQ ID NO: 37314 - protein, 9 aa, Homo Sapiens
QTPAHIAAF

SEQ ID NO: 37315 - protein, 9 aa, Homo Sapiens
QVADIDGQY

SEQ ID NO: 37316 - protein, 9 aa, Homo Sapiens
QVAEIVSKY

SEQ ID NO: 37317 - protein, 9 aa, Homo Sapiens
QVHEIQSCM

SEQ ID NO: 37318 - protein, 9 aa, Homo Sapiens
QVINNVSKF

SEQ ID NO: 37319 - protein, 9 aa, Homo Sapiens
SAPQSAGIT

SEQ ID NO: 37320 - protein, 9 aa, Homo Sapiens
SIIQRIQEF

SEQ ID NO: 37321 - protein, 9 aa, Homo Sapiens
SIKDRMAKY

SEQ ID NO: 37322 - protein, 9 aa, Homo Sapiens
SIPDIKTAF

SEQ ID NO: 37323 - protein, 9 aa, Homo Sapiens
SIRSFVSKM

SEQ ID NO: 37324 - protein, 9 aa, Homo Sapiens
SLKETIGKY

SEQ ID NO: 37325 - protein, 9 aa, Homo Sapiens
SQHYHQGYY

SEQ ID NO: 37326 - protein, 9 aa, Homo Sapiens
STFSHKTVY

SEQ ID NO: 37327 - protein, 9 aa, Homo Sapiens
STHVTISTY

SEQ ID NO: 37328 - protein, 9 aa, Homo Sapiens
STIDWNKLY

SEQ ID NO: 37329 - protein, 9 aa, Homo Sapiens
STIQDYLGF

SEQ ID NO: 37330 - protein, 9 aa, Homo Sapiens
STTAVSARY

SEQ ID NO: 37331 - protein, 9 aa, Homo Sapiens
STYEKALGY

SEQ ID NO: 37332 - protein, 9 aa, Homo Sapiens
SVADIRNAY

SEQ ID NO: 37333 - protein, 9 aa, Homo Sapiens
SVAGIFNYY

SEQ ID NO: 37334 - protein, 9 aa, Homo Sapiens
SVASIKTGF

SEQ ID NO: 37335 - protein, 9 aa, Homo Sapiens
SVIATIQEY

SEQ ID NO: 37336 - protein, 9 aa, Homo Sapiens
SVIDIINKY

SEQ ID NO: 37337 - protein, 9 aa, Homo Sapiens
SVIEAVAHF

SEQ ID NO: 37338 - protein, 9 aa, Homo Sapiens
SVIEQILHY

SEQ ID NO: 37339 - protein, 9 aa, Homo Sapiens
SVIKIQSYY

SEQ ID NO: 37340 - protein, 9 aa, Homo Sapiens
SVIRKIPAL

SEQ ID NO: 37341 - protein, 9 aa, Homo Sapiens
SVKDKITAF

SEQ ID NO: 37342 - protein, 9 aa, Homo Sapiens
SVKEKISMF

SEQ ID NO: 37343 - protein, 9 aa, Homo Sapiens
SVPDFKVFY

SEQ ID NO: 37344 - protein, 9 aa, Homo Sapiens
SVVDDIPEF

SEQ ID NO: 37345 - protein, 9 aa, Homo Sapiens
SVVDISQQY

SEQ ID NO: 37346 - protein, 9 aa, Homo Sapiens
SVVDRVASM

SEQ ID NO: 37347 - protein, 9 aa, Homo Sapiens
SVVEAIPEF

SEQ ID NO: 37348 - protein, 9 aa, Homo Sapiens
SVVELINHY

SEQ ID NO: 37349 - protein, 9 aa, Homo Sapiens
SVVGAISSY

SEQ ID NO: 37350 - protein, 9 aa, Homo Sapiens
SVVSVISRF

SEQ ID NO: 37351 - protein, 9 aa, Homo Sapiens
TISSNVASK

SEQ ID NO: 37352 - protein, 9 aa, Homo Sapiens
TLIDIMTRF

SEQ ID NO: 37353 - protein, 9 aa, Homo Sapiens
TSTDISSLY

SEQ ID NO: 37354 - protein, 9 aa, Homo Sapiens
TTIAKYAQY

SEQ ID NO: 37355 - protein, 9 aa, Homo Sapiens
TTIDIGVKY

SEQ ID NO: 37356 - protein, 9 aa, Homo Sapiens
TTSGIQVRY

SEQ ID NO: 37357 - protein, 9 aa, Homo Sapiens
TVHSIISKM

SEQ ID NO: 37358 - protein, 9 aa, Homo Sapiens
TVIDQIPFL

SEQ ID NO: 37359 - protein, 9 aa, Homo Sapiens
TVIEPLKGY

SEQ ID NO: 37360 - protein, 9 aa, Homo Sapiens
TVPEKIGVF

SEQ ID NO: 37361 - protein, 9 aa, Homo Sapiens
TVSDAILRY

SEQ ID NO: 37362 - protein, 9 aa, Homo Sapiens
TVVVRIMEF

SEQ ID NO: 37363 - protein, 9 aa, Homo Sapiens
VEELKPTPE

SEQ ID NO: 37364 - protein, 9 aa, Homo Sapiens
VLKEKIAKY

SEQ ID NO: 37365 - protein, 9 aa, Homo Sapiens
VSTSHTTIS

SEQ ID NO: 37366 - protein, 9 aa, Homo Sapiens
VVAPITTGY

SEQ ID NO: 37367 - protein, 9 aa, Homo Sapiens
YASSPGGVY

SEQ ID NO: 37368 - protein, 9 aa, Homo Sapiens
YAVSELAGH

SEQ ID NO: 37369 - protein, 9 aa, Homo Sapiens
YIATKIGAF

SEQ ID NO: 37370 - protein, 9 aa, Homo Sapiens
YIIDYYGTR

SEQ ID NO: 37371 - protein, 9 aa, Homo Sapiens
YIIQNIPGF

SEQ ID NO: 37372 - protein, 9 aa, Homo Sapiens
YTAQPTQGY

SEQ ID NO: 37373 - protein, 9 aa, Homo Sapiens
YTIATILHY

SEQ ID NO: 37374 - protein, 9 aa, Homo Sapiens
YTKHGTLKY

SEQ ID NO: 37375 - protein, 9 aa, Homo Sapiens
YTKNYLPLL

SEQ ID NO: 37376 - protein, 9 aa, Homo Sapiens
YTTDRVMTV

SEQ ID NO: 37377 - protein, 9 aa, Homo Sapiens
YTVEKREGY

SEQ ID NO: 37378 - protein, 9 aa, Homo Sapiens
YTYESPAGY

SEQ ID NO: 37379 - protein, 9 aa, Homo Sapiens
YVADHASSY

SEQ ID NO: 37380 - protein, 9 aa, Homo Sapiens
YVAEILPKY

SEQ ID NO: 37381 - protein, 9 aa, Homo Sapiens
YVIGGYTTR

SEQ ID NO: 37382 - protein, 9 aa, Homo Sapiens
YVIGRRKSY

SEQ ID NO: 37383 - protein, 9 aa, Homo Sapiens
YVILNILRF

SEQ ID NO: 37384 - protein, 9 aa, Homo Sapiens
YVIPKTGFY

SEQ ID NO: 37385 - protein, 9 aa, Homo Sapiens
YVIQKFFEF

SEQ ID NO: 37386 - protein, 9 aa, Homo Sapiens
YVPDVTGRY

SEQ ID NO: 37387 - protein, 9 aa, Homo Sapiens
YVPESVGSF

SEQ ID NO: 37388 - protein, 9 aa, Homo Sapiens
YVQDRVPSY

SEQ ID NO: 37389 - protein, 9 aa, Homo Sapiens
YVSDINSVY

SEQ ID NO: 37390 - protein, 9 aa, Homo Sapiens
YVTHLHAEY

SEQ ID NO: 37391 - protein, 9 aa, Homo Sapiens
YVTTSTRTY

SEQ ID NO: 37392 - protein, 9 aa, Homo Sapiens
YVVEPYRKY

SEQ ID NO: 37393 - protein, 9 aa, Homo Sapiens
YVYEYPSRY

SEQ ID NO: 37394 - protein, 10 aa, Homo Sapiens
AIVEKLRFTY

SEQ ID NO: 37395 - protein, 10 aa, Homo Sapiens
ATFDAISKTY

SEQ ID NO: 37396 - protein, 10 aa, Homo Sapiens
AVADKVHLMY

SEQ ID NO: 37397 - protein, 10 aa, Homo Sapiens
AVDFAERHGY

SEQ ID NO: 37398 - protein, 10 aa, Homo Sapiens
AVIAHDFLAF

SEQ ID NO: 37399 - protein, 10 aa, Homo Sapiens
AVIEDTWHYF

SEQ ID NO: 37400 - protein, 10 aa, Homo Sapiens
AVIEGAKFIM

SEQ ID NO: 37401 - protein, 10 aa, Homo Sapiens
AVIGDVIRVY

SEQ ID NO: 37402 - protein, 10 aa, Homo Sapiens
AVISAKLTGM

SEQ ID NO: 37403 - protein, 10 aa, Homo Sapiens
AVNDAHLLQY

SEQ ID NO: 37404 - protein, 10 aa, Homo Sapiens
AVRDNNMAPY

SEQ ID NO: 37405 - protein, 10 aa, Homo Sapiens
AVVSVCGHLY

SEQ ID NO: 37406 - protein, 10 aa, Homo Sapiens
AVYERELQTF

SEQ ID NO: 37407 - protein, 10 aa, Homo Sapiens
DAAKGFGGKY

SEQ ID NO: 37408 - protein, 10 aa, Homo Sapiens
DIASLVGHEF

SEQ ID NO: 37409 - protein, 10 aa, Homo Sapiens
DIGWITGHSY

SEQ ID NO: 37410 - protein, 10 aa, Homo Sapiens
DIIDHHDNTY

SEQ ID NO: 37411 - protein, 10 aa, Homo Sapiens
DILDFAYTSR

SEQ ID NO: 37412 - protein, 10 aa, Homo Sapiens
DISPVDNHRY

SEQ ID NO: 37413 - protein, 10 aa, Homo Sapiens
DIVAAIQHNY

SEQ ID NO: 37414 - protein, 10 aa, Homo Sapiens
DIYESPNHLY

SEQ ID NO: 37415 - protein, 10 aa, Homo Sapiens
DIYGGDYERF

SEQ ID NO: 37416 - protein, 10 aa, Homo Sapiens
DIYNFPIHAF

SEQ ID NO: 37417 - protein, 10 aa, Homo Sapiens
DLIGDFSKGY

SEQ ID NO: 37418 - protein, 10 aa, Homo Sapiens
DLPDDLIGYF

SEQ ID NO: 37419 - protein, 10 aa, Homo Sapiens
DLYAGMLHSM

SEQ ID NO: 37420 - protein, 10 aa, Homo Sapiens
DSFPMEIRQY

SEQ ID NO: 37421 - protein, 10 aa, Homo Sapiens
DSHEPTYGIY

SEQ ID NO: 37422 - protein, 10 aa, Homo Sapiens
DSHPFDLGLY

SEQ ID NO: 37423 - protein, 10 aa, Homo Sapiens
DSIGEKLGRY

SEQ ID NO: 37424 - protein, 10 aa, Homo Sapiens
DTAPSGVSRF

SEQ ID NO: 37425 - protein, 10 aa, Homo Sapiens
DTFIGEGKEY

SEQ ID NO: 37426 - protein, 10 aa, Homo Sapiens
DTIEEKFVPY

SEQ ID NO: 37427 - protein, 10 aa, Homo Sapiens
DTIGYLLTRY

SEQ ID NO: 37428 - protein, 10 aa, Homo Sapiens
DTPGHVDFSY

SEQ ID NO: 37429 - protein, 10 aa, Homo Sapiens
DTTAINKSYY

SEQ ID NO: 37430 - protein, 10 aa, Homo Sapiens
DTYASTIGHY

SEQ ID NO: 37431 - protein, 10 aa, Homo Sapiens
DTYCEDLTKY

SEQ ID NO: 37432 - protein, 10 aa, Homo Sapiens
DTYPEESRSY

SEQ ID NO: 37433 - protein, 10 aa, Homo Sapiens
DVFEEPMSGM

SEQ ID NO: 37434 - protein, 10 aa, Homo Sapiens
DVFNEKGWNY

SEQ ID NO: 37435 - protein, 10 aa, Homo Sapiens
DVIAQGIGKL

SEQ ID NO: 37436 - protein, 10 aa, Homo Sapiens
DVIDHDDFRY

SEQ ID NO: 37437 - protein, 10 aa, Homo Sapiens
DVIPVDGARY

SEQ ID NO: 37438 - protein, 10 aa, Homo Sapiens
DVITIIDRSF

SEQ ID NO: 37439 - protein, 10 aa, Homo Sapiens
DVKDGKYSQV

SEQ ID NO: 37440 - protein, 10 aa, Homo Sapiens
DVKGGTLTQY

SEQ ID NO: 37441 - protein, 10 aa, Homo Sapiens
DVMTALSQGY

SEQ ID NO: 37442 - protein, 10 aa, Homo Sapiens
DVPENNQHGY

SEQ ID NO: 37443 - protein, 10 aa, Homo Sapiens
DVPSFGPACY

SEQ ID NO: 37444 - protein, 10 aa, Homo Sapiens
DVTDFISHLF

SEQ ID NO: 37445 - protein, 10 aa, Homo Sapiens
DVVDEKISAM

SEQ ID NO: 37446 - protein, 10 aa, Homo Sapiens
DVVEKTIQKY

SEQ ID NO: 37447 - protein, 10 aa, Homo Sapiens
DVVKEIFFHY

SEQ ID NO: 37448 - protein, 10 aa, Homo Sapiens
DVYAKLLHRY

SEQ ID NO: 37449 - protein, 10 aa, Homo Sapiens
DVYENLYAGR

SEQ ID NO: 37450 - protein, 10 aa, Homo Sapiens
DVYGFKMSCM

SEQ ID NO: 37451 - protein, 10 aa, Homo Sapiens
DVYGGTNRYF

SEQ ID NO: 37452 - protein, 10 aa, Homo Sapiens
DVYNHFLLYY

SEQ ID NO: 37453 - protein, 10 aa, Homo Sapiens
DVYPEIIERA

SEQ ID NO: 37454 - protein, 10 aa, Homo Sapiens
DVYSGTPTKV

SEQ ID NO: 37455 - protein, 10 aa, Homo Sapiens
DVYTHVLSAF

SEQ ID NO: 37456 - protein, 10 aa, Homo Sapiens
EAFGQKIGHF

SEQ ID NO: 37457 - protein, 10 aa, Homo Sapiens
EAFPEKIPLF

SEQ ID NO: 37458 - protein, 10 aa, Homo Sapiens
EAFQTTISKY

SEQ ID NO: 37459 - protein, 10 aa, Homo Sapiens
EAFTEMMEAY

SEQ ID NO: 37460 - protein, 10 aa, Homo Sapiens
EAIDSEGHSY

SEQ ID NO: 37461 - protein, 10 aa, Homo Sapiens
EAIKILKGEY

SEQ ID NO: 37462 - protein, 10 aa, Homo Sapiens
EAIYVTRHLF

SEQ ID NO: 37463 - protein, 10 aa, Homo Sapiens
EALNKQIMEY

SEQ ID NO: 37464 - protein, 10 aa, Homo Sapiens
EAMSGHIDQF

SEQ ID NO: 37465 - protein, 10 aa, Homo Sapiens
EAVCEVALDY

SEQ ID NO: 37466 - protein, 10 aa, Homo Sapiens
EAVTHIGRVY

SEQ ID NO: 37467 - protein, 10 aa, Homo Sapiens
EAYNSLMKSY

SEQ ID NO: 37468 - protein, 10 aa, Homo Sapiens
EAYPLPGVTY

SEQ ID NO: 37469 - protein, 10 aa, Homo Sapiens
EAYSAKIALF

SEQ ID NO: 37470 - protein, 10 aa, Homo Sapiens
EAYTQLLTEM

SEQ ID NO: 37471 - protein, 10 aa, Homo Sapiens
EIADQVSREY

SEQ ID NO: 37472 - protein, 10 aa, Homo Sapiens
EIASFECSGY

SEQ ID NO: 37473 - protein, 10 aa, Homo Sapiens
EIATTFEHYY

SEQ ID NO: 37474 - protein, 10 aa, Homo Sapiens
EIFDGIQPKM

SEQ ID NO: 37475 - protein, 10 aa, Homo Sapiens
EIFDGNVAHI

SEQ ID NO: 37476 - protein, 10 aa, Homo Sapiens
EIFNPDIGMF

SEQ ID NO: 37477 - protein, 10 aa, Homo Sapiens
EIFPGNGHCY

SEQ ID NO: 37478 - protein, 10 aa, Homo Sapiens
EIFPLETPAF

SEQ ID NO: 37479 - protein, 10 aa, Homo Sapiens
EIIEHGIELF

SEQ ID NO: 37480 - protein, 10 aa, Homo Sapiens
EIIETGLAAF

SEQ ID NO: 37481 - protein, 10 aa, Homo Sapiens
EIIGRDLSGF

SEQ ID NO: 37482 - protein, 10 aa, Homo Sapiens
EIIQIDGHIY

SEQ ID NO: 37483 - protein, 10 aa, Homo Sapiens
EIITNQIPKY

SEQ ID NO: 37484 - protein, 10 aa, Homo Sapiens
EIKPEMIGHY

SEQ ID NO: 37485 - protein, 10 aa, Homo Sapiens
EILEKSFSEF

SEQ ID NO: 37486 - protein, 10 aa, Homo Sapiens
EIMDRAYDSF

SEQ ID NO: 37487 - protein, 10 aa, Homo Sapiens
EIMEHRFKTY

SEQ ID NO: 37488 - protein, 10 aa, Homo Sapiens
EIPETVSLEM

SEQ ID NO: 37489 - protein, 10 aa, Homo Sapiens
EIVEGENHTY

SEQ ID NO: 37490 - protein, 10 aa, Homo Sapiens
EIVPFRVAAY

SEQ ID NO: 37491 - protein, 10 aa, Homo Sapiens
EIVSTPRLQY

SEQ ID NO: 37492 - protein, 10 aa, Homo Sapiens
EIYGGSDSRF

SEQ ID NO: 37493 - protein, 10 aa, Homo Sapiens
EIYPPEVAEF

SEQ ID NO: 37494 - protein, 10 aa, Homo Sapiens
EIYPPKLHQF

SEQ ID NO: 37495 - protein, 10 aa, Homo Sapiens
EIYQYVLNSM

SEQ ID NO: 37496 - protein, 10 aa, Homo Sapiens
EIYTRDGNSY

SEQ ID NO: 37497 - protein, 10 aa, Homo Sapiens
ELFHGSYGTF

SEQ ID NO: 37498 - protein, 10 aa, Homo Sapiens
ELFHKDIEAF

SEQ ID NO: 37499 - protein, 10 aa, Homo Sapiens
ELIGRPIGEF

SEQ ID NO: 37500 - protein, 10 aa, Homo Sapiens
ELIQAKVGSF

SEQ ID NO: 37501 - protein, 10 aa, Homo Sapiens
ELMHSIVGSY

SEQ ID NO: 37502 - protein, 10 aa, Homo Sapiens
ELMYGGVSSY

SEQ ID NO: 37503 - protein, 10 aa, Homo Sapiens
ELPSVNIGAF

SEQ ID NO: 37504 - protein, 10 aa, Homo Sapiens
ELVTGTVRTF

SEQ ID NO: 37505 - protein, 10 aa, Homo Sapiens
ELYERPPHLY

SEQ ID NO: 37506 - protein, 10 aa, Homo Sapiens
ELYNRMLKRF

SEQ ID NO: 37507 - protein, 10 aa, Homo Sapiens
ELYPKQIRAM

SEQ ID NO: 37508 - protein, 10 aa, Homo Sapiens
ENMWNTGSTY

SEQ ID NO: 37509 - protein, 10 aa, Homo Sapiens
ESAGIHETTY

SEQ ID NO: 37510 - protein, 10 aa, Homo Sapiens
ESAPKEVSRY

SEQ ID NO: 37511 - protein, 10 aa, Homo Sapiens
ESIGQRIACY

SEQ ID NO: 37512 - protein, 10 aa, Homo Sapiens
ESIWEILHRY

SEQ ID NO: 37513 - protein, 10 aa, Homo Sapiens
ESYENDIASM

SEQ ID NO: 37514 - protein, 10 aa, Homo Sapiens
ETANITPSVY

SEQ ID NO: 37515 - protein, 10 aa, Homo Sapiens
ETAPRHMMRL

SEQ ID NO: 37516 - protein, 10 aa, Homo Sapiens
ETASELLMRL

SEQ ID NO: 37517 - protein, 10 aa, Homo Sapiens
ETASKTLSRF

SEQ ID NO: 37518 - protein, 10 aa, Homo Sapiens
ETCGDWYRGY

SEQ ID NO: 37519 - protein, 10 aa, Homo Sapiens
ETCHSVGAAY

SEQ ID NO: 37520 - protein, 10 aa, Homo Sapiens
ETFDAGLQAF

SEQ ID NO: 37521 - protein, 10 aa, Homo Sapiens
ETFDFQAMGR

SEQ ID NO: 37522 - protein, 10 aa, Homo Sapiens
ETFDGVIYGF

SEQ ID NO: 37523 - protein, 10 aa, Homo Sapiens
ETFDLQLGRF

SEQ ID NO: 37524 - protein, 10 aa, Homo Sapiens
ETFGEASQKY

SEQ ID NO: 37525 - protein, 10 aa, Homo Sapiens
ETFGFEIQSY

SEQ ID NO: 37526 - protein, 10 aa, Homo Sapiens
ETFKEQGNAY

SEQ ID NO: 37527 - protein, 10 aa, Homo Sapiens
ETFPEAYKPT

SEQ ID NO: 37528 - protein, 10 aa, Homo Sapiens
ETFPGVTALF

SEQ ID NO: 37529 - protein, 10 aa, Homo Sapiens
ETFQQKMLRF

SEQ ID NO: 37530 - protein, 10 aa, Homo Sapiens
ETFSGVYKKL

SEQ ID NO: 37531 - protein, 10 aa, Homo Sapiens
ETHQPIVETY

SEQ ID NO: 37532 - protein, 10 aa, Homo Sapiens
ETICKRLLDY

SEQ ID NO: 37533 - protein, 10 aa, Homo Sapiens
ETIDSRVQEY

SEQ ID NO: 37534 - protein, 10 aa, Homo Sapiens
ETIDTARLHY

SEQ ID NO: 37535 - protein, 10 aa, Homo Sapiens
ETIHIRGGVF

SEQ ID NO: 37536 - protein, 10 aa, Homo Sapiens
ETIKDGVSRF

SEQ ID NO: 37537 - protein, 10 aa, Homo Sapiens
ETIPDGIGKL

SEQ ID NO: 37538 - protein, 10 aa, Homo Sapiens
ETIREVCTKY

SEQ ID NO: 37539 - protein, 10 aa, Homo Sapiens
ETIYDLGTKM

SEQ ID NO: 37540 - protein, 10 aa, Homo Sapiens
ETKEPSMMEY

SEQ ID NO: 37541 - protein, 10 aa, Homo Sapiens
ETLETEKAQY

SEQ ID NO: 37542 - protein, 10 aa, Homo Sapiens
ETMKILGSLY

SEQ ID NO: 37543 - protein, 10 aa, Homo Sapiens
ETMSPGVFSR

SEQ ID NO: 37544 - protein, 10 aa, Homo Sapiens
ETMTEKLVKF

SEQ ID NO: 37545 - protein, 10 aa, Homo Sapiens
ETPFFLLTGY

SEQ ID NO: 37546 - protein, 10 aa, Homo Sapiens
ETPNRVMLDY

SEQ ID NO: 37547 - protein, 10 aa, Homo Sapiens
ETQTDSISRY

SEQ ID NO: 37548 - protein, 10 aa, Homo Sapiens
ETRDGQVLGR

SEQ ID NO: 37549 - protein, 10 aa, Homo Sapiens
ETRPAGDGTF

SEQ ID NO: 37550 - protein, 10 aa, Homo Sapiens
ETSADNQHYY

SEQ ID NO: 37551 - protein, 10 aa, Homo Sapiens
ETVGTGIMGR

SEQ ID NO: 37552 - protein, 10 aa, Homo Sapiens
ETVLYIEHRY

SEQ ID NO: 37553 - protein, 10 aa, Homo Sapiens
ETVNHHYLLF

SEQ ID NO: 37554 - protein, 10 aa, Homo Sapiens
ETVNLRSLGF

SEQ ID NO: 37555 - protein, 10 aa, Homo Sapiens
ETVRTLNNLY

SEQ ID NO: 37556 - protein, 10 aa, Homo Sapiens
ETYEAKRHEF

SEQ ID NO: 37557 - protein, 10 aa, Homo Sapiens
ETYEALLARF

SEQ ID NO: 37558 - protein, 10 aa, Homo Sapiens
ETYGNKFAAH

SEQ ID NO: 37559 - protein, 10 aa, Homo Sapiens
ETYKEAQAAM

SEQ ID NO: 37560 - protein, 10 aa, Homo Sapiens
ETYNGHLVSC

SEQ ID NO: 37561 - protein, 10 aa, Homo Sapiens
ETYPFNPPKY

SEQ ID NO: 37562 - protein, 10 aa, Homo Sapiens
ETYPNYLPLY

SEQ ID NO: 37563 - protein, 10 aa, Homo Sapiens
ETYPSNILSH

SEQ ID NO: 37564 - protein, 10 aa, Homo Sapiens
ETYQDIFRDF

SEQ ID NO: 37565 - protein, 10 aa, Homo Sapiens
ETYRMPVMEY

SEQ ID NO: 37566 - protein, 10 aa, Homo Sapiens
EVAAPDVGRM

SEQ ID NO: 37567 - protein, 10 aa, Homo Sapiens
EVADELVSEF

SEQ ID NO: 37568 - protein, 10 aa, Homo Sapiens
EVADRIGDYV

SEQ ID NO: 37569 - protein, 10 aa, Homo Sapiens
EVADRLFSSF

SEQ ID NO: 37570 - protein, 10 aa, Homo Sapiens
EVADVLVDGY

SEQ ID NO: 37571 - protein, 10 aa, Homo Sapiens
EVAEVKISHF

SEQ ID NO: 37572 - protein, 10 aa, Homo Sapiens
EVAGIINDAK

SEQ ID NO: 37573 - protein, 10 aa, Homo Sapiens
EVAGIKFWCY

SEQ ID NO: 37574 - protein, 10 aa, Homo Sapiens
EVANKVGGIY

SEQ ID NO: 37575 - protein, 10 aa, Homo Sapiens
EVAPCMGDRF

SEQ ID NO: 37576 - protein, 10 aa, Homo Sapiens
EVAPDFFEYF

SEQ ID NO: 37577 - protein, 10 aa, Homo Sapiens
EVAPENFFSL

SEQ ID NO: 37578 - protein, 10 aa, Homo Sapiens
EVAPGALLGL

SEQ ID NO: 37579 - protein, 10 aa, Homo Sapiens
EVAPPEYHRK

SEQ ID NO: 37580 - protein, 10 aa, Homo Sapiens
EVAPVISSAY

SEQ ID NO: 37581 - protein, 10 aa, Homo Sapiens
EVAQHLAATY

SEQ ID NO: 37582 - protein, 10 aa, Homo Sapiens
EVAQKCGLSY

SEQ ID NO: 37583 - protein, 10 aa, Homo Sapiens
EVAQVESLRY

SEQ ID NO: 37584 - protein, 10 aa, Homo Sapiens
EVASAVCLRL

SEQ ID NO: 37585 - protein, 10 aa, Homo Sapiens
EVASGMILVM

SEQ ID NO: 37586 - protein, 10 aa, Homo Sapiens
EVATDHKAFY

SEQ ID NO: 37587 - protein, 10 aa, Homo Sapiens
EVCPLSESRF

SEQ ID NO: 37588 - protein, 10 aa, Homo Sapiens
EVCQSYKSLY

SEQ ID NO: 37589 - protein, 10 aa, Homo Sapiens
EVCRIPTHLF

SEQ ID NO: 37590 - protein, 10 aa, Homo Sapiens
EVFANRFTQM

SEQ ID NO: 37591 - protein, 10 aa, Homo Sapiens
EVFDHMMKRM

SEQ ID NO: 37592 - protein, 10 aa, Homo Sapiens
EVFDKDLSKL

SEQ ID NO: 37593 - protein, 10 aa, Homo Sapiens
EVFDKTYQFL

SEQ ID NO: 37594 - protein, 10 aa, Homo Sapiens
EVFDSAILSA

SEQ ID NO: 37595 - protein, 10 aa, Homo Sapiens
EVFDYSYRDY

SEQ ID NO: 37596 - protein, 10 aa, Homo Sapiens
EVFETIIHSY

SEQ ID NO: 37597 - protein, 10 aa, Homo Sapiens
EVFHDQLHTF

SEQ ID NO: 37598 - protein, 10 aa, Homo Sapiens
EVFIHKDKGF

SEQ ID NO: 37599 - protein, 10 aa, Homo Sapiens
EVFMHVSTAY

SEQ ID NO: 37600 - protein, 10 aa, Homo Sapiens
EVFNGPLPRA

SEQ ID NO: 37601 - protein, 10 aa, Homo Sapiens
EVFNHREVNY

SEQ ID NO: 37602 - protein, 10 aa, Homo Sapiens
EVFNKFFKER

SEQ ID NO: 37603 - protein, 10 aa, Homo Sapiens
EVFPDSPGAY

SEQ ID NO: 37604 - protein, 10 aa, Homo Sapiens
EVFPEHLARF

SEQ ID NO: 37605 - protein, 10 aa, Homo Sapiens
EVFPKEMTKW

SEQ ID NO: 37606 - protein, 10 aa, Homo Sapiens
EVFPLAMNYL

SEQ ID NO: 37607 - protein, 10 aa, Homo Sapiens
EVFPLKVFGY

SEQ ID NO: 37608 - protein, 10 aa, Homo Sapiens
EVFQTKIQEF

SEQ ID NO: 37609 - protein, 10 aa, Homo Sapiens
EVFRKEMSQF

SEQ ID NO: 37610 - protein, 10 aa, Homo Sapiens
EVFSFKMVSY

SEQ ID NO: 37611 - protein, 10 aa, Homo Sapiens
EVFTGGIGSY

SEQ ID NO: 37612 - protein, 10 aa, Homo Sapiens
EVFTGGISSY

SEQ ID NO: 37613 - protein, 10 aa, Homo Sapiens
EVFTGHMGKL

SEQ ID NO: 37614 - protein, 10 aa, Homo Sapiens
EVGGEALGRL

SEQ ID NO: 37615 - protein, 10 aa, Homo Sapiens
EVGPEGALGK

SEQ ID NO: 37616 - protein, 10 aa, Homo Sapiens
EVHNLNQLLY

SEQ ID NO: 37617 - protein, 10 aa, Homo Sapiens
EVHRFGITGY

SEQ ID NO: 37618 - protein, 10 aa, Homo Sapiens
EVIAHCGMHY

SEQ ID NO: 37619 - protein, 10 aa, Homo Sapiens
EVIASIISRY

SEQ ID NO: 37620 - protein, 10 aa, Homo Sapiens
EVIDHKLTER

SEQ ID NO: 37621 - protein, 10 aa, Homo Sapiens
EVIDLMIKEY

SEQ ID NO: 37622 - protein, 10 aa, Homo Sapiens
EVIDTQTKLY

SEQ ID NO: 37623 - protein, 10 aa, Homo Sapiens
EVIEALLRKF

SEQ ID NO: 37624 - protein, 10 aa, Homo Sapiens
EVIEDEKQFY

SEQ ID NO: 37625 - protein, 10 aa, Homo Sapiens
EVIEKKPEKF

SEQ ID NO: 37626 - protein, 10 aa, Homo Sapiens
EVIESTNLKY

SEQ ID NO: 37627 - protein, 10 aa, Homo Sapiens
EVIETEKTLY

SEQ ID NO: 37628 - protein, 10 aa, Homo Sapiens
EVIGLLGGRY

SEQ ID NO: 37629 - protein, 10 aa, Homo Sapiens
EVIGQVLSTL

SEQ ID NO: 37630 - protein, 10 aa, Homo Sapiens
EVIHLEAGGY

SEQ ID NO: 37631 - protein, 10 aa, Homo Sapiens
EVINGNIKTV

SEQ ID NO: 37632 - protein, 10 aa, Homo Sapiens
EVINKLGPRY

SEQ ID NO: 37633 - protein, 10 aa, Homo Sapiens
EVINRSMDTY

SEQ ID NO: 37634 - protein, 10 aa, Homo Sapiens
EVIPENTVIY

SEQ ID NO: 37635 - protein, 10 aa, Homo Sapiens
EVIQGLLKKF

SEQ ID NO: 37636 - protein, 10 aa, Homo Sapiens
EVIQNLERGY

SEQ ID NO: 37637 - protein, 10 aa, Homo Sapiens
EVISGKGQFF

SEQ ID NO: 37638 - protein, 10 aa, Homo Sapiens
EVISNEGGRF

SEQ ID NO: 37639 - protein, 10 aa, Homo Sapiens
EVISPSPHFY

SEQ ID NO: 37640 - protein, 10 aa, Homo Sapiens
EVISQHLVSY

SEQ ID NO: 37641 - protein, 10 aa, Homo Sapiens
EVISTLLEKM

SEQ ID NO: 37642 - protein, 10 aa, Homo Sapiens
EVITHELQDF

SEQ ID NO: 37643 - protein, 10 aa, Homo Sapiens
EVLAGHGHLY

SEQ ID NO: 37644 - protein, 10 aa, Homo Sapiens
EVLDFITHLY

SEQ ID NO: 37645 - protein, 10 aa, Homo Sapiens
EVLDSLLVQY

SEQ ID NO: 37646 - protein, 10 aa, Homo Sapiens
EVLEVDNVKY

SEQ ID NO: 37647 - protein, 10 aa, Homo Sapiens
EVLPAALAVY

SEQ ID NO: 37648 - protein, 10 aa, Homo Sapiens
EVLPHVPLGV

SEQ ID NO: 37649 - protein, 10 aa, Homo Sapiens
EVMNQNLAYY

SEQ ID NO: 37650 - protein, 10 aa, Homo Sapiens
EVPREKLASR

SEQ ID NO: 37651 - protein, 10 aa, Homo Sapiens
EVPRIQLEEY

SEQ ID NO: 37652 - protein, 10 aa, Homo Sapiens
EVPSFLVERM

SEQ ID NO: 37653 - protein, 10 aa, Homo Sapiens
EVPTQLVSYF

SEQ ID NO: 37654 - protein, 10 aa, Homo Sapiens
EVRGGGLTRY

SEQ ID NO: 37655 - protein, 10 aa, Homo Sapiens
EVSEIKSSYY

SEQ ID NO: 37656 - protein, 10 aa, Homo Sapiens
EVSSMVLTKM

SEQ ID NO: 37657 - protein, 10 aa, Homo Sapiens
EVTGHTDHYF

SEQ ID NO: 37658 - protein, 10 aa, Homo Sapiens
EVTTHILSQF

SEQ ID NO: 37659 - protein, 10 aa, Homo Sapiens
EVVAGEFGSR

SEQ ID NO: 37660 - protein, 10 aa, Homo Sapiens
EVVAGIKEYF

SEQ ID NO: 37661 - protein, 10 aa, Homo Sapiens
EVVAIKKMSY

SEQ ID NO: 37662 - protein, 10 aa, Homo Sapiens
EVVAVAHAVY

SEQ ID NO: 37663 - protein, 10 aa, Homo Sapiens
EVVDCHLSDM

SEQ ID NO: 37664 - protein, 10 aa, Homo Sapiens
EVVDFIQSKI

SEQ ID NO: 37665 - protein, 10 aa, Homo Sapiens
EVVDKKIEEF

SEQ ID NO: 37666 - protein, 10 aa, Homo Sapiens
EVVERILFIY

SEQ ID NO: 37667 - protein, 10 aa, Homo Sapiens
EVVGEQVTSY

SEQ ID NO: 37668 - protein, 10 aa, Homo Sapiens
EVVSEPFRSF

SEQ ID NO: 37669 - protein, 10 aa, Homo Sapiens
EVVSGVVSKV

SEQ ID NO: 37670 - protein, 10 aa, Homo Sapiens
EVVTGVIGQR

SEQ ID NO: 37671 - protein, 10 aa, Homo Sapiens
EVVWPGVTSM

SEQ ID NO: 37672 - protein, 10 aa, Homo Sapiens
EVYAGDICAL

SEQ ID NO: 37673 - protein, 10 aa, Homo Sapiens
EVYAWAPKPY

SEQ ID NO: 37674 - protein, 10 aa, Homo Sapiens
EVYCDSMEQF

SEQ ID NO: 37675 - protein, 10 aa, Homo Sapiens
EVYDKICKAA

SEQ ID NO: 37676 - protein, 10 aa, Homo Sapiens
EVYDQLFKSR

SEQ ID NO: 37677 - protein, 10 aa, Homo Sapiens
EVYEGRFSLY

SEQ ID NO: 37678 - protein, 10 aa, Homo Sapiens
EVYEGVWKKY

SEQ ID NO: 37679 - protein, 10 aa, Homo Sapiens
EVYEGVYTNH

SEQ ID NO: 37680 - protein, 10 aa, Homo Sapiens
EVYGKNLTSS

SEQ ID NO: 37681 - protein, 10 aa, Homo Sapiens
EVYHSSLASL

SEQ ID NO: 37682 - protein, 10 aa, Homo Sapiens
EVYNEKIHDL

SEQ ID NO: 37683 - protein, 10 aa, Homo Sapiens
EVYNEQIHDL

SEQ ID NO: 37684 - protein, 10 aa, Homo Sapiens
EVYPFGIVGM

SEQ ID NO: 37685 - protein, 10 aa, Homo Sapiens
EVYPFQVAWY

SEQ ID NO: 37686 - protein, 10 aa, Homo Sapiens
EVYPGAKLFY

SEQ ID NO: 37687 - protein, 10 aa, Homo Sapiens
EVYRHHLEQM

SEQ ID NO: 37688 - protein, 10 aa, Homo Sapiens
EVYRLAIQSF

SEQ ID NO: 37689 - protein, 10 aa, Homo Sapiens
FTMDVIGGKY

SEQ ID NO: 37690 - protein, 10 aa, Homo Sapiens
FTPDGNHFLY

SEQ ID NO: 37691 - protein, 10 aa, Homo Sapiens
FTVETASREY

SEQ ID NO: 37692 - protein, 10 aa, Homo Sapiens
FTYDPWIGKL

SEQ ID NO: 37693 - protein, 10 aa, Homo Sapiens
FVAPVDLQAY

SEQ ID NO: 37694 - protein, 10 aa, Homo Sapiens
FVFDRPLPVS

SEQ ID NO: 37695 - protein, 10 aa, Homo Sapiens
FVHWYVGEGM

SEQ ID NO: 37696 - protein, 10 aa, Homo Sapiens
FVYEQKLNEY

SEQ ID NO: 37697 - protein, 10 aa, Homo Sapiens
FVYEVTSTKY

SEQ ID NO: 37698 - protein, 10 aa, Homo Sapiens
GTFEYEYSQR

SEQ ID NO: 37699 - protein, 10 aa, Homo Sapiens
GVIEKLLTSY

SEQ ID NO: 37700 - protein, 10 aa, Homo Sapiens
HGIDPTGTYH

SEQ ID NO: 37701 - protein, 10 aa, Homo Sapiens
HIATFNALGY

SEQ ID NO: 37702 - protein, 10 aa, Homo Sapiens
HTAEVNCLSF

SEQ ID NO: 37703 - protein, 10 aa, Homo Sapiens
HTFQNDIHVY

SEQ ID NO: 37704 - protein, 10 aa, Homo Sapiens
HTINGHNAEV

SEQ ID NO: 37705 - protein, 10 aa, Homo Sapiens
HTPENPVIRY

SEQ ID NO: 37706 - protein, 10 aa, Homo Sapiens
HTVDFTADKY

SEQ ID NO: 37707 - protein, 10 aa, Homo Sapiens
HVASCGVNLY

SEQ ID NO: 37708 - protein, 10 aa, Homo Sapiens
HVFTFGSRLY

SEQ ID NO: 37709 - protein, 10 aa, Homo Sapiens
HVISYSLSPF

SEQ ID NO: 37710 - protein, 10 aa, Homo Sapiens
HVITGLLEHY

SEQ ID NO: 37711 - protein, 10 aa, Homo Sapiens
HVKDANGNSF

SEQ ID NO: 37712 - protein, 10 aa, Homo Sapiens
HVPAGLLALF

SEQ ID NO: 37713 - protein, 10 aa, Homo Sapiens
HVPNFIFDEF

SEQ ID NO: 37714 - protein, 10 aa, Homo Sapiens
HVVDEHTGQY

SEQ ID NO: 37715 - protein, 10 aa, Homo Sapiens
HVYDGKFLAR

SEQ ID NO: 37716 - protein, 10 aa, Homo Sapiens
HVYQHGLTGF

SEQ ID NO: 37717 - protein, 10 aa, Homo Sapiens
IIGKRGIIGY

SEQ ID NO: 37718 - protein, 10 aa, Homo Sapiens
IVFDSEYCRY

SEQ ID NO: 37719 - protein, 10 aa, Homo Sapiens
LAADFEIGHF

SEQ ID NO: 37720 - protein, 10 aa, Homo Sapiens
LSNVSLDTIY

SEQ ID NO: 37721 - protein, 10 aa, Homo Sapiens
MTIEELLTRY

SEQ ID NO: 37722 - protein, 10 aa, Homo Sapiens
MVADVFSHRF

SEQ ID NO: 37723 - protein, 10 aa, Homo Sapiens
MVITPQNGRY

SEQ ID NO: 37724 - protein, 10 aa, Homo Sapiens
NLPDEIYHVY

SEQ ID NO: 37725 - protein, 10 aa, Homo Sapiens
NVIEQYIGRF

SEQ ID NO: 37726 - protein, 10 aa, Homo Sapiens
NVIEVDSAHY

SEQ ID NO: 37727 - protein, 10 aa, Homo Sapiens
NVSTVLTSKY

SEQ ID NO: 37728 - protein, 10 aa, Homo Sapiens
PENTVFDAKR

SEQ ID NO: 37729 - protein, 10 aa, Homo Sapiens
PKTAENFRQF

SEQ ID NO: 37730 - protein, 10 aa, Homo Sapiens
QIYGYEGRGS

SEQ ID NO: 37731 - protein, 10 aa, Homo Sapiens
QTIGALLTKY

SEQ ID NO: 37732 - protein, 10 aa, Homo Sapiens
QTPDFTPTKY

SEQ ID NO: 37733 - protein, 10 aa, Homo Sapiens
QVAEMLGHKY

SEQ ID NO: 37734 - protein, 10 aa, Homo Sapiens
RVPFIYGHKY

SEQ ID NO: 37735 - protein, 10 aa, Homo Sapiens
SAVEFRQTGY

SEQ ID NO: 37736 - protein, 10 aa, Homo Sapiens
SAVEKKLAEY

SEQ ID NO: 37737 - protein, 10 aa, Homo Sapiens
SSFDGIIAMM

SEQ ID NO: 37738 - protein, 10 aa, Homo Sapiens
STIGFKLPSY

SEQ ID NO: 37739 - protein, 10 aa, Homo Sapiens
STISGGYAEY

SEQ ID NO: 37740 - protein, 10 aa, Homo Sapiens
STVGGWVSTR

SEQ ID NO: 37741 - protein, 10 aa, Homo Sapiens
STYEKALGYF

SEQ ID NO: 37742 - protein, 10 aa, Homo Sapiens
SVADWKVMAF

SEQ ID NO: 37743 - protein, 10 aa, Homo Sapiens
SVAEITNACF

SEQ ID NO: 37744 - protein, 10 aa, Homo Sapiens
SVDRKFISLM

SEQ ID NO: 37745 - protein, 10 aa, Homo Sapiens
SVFGGAICRM

SEQ ID NO: 37746 - protein, 10 aa, Homo Sapiens
SVIDGRFEGF

SEQ ID NO: 37747 - protein, 10 aa, Homo Sapiens
SVIEKALRNF

SEQ ID NO: 37748 - protein, 10 aa, Homo Sapiens
SVIERQVGTF

SEQ ID NO: 37749 - protein, 10 aa, Homo Sapiens
SVISKDGELY

SEQ ID NO: 37750 - protein, 10 aa, Homo Sapiens
SVKDAKIAVY

SEQ ID NO: 37751 - protein, 10 aa, Homo Sapiens
SVPTQQGHLY

SEQ ID NO: 37752 - protein, 10 aa, Homo Sapiens
SVSTVLTSKY

SEQ ID NO: 37753 - protein, 10 aa, Homo Sapiens
SVVGGFVSHY

SEQ ID NO: 37754 - protein, 10 aa, Homo Sapiens
SVYEFQTPSY

SEQ ID NO: 37755 - protein, 10 aa, Homo Sapiens
TEPVSLFPEE

SEQ ID NO: 37756 - protein, 10 aa, Homo Sapiens
TISSNVASKA

SEQ ID NO: 37757 - protein, 10 aa, Homo Sapiens
TTISKSGGDY

SEQ ID NO: 37758 - protein, 10 aa, Homo Sapiens
TTKVGPNATY

SEQ ID NO: 37759 - protein, 10 aa, Homo Sapiens
TVAEITNACF

SEQ ID NO: 37760 - protein, 10 aa, Homo Sapiens
TVFDKLNHEY

SEQ ID NO: 37761 - protein, 10 aa, Homo Sapiens
TVIEEHLGKF

SEQ ID NO: 37762 - protein, 10 aa, Homo Sapiens
TVIEPLKGYY

SEQ ID NO: 37763 - protein, 10 aa, Homo Sapiens
TVYEEMMAKM

SEQ ID NO: 37764 - protein, 10 aa, Homo Sapiens
VGLSDELAKL

SEQ ID NO: 37765 - protein, 10 aa, Homo Sapiens
WSQHYHQGYY

SEQ ID NO: 37766 - protein, 10 aa, Homo Sapiens
WVFEHPETLY

SEQ ID NO: 37767 - protein, 10 aa, Homo Sapiens
YAADIFYSRY

SEQ ID NO: 37768 - protein, 10 aa, Homo Sapiens
YIFPSSISAM

SEQ ID NO: 37769 - protein, 10 aa, Homo Sapiens
YINPAKLTPY

SEQ ID NO: 37770 - protein, 10 aa, Homo Sapiens
YLPDFRFTPF

SEQ ID NO: 37771 - protein, 10 aa, Homo Sapiens
YNSDGYGGNY

SEQ ID NO: 37772 - protein, 10 aa, Homo Sapiens
YSKYYKTIDD

SEQ ID NO: 37773 - protein, 10 aa, Homo Sapiens
YTIHMGCHGY

SEQ ID NO: 37774 - protein, 10 aa, Homo Sapiens
YTYPENWRAF

SEQ ID NO: 37775 - protein, 10 aa, Homo Sapiens
YVFDGTNPPY

SEQ ID NO: 37776 - protein, 10 aa, Homo Sapiens
YVFEGKMLEA

SEQ ID NO: 37777 - protein, 10 aa, Homo Sapiens
YVHSFLSSGY

SEQ ID NO: 37778 - protein, 10 aa, Homo Sapiens
YVIEPHSMEF

SEQ ID NO: 37779 - protein, 10 aa, Homo Sapiens
YVNPANTHQF

SEQ ID NO: 37780 - protein, 11 aa, Homo Sapiens
AAYDEEIQHLY

SEQ ID NO: 37781 - protein, 11 aa, Homo Sapiens
CTIDEKRLAGY

SEQ ID NO: 37782 - protein, 11 aa, Homo Sapiens
CVINNQEMGFY

SEQ ID NO: 37783 - protein, 11 aa, Homo Sapiens
DAADKAAVVKF

SEQ ID NO: 37784 - protein, 11 aa, Homo Sapiens
DAASGSLLRAF

SEQ ID NO: 37785 - protein, 11 aa, Homo Sapiens
DAVKAKLISRM

SEQ ID NO: 37786 - protein, 11 aa, Homo Sapiens
DIINREKLLQY

SEQ ID NO: 37787 - protein, 11 aa, Homo Sapiens
DIPGEAMVKLY

SEQ ID NO: 37788 - protein, 11 aa, Homo Sapiens
DIPLFPVQTKY

SEQ ID NO: 37789 - protein, 11 aa, Homo Sapiens
DIQIKDAIGRY

SEQ ID NO: 37790 - protein, 11 aa, Homo Sapiens
DLLDWKYLGRY

SEQ ID NO: 37791 - protein, 11 aa, Homo Sapiens
DLPGMYPAHMY

SEQ ID NO: 37792 - protein, 11 aa, Homo Sapiens
DSFFGETSHNY

SEQ ID NO: 37793 - protein, 11 aa, Homo Sapiens
DSVDPHGFISY

SEQ ID NO: 37794 - protein, 11 aa, Homo Sapiens
DTATPDIKSHY

SEQ ID NO: 37795 - protein, 11 aa, Homo Sapiens
DTFGRPVIVAY

SEQ ID NO: 37796 - protein, 11 aa, Homo Sapiens
DTIDERAINKK

SEQ ID NO: 37797 - protein, 11 aa, Homo Sapiens
DTIDERTINKK

SEQ ID NO: 37798 - protein, 11 aa, Homo Sapiens
DTITETDLRNH

SEQ ID NO: 37799 - protein, 11 aa, Homo Sapiens
DTVDKIVVQKY

SEQ ID NO: 37800 - protein, 11 aa, Homo Sapiens
DTVTSAVMMQY

SEQ ID NO: 37801 - protein, 11 aa, Homo Sapiens
DTYDDRAYSSF

SEQ ID NO: 37802 - protein, 11 aa, Homo Sapiens
DVAALRGSRKF

SEQ ID NO: 37803 - protein, 11 aa, Homo Sapiens
DVAEGDLIEHF

SEQ ID NO: 37804 - protein, 11 aa, Homo Sapiens
DVAHSDLILHV

SEQ ID NO: 37805 - protein, 11 aa, Homo Sapiens
DVAPSTLLPSY

SEQ ID NO: 37806 - protein, 11 aa, Homo Sapiens
DVASGQVVRKF

SEQ ID NO: 37807 - protein, 11 aa, Homo Sapiens
DVASKGLGLVY

SEQ ID NO: 37808 - protein, 11 aa, Homo Sapiens
DVCSAQGVRGY

SEQ ID NO: 37809 - protein, 11 aa, Homo Sapiens
DVFPTKYGREF

SEQ ID NO: 37810 - protein, 11 aa, Homo Sapiens
DVFQQQTGGVY

SEQ ID NO: 37811 - protein, 11 aa, Homo Sapiens
DVFSEPRAIFY

SEQ ID NO: 37812 - protein, 11 aa, Homo Sapiens
DVIAEQSVSGY

SEQ ID NO: 37813 - protein, 11 aa, Homo Sapiens
DVIGVTKGKGY

SEQ ID NO: 37814 - protein, 11 aa, Homo Sapiens
DVMDSTTTQKY

SEQ ID NO: 37815 - protein, 11 aa, Homo Sapiens
DVPDGTLVTVM

SEQ ID NO: 37816 - protein, 11 aa, Homo Sapiens
DVPDGTVVTVM

SEQ ID NO: 37817 - protein, 11 aa, Homo Sapiens
DVVDSEALQVY

SEQ ID NO: 37818 - protein, 11 aa, Homo Sapiens
DVVGPEGMEKF

SEQ ID NO: 37819 - protein, 11 aa, Homo Sapiens
DVYGANLFHQY

SEQ ID NO: 37820 - protein, 11 aa, Homo Sapiens
EAAGSSLIGHL

SEQ ID NO: 37821 - protein, 11 aa, Homo Sapiens
EAAPEETRALY

SEQ ID NO: 37822 - protein, 11 aa, Homo Sapiens
EAAPGPRVLGF

SEQ ID NO: 37823 - protein, 11 aa, Homo Sapiens
EAAPGTIRGDF

SEQ ID NO: 37824 - protein, 11 aa, Homo Sapiens
EAFDELLASKY

SEQ ID NO: 37825 - protein, 11 aa, Homo Sapiens
EAICPEGIARL

SEQ ID NO: 37826 - protein, 11 aa, Homo Sapiens
EAIGIISKMMY

SEQ ID NO: 37827 - protein, 11 aa, Homo Sapiens
EAIGNEVTRLV

SEQ ID NO: 37828 - protein, 11 aa, Homo Sapiens
EAVDGHTVSIF

SEQ ID NO: 37829 - protein, 11 aa, Homo Sapiens
EIAPHFAVNHF

SEQ ID NO: 37830 - protein, 11 aa, Homo Sapiens
EIIDNIKGTEY

SEQ ID NO: 37831 - protein, 11 aa, Homo Sapiens
EIIGKRGIIGY

SEQ ID NO: 37832 - protein, 11 aa, Homo Sapiens
EIITADEVHYF

SEQ ID NO: 37833 - protein, 11 aa, Homo Sapiens
EIPAANLVNKY

SEQ ID NO: 37834 - protein, 11 aa, Homo Sapiens
EIYDRREYSRF

SEQ ID NO: 37835 - protein, 11 aa, Homo Sapiens
ELIGNLVGHLY

SEQ ID NO: 37836 - protein, 11 aa, Homo Sapiens
ELVDAFVEHRY

SEQ ID NO: 37837 - protein, 11 aa, Homo Sapiens
ELYPYGELGHY

SEQ ID NO: 37838 - protein, 11 aa, Homo Sapiens
ETADTLMGLRY

SEQ ID NO: 37839 - protein, 11 aa, Homo Sapiens
ETAMVTADSKY

SEQ ID NO: 37840 - protein, 11 aa, Homo Sapiens
ETANADIVTLL

SEQ ID NO: 37841 - protein, 11 aa, Homo Sapiens
ETAPAKLIVYL

SEQ ID NO: 37842 - protein, 11 aa, Homo Sapiens
ETCSIALVGKY

SEQ ID NO: 37843 - protein, 11 aa, Homo Sapiens
ETFGGFDSHQM

SEQ ID NO: 37844 - protein, 11 aa, Homo Sapiens
ETFGHLGALGF

SEQ ID NO: 37845 - protein, 11 aa, Homo Sapiens
ETFKEQGNAYY

SEQ ID NO: 37846 - protein, 11 aa, Homo Sapiens
ETFPANIQVVY

SEQ ID NO: 37847 - protein, 11 aa, Homo Sapiens
ETFPDAKGWIF

SEQ ID NO: 37848 - protein, 11 aa, Homo Sapiens
ETIDVHSGYDI

SEQ ID NO: 37849 - protein, 11 aa, Homo Sapiens
ETIGRDLHRQF

SEQ ID NO: 37850 - protein, 11 aa, Homo Sapiens
ETIGTGGFAKV

SEQ ID NO: 37851 - protein, 11 aa, Homo Sapiens
ETIHIRGGVFS

SEQ ID NO: 37852 - protein, 11 aa, Homo Sapiens
ETITQLNLSGY

SEQ ID NO: 37853 - protein, 11 aa, Homo Sapiens
ETIVLKEGSEY

SEQ ID NO: 37854 - protein, 11 aa, Homo Sapiens
ETLPEQLCVFY

SEQ ID NO: 37855 - protein, 11 aa, Homo Sapiens
ETMHTLLDYTY

SEQ ID NO: 37856 - protein, 11 aa, Homo Sapiens
ETSPAPIPNGF

SEQ ID NO: 37857 - protein, 11 aa, Homo Sapiens
ETTEESLRNYY

SEQ ID NO: 37858 - protein, 11 aa, Homo Sapiens
ETTSHLMGMFY

SEQ ID NO: 37859 - protein, 11 aa, Homo Sapiens
ETVDEIVKSGY

SEQ ID NO: 37860 - protein, 11 aa, Homo Sapiens
ETVDPASLWEY

SEQ ID NO: 37861 - protein, 11 aa, Homo Sapiens
ETVGEEDIRLF

SEQ ID NO: 37862 - protein, 11 aa, Homo Sapiens
ETVGTGIMGKM

SEQ ID NO: 37863 - protein, 11 aa, Homo Sapiens
ETVGTGIMGRM

SEQ ID NO: 37864 - protein, 11 aa, Homo Sapiens
EVADEKMLSGL

SEQ ID NO: 37865 - protein, 11 aa, Homo Sapiens
EVAPAKDVTLL

SEQ ID NO: 37866 - protein, 11 aa, Homo Sapiens
EVAPGYVVTVL

SEQ ID NO: 37867 - protein, 11 aa, Homo Sapiens
EVAPHHLFLSH

SEQ ID NO: 37868 - protein, 11 aa, Homo Sapiens
EVAPMLKAREY

SEQ ID NO: 37869 - protein, 11 aa, Homo Sapiens
EVASAKQSVKY

SEQ ID NO: 37870 - protein, 11 aa, Homo Sapiens
EVFDPSPQGKY

SEQ ID NO: 37871 - protein, 11 aa, Homo Sapiens
EVGGEALGRLL

SEQ ID NO: 37872 - protein, 11 aa, Homo Sapiens
EVIAHCGMHYF

SEQ ID NO: 37873 - protein, 11 aa, Homo Sapiens
EVIDEGWWRGY

SEQ ID NO: 37874 - protein, 11 aa, Homo Sapiens
EVIDFSHGLAM

SEQ ID NO: 37875 - protein, 11 aa, Homo Sapiens
EVIDVFEIMKA

SEQ ID NO: 37876 - protein, 11 aa, Homo Sapiens
EVIESTNLKYF

SEQ ID NO: 37877 - protein, 11 aa, Homo Sapiens
EVIGVLAQSKF

SEQ ID NO: 37878 - protein, 11 aa, Homo Sapiens
EVIPYTPAMQR

SEQ ID NO: 37879 - protein, 11 aa, Homo Sapiens
EVIRKGSITEY

SEQ ID NO: 37880 - protein, 11 aa, Homo Sapiens
EVISGEKVTFY

SEQ ID NO: 37881 - protein, 11 aa, Homo Sapiens
EVITDTGVVCH

SEQ ID NO: 37882 - protein, 11 aa, Homo Sapiens
EVIWSHAIQKY

SEQ ID NO: 37883 - protein, 11 aa, Homo Sapiens
EVKEDDGKGNF

SEQ ID NO: 37884 - protein, 11 aa, Homo Sapiens
EVKEDIGVGSY

SEQ ID NO: 37885 - protein, 11 aa, Homo Sapiens
EVLSECRLLAY

SEQ ID NO: 37886 - protein, 11 aa, Homo Sapiens
EVLTCLGIHLY

SEQ ID NO: 37887 - protein, 11 aa, Homo Sapiens
EVMDEFDGRSF

SEQ ID NO: 37888 - protein, 11 aa, Homo Sapiens
EVNDARRIGKY

SEQ ID NO: 37889 - protein, 11 aa, Homo Sapiens
EVNVAKSIAKF

SEQ ID NO: 37890 - protein, 11 aa, Homo Sapiens
EVPDDETVNQM

SEQ ID NO: 37891 - protein, 11 aa, Homo Sapiens
EVPDPNVVPHY

SEQ ID NO: 37892 - protein, 11 aa, Homo Sapiens
EVPHFHHELVY

SEQ ID NO: 37893 - protein, 11 aa, Homo Sapiens
EVPPPTVPMDY

SEQ ID NO: 37894 - protein, 11 aa, Homo Sapiens
EVPSWLENMAY

SEQ ID NO: 37895 - protein, 11 aa, Homo Sapiens
EVRQAMGMLAF

SEQ ID NO: 37896 - protein, 11 aa, Homo Sapiens
EVTDEDTVKRY

SEQ ID NO: 37897 - protein, 11 aa, Homo Sapiens
EVVDARLVSVF

SEQ ID NO: 37898 - protein, 11 aa, Homo Sapiens
EVVDGLEKAIY

SEQ ID NO: 37899 - protein, 11 aa, Homo Sapiens
EVVDLFRAYDA

SEQ ID NO: 37900 - protein, 11 aa, Homo Sapiens
EVVGNMAVSRY

SEQ ID NO: 37901 - protein, 11 aa, Homo Sapiens
EVVGPEGMEKF

SEQ ID NO: 37902 - protein, 11 aa, Homo Sapiens
EVVGVTGVVHM

SEQ ID NO: 37903 - protein, 11 aa, Homo Sapiens
EVVNKDVLDVY

SEQ ID NO: 37904 - protein, 11 aa, Homo Sapiens
EVVQKLKFGVY

SEQ ID NO: 37905 - protein, 11 aa, Homo Sapiens
EVVTEGLLNTY

SEQ ID NO: 37906 - protein, 11 aa, Homo Sapiens
EVVTGVIGQRM

SEQ ID NO: 37907 - protein, 11 aa, Homo Sapiens
EVVTHKTFHRY

SEQ ID NO: 37908 - protein, 11 aa, Homo Sapiens
EVYDHARRALY

SEQ ID NO: 37909 - protein, 11 aa, Homo Sapiens
EVYDQEVGTSY

SEQ ID NO: 37910 - protein, 11 aa, Homo Sapiens
EVYSADREDLY

SEQ ID NO: 37911 - protein, 11 aa, Homo Sapiens
FVADEELVHLL

SEQ ID NO: 37912 - protein, 11 aa, Homo Sapiens
FVAPATGAHNY

SEQ ID NO: 37913 - protein, 11 aa, Homo Sapiens
FVFDTIQSHQY

SEQ ID NO: 37914 - protein, 11 aa, Homo Sapiens
FVYDVTKMTSF

SEQ ID NO: 37915 - protein, 11 aa, Homo Sapiens
GFGQHGSVSGQ

(The sequence listing continues in the following parts.)

What is claimed is:

1. A method of identifying one or more selected candidate peptides capable of binding a class I major histocompatibility complex (MHC) molecule of a single human leukocyte antigen (HLA) allele, the method comprising:
   a. generating at least 100 models simulating occupancy for each of one or more candidate peptides on an HLA binding pocket, wherein the HLA binding pocket is in (i) a crystal structure of the MHC molecule of the single HLA allele or (ii) a crystal structure of a similar MHC molecule;
   b. extracting structural features indicative of occupancy from the at least 100 models of step (a); and
   c. providing the structural features extracted in step (b) to a machine learning algorithm, wherein the machine learning algorithm has been trained using a prior dataset comprising:
      peptide sequence features of one or more binding peptides on the HLA binding pocket,
      peptide sequence features of one or more non-binding peptides on the HLA binding pocket,
      structural features of one or more binding peptides on the HLA binding pocket, and
      structural features of one or more non-binding peptides on the HLA binding pocket,
   whereby the machine learning algorithm outputs selected candidate peptides for binding the MHC molecule of the single HLA allele
   thereby identifying one or more selected candidate peptides capable of binding the MHC molecule of the single HLA allele.

2. The method of claim 1,
   wherein the machine learning algorithm is trained with one or more peptides bound to MHC molecules in cell lines mono-allelic for the HLA allele; and/or
   wherein simulating occupancy is performed using one or more protein-peptide docking models and/or molecular dynamics simulation; and/or
   wherein the machine learning algorithm comprises one or more peptide encoding schemes.

3. The method of claim 2, wherein the one or more peptide encoding schemes comprise one-hot/dummy encoding, blosum62 encoding, or peptide: MHC binding energy covariance (PMBEC) encoding.

4. The method of claim 1, wherein each selected candidate peptide is predicted to bind one or more MHC molecules of one or more HLA alleles; and/or
   wherein the selected candidate peptides capable of binding the MHC molecule of the single HLA allele are 8, 9, 10, or 11 amino acids in length; and/or
   wherein the selected candidate peptides capable of binding the MHC molecule of the single HLA allele are any combination of peptides selected from the group consisting of 8, 9, 10, and 11 amino acids in length.

5. The method of claim 1, wherein each selected candidate peptide is predicted to bind one or more MHC molecules of one or more HLA alleles, and wherein the prediction is evaluated using metrics comprising area under a curve for a receiver operating characteristic curve and positive predictive value.

6. The method of claim 1, wherein the candidate peptides are selected from a subject and the MHC molecule of the single HLA allele is expressed in the subject.

7. The method of claim 6, wherein the subject is suffering from a disease or condition.

8. The method of claim 7, wherein the disease or condition is selected from the group consisting of cancer, an infection, an autoimmune disease, and a transplant.

9. The method of claim 8, wherein the peptides are identified by nucleic acid sequencing of a sample obtained from the subject, wherein the sample comprises tumor cells, infected cells, cells targeted by an autoimmune response, or cells to be transplanted.

10. The method of claim 8, wherein the disease is cancer and the peptides are neoantigens and/or novel unannotated open reading frames (nuORFs).

11. The method of claim 1, wherein the one or more binding peptides are selected from the group consisting of: A*01:01 (SEQ ID Nos: 44-1120); A*02:01 (SEQ ID Nos: 1121-4202); A*02:02 (SEQ ID Nos: 4203-7373); A*02:03 (SEQ ID Nos: 7374-9953); A*02:04 (SEQ ID Nos: 9954-11940); A*02:05 (SEQ ID Nos: 11941-14981); A*02:06 (SEQ ID Nos: 14982-17191); A*02:07 (SEQ ID Nos: 117192-20710); A*02:11 (SEQ ID Nos: 20711-22696); A*03:01 (SEQ ID Nos: 22697-24233); A*11:01 (SEQ ID Nos: 24234-27505); A*11:02 (SEQ ID Nos: 27506-29812); A*23:01 (SEQ ID Nos: 29813-32133); A*24:02 (SEQ ID Nos: 32134-34347); A*24:07 (SEQ ID Nos: 34348-35681); A*25:01 (SEQ ID Nos: 35682-36682); A*26:01 (SEQ ID Nos: 36683-37957); A*29:02 (SEQ ID Nos: 37958-38921); A*30:01 (SEQ ID Nos: 38922-40029); A*30:02 (SEQ ID Nos: 40030-42114); A*31:01 (SEQ ID Nos: 42115-42919); A*32:01 (SEQ ID Nos: 42920-44874); A*33:01 (SEQ ID Nos: 44875-46761); A*33:03 (SEQ ID Nos: 46762-49053); A*34:01 (SEQ ID Nos: 49054-50948); A*34:02 (SEQ ID Nos: 50949-53677); A*36:01 (SEQ ID Nos: 53678-55165); A*66:01 (SEQ ID Nos: 55166-56901); A*68:01 (SEQ ID Nos: 56902-58374); A*68:02 (SEQ ID Nos: 58375-59804); A*74:01 (SEQ ID Nos: 59805-61821); B*07:02 (SEQ ID Nos: 61822-63473); B*07:04 (SEQ ID Nos: 63474-64885); B*08:01 (SEQ ID Nos: 64886-65609); B*13:01 (SEQ ID Nos: 65610-69419); B*13:02 (SEQ ID Nos: 69420-71587); B*14:02 (SEQ ID Nos: 71588-72970); B*15:01 (SEQ ID Nos: 72971-76378); B*15:02 (SEQ ID Nos: 76379-77762); B*15:03 (SEQ ID Nos: 77763-80458); B*15:10 (SEQ ID Nos: 80459-81940); B*15:17 (SEQ ID Nos: 81941-83632); B*18:01 (SEQ ID Nos: 83633-85593); B*27.05 (SEQ ID Nos: 85594-87076); B*35:01 (SEQ ID Nos: 87077-87772); B*35:03 (SEQ ID Nos: 87773-89157); B*35:07 (SEQ ID Nos: 89158-90977); B*37:01 (SEQ ID Nos: 90978-92452); B*38:01 (SEQ ID Nos: 92453-94858); B*38:02 (SEQ ID Nos: 94859-97742); B*40:01 (SEQ ID Nos: 97743-100731); B*40:02 (SEQ ID Nos: 100732-104409); B*40:06 (SEQ ID Nos: 104410-106653); B*42:01 (SEQ ID Nos: 106612-019885); B*44:02 (SEQ ID Nos: 109886-110903); B*44:03 (SEQ ID Nos: 110904-111749); B*45:01 (SEQ ID Nos: 111750-113153); B*46:01 (SEQ ID Nos: 113154-114113); B*49:01 (SEQ ID Nos: 114114-117833); B*50:01 (SEQ ID Nos: 117834-118468); B*51:01 (SEQ ID Nos: 118469-119991); B*52:01 (SEQ ID Nos: 119992-121525); B*53:01 (SEQ ID Nos: 121526-123560); 54:01 (SEQ ID Nos: 123561-124684); B*55:01 (SEQ ID Nos: 124685-126136); B*55:02 (SEQ ID Nos: 126137-127557); B*56:01 (SEQ ID Nos: 127558-129239); B*57:01 (SEQ ID Nos: 129240-130274); B*57:03 (SEQ ID Nos: 130275-132636); B*58:01 (SEQ ID Nos: 132637-134577); B*58:02 (SEQ ID Nos: 134578-135530); C*01:02 (SEQ ID Nos: 135531-136878); C*02:02 (SEQ ID Nos: 136879-137802); C*03:02 (SEQ ID Nos: 137803-138984); C*03:03 (SEQ ID Nos: 138985-141074); C*03:04 (SEQ ID Nos: 141075-143394); C*04:01 (SEQ ID Nos: 143395-145236); C*04:03 (SEQ ID Nos: 145237-146269); C*05:01 (SEQ ID Nos: 146270-147708); C*06:02 (SEQ ID Nos: 147709-149028); C*07:01 (SEQ ID Nos: 149029-149822); C*07:02 (SEQ ID Nos: 149823-150900); C*07:04 (SEQ ID Nos: 150901-151615); C*08:01 (SEQ ID Nos: 151616-153388); C*08:02 (SEQ ID Nos: 153389-156499); C*12:02 (SEQ ID Nos: 156500-157889); C*12:03 (SEQ ID Nos: 157890-160043); C*14:02 (SEQ ID Nos: 160044-161408); C*14:03 (SEQ ID Nos: 161409-164186); C*15:02 (SEQ ID Nos: 164187-167475); C*16:01 (SEQ ID Nos: 167476-170317); C*17:01 (SEQ ID Nos: 170318-171281); G*01:01 (SEQ ID Nos: 171282-172073); G*01:03 (SEQ ID Nos: 172074-172742) and G*01:04 (SEQ ID Nos: 172743-173477).

12. The method of claim 1, wherein the structural features are selected from the group consisting of energies of attraction, energies of repulsion, energies of solvation, energies of side chain and backbone hydrogen bonds, energies of side chain and backbone conformations, Lennard-Jones attractive potential between atoms in different residue, Lennard-Jones repulsive potential between atoms in different residues, Lazaridis-Karplus solvation energy, Lennard-Jones repulsive potential between atoms in the same residue, coulombic electrostatic potential with a distance-dependent dielectric, proline ring closure energy and energy of psi angle of preceding residue, backbone-backbone hbonds close in primary sequence, backbone-backbone hbonds distant in primary sequences, sidechain-backbone hydrogen bond energy, sidechain-sidechain hydrogen bond energy, disulfide geometry potential, Ramachandran preferences, omega dihedral in the backbone, internal energy of sidechain rotamers as derived from Dunbrack's statistics, probability of amino acid at phi/psi, and reference energy for each amino acid.

13. The method of claim 1, wherein the prior dataset used to train the machine learning algorithm further comprises data selected from the group consisting of:
 amino acid physical properties, peptide physical properties, expression level of a source protein of each peptide, protein stability, protein translation rate, protein degradation rate, translational efficiencies from ribosomal profiling, protein cleavability, protein localization, motifs of host proteins that facilitate TAP transport, whether host protein is subject to autophagy, motifs that favor ribosomal stalling, protein features that favor nonsense-mediated mRNA decay (NMD), peptide cleavability, dummy peptide encoding, PCA peptide encoding, and Kidera peptide-level features.

14. The method of claim 1, wherein the machine learning algorithm comprises a neural network model.

15. The method of claim 14, wherein the neural network model comprises a single hidden layer neural network model and/or a convolutional neural network model.

16. A method of identifying one or more selected candidate peptides capable of binding a class I major histocompatibility complex (MHC) molecule of a single human leukocyte antigen (HLA) allele, the method comprising:
 a. generating at least 100 models simulating occupancy for each of one or more candidate peptides on an HLA binding pocket, wherein the HLA binding pocket is in (i) a crystal structure of the MHC molecule of the single HLA allele or (ii) a crystal structure of a similar MHC molecule;
 b. extracting structural features indicative of occupancy from the at least 100 models of step (a); and
 c. providing the structural features extracted in step (b) to a machine learning algorithm, wherein the machine learning algorithm has been trained using a prior dataset comprising (i) peptide sequence features of one or more binding peptides on the HLA binding pocket, peptide sequence features of one or more non-binding peptides on the HLA binding pocket, structural features of one or more binding peptides on the HLA binding pocket, and structural features of one or more non-binding peptides on the HLA binding pocket and (ii) non-structural features of the one or more binding peptides and non-structural features of the one or more non-binding peptides, whereby the machine learning algorithm outputs selected candidate peptides for binding the MHC molecule of the single HLA allele, thereby identifying one or more selected candidate peptides capable of binding the MHC molecule of the single HLA allele.

17. The method of claim 16, wherein the prior dataset used to train the machine learning algorithm further comprises data selected from the group consisting of: amino acid physical properties, peptide physical properties, expression level of the source protein of a peptide, protein stability, protein translation rate, protein degradation rate, translational efficiencies from ribosomal profiling, protein cleavability, protein localization, motifs of host proteins that facilitate TAP transport, whether host protein is subject to autophagy, motifs that favor ribosomal stalling, protein features that favor nonsense-mediated mRNA decay (NMD), peptide cleavability, dummy peptide encoding, PCA peptide encoding, and Kidera peptide-level features.

18. A method of identifying one or more selected candidate peptides capable of binding a class I major histocompatibility complex (MHC) molecule of a single human leukocyte antigen (HLA) allele, the method comprising:

a. generating at least 100 models simulating occupancy for each of one or more candidate peptides on an HLA binding pocket, wherein the HLA binding pocket is in (i) a crystal structure of the MHC molecule of the single HLA allele or (ii) a crystal structure of a similar MHC molecule, wherein the output models are generated by a peptide docking tool and comprise one or more protein-peptide docking models;

b. extracting structural features indicative of occupancy from the at least 100 models of step (a); and c. providing the structural features extracted in step (b) to a machine learning algorithm, wherein the machine learning algorithm has been trained using a prior dataset comprising (i) peptide sequence features of one or more binding peptides on the HLA binding pocket, peptide sequence features of one or more non-binding peptides on the HLA binding pocket, structural features of one or more binding peptides on the HLA binding pocket, and structural features of one or more non-binding peptides on the HLA binding pocket and (ii) non-structural features of the one or more binding peptides and non-structural features of the one or more non-binding peptides, whereby the machine learning algorithm outputs selected candidate peptides for binding the MHC molecule of the single HLA allele, thereby identifying one or more selected candidate peptides capable of binding the MHC molecule of the single HLA allele.

19. The method of claim 18, herein the peptide docking tool is selected from the group consisting of FlexPepDock, DockTope, pDOCK and HADDOCK.

* * * * *